United States Patent 9,328,346 (POLYCOMB-ASSOCIATED NON-CODING RNAS) - sequence listing, part 2

SEQ ID NO: 38 - RNA, 96299 nt, Mus musculus
acgggaagaccagaaaaggccagagaaggggggaaagguuacaaaguacaauuuucuaagcacgauacagccaugacagccaagaacucauagcagcuguguauacuagaauugggucuauggaagcugggcugucuaacaaucagucuggagagggggaaauucuugugacccuagcacagagucugcuggucuauuagaaaucagagauucugagagaggaaaacaugcuaucuaguuguaugccuacugcaaggccaggcucugauguuugguuccaaacucaggaugauacaaaugucccugauuaaacccauggaacacuaaacaaaaccaacacaucgaaaaagggaaagagaucuguaggagagaguuagcugggaggggaaucacauacauaggguccauauaugaaauuguaaaagaauacaauguacuaauaaauaaggagugccuacccucaucaaggugucacacaacccaugacauugauagcaagagcagaacacauggaagaagaggguaacguuucucucucuacuuuagcugugacaccugucuucuguccuuagauggcagagcuucucauucuggaacuuucuuacucagacugucucagugaucuccuauuuccaggccccucagaacugaggcuacauguacauuuaagcaacucucuuguuaugugaauaacauaauauugcugagaauauuauuuuggggugaaacuuuuuaauaaaugauauguucuuaauguuccuguucauauugcuaaagcugugugcuucuuauuauuuccugucacauaauguuauauuucugcucauaauguuauuuccuguccagacaccucuucugaacgugaagcucauauacugaaaggccaagcggauauuuacucucagauaagaagagaacaucggaaauuuaauucccaaagugaaugcuuagugucuuccaucucuccugagccaaagcuggucucauaggccauguucuguuacuccauaacuaaaucuuccaccuuuggguuacauacccaagaagcccaucucugugguuuuccccuuucccugaagcuuccugguaugugugugcacaugccuauauguauauguauauguauguguauguguauguguauguguauguguauguguauguguaugugugugugugugugugugugugugugugugugugugugugugugugacacacauucgaacaagcauaucucaaaccuaucuaacuuccuuaucucaacauucuucccuccuggagcccuauguuucccuucccucaggaaaacaaaaagaauuccacucuacuuccucuugcgucuggauuccauacuggagucacaguaagguuaaaacauagggaaggcaaggggagugcuuucuggaguacucugaugcuuggagugcuuccuuuucguucuuuucuccaaauauucuuggagggaccuggagucuccucggugucaggcagauugucccucaguucugacaguaugguuccuuggauccaagcccacucccaccaccuuuccuguucccccuguggaacacagaucaccccauccccuagccuggggcaacuaccucuggugacagccauuuuguccucagcugccucgacucaguccuuuuucagauugcccauacacaugcucacagugacucuguucuuuguccccacugguccaaaucggcaaccugccucgaaggugagugcuuagugcucugugggcuuuuccuaugugccuucuuaaugauacuuccuuggcucuccuuuaugcuccaaugaaacuguuagccuuggcuuuccugaaguuaaucaaaaucucauccacuauauggucuucuguaucacaagugucaguggguugggaaagaaggcuagcagguggauucugcccauugucuggcccuagagaccccaugaucaauuuaaaggcucuggacagaucuucaauaagacagccuuugcccaacacagggguuggaguuaugaaaucacuuaguagggcuaacacuaaguguaugaaaucaggacugugugagaaagcauuagaugguagaguuaugaaguaagaaagagccaagcugucagggcuuguugugaaucaagcucacugggugagauuucuuaggagcccaaagaagggcuacacgccuugaccuuuauaccagcagaaauuaauguuuaaccagaauacaaggcuaaaauguaaggacaaagaaaugggucaguucaaagcaucgaugagaguaaguugcccaagcaccaaguucacaguugugucgccaccuccucuucaguucgcagagcuggacaaucccgacaacagaguggaccugugaagaauccaaauuccaagcaaguaaguaguauauuuuguuggacacuaguugcugaaaaggcaccauuccuauugugacucuugggcuccacaauacugaaugugugcugaaaggacggcucucuugagaacagggauuguugauaacaaaaggcuuccucuuugcugaagucuuggcaaacuuuucgguucuauugcaguugcguaguugguugcacaugugugcguacauacaggcagggcgggaacacccaugcaguggugacacaugacuucagggagaaaguuuaguagcagauaaaggagacagggcuuccccuucacaagaccaugcgcaacaaaguggcauuagucgcuucauucccuaagccugcucaucugggaaauggcaguuuuaauagaaccuacuuugcaagguuccagugaaaauuaaauccgugcucaugcucccagaucugagaaaauccccucacagaacucugaccuaccuuagaaggacccuugccuggaagacgcucgggagaaggcugaggaagaaaagauggucacauuugaagaaaguuauuugaguaaucaacucaauaauuuuaguguauuacugaaauuaaaugacauuuuacuccuucaaggaacaguucguauaggaagcuauugaaaagaguccuuaaaaacugugauaaagaugcugguuaaagcguaacucuucacaguugacaaccucuggcaggugugugugugugugugugugugugugugugugugugugugugagagagagagagagacagagagagagagagagagagagagugugugugugugugugugugugugugcguguaaagacucagcuuucuuuaaaggacuggccaccgggauuuuggucuuucuccagugaguauaugggcaauacaagugggguuuuuguuuguuuacuugcuugcuuuaugggggagaggacaagggugggaagguggaccugugaggaaugagagggagugugauugggguguguguuugaaauucccaacuaaauaauaaaaauauuauguugggggaagcauauaauacaauucuauacacauagaaguucaaacaugcacaagagauauuaauacgauuauugggagaaauuaaaaauaugccacuagaccgaaaaauuccaacauaucuuuacuaaauaucacuguuucuguacucaugagggauggauccuguaacccugcaaaaaucaacacccaugaauuuuucaagugccuuuuuaaaaguggucuacuuagguugcaaagaugguucagugguuaagaggacugacugcucuuccaagaggucuugaguucaauuccuagcuacccuuugguggcucauaaucaucuuuaauuggguccaaugcucucuucuggugugucugaaggcagcuacagucugaagaugaacuauaguguauucauuucucucucucucucucccucucccucucucucucucucuuucagacaggguuucucuguauagcucuggcuguccuggaacucacucuguagaccaggcuggccucgaacucagaaauccaccuaccucugccucccaagugcugggauaaaagacgugcgccaccacugcccggccaguguauucauauacauaaaaaaaaaaaaaaaaaaucagcuggacgugguggcaaucuggaggcaaaggcaggcagauuucugaguuugaggccagccuggucuacaaagugagcuccaggacagccagggcuauacagagaaacccugucucaaaaaaaaaaaacaaaaaacaaaaaacaaaaaacaaaaacaaaaacaaaacaaaaaaucaauaaauauuuuuuuaaaguggccuguuuggcuuucaacagauagugcuucccauaccugugaaucaugucuagauauuauauaauacagugugaacaguuguuaguacucuauaguagccagaauuugcuauuuuguggguucuuuuucuucuacccuucuucacccuuuccccaccauuucagcucccgaauacuagacaagauagaaaaaaggauagaagggaaaggggcaaccauaggucaacauacuaccucuaacugauuagcuggguugagcuccuuggggaaaguuugaucuuugcccucaggauaucuaauuucuuccuguuguuucuucuuuguacaugaauaaacugugaacuaucaaaaccaaccaacaaacaacaaccuacccuaccagcagagcccuaacauguacauaccuucugaaaaguccccacaauuccaaaugucacacaauccuagaaacuaucugccgcuagcaaaaaucacacuucugcuuaaaacaggaagcaaaccuuagcugcugugaacaagcugauagccuauaucuaagauuaaaacaaaaacauauucuuauaauauuucuguguuauuuuaaagaaaccaaaauucuaaaauugccacuagacuugcuguugagguuugaucuuuugauaaguuuuguaaugauaaauacucgccuccaaggccugguugcuccugggaagcagagaauccacacgugcaaugugaccuugcucccuaacuuaaaacuauugguuaaauaauggugccgacaaccaauagcugggcagaagagacauaggcaggguuugggguuucugggcuuggggucugaggagaccacgaggagagaaaggaaguugaagagaggggagaugggguaagaauguaaaaauaauggccacaaggaguggguaauuggagcuacgagcagcccagacaaaacacaguaaaucauauagggggguuauugacaggaaaauaaacauaauagcauagaggauagacaucugcucagcucuagugcugauuaaggcuuguuauaaauuaaagacccggagugucguuuauucaagaacucaauacucaaagguggcuagaagcucccgauugacauuaaguguuuuucacaguacuauacuguucaggauaacggcaagaagaagcacgugcuugcucagugagauguaauauuaaaaacauuucugacacacagcaaauucacaguugaggauccucuacucauauaugggaccuugcaucuagcaaacagagcaucccugaaaucuaaccccuuuacaucauagucaaguauaagugaaagaaagaggaagagacugcggccccaauaucccauucauguuaucagugaccaagguucagguagauccaacccuuaagcuuccaccgccuccaaauaacaccauuuaugaugugggacuguggggggaauggggggggggggugucuggggcucgucccauguccucugggucacuccagauccaaacuaccugucagucaucacaucaacaguuuugaaaucucccagguugauucacuuaagcauuuauuauaagaagaagaacagaagaaaacccaauacugaauucccaguuauaauuaauagcaaaauguuaggagcauuccuuucaaugucaauaggaccagguuacuugcuaacugcuucuaaucaauauuguccuaaaguaaagguuuuucaauauucuuuaggaguaagaauuuucggggucaggugccugaguaaucugaaauuuuagguguucugguagccacaucuuaaaaaguaaaaaguguaucacuauuacaaaggagugaaaacaaagacuuuuuuucccuucuucauauauaauaguuuucaauuauaguucaauuauaguuuuacacuagcauuguuuuugacggggaaaggcuucaguuuauaaacaaucuauuuuagcuuguaaaauagauugagcaguuauuuguucaacagcaguggcugcugugugugagagccccacagccagauguaucugggucccccauaaagaccagaagaaagucaaauuggcacacucugagaagguaugacuguugaccuggaaauccaccuaaauuaauaaacaugauauuaaaacuuuaaagauaagugccaggacaaggguugcccuauaacaugcugacucaacccuaucuguuaaucauaaacaguuccuuucucugacuaccaaccacaaagacauauucacaugcccaugagaauccugaauuccaugucucacaaacgcuuguccuggaacauucuguagaccaggcuagccucaaacucugagauccuucugccuccacuugccaagugcugggauuaaagguguguuccaccacuacccagcuuuuuucuuauuuuaauuuuuauuuauuucaaaacugcucacccauaguuagcaagaugcuucucaaagcuucccucuaguuucuagcuucuguaguuugaaguacuaguaagaaaaaaaaaauccaaucugucuaucuuuuauggcuagcugaaaaagcaaaucguuuaggaaauccuucugcuccaauaucaugaaagucaugcgucuugguuucuuuuagaagcuugccccuacaggucagaauggagugaggagagaauccagcuuuguguccuuccaaguagagcacaguugugguggcaucuagcaccccacccguuccauuuuggucugcaaugugcaccugucaauuuuccacacuggggccuuuuuuuucaccccuucuggaaucuuuauucugcuuaaguacacacaaggcuauuugcacucccaugcucuuucgucucugaacuucacuggucuuucuugggcuucugcuuuuccauuucuauuucagagugaaacauguguuggauuuuuauuacaguggcgcugagucuguucaccuguuagagaagaauucaaguauuuauaacccuggcugauccuacuccaagcuggcuuauuuccauuuagucucaucuucccuugugucuccccagaacccggcagagcuuuugccggcucuuguuagauccguuccucuugguuugcuucuguuguaaacacugaucugucugcuucgauguuaugcaaaaacugugaguucccccucccaggcgcugaaaacagaucccgguacaagaucugggaccugcuggccugaccucaguggcuuucccugucaccccaugucuuucccuuucuaaucuuaaaaaaaaaaaaaaucuuacaucuauguauucucauucuugcccguccaaccugcaauuuacucccugagaaaugucaauaagaauuucuacacaugagccugagacacacccacacacuacuuuaaagcucagaaggcucacuuucaccaagcacgaucccccugugaugccuagguguccccaaccuuuucccaggcuaugccaucaccugccuuauuuuguugacugauuucuuuuuuuuuaauagaaucauucaggcuggcaagagggcucagcagguaagagcacugacugcucuuccaaagguccugaguccaaaucccagcaaccacaacuacauaguggcucacgaccaucuguaaugagaucugacucccucuucuggugugugucugaagacagcgacaguguacuuauuuauaauaauaaauaaaucuuuuaaaaaagaagaagaaaaaagaaacauuuuauauaauuuggagguaguacuuccguauaugucugcauugaauaguauuuaaauuagguuaaacaugccuauguccucaaaugucugucugcggcugugugaucuucaguaaguaccccaaucucucugagguguuauuuucccaucuguaaauuggugcuggagacuccuuuuccucauaagaauaugggcauauuguuucggcuucaugacagccuuccccaccucacugaggcuuucucuaguuuucuagguuaucuggaagguguguguguguguguguguguguguguguguguguguguauguguguguguguguugcaaggggagguguugucagccuccugcucauucaacaaggcucccuccccaaccccuggugauggucccaguugcuggggugcuccaucugugcagauagaccuaaucuccuuaccuccuccacugugcauauggcugcuguuugcaaugguaguggagggagcugccugugccugugcucugugcauucuacuguccuggaagccacuuccacugucucaaaggugccuuugaagagauccugcuggggccacaucauggagaauuccugacuuuggacuguacuccugacucaacucugaacaauguuguguguauauuauauaugcaucuguguuuguguauaugucaguauauguauaugccuggauacaugugcauuuuaugugugcauauacaugagcacagugacugcaugcauacauuuguguugauguauguacagacaugcauucacauuuguguguaccuguguguguguuuccugugugcgugugugugccuuucugcauaugugugcucuauguacaugaguguguucauuaucuguucauagguguguguccucugugcauggguggguaccuucuaugcaugugugugugcucucuacauguguuuauugacuauccaugugugugcucucugcauauggaugugucucuauuaauguguguguguacucugcaugugugugccaucuguuugugugugccccauguacacaaguguguacccucuaugcauaugugugugcuguuuguguguguauacuuuuuguacaugugucugcucucuuugcauguauguauacuauguucaugugugugugcacucuguacauggauaugacaucuauaaacguguggguacccucuaugcauaugugugcacucucuguuuauguguauauguuuucuguacauaaucugcucucucugcaugugugaauacucgguaugucuaugugugcuguacacauguguguguucauucucuauacaugugugcauucucuguacauaacacguuuucugucaguguuuguauguauucucugugcauguaugccucugguucugauagaggcuucugcaugguguugcuguuuaaagucagcccuucuuccacccuuccuucucuguauggccaaagccuuuguucuagauucaccugguaauguguacccuuucaaaagaaaacaaauuuagacccguaagccccacugauuagcagaaugcauggucugccuuuucucauuccuauccaguggguaaaaguguauagagcccaacaugguuuggauggugauuggccaaaggaaccaguauuguauuuugaaggaguugagugagauuuagguuuggcauucucagucccucacagccccuguaucagaauuccaguggauggaaucccugcggauggaugaagcagggccugagccaggauucgccccuagaaugaaaccuggguuuugaguugccaggagccauuaggagcccuggucuuuagucuggguuccacacagugacagggaacccaggacccacuucugggccucucuccaggccccauuguucccucugcucugcugggcuccauccuguggagcaggaggcauacagggagagggagccgaagcucuggguaaauaaugcagagaaagcugcugauuggcuucgggaggcggacacuuugucuacauaaauggcaaucgcauccucugugucuuuuaacugucaccaaggagagagagagagcaagagagcgaauagagaggaggcgacuccagcugccugugaguacaucucuuugucuacauggcucagggucagaccccagcacccacugcugguagacaacgacccuggggcuggagugggcgucugugguugauuuuggucaugaugucuuucuaaggauagagauacugcugguugagaaggcuaagcauccaacaugcacaggugacagggcugcuaagggaacuuccugagaaauucgguaccagucucugccugucuguuuugaguaauuucuauaggagugcagcagagaauuaggaacuucugauggcuuuuuaacccuugcuauuugaacuaucguggcaacauaaccaagugaguggacuggcuuucgggagacuccugcagcugugagauagaaagcaagaggcagcuuugggacugcacaccuaggugugccuuuacaggugacagaugacuaacagcauccucugacacauuguaguaaucucauuccuaaagggcugggcacacaauggauauucaguaucugggagcucuguuauaaacaagcaaggcagcuacaaguagaaaggugcacucuucccuccacauccucuuagcuccaguuuccaagguaacuuuagucaaaugaccuggguuuucuucuuaguuguuuuuuuuuuuuuuuuuuuuuuuuuuuuuucuucuucaaagacuuccaguucaguuccuuguacacaauuucuuguuaggaaacacuauguuucuccuccaaaaacaggaucaaaguaaaggugacaaucucaggaaagcuggccuccuuuagaacuuugaggggugccagagagaaacagacuuugcucuggcucaccgcaagcgcagucagagccugcaguauccuagaucaguguaucccaggacaaugaagaacuagcagggacagggaauuugaaugucugcagagaaauaagaccuugccaucucugacagcauccuuuucuuuucccuggacacauggugugugggccucuacacauggauuguacuaaugagauaaggaaauuuacauucuccuuuaaaacuucacauagccaaagaaguguccagggaucuaauucuguuuguuuuccucucuuggggcuguugauuaucgugaagacuucucccugaacuuuugcaaacucaucuucugucugguguuagguuugagaaaguguccaggaaaugauugcucauugguauuuuagaacagucuuaaguuucuuuucuuguuccuaggcauucuggcaggaaggcccucaggaggcacagauguaccucauaggcaaguagagcagguuuauagggaagguuaaaaucccacugacugaguggcaugaggugguaaggaaguagguuugccuuucugcugggacaggcccguguauauauaccacuuuugauauaugcaagcguaugcaagccaacuguugcuuccugucuacucucuuccuucugaagggagcucugcucugcggagcugaugugcaaauggagggaacagaggacagcaggcuagcccagccuguucccauggagaugcaccuaagguaguaggcagccuggugucuuaguccuccuccugaagcuacucuucuguccuccugugaguuaggaguggcagaaaccuaguggcaagggcuggaccacugcaacuguacucgggguugcagcuaacaucuccaucaguccuggcaggagagcuguugggguccaccugugccucucaggcuacagagacagggugggauacccaggucaagggcugauugcgaaaaggcuggcuucagaaggagagaagacugcgcccauccacacuugcuggcucugugacucgggucaucuguaauaauaauccuuaucucaccuuacacgguuagauaaguaagauacugugaauaccaugugcuuaacagaagguuaggaaauaccuauuuguuugguuucuuggacaauauaaugugacaaccaaaugucaauguauucucagaacugaauguggaagagucugaaauacaggguucuuagcaacacagugacagaccagcaacugugcugacgaauugagaagucaguguuuaccauugaccucauucuugagagaaaauugagacuaucagaagcggguaccaaagggcaccaaauaaacccacagugccaggugucaguguuugcaaagacaauaaaccaauaugagacuauuacggagaggcagucacuagaacacagacugagggggucucuagccuacaggaaaggcaagugaacugugagacuugguaaacuauuggcuaugcucugauuuuucagauaggcauauggagaaagucaaauacaaacagaaaaaaaaaaaaaaagaaaagaaaagugaucucucagucccaaauguuaucuuuuuuucuuuuaacgucacaaaugucaugauuuuuuuucuaguuuucuauagcuugggucacagcauggugauaugauuagaaauaguauuuccccaggagaacagagcugaaaaucauuacuuaaacucuauacacugucagccaagaaaauauuuagaugcuucaugguuacaaaagaggaaauaggaaggaaucaguggccccuuucucaucugcagaagggcaaggguagggagaacuggcacacugugagcauccugagcaucauuacaguucuguguggaguguggaguguggaacuguggguaucucacauguuggaaauggaguucaaaggacugugguuucuauacuuccaagcucauaugucccauuuuacuacaggacauggugguuauaggaagugagaccuugugggugcuuugcucuggaagaugggaaugcggugaacccucauuccuuucuccauggacacugcaagaagccaauagugugagccugggauaggcaccucgccugaaagccaaugugauuucagaauccuagcgccugcaacuuuauaaaaccauuguuugugggguguaagccaccugguuugccaugucuucugccguggcauaaaugggcuaaugugaaagacuggcuaugguuacaucucaacaagugcugucuaggcuucuuguuuuccuucguaaugaacguggccucuuaccaacgaaugugccucagaagccaguauauuauaugcccugggaggcauuugggcaucaugacugugccugaggcucaggggaugaucaggccucaaguucugaugccgcuuuaggacacuuuucuagcgguugucaggcaaugggcauuugcaacaucuguuaagaugcuuagagcucaugcuaguucagugguaguaggagccagagccugaauuccgcuaaaacgggaccuugcuaacaggguacucugguucaguggagugguucgguuauacuguuauugacaggugacaagacaucuaguggaagguccuuaggucacuaggaugucccugagaaggagaccgugggauccugaucuuuuuuuuucucuuucuuuccugccugaccaguggccagaaacacaugcuacccaaagauaaacccaaaucagacaugagcauacacuugagcucugagugcugucuccauauucccuggcucugacuuuuagaagaucuguaguuagugcaggcuacuucucaagacugaaaaggaaaugguggguaguuacagaccggcggcaggcuuuccacuugauaaagggaagcuugugaaccauagggcagaaaugcagcaagaucaugugagggaguggccucuacagccagaaaaaaaaaaaaaaaaaaaaaaaaaaaacccaugugcugcugcugcuguugcucagugaauuuccccucuuacuuaaaacacuaaaacacccaaauuugagucugguguagagcagacuagucugugguuuguaaacaugggaaguggaagcaggaagaauaggaguacaagaccauucugagccucaaucuagccugggaugcaggaggcaaagcagagagagaaaaggggagcagugggaaggggaggggaggggaggggaggggaggggaggggaggggaggggaggggaggggaggggaggauucucacaucccaccccccuccccugcacaauacuucccugcugccuaauaaaaguuuuuccugagugcgacugggcugcaggcacucagcauguagccucuuuucauccuaccgauggcacuccuggggguguuuucaugccuguuugccuuugcaaaaauugacaggaaaccuuagaaagguugaagguugaagucuccaugguaauugaagaugaacccuugaccuuggaucaccugacacuggcacauaccaagccccucuugagucaauuuugacuauuccugugcuucacaguuaacagugggggaaaaaacgcuggccagaaaauucauuuaaaagcauuucauuagccagcaucuucagagucuaaaaaggcuuaggggacuuuggaguuuguuguuguugagaugaaguuucagauagucuuucuucaaauuauuagcaauuucucauggcuagaaacauuucuuaugguuucggauggaagcauggaaaugugaaaugguaggcaggaccaugcauggguguuuggaacuucuccguccuucccucggcccacaagaccuuacacccugacacaugccacaguaggauguacaugucccuucagugaagcaggcuucagauccacaaccggaagucuucaccaaggucccacagaaguagaauuacuguacuaccucccauucgauuuguaagaauguaaguaggggccuagauuggacucuaggaaacuggcuauggcagaggaguccaagaagagaaauugcagagaguaaaaacuauagccugggcaugguuagaaugaucugaucacagagcagaugagggugugguugugggugucucuacaguagcuaugacucuaccagggaugugauaagcagcuuuuugagacaucauaaaagcacgguuggauccaauauacaauagagcagaaauaaaauauuuacaaggcugaacggauucauucauuuauuuauucacuuauucucgguuaccaaaggacaacaguggaacagaaagcuacaacaauaauaacuucauaacugaggguugauuggggguucuuaucuuccuaaagcccaugaguauagaacugugcugaccgucgcuccuaugauaaagcauccagggaggugccuggcuccccacacgagcaccaaccaugacagggguuccgugcaaaaucuaugcagugcagcugcugccgagacaaaucagguugugucaacagaaacccuuuuagggucuggagaaguguaggccguuggccuuaucaccgucuacaucuuccagcuaauauuugcccagcucggagccaugaauaucagacagcuccaaaaugagcgugagagucucuugaggcuuugcucuaaguaccuucugcaaaggcuucaguggaaaauaaucuucaaauaaaugacaggaggguuugaaaagaauaagcagguauuauguuacuguuugacuaggaauauuuccuuccauagugggcugcugcaugcuuauuuguuuuucccuggcacauccugcuuuguccauaaagcuguguuauucccaggagacagacaccacugcugggcugggaggcugagggccucucucagcuuuguagaacguucagauacuucagcuuccuauaaaaagggauugcaaaaaugguuacuuuuaaaggcauagaaaucacacgugagguucaaaucauaagggggaacuugugagauuuugacacauagaaauuaaaucuccugcaaaagcucuucauucugagucuuaaaagucagaauaaaaucaucccacauuaggucagacaaaaaugaggaaaacaucacaaaacauaaacaagcagauaugaggguagaaguuuuuuuguaauguguuaggauccuugcaauuaaauaaaaaacugccgguauuuaguggaagaugcagugaauaagcaauucauaaaugaagaaauccagacgugaaagcaacaucugagcacugguugauuucaauagucagagguaaaagagaaccauucaugcuuaggagacagguuaaguuuaaaauuaaccucugugacuguguagcacuccccaucaaaggagaagccugauaaaacagugugcucagagaaauuuagcaguauaauguaaaaacacuaaagccauauaucucuagaaaaauugguccuaaagaagugaucaaauguuuuccacuuuucggacuuuuucaguuuuuuuuuuuuagugugaaacaaaaaccugcagaacagguaagaggcuugcuuuagaguaauuaucaaaagcugcuagaauacuugccuguaauucauagggagcuacaguucaagaccuacagaggcucccugaagcuaagggcagaaauguacccuacgcauauguaccugggcggaagcuuauuucacaaguaagacacagaaagaaguuaacgauagcgaauaugcaacgggaaaguuauugcguuaguacaaggcuuacuuggacaaagaacugcuguguugggacgacuaacaggcagguaguauauacaggggagaaacacugaacuaaaggaugauuuauguacagggugacacagaacaggaaggcacagaugccauuaugcuauucagaugagugcacaacuuaaaaauugcaagcccuauauuuuccauucaacguuuuuggguugcagcugacugcaaguaacuuaacugaaaccucagaagaagaaaaccgagacaauggggagcuacucuaacugacaauucuuaguagcacuguccaaagcuauuccuaugcaucuauucaauacaauaaauugauaguggcgggacucucauuaccaaaacaaaaaucuugauuuuuuauuuucaguuaaggaaaacgaggguuaauaugguagcaauuugagaaguauguugguguauagccacuaaacaugagucagggucuguacgaauaggucaucuauugacccugaaccucagcucugcauuuugccgucccccccacccccgcccaccuuuucccacaaacagagcuggaaacagauaaugaugguaauacucagcaaaggaggggcaccgccugacuguagccaggucccagugcguauguaguaugucaucgugagaaggcacaggacagaaugcauuuaccaauaugguuucccucccgccuccuguugggcuguaauuuauagcuuaccuuauguaucaccauugucuccuaagcacucuuggcugaaaugugcacccaaaugguaacucugaaauggaggcugggucaucuuuaaaucaugccuguguguagucccuuuaguggagaacacuggaggaaggaaaaaccugaucagguacguuguccuuggauaccaacuaucuccuagcucaacauuagucagcuuaaacccaguuugacaaagaagcccugccugcaaagcggauauugcuagcaucuaaucacauguaucucaucucuuuccacccuugguaucuaucugauccagcuugcuacuucccaaccccgagacuaacuccuaugcucucagucauuuuucuuacucacuggguuuagugggugcuaucaucauugcccuugguuguuugguuagagugagagacaccuaggaaauugauaaggcacaugucuuggugcguaugggacaauauuaccagaaacucuuggaggguggucagugaacugacagaagaacuagcuuugcaucugagcagcaccaauagacugggucagaugaaucaaaaggccgaaggaggaaguuccacugcccugcccuagcagguaucuguuuuuugcugcuguccugacugguggacaucagacucuggcuucuuccgucucucaauaaauaccaacacccagugacucccugugguaccuccagggcuuugauuucugguugaccauugguggauccuguacggagacuuccgguuucuuggacuuaagugccaacuuguuucuaguccuccagcuugcugacagccauugugggaagaaacagccucugagcaugugagucaacccaaaaaaccgccuuuuguaguuagaaguauauguauauggugggcuucacuccuccggaaagcccugaguaaucccccuuuggcuacagcuccccaucugucccugguguuucaaaguugagggcaaacuuuuuuccccuaugcaguacucuugaauaaaaaucugucuucccauuuuaaaaaagugucugaugaaucauuuugaacgcauuuaacaucacaaaaucuguccagccccccucccaucccagacaauggggagcauggggcagugcugggaacaggacaugaaggucagcuccaaugcuaaucacaauggauuugacucauccccaguacuuacucugauggaaaauccaucuucaauuacaaagcucuggacuaagggagggauuuagaaauguauccuuuguuuagcuuucaauugucucucacaaauuuagcaacuauucaggaaagacauguuacaaauggggaggacaggauucuagcagguugucuaucuuucuuguuuugcaaauacauuugauuuuuaccaaacauaaguucgagacacucaguuucuccagcaugcuaacuuguaucugaauccucacuuaaggcucacuaugccuuccugaccaagcacagagccagggaacuccgugaaucaucagaagcucacaaucccucugcgguugaaccaggcgcuucucugccuuguguuuugagcucuugugauguaaauuaaggguccuuucgcccccuaaucuguuuugaccucaucuuuuauauuguuacuguuuuucuugugauuuuacuguuuaaaacgacucucgaagaaauguacugcaaaaagauuugucucaugaucugcagcccaaguaagccgcaguaagugccugguagaaaaaugacuguaugucagcuucacucagacuuuuggaauguugaagaagauaacgaacacaaacucuugauagcugccugugugucugacuuggguaauauaaagaaaguaccauccugauaagcagauuauaggcaaaggugcaggucaccaggagaugggauuccaggaaaagacauauaucucuagcuuuggacagagcugugcugucuuaggcucucggcugagccuccagagauugugguccuacccuuacccauucuucaggggcugccguggccgucuucauuucucagcugaaaaguggggcucgaagugcaaggcucucauucagauggcuaacaaaggguacauacaggcagaaugugggccagaaugggaaccaguauuugucauuaaagucggaaggauccauaacugugugcuucuugcauuuuacugugauauuuuuauuuuuaaaugagggugcuguucugucuucugcugacugucuugugagauguggaguggucauugugcagcacuguguggauccaguggcaugucuaucucauccagacauagaagguggcaagggaugcuggguuggggacugagggucuuuaugauauagaaucucugcucccuggacuugcucaccccccugcccaguucagaguuauaauguuuuauugguugauuucuauucucucugucggcaguuuucaacauggauucccgugaauuccggaggagaggcaaggagaugguggauuauauagcugacuaucuggauggcauugagggucguccaguguacccugauguggagccuggcuaucuucggccccugaucccugccacugccccccaggagccagaaacauacgaggacauaaucaaagacaucgagaagauaaucaugccagggguaagugaguauggauuugaggucaaauaacagcugggcuuaugccuauaaagcacccccugaaagcuguacuuccagugucauggggucaccacaacacguaagcuaaagagaaacuacuaaccucuguuuugcuuucagcggagacagcuuagguuuagagaaguuaggugguccaugaagcucucaugggagaguaaaggauagagccaaacuacauaggcagugcaagggcuuucuccaaggccuccaagaccaguauuugcaucaccauacaggguuccuagaggguuauucuuugauagcacgaaaaaauaagcuccuaguggucgauugcaagcaguuuaauuaauuacccuaaauaaagguacuugcaucguucuuagaucugccaaaggcuaacguucauguacccagaaaauguuugcuccauuuuguuugggcauggacaguugugcacagguucugccuaagggcacagaauagcugagcuaucccugauagucagagggaucaaaggguugcagugaaucucagugccccgucuccagaguacuacuuuacccagcaagcaauuuaccuaaaagccuauccuuuaacauggccuugaacaaaugggugugacccugaucauuaauuccugaacgaagucugggccuggugcugguaacacuggcggauugcacacaccccuacuggggcuuacuaguugugacuuuaaggugaccgaggaguaggcaggaggggaucugacagaguggacagucugcucuuguuuucacagagaacacagaggcucuggggaggcgcauagucagccaaaguccugggcuucagaggcagcuccucgguuccagaacaucucucauagcccucgucaaguuucaucuuaaggagauuucccauggcauuuguucuuugaauauaacucaaaauucuggcucuggcuugggaguugagcaaauaaacuaagccguucagcauaaagccaguacagggaggccuagucaaaugucaggccaaguaggaauacaggagcgcagugcuggaaaaaugugcgguccucccgcaggagucuguguucuauaggaguauuuacugugcagagcaaagcuggaaaaugcagaggcucuggcauuagcuccccaaguuacagauccagccagcccccugcuagcugugguuaaccagaaguuaggugaagagucugugcugugcagagccaguguagaacuauccaccccacacauucuguggcuauucacagagaggagagcaggggagugcgcuuuccagucaggauucacccugggagggcggcagacaguguggagccuccagguaccugaaagaaacugaggcccugggccccaucugugcccucuggcccucugccuuugugcagucuuuggccucuuccucuauggggcuuugcaauuacacuuuauaaaggcauuuccgcaaagacaagcgaguuaccacuacagauguuuugguuuuuaucugaacauucuuuuuuuuuucccuaaagccucaugggccucacuccugcucugcugaacacaucacucagcccgugaaguucuccagagccuccgagacucacugucagccccucccucccccucccuuccucccucccucccucccccuuuccuguucuucauuacccugauuuucuuccacucucacuuuuuuuucccccucuggcucugucccacucccaggccuggagacagacuugcaaugagccuugcuggaaucuuccagcuuuuaaugagcuauccuaguuggcuaucuucuuaaucggggcuugcucgugccacauaaaggccuagugugguuuuacugagaaaagacauguuuauaucuuugcaaagacuaugaaaaaaaaaaaaaaaaaagcaauguguuagucagcuuucugacccuguaacacagcuggaaugacaaacuuacauggggacaagguucauuuugacauguaguuuuggagguucagcugcaggacuccuuggucuuguugcuuuuagcugguugugagccaguacaucauggccgaagcacacagcagaggaaaucgacucacuucagggcuggaaagcauuggggggggggggggggcggggagcggggggggggcgggggaucgccaucacagccuccuuugagggcacaucagcaaaggccucuuaguaucucccacuagugccaccuuggggugugagccucaaacuuaaggagcuuuaggaauucuuaagagccacgccauagcaagauguuauaauaaagaauguagacguggcagcuucgacaugucucaaguuuguggagguuggguucagauaagggcuucuuaaguuacagagagcagcuuuguaccccacagugguagggagcuagcucuggucuccuccuccuccucccccaccaccacacuuaacgucuccccucuaauagcuccuucuaugccugacacccaaugcuccucacauccugcagaccccuacuuucaucuuuacuugaauguuuacauggagugauuugagcucgcagcuucuauaaugacaggaucuaggccccuccugcucucagggaucgucuuuccuuguacucuggcgaagaaugaaugcuucuuuuccaucucugcccgcaguucacuuugugaaaucucuuccccaggacaggcauauccuuuaaaaauauauauauauauauauaccagccuaagacugugccucaucacagaaauuuguacuuuguacagaggagaguuucugaguacauguuccuuacacuggaaaauauauccugauuucagagaucuuaaaacccucagaguuuugucuuauaaucacugaaaaagaaacauuuauuugacuagaaucuggaggagaaaagucagaaauagucucaccuggcuagcgaugcagaaagaaacauaguuucugguuuugggaaaucaggaguggaccauuuuuccagaaucuuuugaucagaaccauauaagcauucugaacuuuucagagagaaauguuuccuuagccugcuacaaaccaccacacagaagaucaacuuucaauauuucaaaaguggaauuuuuuauuuaaugaaauucggugguggggugggauuuguguucaaacuuuccaaauggauacaguccgugcccucuauaaauucuggaauuguuagucuaugaucagucucauaucuccuuauacgagcccaaaucccaucacaaagccccacucucaugaucuacguaccuugccaaagcccugucuccuaauacugccauuuggggcuggagauguuguuucaacuuacacauugcaagggaaagacugcucauguagccaauauuggucuguguguccuuaccacuauccugguucccaccaucuuagggauuccaaagaucaccaccuaugaggcucuuuucccugucagucugagcuuuuccacuguaccuaagucaggguuggcacggaguagguuguuuuccucuucugugcuagaggaagcaggggagauuguggcuauuaugagaaaccgagguagcaacagcucuucuuaaaggaacugauuguuagauggaccagauuguacaagacaguggaaagggacaauacccaaaaaaaaaaaaaaaaauuguuuuuaaaaauuggguauuaaaaaaaaaaccaaaauagacaaaagcaacugaauuugcuagggcagcuuugagaaaaccaagccuuuugcacuaggaucucgguuguguggugcagugcuuucccuguccagagaacccaggaagaacccaaagagguauugcugucgcuccuaccuagagacuucacguguuaugaaaaaaauauaauaauuccuacauuaucuucugaagacagcauuuccuucuugacuagcaaagauauugaagcacaaacaggaagucuguuuacuguaaugauaauggggugaaauucagacagaaaguauaggaugauugaacuugagaaacucugcccaaguugccuucuacagguaccuugaggaauucaccacuuuguccuagaguaacuguccuccuccccacaggugacacacuggcacagucccuauuucuucgcuuacuuccccacggcuagcucauacccagcuaugcuugcagacaugcuguguggugcuauuggcugcauugguuucuccugggugaguaucuccaagacacugugguggggucuauucuugcaugagacggugaucccuuugcacacaggacagaaacagguggcucugucaccuguagguagcagggcuacuuugcagaaagcagagcuugggucccagggaggaaguuucuaagggaagagaaauucugaguggaauaugggagagggaggaaggagaaggagaaagauagaggggagagggaggaaaggagaagaagcaaggagagaggaaaggaauggaggagaagggggaaggggagaggagaaaagggaaagaagagaagcgaaggaagagaagagaaggaagagaagagaagagaagagaagagaagagaagagaagagaagagaagagaagagaagagaagagaagagaaggaagagcagagcagagcagagcagagcagagcagagcagagcagagcagagcagagcagagcagagcagagcagagcagagcagagcagagaagagaagagaagagaagagaagagaagagaagagaagagaagagaagagaagagaagaggauucagcauaguacuguuuuuugguuucuauuuguuugguuuuguuuuuuuuuuuuuguuguuguuguuuuuaauaaccacuugauuugaaucaaaaucccaguucaagguugugaagcuuccauucccccaagaccagaagauugcuaugcacucugacuuuggagacgguuccuacccuugacucauucaucggccucccaccagccuacuguccagccuaucugaugggcaaggaggcagagcaaaagugcuaaaaauaggcccaugccugccuacaggcuacucaccccucccugugugagguccucuucuacauggaguaaagacuuagaaaguucccuacugaaggcaucuggccuaggucucccugagcucugugucccagcugugugcuucaggcaagauuugaagcagaugucauuggcucucagguucugagccugcucacuccaugaagaauuccucaaagccuagaacugucuugggcucucuagauagagagugagugucucucauauuugugccuuagauucuugugcuuaugaauucucagcagccaucagggcccagcugagcugacugcuuuaccacauggcaccugauuuucuuccagcugggauacugaggggcugggcuagugggagucacagcucaugggaagagcugagauggccuucuugcugaacuguugccauugcucuuaggucaggcacuuggggccuucuucuauagaccaagccuaggaugaguguauccuuuucuuucauuaaauguuguuguggcagguuucauuggugucauucugcugcuccaaaagccacugcauauauuugucuggagacccaaaaucaaccucugacuuaucugcuuuucuaggauggucuugguugaggaagagccugacacagagguuguguugcuugauagcugugguucauaacauggaauguuggcuccuauacugagaauuagcauuagcuuggcugcaguagcacccagcaggauggggauaaccaucuaaccagcagggggaaaguccucaguuccucuugucaucaaugugucauaauuccagaaugcacaagagcagccuggucaccauguugugccccuuagguaaagacccaaaauaaauggaggcucaagucacuuuugccuggaccugagaguacccagcuagcuacuuucugugugcaaugagaggagagaagccagacaccaaaucacuggggaauuaaaagacuacaugagaugaguggcuuaucugauguugccuagcagaagaaaguaggcaguaccuguuuucuuggcuccauccugcccuauaaaauuugcuccuggccauggaggagggucuucuaguagaccuuuuuauauuguucuguuauaugaucaagcacaccgagcacaagcaggcaggcauggugccaucccccuuacaccaaucuggaugaaugaaagaagcuauaucugagacugaguucaggcauuugaggcccaccugagauugaaagaguuuaaauuuggguuuuagccaggcauuggcccuaaacuccucaggaacugggcugcuguuucagcauuagcucuuaaagaaccauggcuguguauguggugggcuggggaagaugaugcauccagggaacgcucucagcuuauacccugugaccugucauggggagaugauacaauuggugggguaacucaaaaggggcccauagaggucuacccucauggaucccugauggaucucaucuggaaggagaugaggaagagagagaaaugucuuccuuguaaagcucugucaguguugucaggcccaggcucugcuuccaggccuccuggcagagccaaccccugaggcgcccugggaucucugggaaaugagaacauagcauugucucgauccauuuucagggggagaacaaaaugcuguagccugaauccuuuauaaacauuagaagucuacucgagggugugaagaacaugcuacuggcaucuggcagcaaggccugcugugugaucgcagcagagaauaugcagcgggcagcaggcaugcgugaaacagacaagaacuucuguucuuggagugaacuuccuuguuuccaucuaauccacucccgagacgacccacuuuccaucaguucacgagcaaggagccacacaggcuggcugacccguaaacucccccaccucuuaauauucucaucguggguucagguuucaacauaugaaugugggagacacacucaaaucccagaaaccaagggauuaauuccccaccaaggguggauuuggggggcaaaaaugugaacuuuuuguuaaauugaucaaauaaaaaccaccaaagaaacaaugcuuuccugugucacuccuuugugcggaggccagcugccuuguggcuuagcugcucacuuucucccccaacccccacugcaggcugcaagcccagcgugcacagagcuggagaccgugaugauggacuggcuggggaagaugcuggagcugccagaggccuuuuuggcuggaagagcuggggaagggggaggagugauccagguaaggcggggaaagcgggaaggcagacuuuugggaguaugggcuccacaaaggaccacagcugcaaacagaaagcggcgcccacguugcuuuuggccgugccuuuagguuucuuccagagaacaggaaagccggggaaguaugcucuuggagaguugauggaaucuggauuuagauccuggugcuguuucccaugagcacucaucuccacuggcucuucugguauauagaacuaaagcuaaagcauagguagauguuggcguacccauugcugaccuccaugucuaggcacuuuccagacacacugacuucucacugugaauuaggcacuccauuugacaaucaaggaaacugaggcccaaaacaacuaauaacauaccacucagcuucuugcuugggaguuacagaccuugugucuguguauucuagaaccuaaggucuugcggccaccacagaauccuaucuuuaccacaagugacagcuguggccaugcuucgauggcuguaugugcuacuuggcuguauguguuauuugucuguuugccaacagcuuaccuaaggcuucugcuaugucuaugcauacauuuaauucauucucuguauucaucaggaacaacuguagagcuuacaagagggcacacaacagaugcaaaugacagccguggugaauuuuccauuccaccaggaucuucagagugaaugauuggaauuuaugcuuuuuuuuuuuuuuuuuuuuuaagacaaggucugacuauguaguccuggccuggaacucacuauguggagcaggcuggccuugagcucugagguccaccugcucugccucccaaaugcugggauuaaaagaaugucccaucaugcccuggcaaaugugaaucuuuacaaaacauuuuguaacacagacaaugaacuccauuaacucagcagcccuccuuauguuguuuuucucaugucaaguucaugguuuuaacacugagaaaguauuacuaaccuuagaaucaagaaguuuguguguguguguguguguguguguguguguguguaacauauaguuuuuucagaagcucugauaagcagugauagcuccacauaucuuauggaugagagcacugaggcugacaaaagaaugccuuuguggaagaucacaugucugcuauggacaaaguaaacuaggaagcaagacccuugucuuguuguccugggacuauuuguuuuaacuucccauguauuuuaaccuccaauguauggucucuuucuuaagggugcuacaugcaacuuaguggcuuuaaauacauuucuuauccuaugguucugaaagucuggccuagguuuuagugaacuaaaaucaagacugucaucuuaaaagcccaaggggaaaauccauuucccccaccuccucaaguuuucuaaagccuucuggaauuccuuggccugcuacucccaucuccaccucccaaagcagcugcauuccaucucgcugaccuuucucucacugucauguucugacugcagaugugaaaucgggucuccacuuuuaaggacccaugugauaggauuggguccacuccgauaauccaagguaaucuuuccaagucaagguucuuaauguaaucacauuagcaaaguccccuuuccccugaaagguaaacagucucugucugggaaagaggccuggcaucuuggugaugggagaugcagcgcguguugcaugcagucugcagaagcucccagagaggauuuguucucaauggcuuccuagccucugccccuagagagccaagcucagcagggcuccagugggccugagaauguaauucuuguucauucuaaugcauuagagugggcaagccagcagucccuguggcucaaaccauucuuuuuuaaagucuuugaauaugucccuuugucauaacuaggucacuguaaguagggaagcugauaaaaaugaacuacuagaguuagggaggcugagagucaccuguaauaccaacaguugagaggaggaagcaggaggaucggggguucauggccguccuuggugaauucacgccaaauaauucugggucaugccucugaagacggaucugcuggcuucuuuaucccugaauggcugcagacucucucuggacacucugacuugauuguccuuguuaaggacgacaagcaugccccugggacgauaagcaugcaccaggguuaagguuaggguuaggguuaggccauuagacccuauuaaauaaauaaauaaauaaauaaauaaauaaauaaauacauacauacauacauacauacauacauacauaaauaaauauuaccauauggauuuuauacuauaacauacuaguacacacauacacauguauguaauaaguaaguguacacauaugcuguaccauaacugaaguaugaauggauacuaugaaccagacuucucaaaaugacagcuggaauguucucgggaagucccaguauaauuucacagaacuucuuuuuucuuuucaaagguuguguggcauggucagacuuccuuggguaauguuacaaaaaggcauggcacagaugcuguucuggcuugaaaaggggcugcagcacacguccccaaaauacacagucagagauguuucuucuaggugaagcgcugguggcuuuccagguguugacgcuggaauccugauuuuccaggggcaugcuugucguccuuaacaaggacaaucaagucagaguguccagagagagucugcagccauucagagcuacagaauccagcagaucugucuucagaggcauggcccagaauuaugguuuauuuauuucugggcaaguaucucacucuucagaguaggccugacucuagagcagauuuuuuacuauaacuccacaucuuggcugagauuuuagcuuuguuaaacccugcuaccucaugaacaauacagcuuucuaucuaccuugggauauuuccucuuuucuauguuagugaggaggccauuucaacccuuuucaggggcuugaguuuccauagacucaguaccauuuucuuaagcucucucucuaagcucgcucucucucucucucucucucucucucucucugaauagcuucuuuucccccccucuuuucagucauuuucuccucuauauuuucggugaauugcucaugguuuucuguguaucacuguaauuuuccacauugccaauuuacuaucucccaugucaauuuugauuacacuuucuuacuuuuaaaaaugauugugcccucuguauuuauggauaaugggcacucacuguaaaaugggaaaaugcaguaacuauuuuagagcauaauucucucuagucuuagucuaguaucucuguaugugugguuacauaaauugagaugauucaauacauauauacaauguuuucuuauauuuucacuguuuaaauacuuuaauuucuuuuuuuuuuuuuuuugguuuuagaccaggcuggccucgaacucagaaauccuccugccucugccucccgagugcugggauuaaaggcgugugccaccacgcccggcaauacuuuaauuucuuacuacuauuacugcuguguguguacacgguaggugugcacggauacucaugccaugacucucacagggaggucacuuugugaagugagcucuuucuuuauaccuucuugugggucaccagacuuaaaggauaaucucucuuccuauucagccaucucacuggcccucggcuguuuuaaacuuuuucuuaauuuauuuuuucaguuaguaaacaaagcaacgggcuucaucauagcacuuucacacacacaugugaaauguuuuucacaaauauuuuauucuuaucuaccuucuuucuccagcgcucucccucacacuucuuguuacucuguauugguccuccccgugccccgucuuguccaaauauuuuuuugagaauauuauugcuguacaauuuuuaggauguacuacaauuuauguaaauaacacauaaaauauucaugccauauuacacuuuucaguccugugaguaagaauucagaggacagccuuuaggacaagaggcaacugucuuccaucagcuuccuccccauggcacauaagugcgccaccaagaccagaauagcaccacaggagagagcacuuuugggucgcuugucauacggugaaaacaauuucauuuucgagucuuuauauccaaagacgaaucuucuaguuuugguacuucucaaagaauuuuacaaguaacaaaauuuauugaauaacuauuacaaaaccgacuguguucuagccuauuuauugugcuuuauauaaucaauuuucauccucaaaauacuuaugaggauuaguugcauuaucaaccuuaguuuucauagcaaagagauugaggcucagacaaguucaguggcagaaacuaaaggcaguguguaaagccgguguuaaguauuaucaccagcuugcccaggcucucugcgugggauagagucuggagguuugaaugcuaccauuggguuaaaccaccuuuucagcgaagacaaucucauuuugagaagucccagccuuagguuaggacuaauucuggcaucucucagcccaggcuucaacaaagcccuggugagcucaacccacuuaguuuggguuaguagaaagcagacuuccuuguguuuacugcagggagcuggcuggcccuuuucagcucaugaggcugauugacuguaauuugugaggccuuaaagagcacugagcccagugacagcccgcaaggcagucugccuuaucgauccccucagagcuguaaucacagcuuagcauccgcgcagcagugggugucugagcccaacggcacaccaucauugugaggccggacaaaugagaccugcaaaaugggucucuuaauuggguuugaaagcucuuguagaagaaaagcugccaauuucuuacccugugugaggugacauuuguaaaaccuagaagaugaaaggaccuuucggcucagggcaucagcagcccugagcaucgacucuccaaaaggucccucccaccucagagcaggcucgccauggcaaccuuugucugccugaagcaaaggcauuggcgagccacacaaagacguggggguaaaccgguuccagguaaacgaaggagcaagugugugggcuuagcucgguugcagcucggggcuguucaacccccaaguuucucaguuucucagccacgaagcacaauaaucagcgugggcucuucaccucucucucucucucucucucucucucucucucccucccucccucccucccucccucccucccucccucccucccucccucucucucucucucucucucacacacacacacacacacacacacacacacacacacacacacacacacaacuuucuugguauaaaagaaagaaauuucugucagaauauggagagcacccuucaaguccauaaugagcuacucagaauaauaaagguguccagggcuccgaagagagggcagacagagucucacuauuuagcccuagcuguucuggaacucgcuauguagaucaggcuggccucaaacguugagaucagccuaacucuguccccuucugagugcagggauuaaaagugugugcuacuacaaccacaauccacguuuuguuuuguuuuguuuuguuuuguuuuuugagacaggguuacugugugaaacagagcccuggcuguccugaucuuacuuuguagaccagguaggccucgaacucacagagauucuccugccucugccucugccuccgccuccgccucugccuccugagugcuaggauuaaagacauguaccaccacaccaugcucccacaaucuacuuuuuguuuguuuguuuguuuuguuuuguuuuguuuuguuuuuuguuuuuuugagacaggguuucucuguauagcccuggcugucuuggaacucacuuuguagaccuggcuggucucgaacucagaaauccgccugccucugccucccaagugcugggauuaaaggcauguaccaccacgcccggccacaaucuacuucuuaauagacagaccuugaaaaacagaauguggccagagugucugaaauaagcaagccaggagagaaaaacaaugggaugcacaggggaagugggagacgcagcgucuguuuucacagacuugaauuuccugaaauggcugccagucuugucggccuucuuuaacguggucugaaacuaugcaggacgacuguuggaaguacagcccagaaggaaaugugugagucacucagaugcugagugaagaccauggucuguuuaucugaauucaugcauuacagcuacagaaauaggaauauguguaccuagcuugaaagcucaccccacuccucagggaguaggacuugauucaaaaaaaaaaagguaaaagcaguagaugggaaaaaucaaagugggagauugugauugaugaagggggcaaaauauuaauaagaaaaauuuucaccucuacacaauucacuguauauuuaucuggaaaacuucaugucuuaaaaacuuucagagucagcaaaaaucugauggguuuuuccugagacuugucucccagcgaagcugagcgcaaaugcuaggaaguaccaagaaaaaccagacggagccucauuuuuuuuuuuuuuuagauguauuuauuuauuauauguaaguacacuguagcugucuucagacacuccagaagagggaaucagaucuuguuacggaugguugugagccaccaugugguugcugggauuugaacuccagaccuucggaagagcagucaggugcccuuacccacuaagccaucucaccagccccggagccucauuuuuaaccauacccaagucuuacugcaaaucuggugggauguuacagaggcccaucugaagaugaaagacauuaaaaaaaauaggauucuuuuacaaauuauaugggauaagugauacagugggcucugaacccauuucuuuacucucaaguucaaaagaugaaucacauucaauauuucuccacuuugcugaagcauacuguugggauuucuugcacugguucaccaggccugcuauaacaaagaacggagcaaaaaugacugaaacagcauauuuguugcucccgagucccccaugaaggcugaaggccaagaccaaggugucagcaggauugcuuuuccugagguuuaaucuugaguugcucacuucugccuucucaaagucucaccucuauguaugucaugucugcugccuaauuccuuauucucaggacaccauucagauugguuuugggucuaccuuaaagauuuaauuauuacuuaaagguccccuuugucucuccuccccuccuuacugcuuccuaauauucuugcuucuuaccuucuuuucuuauguguauuuugagaccuucucaaacuguagcccuaacuggcuuaguacacguuauauacccaaguuggcccugaacucacaguuauccuuagcacuaagacuacaagcauguaguguaaaacgguguuuggcuuaaaagguccuauuucuauaaaguguaggacauucugagaugcugaggucuagggauucaguauguggauugcagggagggagggaaggagcacaguucagcccauuacauuaaggacugggagaaacuuuccaagucaaccucugcgugucaaggaaaaugcauuccuauguuauaagcaaauacaaauuguucuguccacaugcauaggaacacagagcagggauugggcagguugcccuggaucagucucuuccucugauggaaguggagacaguaugucccagacggcuuaaggaacccaugagagaacaccugcagagucuuguauaugcuacaggaucagagugcuagcucacugggacauaauauggauaaaacaaugucaaacuaauuacaagagcuaaaccagccccugcagaugugagaugcaaaaaugagugaauuuugcaauuucuggcucaacuuuuaaaggaaacuauggacauaaauaauaugucuuccaaaaguuuagacugggacuucuuugcaacauuucaaauuucauuuggccuuuuucucuuggauucagggaagugccagugaagccaccuugguggcccuacuggcugcucggacuaaaguuauccgccagcugcaggcagccuccccagaguucacacaagcugcuaucauggaaaagcugguugcuuacacaucugaucaggugagugugcuggugugggcauuggcccaacacccgacagcccccaccucccacccccauccuccaccgcagagcugaauccaaggaacaguuagcaucacgucaaauccaaaagcugguccuucgggaucacaaggcagagaaacuccucagucuaucgugggagcuugauagaucuagucagaaauaaaauacacauacugagagccuccgcaacuggcuggaaaccauuucuguaguguggaacugcucagugccccuguggccugccuuuaaggcuccacuguggaaaaauuggaagggagacucaacccaaugccaaauccuagcuuuguaaaucauguacauucucaaagccuacuuuuuuuuuuuuuccaaaagggauaaaaaaaaaacaucaugccugcugugagcacucagcccagccuguggcuugagaggacugacuucgaguucacuauaaugcucauaaaacccuacaaauagaagaaaauaaaaauuuaguacuuuuagcucacuuauuguauuuacuugacuuuuugaucgaucgacuguuucuaucguuucuuuuucuuuauuuuaucuuguuaguuuuuuuuuuuuuuuuuuuuuuuuuuuugaaggguagguggggucagggguugaaauggguuuucucuguguagcccuggcuguccuggaacuuucuagaccaagcuggccucaaacucagagaucugccuaccucugccucugaagcgcugggauuaaaggagugugaugccaccauccaguauauucuuuuaucccucagcccuguucgucuccuuuggugugcaaauugcuauauccuugaaucuacauguauucaaaaucacacaagugaaugaaaaacuuaaucgauguagaaccgauacucacucuggcaguauuugauucguuagacuggaaagcaagguucuaggauggaaacaaguccaggaaaggagugcuuucaaaaaggaggaggggaagauaucaauucuaccaccuucuuggggcaucaagagcccaaaacaagugcucuguagaaccugugacucagauuccauucgugacuuacuacucacucuuguugcaggcgcauuccucuguagaaagagcuggguuaauugguggaauaaagcuaaaagcagucccuucggauggcaacuuuuccaugagagcuucugcccuucgggaagcccuggagcgggacaaggcagcuggccugauuccauucuuuguaaguucaaugcucaauggagauggcacugugggguccucugggucuugucugggccuaggguagaguuugagggguguguguucugggaagagguagucacugucuucucuuguagugacuugaaugagaaaugucccccauuagugcuaguuaggcauuugaccacuuggucccuagguguuggcacuauuuggggagcuuaaggugguacagccuuucacuaggagugagcuuugaggggaaaaaaaaaaguccuacaccauuuucaauucacucuuucaucacacucagaacucaggaugugaauucuuaccuuccugccccuccugcaaagcccguugccugcugucaugcagccccugccauuuaggacaccaaccuucugcaacaggaagucagauacacucuuccuucuuugucuuggucacgccaacagaaaaguaacuaagauucuccucuccaaaugaugccucaaaacuuauagucacacaggcagcccuggucaaaaucagugggucacaugacaaaacaaaaugacuguaagaaagacuuguaaagaggaaggugagaugucaaggguagaaaggagauaggagggaauggggugugagaguaaccagaaugguuauaauguguaugaaaaugacaaggaauaaaauuauaguuuuaaaaagaauaacugcaggcuuuccugcccggguuuguugcucuuagcagaugcuaagaagguugguucauuugugugaggcuuaugagcaagcaauaaauuuucccuccaagguaaaaauaucuaacaagccaaauggcaugcaggcucuuuugugucuagauaugcauucuagugggggaugcaccuggagucugggaauugucauguuucugacauagccacagcaguauguucugccugggacuaauaugucauguuugaagcaauuagagugucaugacuguggcucuguggauauucugucuggcuacacaguauuacccaagggagcuuuaggaaugcggacucugggccccuuuccuguagaauuuuggaagccugaccacugguagaaccaggcacauuaaauagcaagagucuagugugcaucuggguuugaaaaagauguuuuaaaaaaaucucuuuuaaccuuuuuauuuuucaguguuggggauggaacccagggcucacaggaggagccuuaacaccuuguguaggauaccugcauccaaaccuuucuaguaguaguaguaguaguaguaguaguaguaguaguaguaguaguaguaguauugguggugguaaacuuauaggauaacaacuuuccauguggauuuuaaaaacacuccccaaagccuggucuacaaagugaguuccaggauagccagggcuacacagagaaacccugucucaaaaaaacaaaacaaaaacaaacaaacaaacaaacaaacaaaacaaaaaacaaacccaaccacuccccagugucaaguuaucccucccaucccucccucagcuccugcuuuacccacacacccuuucucuccccaccauggaauucuuccuguuccauuauucuauccaccuuugcagcacauguauucuacuauccucucauucuuaagauccuuauuucucccucucuccuuuaguggucccuuucuaccauucuagcuucaagguaaacacaaaaaucuaaagauggcagcuaugguccacauagggaugauuaaaugugguguuagucguucugggucugaguuaucugacugcauccacuugacugcaaauuuuguuuuucauuaaaguggaauaaaauucuaucguguguauaaaccacaucuucauuguccaugugauagcaaauagauagcuuauuuuauuuccucgcuauugugaauagagcagccaugaacauggaugagcaguuaucucuguguguguguguguguaugaauauauauucucuuuaaauacaauacuauauauuauauauguauacauaaaacuauauauuauauuuguauauauaacaaauauauauucucuauauagaagacuauauuauauauauauauauacauauauauauauauauauauauauauauauaagaauauacaucuguguauauauaagacucugcagcuauaauaggcuauagcuacaguccuuuggguauauguccuagaaugauauagcuaggucacaagggaauucuccucguuuuagaguaagcuucacacugauuuccaugguggcugcaccagucuguacuccaaucaacagugaguguuccuauuuucucacucccucaaaagcaucuauggucauuuguuuucuugaucuuggccauugugacuggguuaagguaaaauaccaauguaguuuuaauuugcauuucccugguggcuaaggauauuucuuggacauuuguaucucuucauuugagaacucucuguucaguguucagcccacuuuuaauagguuguguuuucuugauaauuggguuuuuuagucccuuuuauauucuagacacugguccucugucagaugcauagcuggcaaggacuuucucauauucucuaugcugccccuucacucggguuccaguggagcauggaaucuuuuuaauuucaugcuugccggcuugucgacuguuggcuguguuuccuguacaucugagucuauauccugaacugugccucucauuguccccucuagauauuuuggguacagcauugagaucuucggugcauugaaaaucgaucuuuuuggaaggucuaaaguaagaauaaaauuugcuagauaagacgguacucguagccaucugauuuuuggcaaagauuacaaagauaaaaccuacccuggagaaaagaccacaucuucaacaaauggugcuggaauacccagaagucucaguucuugaugaggguggcuugcgguuaggaaaugcucuauuuuucucuagcccuuuauguuuaucuaagaacaccccagguaagcaguucaugacuugcucuuuuuaauuuuuuuuuuaagauuuaguuuuaaacccacuguaacaauuguuacccaaguuuuccauuuacacccaagcuaauugcucauaauuuuaaauguuaucuaccaucuagguauuuauuuucuguuuggcccacuucuuauauuuuuuuucuuauacuugauuuuuuuaaagucgguuuuauauuuuuccaccauccucauuuuaucuuguuauuuuuuuuauuacagguccccaacaccuuuuguguaauuauuucauuuaaaucuacauguauuuaaagucuacuagguauugcaauguuacaagagcaacauaagucuagacaacucuacaauaucuguuucauuaacauucacuuuauauauauauauauauauauauauauauauauuucuuauuuucuucuaugugaaaauauuuagaauuuaucuuagugaauagacaggguggucugcuaguuuuauuucuaugagaauaucuuuauuuuccguuuacuuuggaaagacauuuuccagaccuaaagacagaaaggugcuuuuguuuuuuuguuugcuuguuuguuuguuuuuaagauuuucauuuuauuuugcauuuugcuuaauauggucucagcaucauuugcuuguagugucccuggaggccaaggucaucuguuccagaugguugugagucuucuugugggugguaggaaucaaaccccagagcucuaggagaauggucauugcucuuaaagauguagccaucucucaagcccccgcuuguuuuauauuuugagcucgcaguucaagugcaaugcaucaagaguaaugacugcaugcacacucaaguucagauuggcuucuccacguuuggcagcucagauguccuuugagggguauggucuugccuacaauuacagugaguuagcacaaucaagacaaccccccacaggcauucccagaagcccaucuugcaggugauuccagauccuaucaaguugaagaucaacacuaaauaucacagcugagcauaaaugcuaagggggaagcagauaccuguucaccgacuuuccucuaugauuucuggugagaugucaguugucaguguuguuguuugcauugagauaaugaggaaagugacuuucuucuucccaauugcuuacaguauuugucuuuccucuuuacuuuugggcaguuucaccaugacacaaagguuuuuguuguuguuguuguuguuuugguuuuuuuguuuuguuuuuguuguuguuguuguuuucgagacaagguuucucuguauagcccuggcuguacuggaacucacuuuguagaccaggcuggccuugaacucagaaauccgccugccucugccucccaauuguugggauuaaaggugugcgccaccacgccuggcugacacaguuuuuuauacuuacucuauuuccaauccaugggaauaagguggaaucuaauaucagucuugggaaauacccauugucuuuuucucguaguuuaguucaaucuguuuccucuccccuuucuuucuggggcuaugguuacaugcaguuacaucuuucuacugaaugucagggaccucauagacucaucuccaugcuuugugucuuuaaaaacgaaauauauaguucagucugaccuacccauauuuuuccaauguucucuuuagcuugccuaguuaacucaugaaaacugucauuuuaauuauaaauauuaaauuuuuaacuuuuaacuuugaaacaauuguggguucauuaaaauuugcaggggcuggagaacuggcacauugauuaagaacauguacugcucuuguagaagacacaaguuuaguucccaacaccugugucagguggcucauagcugcuuauaacuccaggaaaaucgaauggcucuggccucugugaguaccugcacucauaugcacauacccauacacagacacaagcacauuauuuaaaauaauaaaagaaaaaauuucuuaagauuacaaaauuaaaacaaaggcauccuagacacuuccacuuucacacccaaguguuaggguauguaauguuaggaccaggaaauuggcacuggcuuacugugcuuguacaguccugucuuuauaguuaucgaauccucuaacuacccucugaguuaaaacgcugaaauguuuuggaugaaaugaaaggauccacuuuucugcugcuccuuccuuuaaucucaccuugucucccauuauccucacaaucuguucuguguucuaaguuuccguugauacuggggauguuaugcaaaugggucauauaguccaugaaaagcucagaaggacaucuuuucacucacuuuugugccuuuaccaucugucuagguccuuucagcugcucuaccacagauuugauaccaagcuguguagcucacuacuuguucauccaccaccuagugagaaauacuuuaguugcucccauuuuccacccaugcacagacagcaucugugaacauuaaugcacagauauuugauuagagaaguacuuccauuucuuugggauacuuuuuauaagaaauuaauagacugccuugucgucccacuauucuuauucuauucauuuauucuugguuguaguucuauggauagggguauaauaacaucuccuagggacauaauaaucacuucucuggugacuaacaauguuaaauaucuuuucauguggauauucgccauccacacguuuuuaguaaaaugugaaauuauuuuuuaagugugugcacguguaugugugcgugagcaggugccuucaaaguccagaagaagguacuggauuccuuuagagcuacaguuaguuacaaguggcugugagcugccccaugaugguuccuagaaacugaaauuggagccucugcaaaaacaguaugugcucuuagauacuggccaucuuuccagcuccuguguugauucuuaauuuuuuaaaaaauuuuaaauauauuguuuuuaugaauucacugaggauuuuguacaaugcauuuugauaauauucaccccaauuccucucccuaauuauuuucggaaauuacucacgucucccuacccacucacaagccugugucuguuuauauuauuauuauuuuauuauuauuauuauuuuaaauaacccacugagucuguuuugcauuguccagauacucauggggguaagaccguccaguggagcacaguugacauauuaggggccgcacucuuaaggaaagccgacucuccucccccggcagucaucagugucaacccuggguugauuuuuuuuuuuuuuuuuuuuuuuuuuuguaacagauugauuuuguuagagcaguuuuagguugcugccuugacagaauaccuaacagaaauaauucaaggaggaaggaauuauucuggcuccugguuuaaggaacacaggcuaucaaauggcagcaggggcuguuuggagggcaguuggaaugugaggcagcuguuaaaucacauuagcagucaaaaaccagagagcugaggcuagaagggagccagccaggaacccauaaggccugccccacaaugacccacuuccccuagcuaggccccaugucccaaauagccugccaccuucuaaagccaccccgccaucugcgugaguguugaaauacaugagccugugagggacauuccacauucaagucacagggcaggcucgcagauuaaaaaauagaacagaaaguuuccaugcugacuugcauguuucccagaugucuucucacaggcuguagccuguuguucuagucucugaauuugggucuuuugucuuuggugagacagauaucuaauuuuagugagguacaauuuauccauuccuuccacagaccagaccuuugguguuacacauaaaaguuuauuagccaguacaacguaaaaagaccuuucccuccuuggaguagugcuaaauacuauuaagacacaacacaacacaacacaacacuaucaguguuaacaaaacagucuuuaaguacucuuuguuaugucccuuuucucauaaucaaacaugcagaagaauggcccaauuugauucccuaauuagcaguguuagauucucucuugcugccuuagcugcaacagaauugucaaaucaaaaagucaacuccccuuaugccagugccaaccauugagaacaauuaguucacagacacccugagaaaacuaaagacugccauaguugauugccccaacuaacugaagaauauagcuucagucaggcagugcuguuugaaacaguccaugccagccuauuugcucucccaggcuuccuuccauaaacuauaucucuauaacucuguuaccauuuccacguaggacaaaacgaaaccaccacacuggccuagcaaagaaacugcucugacuggugguaaagagacaagguugugauugauccaaaaacaggucucagugggugauuggugcuaagaagcaaggucguauugcuucaaaacaaauggcaguuucugccuuaaugccucuucucggguuguacucuccggcuucccagcucacuaagucuaucagccucgaugcuuuguacugugcugccuucccugguguggccacauuaggccuaagaaagggcucucuccagugggcuuuccuuuuaguagugaggcugagcaacagaaagagcagagcugccaggauggccaaggcggccgaguggcagaggcagcgacagcugagcaaguuggcaggcugggcggugagggaggcaaggcagcugcuugacagcggaagaagaaucggaugaacggucugagagcugcuagggugggacacgaaggacugaagaagagagacaauuuuagugaggugcaauuuauccauuucuuccacagaucagaccuuugguguuacacauaaaaguuuauuagccauuacagugcaaaggaccuuucccuccucggaguggugcuaaacacuauuaaaacaaaacaaaacagaaaacaacgcucucaguguuaaugaaacagucuuuaaguacucuuugugauguagugggcagcugagaccaaaaaagaagaaaagggcauaaggugucagaaaagaaaaacugcaggcccugcuugccagaggaauuccagaggacugucaggucguuaggaccaagggucucagaggccccggggcuagcauggaaacacuggccagagugugggguucaggaaucccaacuuccuuggcuacacaagauuugugacacugguggcugucaagagcugagaaauccuuauacuccugcugcccacaaacuucaacccuaauuacaagcaagggcugaaaaaugccagcuuucuagguuuacacaagagcuguagcacguacagggcucagagucccaauaugcaaggcaugcaugaagacuguaacacuagaagguaccaccugcugcugcucccaccugcucgcugccaucacucaaggcugcaaaacaccgagggaaacaaaggggcccacaauuugaagguugucuccuuggcuacacauuauuucuguauaaacagaacaaaaggacuccagccaacugauucaacaccaugaccagauagauuuuccucaguguuacauuuuaggcgcuuuguaguuuccuacgguauacuuaaaucuauaaucuauuuucagccgagucuugugaaaggagugaaauauguuuagaguccuuugagggugugcauaugugagucuugugaugggccauuguuccagaauggucuguugaaagacuauacuuccuucauuaaacaaccauuucuccuccuuuagccacugccuggcuuacauguagaccuauuucuggaccauuggucuguuguuguuuuuuuccuguuucuuucuuuguuucuuuuuaaagauuuauuuguuuuauguauauaaguacacugucccugucuucagacacaccagaagggggcaucagauuccauuacagaugguugugagccaguaugugguuucugggaauugaacucaggaacucuggaagaacagucagugcucugaacugcugagccaucucuccagcccugucuugcuguuucuaagaccaugcugucuugguuauuucagauucauuuguuauuauuuaccacgagacucauggcuaauaucaaguugagaacguuuuguauaauccuguuugcccagagguaacuuugcuucagaucauauaugaugauacauuuuuaaaagauuuauuaauuauauguaaguacacuguagcugucuucagacacaccagaagagggcgucagaucucauuacagaugguugugagccaccacgugguugcuggggaguaaaggguuuauuuaacuuacacagcccaguuacaguccaucacggaggaagucaagggcagggcuggagagauggcucagugguuaagaucucuggcuguucuuccugagcaacugguucaauucccagaacccaccucaggcagaucacaggaaaccugacacccccucuggucucugacacacacauauccacauaucuauguguaauuaaaaguaaaaaaauaaaaaagccuucaaaaaaaaauggcucugugccuaugaaaggaagucagggaaggagcucaagucagacacuuggaggcagggagugaagcaaaggccacgagcaguccuccuuccuggcucauucccaugguuugcucaguuuucuuaaacaauccagaccaucugcccagagguaguauuucccacagugagcuuagcccucucacaucacacauuaaucaagaaaaugcccucacagacuugcuuacaggccaauuugauggaggccuuuucucaguugagguucccuauucccacaggacacucccuugugucaaguugacaaaaaacuaaccagcacccucucaaguuuccugcauuacuguguucaguuuaauuuuuuuuguaaugaaauguuuacauucaauauauacauugggcuuguggaaaaugugcagaaaugagagguuugugagcacaguuguuucucacuauccacaggauauuguuuccaggaggccuguggaugcucaagagccuuagaagaaagcccauggcauuugcauauaaccuugguaccuuccuacauacuuuaaguauuucuaauuucuaaaacaauguccacacaucauauuauuaaaggauucagcacaugguacucuaugcccagcagauuaaaguggguucacuggaaguuucuggaauuuuccccuaauauuuuaaaguuuucacuuuuaauugaaaauagaguuauuuuuguaugauauauucaaaucacagcuucccaucucucaucuccacccaaauccuccaccucuccacccugccaauuccacacauucuuuuuuucugucucaagaaaacaaacaggcaaauaaaaaaagacaagaaagaauaaaaugaaaugaacaaacuaacaaguaagaaagaaagaccauaagaaaugcacacacacacacacucagaacacacacacauacaacacauaacacacucaucuaccuuaaaaacacaaaaucacaagccauaauauaaaaacaagaggccaguaagacuuaaaaaaaaaaaguccaaacaaagcaguauuagacaaaaaaccaaaacaaaacaaaaccaaaaagaaagaacgaacaaacgaaagaaagaaaagagaaacaaagacagaucacaaaaauuguauacauacacauacacacauucacauacagaccacacacauagucacacacauaccacacacaccacuacaccacacacacaccccuaccuuaaaaacacaaaaucagcugggcaugguggcgcaugccuuuaauuccaacacuugggaguucgaggccagccuggucuacagagugaguuccaagacagaucuauacagagaaaaccugucuugaaaaaccaaaccaaacaaacaaacaaacaaacaaaaacacaaaaucagaagccguauacaagcaaaaagaccaguaaggcuuaaaaaaaaaaaaaaaaaaguccaaacaaagcaauaggagaaaaaaacccaaaaaaacaaaaacaaaaaaaacccuccaaaaauaccuuugaguucauuuuuauuugccaucugcuguuaggcauggggccugcccugaaguguguuucauauauucagugagacuccuuuggagaaacuaauuuuuccuuugcaagcaauuuuuuaaguggagauagaucuuuggccagagaugggagccaccccuccaucucagcucuggcaucuugucugguuuggaucugugcagaccgugugcgugcugcugcggucuccaucgguucauguguguaucaguccuguuuugucuggaagacacuguuccuuugguaucguucaaccccccuggcuccuacaaucuuuuugccuccucugccauauaguucccugagcccugagggcaggaauuugaugaauaccucccuuuuaggacugagcagucucuuauucucuucacacugucccauuaugggucugugcauuaguucccaucuacuacaggaggaggcuucucuaaugaugguugagcaagacagugaucuaugaguauagcagaaugucauuaagagucguuuuauugcuccauuccuauagcugaacaguaguguucaguuuuccccuaagucuguggucucagauucuuggccacccaagcagugucaaaaguggguucuaucuuguggagagugaauuuuuccuaguauuuugauuugagguuguuggaacccaaccuaaaaucaaaccucauauacagagggucaacuguauucaugugcucaacugaagaaauuggcugaggggaaacgcaggaacauuaagugaacacugcacagcucauucaaauaaaguccuguauuuauucaggaggggagagagaaacacuauuccauuuuuugaauucugcuuuaaagacccaaauugcaaaaaaauauauuagaggauacuguugcuguuuugcagacagaaaccacagauaucaccagucugaugcguuggcauaaagagaaaggucacaguucauucaugcauucauacauuuaacaaaugcuugugucucaguguaccuuguaccaacucugaggauaucugaccagucacagucuauuuccucuuggaaugguuucuugcaguaaagauacagauaugccuagucuuugcaccauuucaugauaacuacauuuacagaugaaaguagaagaugcaaucagcuuugaagaggaucaauaauaaugccuguugcuaagcaacucuauacuagagguuggacaggcagggacucauggugccuugcauuuuugauuagagaauaaggacugauaacauucgucaggguuaaaaaacacagccuuuuuggaacaguacaaaugguuuguuauuucaacaugcagcuugggacuauccaacugggauacacccuccugccccagauggggaagggguaguagcuaggccuugucuuaguuuucuaaugcuucuuaguggucauaaguauuuggugugugcauguguaauggccacaugcgcccuccugggauaaggguguguagccuucacuauaccucaagaauuucaggcuucucgagcuggagacccacccccaagaauaagaggcauacuuggcagaguuugagcaagaaagcugacucuguccuuccagggacuagcuugaguuuuaugauaaaguuuuuaucuuucuauuuucuucaugauaguuggcuucuccaauaagccaacuuaauaacaucagcaaagggcaaugccugcgaggcauauaugugaggagaaagggcuggugggguucggacaacaggggaggaggucacacaggcucugucaccagcaggaaggcugcaggcucucaagauagaggcuugcucugccuccugcccccuccugcuacacaaaugugauuagggcucugcagagcacacugaaaucagguuaguggcacugagugaugcugagcugggguaaucagagccuggagcagagcaggugcuagcuuuaauauggcuucugagaaugaggacaagcugacuuguagcuccacagcacguggacaggccauuagaacacugcccgugcagcccacuucacuguccuuccuuccugcccuccaaagguguagcuauugguaucgcuguuauucugucccugccugugugcucuuggacaauaagauacucuggcaccuuccucaaguuaaguaugaagcagggauuguaagccuaucuaaggucauugugaugaggucuccagaaacagccagcaaucggcccuacaccaacaaagcacuaaaaccagccacucauuuuuagucuccaucaaggcuccuugcagaacgaggcagaaagcuauuguuuaugcacaguuguuucgagcucauuacaaagaaaucaauaauugcuugcaaauuuaagaaucaacguuuauguuugaccacaagcucaucucaggcgauaagcaguaaucauauuuggcagacgucccccucuaaacucugugcacucaguaauagauaacagcugauuuuaacaagcaaauguuuaacauguaugaauuuagcagcagaaauuguuguucuuaggccaauuaguguuuagaggagaaaaugagauggagcgaaacgauugcugcacugcagauauaucauuucuaagagacacaaaauggagacaauaaugcaguauuaauauuucaggccaaacuguguuuacugagacugcaucauuuuaccccgaauaacacaaaguguuuuaagagucauaugaugaaucaacccaguuagccggauaccuaaagcaaugcauuuuaauauucaguuaaauaucaggaucaaauuacagauaccagagaaaaaucaccgaggcccugaggcccacgacaugacucaucuugugcaaaugaggcaaguguggaaaauguugaugcaugaagugaaaaaacugauugagauauaggggaacccgaggcuccagggaaaccuggagccugagagucuggaagcccacugguaccucucguaccaggauuaucuugguaugucucccaaggcaauacaacugagcuucacaucuaaggcuuuuauauucuccucucucucucucucucucucucucucucucucucucucucucucucccucacaaacacacacacacacacacacacacacacacacacacacacacacacuuguuuuuuguucuuaugagacagggucuucuuuuuuugaaaauauauuacauuuauuuauugugcccuggaaaucaaagccaggucaucaggcugguggcaagaggcuuuaugugcugagccuucuugccugcccugagaugcucuuccuacauagucuaaacugacauaguccaaaccugagguccagcugccuucacuccugagagcuacaagggcagacccaugucaccucuccugguccucauugucuacuuuucugauguucugacaucguugggcgaagaugucccaagagggcuuaccuauuaugaaucaagacuagguggcaaauccaccacucauaugccucugugagauucucgugucagggggcugucucccugacauauuuaccuuggaaccagccagguaccaaaucauuacaggcagucuaagccacuaaaguuacccaaaggugccaagaaccucccacaaacacagacuucuagauaagcagcaggacucuggcagucaggugagauacccacagaugccagguuaccuggaaagagagcuaugaucucacugggaggucgguuugccuuucagggcaaacuauagguggucaucuguaaaaggaagccagaaaggccuggagauaugaauuuggguccugcaguguagucaacauuauuggagagggggacuugacacaagggugaaaacauuguucaaagagugugguguagcaccacuucuggggagacuugaacaaucacgcacccuuggcauuuggcaugcacuugacauaaggguguaugaaauuacauguuuccaucaagccugaggagaacacucacuauccuaacagcaugaucucugcgaacccguuuucauaaacaagauuguuuuucugaucaccuggugucagcucagcaaauacauuucugcaacagcuccauguccaacaaagugcaaauuacagagcaaggacauugaagcacacaccugagcaauguucuggugugucuuaacugacccuaccgguggcucuccgagaacuauucuacucacgcuugcauacaucuuaugugaccucagugcauguccucucuggugugcuugcucuguguuuuauacacauucaccgccaccaccaccaaacuggggagggcuggggggucuaaauucuuuauucuauggaaacuauguucuuagugccgacagauacagcugacaaaggaauauauauaguauaggaauaacuacccaugugacugaauuaccucuuuuugacccaaagcaccguacucuggaaaucuuuuguaaguccaguaugggcgaccauccaugaaaaccagcaguuccuagccucacagcucagagcucagauuuguguauauuuaugguguguguauguguguaacuauuucugaggagacuugaacacgaauguacccaccccagagugggaacacaugacagauuaaagcaagaccaccaucaaaguccaauauagugaacccaugaguuuuacugaguaaguauacuacucacaagaauaugggugagggguugguuacaggaauagaaauuacucaaggcaacuguaucaccaaagccucccccagcuuaaaugacagcuggaauccuggugcauagggaaagcaauaggcuggaguguccuuuucagguaguucguuggucugagccucuuccuggcagcucaucuugucugagaguucucuuagaaguccuuucuguuuauauaugcguggagauggaggagccuauugaaucuggccaguuuuaaggacuuccugaagcaauugaguuguuuacuuccugagcuuaaagagcuugucugcagggugauauguuugacuucgccuuagaacuuccugugucuuaaggagcaucccuccaagauggauaguuuuaucuuggagaaaauugcugcacagcagcguguguguguguguguguguguguguguguguguguguguguguguagaccacaggaagacauuggugucuguauuguguucucuaccauacauuuaaaaaaaaaauuacacacacagacacacacacccacacacacauuauggguaugaguguuuggcuuguauuuauguauguguaccauguuugugccugcuacccacggaggugagaaggaagcauuggaucccugaaauuggaguuauugacagucuugagcagccaugugaacucugggaagcaaaucugggucuucuaugagagcauuaaguggucuuagcugcuaagccaucucuccagcccuucuacuacucuuuuaggcaggaucucucacugaaccugaagcucacuguuuuggcuaaaccaauugaccagaaagucccuagcauccaccagugucugccccucccgugcugggugacaagcuugugacaccgugccuggguuuuauguaggugcuggggaugugaacucaggugcuuuugauuucacagaaagcacucugacccagugggccaucuccccaggccacaguucagacuucuguucauagguuucuucucuuuaucccguucgguaucaaacgauuaaacacacauucauggguuuccaucuccauguaaacauucauuagcauuguaccugggcuaaccacuggcugcguuacaacaacagcaacaugggaaauaaaaggguuguuuguuuuuuaccuccuagguggucgcuacacuggggaccacauccugcuguucuuuugacaaucuccuggaagugggucccaucuguaaguaucuaauucacucuucuuuuugaaaaguauucuugacauggaguggaaaacaaaacaaaaacaaaaacaaagcugggcggugggggcgcacgccuuuaaucccagcacuugggaggcagaggcaggcggauuucugaguucgaggccagccuggucuacagagugaguuccaggacagccagggcuacacagagaaacccugucucaaaaaaccaaaaaaaaaaaaaaaaaaaaaaaaaaaaccaaaaaacuaaaaacaagacauggaguggggaguuuauccaaccuuucacuuugagggauguucaucaucaauaauucuaaccaucaugauuggcauaucucguguuauauuuacaacaauguaaccccauuggcuuaaauucacaaacucagaguuugaguuaacuaaacaacggcuaagcuuaacaacaccaauauauuaugaaagggagaaaguguccaagcacuuugugcuaauauaauguuuaggauaugguggccauauuaaggaaacuaagcucuucaacauuuggaacaacuacccccacuugaagguccuguugcaugcgugacauacacacagcaugaauuguuugugcuugaauccagucuuuagucacacccacuuuaaaguaucuuuguuuuuuuaaaagaaaauaaauuacuguaagccagaaaauguugaugcaugucuuuaaucccagcacuugaaaagcagaggcaggcggauuucugaguuugaggucagccuggucuacagagugagucccaggacagucagaguuguguuucaaaagaaacaaaggaaagauagacaggcauaauuuauugugcugugcuaugcagugugacauuuucagugaggguaaacaccaguuagaaugccauguguuacuucugagauguguacaagcaaaacaaagcuuucccaaugacugccuuguggaaugauaaauuucucagacaugcccaucaguaaggagcacauagcuguucauauugauuuagcaaaucaaugcuuucaagcuaaacuucuacaaagaacacucaguuucagauaauuuccugggccucaugcuugccuccuuccucccuagaugaggacauuuugucuuucucaucgagacuagaauucuguuuuagcugcaaaaugaagaaaugccuguguuuccaaaguuucaccuuugaugcgagcucugggaacucagcaggccuuggaacuguuucuaaggcaccaaggauauaucagcccaugaaacucacccuucucuguuccucagggauguaaaggcucggguggagcugucccuagcaagcucucugaccucagcccuucgacuugugccagacaucacgccaccugcuuggcauuuggcuucauugucacuucgugugggccaagcacguuucccaccucuccuaaccccugauuuacuuguggucucuucuucggaaagacuucuucucccuugggucauuguucccuggccagcaggagacaaugguggaugugggggcuggccaugaccuuaagcggcagggaagcuuagagcuuacagcugcaugucuuaaauucugaccuucauuuuccccuaucaaaaaauuggaaagaaaaacgguucucauaaugguaaaacaguauuuccuucacagugcagcucaggggaguucuugcagacaauaggcuguaggaaaggcauguacugcguguaguacaugcuuguacugccaggaccgugaggcuaaucaccaaccgugagaagugggguggacacagccuugccauucacucaggauuuggcuccaccuguuaugagcuauggcacagcugugauuauuacuggcuaacggcagccacacacagcaggcugagaacacacugaacuagcuggccauccgcaguauggcuguacugugggccucguuagcugcagaccuucacaagcucagccaagcaagucgaaguccucugacucagaugucaggccaaggacugaauguccuggccaacagccggcugaugucauuccccagggcuaucagauuuaaagcaccgaagucuucugccagauagagacuacacggcugcuaucccugaacucaaucuggcuccccacaggagcaggaagaugacagccagcagguggccccugccauuaaugcucacagugcuggaugagcacagcucaggcugcccugcuguccugcagcucccucuggcaggcgguucgggugcugugggcagagcccgauaugcacuuugcaguuugaguucaaacccagggauugcucuuaggacaguguugggggugcuaacaggccaacaccuaccccuuucaugcauggccaguguucaucagggcaauaauacuaacuggugguagcgucuuauaguuaagccuuuguaacccaccgucucuaagccaaugccuuuuguuugcuggggguggaaggcgaucagcguuuauuaaagagagaauaaguuauagcagauggauagguggcagccuuagguacacacauggggacacugaggaaggggaauagguauacuauggccugccacagcuucaucccaagggacagaggggcuugcaaggagguuguacgccaugguuacccuggccugacuucugcauaaugaggcauccuuuuagaaaauagauuguaguagcaacaggaggccaauggcuuuagaagcaaaaggugguggguguggccucagugguaaugugccugacauauguaacucccuauaucuggcuguuguguguucaugcuacauccacauaacuccuacauguguaugugugcuggagagccuggaugauggggcuggucuuagccaagcauguaagaugcagaacacagaggcauugucaguacugucucccuuccccuuaggaccaggagaagcccauacagaagcuucuaaggagcauuugugaguucuuucuuguuggaguuuggaguugauccaaguugcagacuucucaaggcgguccuugcgacugaguacccuuguuuagacacuagcuacaaccugaggacucuucaaacuccuuuagaccccauaagcugcuaaagacucuaaaacuuacugagaacugucucacagggaugguugaagauuagagauuaaaaucagccaaggagacacacaggacagucuugaagugugagcacacacagcuucuggugaacucugaggagucacaagggcaugaaacacucuagccguauauaauauauaacuauaugcucugaguaacgacauuccccuagaaggcaaggcucucuaaccuuuugcugcuuguuuuuguguagacuugguccuacucagacccuccuggaagcccaacuagaaccuuuagagaucaacucccccagaagugaaaauugccuggugucuccaucacuaaucauaguaucagacugucuggggccaaagcuccaggaaaaaagaggucuauaggucaucucucaagagcagagguuagauuuugcacguaaacuugauucaucguauagaauauuuuccuaccuacugaaccagguuuaugggugacacauucuagaguggcuuuagcuguuccccacuuaguuguugagacucagagugaaaugucuuucaucuaggugcuaagaaacaagcucugagauaccuaggggugcagccaaguggccuguuuucuuuucaaaaaucaugcccuucucucaaggauggaggauaugggauaagcaacagaagggugugagagaaaaaagaagccuaaauagccuucuagacccuaguuucccaugccaagguaugaggguuucuugugguugacccacgaaaacucuccaucuuguuuugucucaccccuucaucugauauccugaacggaacauaaacaacggcaucuaaggagcuauguuagaggacuucagccgaaaaagcaaauucuauaaauagaggucuauguggaacccaagcagcacccauggaaaacaugacaucaucuuguuucaguccauuugggaugcuccacacaacaccacagaccccagaguguguaaauaacaggaguucacuauuuaaacgucuuguguguagaaaggcaggaguagggcacuaguugauuuguugccuggcuaauggguagcacuuucuauguauaaucacaugguagaggauacgagcaaucucuccggugucucaggauuccaccaugaugaucuggucacuucccaaagccaauggauccaaaggauuuaacagacauucaaauuacagugugucuugucuuacaaaggaguauaaagcucugccagucucaugguuaaucugagugauggcugugaugaccauccaucacucauauccuguugcuccuuggggagagucuuguguuauccuaaggcugugucucuugcugcaucccacuguggggcaggggagggcgugugagcacuuggugagucugacaccuucacccuugcuucagaugacuuggguuucuuguuguaucuuagauuuugaugguguucuggcagagugguauccacaaaguuuaugauucauuugaccuugacuuaccaagagguuuaauuugaagaauaauugaaccaaagcuuuggaauguuucuuacauccuuuaucagcagaauucacaaugacuuguuuuuccucccagcacacacauuaaugaucaucauguauggaaaaucaggggugguugggucauucuguaugaauacaaggacagcaggcucuucaccugugcagggauagcugccugcuaucuucucuguagccucaaccuuccuaucuuaacuaccucgugacuauauuuggugcuugaacuguuucucgugguguguuuuuccuagauaagauacaaaaaagcauuacucaccucagacaagaaacuaauuaaaggcccaaauuaacaacuccacaaacauccggcuugacuguacaucgacuguauuggguuauuuacaggcauuugggugagaaguugcucaaaggaacagggauugcucaagggcagcuccaucacugaaaaaccaagcccaacuuaacugacaucucacagaagcugcacccuggagcuuccagcauaacuuguaggcagcucuucuggacagucuccuuuccuuagcagccauuguuauuaauauaacuuugggaggcuggguagaguggggugcacauuuuauaaauuuuguaaauuucagaaacuaccagagaucguugaguuuguuuacuuccugagucuuccagaggccucccucuggcauggaauacuuguuucaauuuauauauuacuauaccauacaugaaaauucaggguuuguuuuguuuuguuuuguuuuguuuuuuugagacacaguuuuuaugugugacagcccuggcuguccugaaacuugcuuuuuaggccaggcuggcuucaaacucauagggaucucugccucugccuuccaagugcuaggauuaaaggccugugccuuuaaugcucugcuugaaaauuaauaauuuucacugacuucuaggugauagaauaggcaauuuacgaguauuauuuaauguauacucaaagcuguaucuaccacccuuacccucagaauaaagcuuaggcuacaugacuaagggcacauauaugcuugccgaggaggcuuucucauccucaaagaaugugagcacucuaucuuuaaggcucuuguguguggugguguggugggggagaagguuagugaugauugucaacuugauaggaucuggacucuuguaggagacacaccaggcacaccaguacccuaauuuagauuagauuagcugcuggccagaccuuuagaggauuaucuggauuaaguuaauugagguggaaaucccacccuaaagugguaacacaauucucugaguuagaguccugcacuucauuaaaaaauagaaagcuagcugagggcaaauaguugucauuuucugcuucuuggucauggauugaccaggaugaccugcuucaagcucccauugucagaacuccucuauguugaaccucguaaagccaaguaaaaccgcucuccuuuaaguugcuuuuguuaagguauuuuaucauagcgagagcaaaagcgggaaaauuuaguuaggaagcguaagucauuuaugacacaagccaacgguaguuuaagauaaauuaccuaaguuugugguggacauggaagaggcagaacaauauaaguguauguaggguucucuagaggaauggaaucuaucaaauauaugcauuuauauccuauacacacaucuauacacauauauguuauaaaagugggauguauuagauugucugcaauggcugccucuauguagagacacaaugaacucagucacugcucaguccaggaaaugaaugcuccagaggcccacucuacggcugaaaacccagauaacugaaaaguuucugguauugaguccgugggggaaggccgaggaagcuggagugagauacuaacagagaacagcaccaagcgauaaaugcagcugauuaggagauaccaucugaggcaggaaggugaccguguuuuuccugggaccucuuucuaugcauuggaaggugccacccgcuuucagugugggucugccauccuugguuaacccuccuuagaaacauccucacagacacgacaagaccuuugccuuucugagugauuccaaaucuggccaaauugaccacuaagaccaucagaguaugggucauguguccuaaggcuguuucugaaaggaggacuugaaaagagguagcaaauacaaugagggagugcacucacgguguguggaaugagguggauggaacuuagaagagaauguggguaagcacaguaggggagcuaugcuggccucaguacuauguucagugguggcuugugugucccccauuugcuaagcacucucugggcagcugauguguuggccagcuguugguaucucugucuuaaguuuuagcccccugaugggagggucuuuuggagauccagcuauuuguuccacaaguacuauugauaagcuauauguaagugguauguaugcuagacgcacaagguugggguauguccagaggagaacucaccuuucccuucugauguuaggcaaccaggaggguguguggcugcacauugacgcugcuuacgcgggcagugccuuuaucuguccugaauuccgguaucuucugaaugguguggaggugaguaagcuguucagugaggucuuuuguuuuugcacugggaaucaaaccuacuggccuccuguguacuuggcuaccacugagcaacacugcuacccaaggucaucagugaaaucucccuguguaagauuuggacaccccaacucuuauugcuucgguuuauuucagcaaacuacuuucuagccaguugcaaugguuauuagaaaugaaaugcccccggggagccaggaacuuuaaucagggaauaaacguguguacuguuguugcagaggaccugaguuugguuuccagcagcuacucccauaacugcaacucuaggacacuggaugccucugucccgugcacuccugcacuccauacauguaccuagacuguguccccauacacauaauuuuuaaaaaaugaaaauuaacuuaauaaauacaguaccucaggauaggggcugaggacauuccagucaugcagccugacuuuugaagcacuccugaggcagacagcuauuuuccaguuugcuacaaauccuggguagagcugugcaucauagguuagacuuguacauauaaagccauagaaaaauauuuaugaguaaaauaaaauugcuaugcauuccagucagacaauaauuuaaaacgucaaccuguaauccucuacgaucuggcucaaugaguugcucacguucuucucauauaccugaguaagaugggcagucacaguggccaauauuccacagaaagucaccaaugcguucuaaaugucccguggacucuucugaaaauugcaaaguguauccuguaaccccaaacgaaacucugucaugagaaguaacaaucaaagcaguuagccaagacucuacucuccccagagcuacagagcauaaaacagugcauacuuaacaaacuuaacacagaugggcccugugguccaucuuuccagacgugggcagaauucuacuguugggcuauccacaggcuaggaagcucuuccaccuggccacuagcagauucaugucccgaagaaccccaagaggccuccuguagaacaaguguguccaagggggggagaugcuaaguuugcggagucagugcuuuagccagacaagaauugcuuucuucuuggaagaagagguuucccgaggcuucacuuuauaagggaggcuggaucagcaagcaggcuucacccuuccagacugggauggcuaugcgcccuugggcaggucagguauccuccaucuaucauaaaguagauuuaccagugaugacuccuuugugcgguuagccuuaggaguggcugcguuaaucacacuuaaaggguuuaagaagaguguggugcacaggaaacugagcacgcauuagaugcuuucauuauuuuucaccagggcuuauagaaagucccccuaaaccucuuucugcuugcaugucaggcuugccgaucaauuuucuaauuacuguuuugaauucacauaagacuguaauaacagaaaagcgacugucaaagguauggaauacaaauugucccaucuuugaagagaauaaucccccuucuugcuggugagccagcagcauugugguuucuauguccaccacaaucacucacucucuuacgcagucaguagucccuuacugaguauuucauacaugcuaaacuggaauccauccuuggagguagaaagagguaaaaaagaucacuaaguacugggguuuguguuaacucgugggaagcucugauccuaugacuguaaugccaaaccccucacuaguuuuguggauguuugggucucggaaaugauugauggugugugacguuucuaaaccaaacuccaacauccagugugcuccaaaauuugaaacuucccaagcccugagaccaugccaaagugguaaauuccaucccaugaagcuuugucucguacauagaaauuuaaaaaacacuuaguaaaauaaccuccaagcugcgucuugggacacuuacauuucaugcuuagguuuggguccuguggcuaauacuuuacccuguauguguaaauacuuuuaaacuuaaagaagcauuucagauaagggacaagaaacccauuugaccuucagcauaguggaggcaagaagggccacacuucgccuaugccuuuccuguaguccggccuaggcucuaaguuugugaguucagauauccgguuuaagauuuccugaucuaccagugcucaucuucggccugaacugacaacucaaaaguuucaccuuucacagaggggugcuggacagucagaccaccagggcgaugggcaccgcagccagauccuaucaacagcagacaccauucacagcacucacagggacaaggacucgcugcaauuuuuccuccauuagugguacagcucuuccuugccuggcugagggcucggcugcuccguggucagauaagcggccgcaauauccugcuguggcccgacccuugcagauaagggccguccucucugucagcgcgaggaaaauaucacuguacgguaaugaaagaaguuuaaacagaucagccccaguggagggaacuaauaaaauccccagcaaacaaugcuccgcuuuaaccuuuuguuuccuuuuaucaacaaaugaaacuugcuguaauuuccugucuccuucucaaaauuacuuuuuuugaaaccugggaggaaaugaaucggcaccuccagcuuggguccauauggaaguuugcuucggcugacucccgugucuaucacugacaccaaucggaccccuuagggcuuugcuaccuccucagugagggucccuggaauuaaauaaagaggagcacccgcaaagccuugggaaguuugaaaaaugucccguuaggaaaucgggguagacugagccuuguuucuaucuaaauuaagcucugaggccaaauccccgacacucagauggaccgguuugccucucaacaaaaccccggggccugcauuuggaaaauggcagaaagcagccuuugugaagcucuuggauuugcgagugcacagcugagacccaggagccuucuagcuguuguuggcaguugaaaucuauuuucuccuugaaagcauggucagcaaagcugcaguuguuaucugugacccuccagccaagaaacuagcaacuguucacuauacuuagaccucaucuuuaaaauugaggaggaaaacccuuagguucauggaaaguaugaucuggugucaugcuggccaaagaaccuuuaguuaaauugaaaaaaaagaggugggggggacuucuaauuaccuuagauuaguuaugagauuuuuuuuuuccucuuuccugucaucaugaugacauguauauccugggaaauuugaugguucaggacaaacuauuugugggcccaaugcucauauucuggacaugguaguuauaaacugaauauucuggauuuccagugcuuugaacucucacgugaggaaucuugcgugaucuuagagccugggaccuaaaacgugaguucuuagaauacacaaggucuuacuuucucccuaaagagcuaugaguaaauugucuuguuuugccguuuuuuaaauuuuuuuauuuuauuuauuuuuuuauuccuuuacaguuugcagauuccuuuaacuuuaauccccacaaguggcuuuuggugaacuuugacugcucugccaugugguaaguuucucuguuguucuggucaccugugguggccccugaauaugugucggcagagagggaggccugccugccagagcacauccagggcccccugagaauggagguagugguuacuuagccuaccguuugccuccauuucagagugcugcuggaauucuugcucaaccucccucugccuguaaacuuuuaucucgaguguauuguugcgacagauuagcuugagggacgagcagguggagacaggcgaccugccauuugacuuaucucucaugagcagacaacaaaucccaggaaauuucaguucuuauauuuaauucucuugcuucuguguauuuauucuuagauuuaucaucagucucuuggucuaacucucacuuaaacaaucuuaaugcuuaagaguacuugcugagaauaaaguaccgcaucuuuaaaauucucuggagauucuuagaaacaaugcaguaaucacuuuggcuacacuaaguaagaaaauuaaguuuuaaaaucaaguggcagaguaccacauaaugacaccuuaagacacaauggcugggaccaaugcagggacaaaugaaacuuguuucuuaaauuaaaaaaaaaaaaucaggguaagaaauugauuaaucacucacgugaccaggggaaagcuuuugcuugaauuuuguuaguauguaagguuaauguuuucaauauguuuacuuugcaaaguugcucaguguauaauauaauuaaaugaaugauauuuuacuuuaaaacaggaaggggcacagcucucacucaauuuagacaaauguagucaaaucccucaguuuaccaaaucaauguaugguguuuguggcuuauuugcaguccuuuaacugauguaaaaucaaauucuuuccugucacaucuuuucaccccaaauuuugauaacauuuuacuaacauuauuuauuaauuugugguguguguguauguaugugugcuguguagugugacauaugugugugugguauguguguguuguaugguauguguguggugugaguguguguaugugugugaguguguacacguguguguguauguacaggcacacacaaagccguggaguauaagucauagggcaacacuuagauguuagccauuuccugccaucuuguggggucugagaauaguguucacuuuagccaggccugaaugcaagaaccuccacccucugcauuaucccacuuucuguuacuauaacaaaauacugaagagaauccacuuaaaaagaagaaaagcauuuggguuuacaguuucagaaacucgagucuauggucauuagguuccauuccuucuaguuugcagggagaaaacacaugagggagaaacuguuugcuugaggacaccuagcugagacaccaaaaacgacaggaaggaccuuugucccuauuaucacuuucaaaagcacagcuugacaucagaagauuuccaauuaggccuccucucuggaaggcccuaccaucuacaaauauugcuauagguuggagacaagugucuucugggccuuuggagggaauuagucgauucgaguugcucuaaaacaccaaaggcucugucaauaacaaauuuauuucucacaaucuuagauguugaaaauccaagauuaaggcccugguagacuuguuauguaaguuaggguucauuuucuuguacacaauuccuucugauuguguuuaccccuaguggaaggggugagggagucaucuaguaucuuuuauaagaaauagucagaaauucucuuaacuaagacugcaucaagcagggcagugguggcgcaugccuuuaaucccagcacucgggaggcagaggcaggcggauuucugaguucgaggccagccuggucuacagagugaguuccaggacagccagggcuacacagagaaacccugucucgaaaaagccaaaagaaaaaaaaaaaaaaacucugcaccacuacgaccuaauaaaccuugaaguccccaacuucuaauuacuucaggauucaaauucaacauucggauagcagcuaaaagaaaguucauaguucauuugagucugagcaguaugaacuuaaaacaaacaaaaaauacuuuauacucuaguggucuuagccacggacugccaggaaauaaaauaagaacagaugcaagcuaagaaacuagauaaaauaguaggcgacagaacauaaaaugcaggugauggcggcuucagggucuaugauugggaagcugucgggggcgggggguggggaaaggcuugggggaaagauggagagagagauuuggguguggaaugaacagaggagaagcuaugaggaggaaaggcgcucaggacgccaugaauuggcucuuucauucacugacagguuauuuaugacagggaggucaggaaaaggcccuuuggggaagugacauuugaccagacaucugaauagggaaagaacaggccggggugagaaagugugugugcacgugaaggccccgcccgagguggaacagacaaugccuaccucagaguugguugaaagaauugcagguuauucaaaaaccauuggaaagugguuuugaguuuguuucaaauaagcuacucaauuuaaaaauugcuacacgugcuuauuuucaaaaugcuauucucauauucagcaugguucagagcugaggagcccugggcaggucacuuucaguacuuucagguucgacacagccuuacuaggccgcuuauucagccaagccugagacuccccaaaacggaaaccccuccguuguucacagcacggcuuuucuuuaagaaggacuggugccaggguagguggcaacaacaaacuuuugccaagagccagcacgcaacugaguucuccagacucaaggacagaauucuguuuuucucugguccccaugagaagugacaaagagcuugccacaaacagacauccuuaugccagacauuuacugcagugccagggucuuugcuuaagaacuuuaccuucuaagcaaaugccuguuauuuuuugcagcacuuggaggcuuaucucucccucugaauagcucugcgggucaggauugcugcccuguuuuauggguaaggaagcuagagcuuaaggcuuaauccagaaauacguggugguaugcaccuacagucucuaccacucaggaaguugagauaagagauuuacuucaggccuggaguuugagaccagcuugggcaacaaacaagauuccuucagaaagacagauagagagauagguagaaagggcugggggcagaagggggagggauuuuucucuggugaaagaguucagagugauccuuaucaggccggguggacugaugucuuaaagugcuggcuugaguaaagaguaagaaagaauccugaaguuugugcauaccaccuaagagcagauacaggaagcagcuuguagcugacacucccaggcacagagaugugcucagggaaugcagggggaucauucaucaugggcccagaagaagcugaagaaagggguuguguuuuggugaagaggggccaaauuaggcagucauucugcuucaacuuucacucaaacaguucuugacuguguuuucucucugaacacuacaaaaggcccugaauucuagcccagaaaguacagccuaaaggcaaaaggucacuagcuagacacaacaucuccauccggcauuucucugcccagcugccuucacggagggguucuguggggcaugcuggggggcugggaggcuggggagggggcgggucccucugaguguuugcagagggcuuuagggggagguggcaccuuuuaaggugguggcagggagucacucagaggaugaaauccgagaacguuuucagugaucuuucucguacuguccggaacaucuaucuacugaauaauaauuuuaaaaaguucucuugcuagcccucauauccuugcaguaauguguucugcucugucaaaauaaagcaaaaccaaagucaggcaggcaggagaucuguaaauacaaaagcuccagguggccagcccgcagacgcugcaaaaugugacacaaaucaacagucccaaguuaaucuuuuacagguguguuuuaagauuuaacuaaaacaagaaacaaauauauauauaugcucccugauuuuuuuuuaaaauuguuugauugguuuggagguguuuuuguuuguuuguuuuguuuuccucugucuuuuguuuuguaaucuuugaaauagaauugucucucuuuuguuucaugagauuucuccaacuguuugcccauaauguaacauaaauauguugguugacuucuuuaaauauuaaaauggacaagauaauggaaguuucugaaacuggcaaucacuauagcauagcaaauaguuucuuaaugaguucauuauuuuguucauaagcuuuuacugcucauuugaucuuuggaccccuuugcguggggcuuaccguccuuuuacugucagagcugccgagaggaucaacaaagccagauaucacucguugucccaugucccgugugcuuagauaaaggaucucaggaaagaugaauaagagaaaauagcucaguguagcucagggauugcuccucaacuaacacauucaagguccuggacucauuccccagcaccaccgccgaggaagcaaauaaauaaggcacacacuggucauuuguagcugccgauggaaggauuuggcugcagaaacuuugggauuguacggcaagaggaacacggucaagaauguccacaacuacacauacaaaaacuucuuucuuccaaaccugauuuaaaaguaaauagaaaacccccaaacucauacaucaggcccguaaaauauucaacgucaauucaaucacaaauguaguuuacaggaaucagcaaaaugucacuuauguuaucaaguuaguuucagaaaaucaggugacgaucccagaaagaaaaagcauaggauaaccgcacaaacuuagauuuuugaauucucgguuaauaaaucucuucuguacugucugucugucgugugguaugaucucuugcagcaguccuuggccccggucugcuugcuuaaguacucuuccacugcaaaaccccuucaguaaaacccagcgguguuuaacaaaauaguauaaugguccagcaugaguguauuccagauguguguguguguuagaauguuagaaaaugucauuuaucauguuaaagaaacaguuauucucuugcugucuuuucacccgcuucccccucucucccugucccccuucccccucuccacgugcucaugguuggccucuucucccccccccccaccccccuucugccuuucucugucucuacuacccucucaacuccucuccccaugcauugaauaauuuguauucuauauaaaaagaaagaaagaaagagagagagagagagaaagauagagagagagaaagaaagagagagaaagaaagagagagagaaagagagagaggaaggaaggaaggaaggaaggaaggaaggaaggaaggaaggaaggaaggaaggagaaaagaaacaguugucacaguagguucagaaaggcguuaggguaaaauaccccugcuggauaaaaccaaaggcaugugccacucacuaugccuggcccuaagcuugaauauguuuaaaaagacuuuuuauuauuuauuuguuuauucauuuauuauuuaacaugcaugaguggcacuuggaugcaguguccaauacaaagccucuuaguaaaaaguagccagucccaucaaugaucagaaauacaaaugaggcucacagagaugggcugcugauguggcuuacuuagaaugaacaaggcccugacugugaucuccagagcagaaaaacaaaaaaauacggcaaaaucaacacauagaaagccacacugaaacaguaccgauugcuggaaaucaaaggcaaaaccacaaaugcaauaccaaauacaaaucugaagcaacagaagccagcacaguguaaagcccaggauggugcuaucuguccagcaaggcguguagucugaguuuuuagggucagagccugggcccugucagcacuaacaagcuaggcuugcucaccuacccucuaugugccaauuaagagacaauaaugaguaauaaugauaaacaacaacaaaaaguuuccucagcguggccacguugagaagagaaacaaagagguccaguguuguuccacccacauuuucuggguccugacauggaaaucagguuuaaauaaauagcaagggauaugcauaaguaagcaguccuggucaauguguggucuagcccaucacggccccagcuccaccggcuccuacaaaaguggucugacaaguccucggaacugggugaaaccuguuucugggagacaaguuacccucuggcuggcccugccuuccagccuuuucuuuucccagcuugacauuccuggggaaauuccaaucgggguucuuaaaagucugauagccaaagggaggggguacaggcgucugcuuaguauaucucuauucccgcugggguuugcaaaccuuaucuuuuguucucucaaaucagggugaagaggaggacugacuuaaccggagccuuuaauauggacccuguuuaucuaaagcacagucaccaggacucaggugagcagacaaacaugcccaccggugcacugugauuaggguuugcuucaggacugacuuggaagacuggagaagcccauagcaccuuccucaggacuggaggggcccugugcucuccugccucacucucgagaaacuucuaugcugugcugaguugagggcagggguuggacuugucuggcagaggcucucgcccugcccccaaucaucaagagccugagugacaugugggaguaaggacaggaggacugcagccaucagccccaggacauguacaagcaugucuuccaagacagaaaacacuuagaauagcgacugcgccaguaucuuuccugaaaaaguauuuccacaacauccaucaauaccauaaaagaaaguaaaauuuaaaaaaaagaaaaggaggaaacccggggagagaaaggcaaugaagagcaaguaggaagaaaaguuaggcagagcugcuggaucgaugcauacuucugcauuuggugggagaucugugucugugccuggagcugauuaccugagaguuuaggaggcucagugucugcacagacugccuaaggaagaggacaagugagagggcagugagagagaaguagugugugggggaagggggagggggcacacagacuccuuucagaagccauagcaggaagcccacaguaacugggguggccucuaauuaagccaugugcuucccagagaccauggcagaaagcagacacaaugagguguuugagccacggugacgguauaagucagccagucagccucacccgccuguuacuacagugagaugccugaggcgauuaacuuaugguucuagaagcucaaguaaagauggggcagccccauagaugugaaccuuuguugaaagaagcacaucguggugggagcauguagaaaaacaaguccucacauuacauuuuauaaguuagaggggagagaaggggaaaagaaaagcuggugggcucucucucagaguccauuuuuagugcacaucuccaaggaccuaagaccauucuaaugggcccuaccuuuuaaggauccaagcaccuucaaauaauaccacagcagaccuccuccucuucuuuuucuccccucucccucuuccccucucucuccucucucuccucucuccccucucucuccccucuccucucucuccucucucuccucucucuccucucucucuccucucucuccucucucucuccucucucuccucucuccucucucucuccucucuccucucucucuccucucucuccucucucucuccucucucuccucucucuccucucucucuccucucucuccucucucucuccucucucuccucucucuccucucucucuccucucucuccucucucuccucucucuccucucucucuccucucucuccucucucuccgcaggguucagaguuucucuggcuguccuggaacuuaauuuauaaaccacucuggucuccaacucugccucccuuugucuccugagugcugggauugaaggcauaugccaccaccuccugacuauaaaccacuucuuuacaaucacuaucugcugaaauuagaaguuagagcaguggcuuaagguacucacagaaccuuccugguacagagagaugcaggggacauucugccacugucugucuccucauugaauucugguauacaacacagccgaauucuuuaaaacacacacacacacacacacacacacacacacacacacacacacacaggaccacguucuaugugccuauuauccuucuuuguaggccacagccuccaguacaaaaucaugaguguaggcuggguucugaauggcaccaagagagcagaaauccacauuucccugacaguauuucugcucaacuguguagccaaggauggugucucacacuuguaacggucuugccuccgccucccugguguugggauuacagaaaugugccaccacacccaauuuaugauucuggggaucaaguccagguuuucauguaugcuggguaaccauucuaccaaccgagccuuuaucuccagccugagauuuuucuauaacagaaaaugcugacuucugcugccaaaaguaggaaaucauugcucucacuaagcaggcuuuucagauauaaucuguguuaauaaagaucuauuuugcaaaguggaaaaagagucaauguaacacuagauuuccuaauucaacauuccaaaugcaaauauuucuguauuaguuacuuuucuguugcuacaauaaaauaucacaaaccaaagcaacugagaaaaguguuuauuuuggcuuacaguuccagagggauagugucuauuguggugggaaaagccugacagcagguaagacuagacaggaacagaucacagucucauccacauacaggaagcagagagaaugagaacaggaagcaggugagacuauaaaaagcccaccccuagugaugaaauaucuccagcaaggcucugccucucaaagguucuauaaccuccuuaaacaauaccacaaacuggggaccaaguguucaaaucuaugagcccaugggagacauuuuucauuuaaaccacaauugucaauauauuguauuucucacaguuuuaagcauugccugauuuuauugcuuuaagguuucauuuacaagcugccuacaccaaaauaaaucaugaaggguuaaagauguaguaggcaugaaagacauaauaagcaguccacaguguguaaacagcuguaaucauaggaacuugcugguguagaggaguugcuggcauuguugcugccagcucuaagugauuguacaaggagcucagguguugaggccagucucccuucaaccccaaugaaacagacucacaaagaagcagauuuccacccaugugugcucuccucucgcucuaaaagccacugugccuaaauccuucuuaaagcggucaguguaccuuccucccaccauguuuccugaaaugaggaaaugcucuacaauucuguagauggcagacgcuaacccacagcgggaaagaugacacuugaaagauggcucaucuggcagaacuaccuuuucaauuuccuuuaguuccacacaacaacuagauuaaaauagcugaaugugacuaacgguacuguaucagauagcucaggcacauacacucugaggcggcgacgucaaacauucauuuucacuuaugagucauguaguuauggccagguaccuugggccuuuaugagucacuaucagguuauuuuuuggcaccaugccacugacaucaaguuuguuuaugagcuccguugcuggcaagaggcuccagagaaaaggucagagugugggaugggaauugaagacccugucucugagucacucaaaagauaggcugagaccaguaguuauguauguccccaacauggcuacuuuauccucguuaagaaaagaccuagacuuuccugauucccaguagaagucaaauaauuacuucagaaguccuggauagagaaugugaacccucccuugcagugcagugcaccguggguauguuagguguuccagcugaaacuaccaugcuacaguugcuauugccuagaaagcaggggugugugcaagcugcagcacgcuuugcuuggccugcauuucugggagagauuuccaaggugccugacucccuauugugcccaacagggcugcagccagccuuuguguuuuccccuagucuguguccaagacacucuagaaacugugguuugugacuccacacagggcucucuuccccaugcuguccugggaucuaggguuguaggcaccagagaacaugagagugcuaaacaggcuuuucagaacccaugugggagcacugaguccaggauaagaaggaauuugacucagaguguauagagcagcugcucugugccagaugccagucaacacccuugaauauggagaugagacgacccccccccccaccuccuuauuauuugaaucauucuuuguaucaccagcuccauuaacaauucagccuuccaaauguguccugggcauccugcuuucagggacuccccuugagucaguuaccuugaaugagccacacagaacacuuagcccuagccaguccuuggauaguuucaugucugccacagaagucaucacuuauaagccuggaggaaaaaaggauaccuuuucuucuaauggccucucucuaauggcugcuuuuugucuuucucuuuucuccaggauucaucacugacuacaggguaagugaguggcuuugcccauuguaaucaaacucugaggugccaagggcucccuacugugcuguugcugucacacacacacccccaccacauuccggagcaggaggccacaagaggcagcuucuaaauguguucugacagacauauuagguggcuuugccguaagcaucucugccacguccaucaagggucggucuucacagcccacguggcccuuuuuucugccuucugccuguacuuggggcagcguccuggggagugcuagggcagagucagagaagagccagccucuuggacaggaucguagucuuggcagucuuuccucuacucacuuuacuucuuucuccauuuuuuuuuuuuuuuaauauucaccacaaauguuuucuggauuuugaaaacaccaggaugucccagcuuugcucuggaaaggaauuuggaaccgcaaguaaugcugggagguuucuuccaagaauagaagccaagccgggcugggaacaugaggggcccacugcaucugcugucucucucagaacacgaaggggcccacuucaucugcugccucucugacuaaaaaaaaaaucugaccuggcuuauuugcuggguggggaggcgggugugcauggugaacacaagacacuaucaaagcaucuuguccgaaguagugugucuaaauucuuggggcaguaugucagccacugauaauaagggguagcaggauugccucuccuagacacagaguacccuuccuucuucugaugacagcugcaggcuggcaggugcagguuaccagggaaucuucauccuaucuucucccaggccagagucucauggaagcuugugcuauggggaaaagcuaggacuugugcagcuauggguauggccaagagaacacuccauuuucuccuuuaacuuuguacaagcuagcccuauuuaggauccaaguuaccuuuuagaaagcacaauuuaagggauacuauaagaauaauauuaaaaguaguuugaggauaagaucacuuaaaaucuuuucauccugacacuucugugggcuuuggauuuguauuacucuugugggggguacaaaugccagacuuuugagaggaaaagcucuacguuaaacagagcuuggcaagucugucagcaauugucagcagacccuccauuguuuuaagugaacuuggcaugaggucagauguccccuuccccacaaugguacuuaaacugugcagaagcaaaauggaaaaacaaacaaacaaacaaaaaaaccccgcacauccuauggccuuauugucucauucugauuuuauauacuugguaaaaguugcaggacugcugcauaauaauucaggaaaaccagaggccuucauaaagaaacaguuuaauaauaaggaauuaaacuagggaguaaagucugauggcgcacacccuuaaccccagaacucaggaggcaggggcaggagguucuccuagccuaccaaccuagccuacuaaguccaugccagcuggggcuacauaaugagacugugccucaaacaaaaagcaauuauaccauaggcauacaaguauaggggaaacagcauauauacauuugguguugucucagauuucaugauucagggaggaacgacugcauuuaaaaauaaacucuguguuccuagaagcagcacggagcucacucuuaauuguagcuaaagcuaauucuuagugggcucugugaugguagacagcgggcgaguuuagggugcuuuucccaacuguagaacaccacccagaagggagacugcgcuuucucuccaggagacuggagccuccggacuagauaagaaguaaagagcuccccucccccagcccgcccuuuguaagcccaaguaaaagaauuucaaagaaagccaggaaguagugcaaggccauccucccgacaggccugugucucaugccugcccuuuccuacgugcuuuuauugcauuuccaaccaucauccaucaccaucaagaagaaugugaggagccagugugaacagccugucagaugaccgucuggaaaagcuaggagaagcagaggcaggcuucuuugguaaaaggguauuaggggucacuccccagaggucagugagacaaaggcgcugauacuguuucagagugcagcuucagugcauccaggcagagaaaggcagacacacaaggaguucagcacccucucucugccuggaugaccuccugcccccucggaagcugccuagggcaggaccacaucauuccuauuucuuccuggagugccuccucugggguguacucagcagacauuugugcguugaaaaugguaaacuucagugccucucguucaguguuucuucuguccucaucuccacaggaugugaaggcagcuucucccucucuucuccccagcucacacaacaaguuguacgccuucccggcugggaaacggccauucuauaggaaacuggcugcuuccagaagaaaccggcugacugggaagcugaaaaggagccuggcuguuugcacuguucucacugacggguucuuuauauuuuauuucagcacuggcagaucccacuggggcgacgauuucgcucuuugaaaaugugguuuguuuuuagaauguacggagucaaggggcugcaggcuuacauccgaaaggugacugccuucuuuguuuaucuaauguucuaacggucggucguaggaaacucagaaacgaauucaggugucuuuguaagcaaacaccaucaugcauugccuaacaacagggauaagcucugaaaaguacaucaugaggcccuuucauaaacaugagggcaucagaauuuucauauacaagcagagacagacaauuuccuagaagggacaggccuuuggggacagaggaauggaugugauaaguuauucucccccagugaaacgagucaauucaaaccagguuugaauaaaggcagguuucuugggaagcagcucuggggcgaguucacuggucccaaggaacgaggcgccacgaggagcgagacagaggggagggggaagagaaagcgagaaagagcaugcgcguucagggagagagaaugcagagaggggggagugagggggagcgagaggccaaaaugucuggauuacauaggaaagagcuucugggggaggggaggggaggggaggggaggggaggcccagcccggggcuggaaaguucaggcuggaaagagagugagagcagccaugaucugcuguugucugaaagagcguuuuuuuuuuuuuuuuuuuuuuuuuuuuccuuaagcacagcguuggaaucaggcaguaguuugggccuuuacgauuaaggcacucacaaacugguucuauguaucuucuaagacacuuucauuagaauauagguuaucagcuccaggaaguuaauuaaaagcaguguguaaauuuaauguuuuccacguauccauccagcaguaauuuugacggagcaauacuaguaaugagagcauaauguuuuucucccccacuaccgccaaacaaaaugaaauaaaacaagcaagcaaacgaacaacagcagcaacaacaacccaaaccucccaaacuaagaaaaccuuugaguugguugggauagauaccaucuaguccuuuugucucaaggaggcuuucugggcaguauggaacuucgguuccaauaagccacccagucacuaugaugugccuuaaaguagcuugaggagccgcuuauuauucuaaguccuacuacccuacuuuuuuuguuuguuuguuuguuuccaggcuaagcccugaguaugagccaggacaugucuacccauuuagucagaugcagagggcccagugacuucagcugaguccuuucuaagccacaacaucaucuugaugaggcaagcaugccugugguuuccagccugugguggugacagcuuuccccuuaagucccacugcauuaccagaugugcagcuaaaggcaggggcugagugucucgggcccucuucuaugacaggaugcagaaaagcaguuguuagaagaguacccgugucucuucuaaacuggcaucuguccaggucacaaaacuguuguaaggaaauguaugcaaacauugagcaguguaagaagcuacacaggggaaagaacuagaaaccuagaguguguguagauuucuagauagucccugauccaauugcaaacgggauaaggagggugagucaacuuguguguaauaagaaagaaaccccaagugguuuaucagucaaagguggugaugacucucaguucaggacagcucacugcgauuagcuugugccagguuaaagacacaccacaccucuuucuggaaaggccccaauccagccuucacaggagaccauaggaauggucaaagauggcguuccuaggcuugagcuaauugaagagcauuuuaguccugaaucuuuggugcccucuggugggaagacuugagacaauugcuucuguggcaucuaugaccaaacaagcugugugugcuucagcuccucuaaaggaugggccuuguggaagguagugcuggaugccaggaggcuccaauuagcuaagugugcccuuggagagugagcaaauguucauaugugguuuuaaucaguuuuugaauucuuuaaacaucuagagauuaaauaaguugguguauucaaugcgaucacauagcguuuucuuuuuccuuuuaauuauuuuauuauuuuggagcuagggucucaguauguagccuugguuggccuggggcucaguaugucgaucagguuggccucaggcucaguaugucgaucagguuggccuggggcucaguaugucgaucagguuggccucaggcucauagaaucuuccaggugcugugauuacaggcacacaccaucacaccagaggggacacagcucuugaauguggcagguuagggugauuccugucuguaaguuggaaucaggcugggaucacuaucccauuuacugcagaagugauaccccaguguacacaucagaugcagcugaugugaaucucagcugagcccagguaugacugaggccuacgcuaugacacuuguucuugcagggucucaguuuccuaucuacaaauuaauaaagcuaucaugaggaggucaagguggccuuuuuuucuuuuagaaucuucaacuacuucuuuauaauguuuauuauaaaauuauaaacggaaggggguuaaaacauagauccauggacagaagaaaaugagguuuuuuuuuuuuuuuuuuuuuuuugaggaagcuggaauccuugugguauagggcagaugaguuucuucucaaccuaugugggaaaugcuggugaggaugcaggacauugcucagcgcaugugaaugacuaauagaugugcagcccuauaagguacuggguggccaggguuaggcuaaaguugugaugagaaagacagcaaguuucccuucccuuuuuccagcacguggagcugucucaugaguuugagucacugguacgccaggacccucgcuuugaaauuugcacagaagucauucuuggguuggucugcuuccggcuaaagguauguuaugccagugucagccaucuuuguuuuuguugaacacaauaaaguauuauucaggacauccacaagcaaaguuguguaccaguugccaagggcuacagaacaugaccuguggugcuaagcaggccgcgcuggcuggcugacuggcccaguagacucuccuccauggacuugcugcccaguuuccucugaugugauuggaugcuuuccucuugacccaaugccaagaguccauccaauaccucuggaacuguaauccucugcugaguugccuguggccucaguaaccaggucaccuguggacacacaacaucagcacaucugggaaccggguugauaaacaaaccccacuguccuagucaucuggcuauauauaccuccacaagauuccugugcagagcggguaccugaguucuguguucuccuugggagggaagccugcccagaucggcacgggaguaagcuaucuuugcagagacuuacacaaccauguuacucaaaaggcccugcucaucacugucuuauaaacgaaaccagaugcucuggccguuacuaagauggcuuuuaauaggccaacaguuuuauguuuuguuuucuuccuccucgccuuccucuccuccuuuuuacaguacugagauggaacccagagcuucacagauucaggacaaguucacacuaugccauaauaccagaaccugccuccuuuuucuccccuuuuaaaaacuaagagaaaagggcuccaagauauuacccaggcugaccugaaacuugcaauccucccaaguaguugggucugcagacacaugccacuacacuugacuggaaguuucugaaucaguucaaaaggucuucaggagaccuccuuguucaagcuuagacaacagucaugagaaggagcaaucugggauacaucauuuucaugcuguugcacucccuguaccaccuccuucccucaucuugauucuuaaagguuugagauaagaucuaaguuugggagauucuagaaggaucaaucacaagcguuauggcgugagugcuagagaggagccccaugcuuucugcaagcaugaaauguaaugucuaaggaagauguauagaaugaccaagaaagugggccauagguagcuugugugggaugccucaaguauaugucucuggaguucgguguguggagcaugggauaugacagggcuaccaacauuggcauugguacuguguugacuucuuuguccuccaaguauuuguuuucauugcagugggcugcugcaguaagauauuuucaguuuuguaggaugcuuauauuuuaauuuuaaugguuuuauugagauauaauucauguuggccuuuagcuuauacauuugagugauuucugguugugaggucaucaccauaauauaauuuuaggaccucuuugucuuccuuaaagaccucugcauaauaucgccuuugugauugucagcuucacucuugaugugauguuguagugaaggcuaagauauugguggauuuguaucauuuaggauuauuccaaauacacuuggccucagauuuugcuccuucucacaugcaugguagugugcacagccgucacacacagaacccuccagacucuuuggcuaagaaacuuuuccuucugugaaacuuuguuaccuccuugccacgauugugccuuuuuuauuaaggaagcauguuagccaaacaccauuucuuuuuuuuuuugccuguauaacuauauugugugauuugccaccuuguccuugucuuuuccaauuugaugaguucaagaagcauauacuguggcugcuuacuuauuaagacagaaucucauguagcccaggcuacucucaaacuggcuauauuagccuaagacuaucuugaacagauuuuuucaucuucauucucaaaaggugaggguacagguaugcaccacucugcugacuuaaaguagcauccauuauacaaaauucauuuuuguggcauuggggauuaaaacuagggucucacgggugcuaggcaacugcucuaccacaaagcuauacuuucuggcccuuguggcccauuauuagacauaaaguaugaggcauuacaauggcauaguuacuccuucuucccuggccaggcuccuuuuaucuuacuuaucuuacuuuugccuuuaagaaaaaguauuuagagcugggcgugguugcgcacgcuuuuaaucccagcacucgggaggcagaggcaggcagauuucugaguucgaggccagccuggucuacaaagugaguucuagggcagccagggcuguacagagaaacccugucuugaaaaaaggaaagaaaauguauuuagggcuggaaagauggcucagugguuaagaacacugucugcucucccagagguccugaguucaauucccagaaaccacauggugggucauaacaaucuguaaugggcauccaaugcccucuucuagugugucugaagacagagacaguguacccacauacaugagauaaauaaauaaauaaaucuuuuuaaaaacgcauuggaucucauuauagauaguugagagccaccaugugguugcugggaauugaacucaggaccucugagagaauagucagugcucuuaacugcugagccaucucucuagcccuacuuuugccucuucauuauugcaucucugaucauuucuguuugcuuucugguccugcuucuuggaagugcuuucuaaccuaaagcaauugaaaauagcacacaacuuuccccuaaauaacuggcuuuuguuuuuuguguuauaugaauuucaagugugugcucucauauguguguguguguguguguguguguguguguuuaucauccuuccuugaauaggaccuuauuguccagucacagcaucuauaccaacaauaugaauagccuguaguucucucacguauagugagagaaaagauuuucuuagaugucacacucagaccugaagcuagaagcaugugaaucuguccaaggccaagagcaguucucaauauccagcagguguucagcugucaugguccaggcagagguaacacuuuccuuuccauguauccuccuaccucucgacccuuaaaauccagaauaguggucuagccuagcaagggucuuaugauuagggagugaagccugaaaccagccccugguacauuuugcuagacggaaaggcuuagcagcuuggaagccauuucaugacaguuauacaaaggaguaaagaaauaggcagagaacagcuaccagccugucuacuuggggcccagcuggaaagugauggcuggcuguguguuguuugauaagguccucuuaucucugguuagucauugggaguggagggcucuggccucucugucuccagcuuguugacuauuuucuuucuagagaagcuguauagagauuauccauaaucccccauucccgcauuuacaaaugcccuuuagagauucuucugggaaacagcuagccuugccuggggugcuccauggucucuguuguugagaccucccguggguuccaauguaucuaaagcugcucuaguguaccagagacagggucacauaguuuauccucaucuauuugcugacagucccuccagggaccuucaucuuucuuaaacaaacuuggaggauaagaaggucaacuucugauaauacagauugcugagaaacgcuaucacagggagaaguuaucuuauaaguucuuuaagcccauguuagucauuucaucaaacuuucugccaucuuacauguaaaagaaaaguaaagaugguuucuucauugucuaccgucucuagguguuacuagacuuuguguuauacgauggaucugcuuucuaauucccccagggcuccaaugaguugaacgaaacucucuuacaaagaauaaacagcgccaaaaaaauccacuugguuccaugucgucuccgagacaaguuugugcuacgcuuugcugugugcgcucgcacuguggagucugcccacgugcagcuggccugggaacacaucagugaucuagcaagcagugugcugagggcagagaaagaaugaaagcagagcugcuucagguaagcuagcugcaccagggacaucuguuuccuuguggaggcaucaggauuccagcucagucccagcauggccacuuagugcugaguggcugugcagugaggaagagaaaacuaucauagucagucaggaguggcagaaagaauguuaugugccaugauucuacagagugaauuuguauucauuucugugggcuuauauacaauaguguauagaucuugcuguauacuuucccuucagauuuccccaaacagcacugaccaaagcaacuauccaaauaagcuuuagcuacaugaaaacaguaaaugggauuuucaugugaccgucaggaaagacccaaagugcgaugguaaggaagggcaggcaggcuucugugcugcuuaucagagaggaagaaucacagccagaguaauuuauaaaauuuaucacuagagauguuagauugguaacaugaacucuuuuguuaaaaugaucuauuguauuggacacugcagaaacaguguauuccuucucugaagucaguuuagaaguacagaaaauucuaauuuuuauuauuuuauuuuuguuucuguaguaucgggaaaggaacaaggaucuuggccuucuaggcaggugcacuacuacugagcuacauugccagcucuccuuauuucuaaguuagccucuaaguucuugcuauuuuuuuucucccauagagaucaaaaguugaaaagaaguuuaucugaaaacuggaaagagaaaaauaacuaccacuccgucuucgugaaaucaugauuacauguggcgucaugugugucuccaacauuaaccagaaaccucugacugacuuuuuggugacuuaucaaugaagaaauauuuucuguauuguccagggaaaaguauuuucuguguggaaagcuauugucaguggcucuagcuucuguucuuuguguggccgugacuucuguugauaauaagaugucuuugugcucauaaggucauugguggcaggauaggcuuauagaaauaguuuccagggcagucuuuggucuuaccuucagaguauaucuauggcuguuaacuuauccucuguguggcuaaauacuaaauaaacaaccuaugugcaauacuaacuguauugaguaagcgucuuguuuuacacuguaucagacucauucuugugaacuugacuaacccuuucagacacuuggucaucauguguuuaaugaaagccugguauaugucagucacuauucagaaucauuaacaacacucaaguucugcuuagauuucaugaguucaauuucuagguauuuacucaaauaaucucugaucuuuauauggaaugauucugauuuuagaaaaauguuauuuuuuuguagauuuauuuuuaauuguguguguauaugugugugcgugugugcauguugcacaaggaggccagaagaggccauucuauccucuagagcuacaguuauaggcaauuauaacccuucuaauugugggugcuaaaaaccaaguggguuuucuacaagaccagugugcacucuuagcuacuuagccaucuccgcagucccagcauaaguguauuuugguccuuuggagacuuuagaauugucaacggcauucacaugagguccuuguguuacuaacagguauggucguuuauauggaguauccacuugauaggaucuagaaucgucgaggagacaugccuccagggaauuucuaauuuagguugcauauggccacacucugagagauuauauugauuauguuacuugagguggugaaaaucagccccccgguggcaucuucccuugggcuuggauccuagacugcauaaaugggagguagggguuaucuaaacguucugaaucuuuagggaauagagucuaagaucucagcuuauguucaaacccaggaaggguacagucuugucuaacuacggcucauuuuuagugcauccacugucuuauuagaguuucuagugcuaugauaaaacaccacgaucaaaagcaacuagagaaggaaaggguugauuuggcucccacuuccacaucacagcccaucaaugaaagaagucaaggaaguacucaaggcaggaccugaugaagagggcaugggguaauguuguuuuacucaguuugcuuucuuacaguaaugaggccacaucaguccagggguggcacugccuauagugaggccagucuucccauauaaaucuucaaucaagaaaaugucccacaggucaaucuagugagagcauuuuccucuucccaaaugacucuagcuuugugucaaguugcuagcagcacaucccaucuucuuggccuuucuucaacauggugcucagacaccaaaacacccagcccuagaaacaggaagaagcgcuuccucccaguuaacaaaaucauacacccgcacuuacucuaugccaggugcugcuauccacauuuaaaaauagcaacucaauaccuauuuaaaaaauuccauagcugggcgugguggcgcacgccuuuaaucccagcacucgggaggcagaggcaggcggauuucugaguucgaggccagccuggucuacaaagugaguuccaggacagccagggcuauacagagaaacccugucucgaaaaacaaaaaacaaacaaacaaaaaaaaaaaaaaaaaaaaaaggaaaaauucuaugagguaagcugcauggcaguggggggugggggguggggguugggauuuggugcuuaugggacaagauccauuuaucuuccuggguaaaccuugccuuugaucccaacuauacauuauucagauagaagucaguauuccaaagccaggcaggcauagugcuuuagugcuuuacugcuuccagugcuuagaagccagaggcaggugggcagaucucuugaguucaaggccaccuugaccuauaaagcgaguuccaggacagucaaggcuacacacagaaaccuugucuugaaaaaucaaaaccaaccaaacaaaagcgaauugagaaugccgggacgcguagcaagugcauuuaaaucugugccuacugcaguugcucacuggagcacagugaccucugguggcagugaugcgugaugcuagaccucagguuuucacugauuccaggcacuucaaccuggagcugagaaagcccuagacuuaucuggacacagcagacagccaacaaaaggcuuauccuggaacaucucuuguuuagaacguagcagagaaaaggcuuccuggaacuggagauccaagucaggcugacugaauacgagucagcacacagaaaaggccgagauagaaggaccugggaaagggauauaggacaagaccccaaggcaaggcaggauugaacuuuuaacauugauugaauccaaucaauggcauaaacucaaaaaugguauuacugguauucuacucagaaaguucacauuugaggaaacaugguacuuacccaauagcauuuuggccuaaugauugcuguauuaauuuuuuuaaaugaauaauauaaauucccaaauauuaauaguguuuacuucuuugguaucaaaaucuguuucuugagcacuucucucugugugccauaaccuacccuuguaaaaaguaaugggaaaaacaauacaaaauuacuagcaaaguaaguugcuugcauaaacugguaauauuugaaaaggucuuuuuaaagaaacuuguguuguuccccaaagcagacaugcaauaaacagucacaagaagaauuauggcaugaccccauagccuguucaaacuagaagcagaagaguccacacauggaccaguuuuuccuaaacacagcaaauucacagcagccagaggccaaacuaccucagcuugacuaagucugcucuaaccucacaagagaaaugagcugaagugagcugaaucaaccugucagcuccuuuccgacaggcucggcucccugcguuacgaagcucacccuucuguuccugcccaguaccggcucuuguucuguuuuguagagugaagguugccccguucgggaauauaaaggcuaacgagaacuuugucagacuuguuaaaauucugccucuggucguaggggagagcaccgucuaaugaaaacuuuucauuaggacuguauguuccauucauguuagacuguauauccgaggaauggcuggcuacaucuccaaucuucacggguccucuuucaccaaggcauguuugaaguggauuucaggauccaacuguacucggggaaucucagaaaaagagacagauuuaauuuugucccaucuucuuuccuaucucuacaacagcccacuucucacauugcuuacaaacauaguuuuuuuuuuucuucccugagacaggguuucccuggcuguccuggaacucacuuuguagaccucuggccucgaacucagaaaucugccugccucugccucccgagugcugggauuaaaggcgugugccaccaugcccggccaaacacaguuuuauaaacacuuauuauuguguguuuguggggaaaggacaugugccuagaagucaaaggacaacuguguggaguuguuuugaauccuuccacuuuuucguggguucuggaagccacacuaaggccaccaagguugcacaggaaauaaauaccuuuaccugagacaucuugcuagcuuacaaacacaauuuuucuggcagaggaugcauauuauuugggaucauuuuauuuucucugaucaaaacaaauuagccagcugaacuguaacaagcauugucugagauuaugguuauaaacucauaaauacauaaacaagaagaagcucucccaccaaggaccaguucugucugcuuagguggcaauuucuuucuugcagguccaauaacuucugaccaugaaaauagagucuaucaaaagcaguuuguguucucggucagcaaguuuacuacuugcauagcuuaagccuuaaacucuuccacaguagacacuggguugugagccuaacaaagccaauuuaaaaaagacggacgccagagaauaauguugcuuuuugcaggauuccuggucuuauaaaaaaauaauuaaaacaaaacaaaacccagacucaguaggaaaccgaaaggcaauuuugaauuuaggggaaaaauaagacaagcuagacauguuggcagccucuggaggaggcagacggauaaggggaaaagagaccaugcuuuuggaguuaaaggucagaaaggcaggcaggcucaacaaugcaggccugggaauggcugcauggguaaggaaggucuucagccugauuaaaaaugcccagagccguagagcaagcaggguuaggaguguuggucaguauuugaaggagauaggaugaauaaaagaaaaguacaguuuucccagugaaaacaggcaggcuuagcgaugaggguuguagacaaagaaaccaaaaaaaaaaaaaaaaaaaccacccaacaacccagcacagccccccuccucuccccucucugacaaucagcucccgacugcuuggagccugacccaauggcuuguuaugccuauacaaacaauuaagaaccuaacccuuggugaccucuccccaaauugcaagccgucuugguugguaauagagagguggggguggggugagguggggcccaaagcuaugaggggaaaguucccucggugacuccaggacuguccauguuuuagcuaccuacgauuaguuuuuuuaaaaaaaaaaaaaaaaaaaagcucuucaguucuuacuggaccccugccagcuacuacuucgguaaucucgguauuccgucuaaugcuggcuguagccuuugcuaaaccuuccuguauucgagucucacuauuugauagcugcugcugaacugguuaaggccggagggcgccggggcgggcaggcucuggaguggcggcccggaggcuacaccuccccuucccccucccgggccgcuuucgcccucccaggggacucgugcucucuacacuccugagcuuucuuuccucucucacugccucugccuaggugccuuugcagcaccuagcucggcaaaaagaacauauuaaggcugcagugaacgggaagccaaggguuugcuuagauuuaucgccaccgcgcgggcuaaaucucccucauagagcgcgggccggaaacccaaauucccgcguuaaggccugggcggugaccucaggccuuccgagacuccgcccucacgcugcgugcagcgcgcgcucagccgcccuuacucuacacgcaugcgcaacgcgggccgagccgucacuucgcgcaggcgcacuucgaaaggcgcgcuuuucgguggcugcggucccggcagggagcacaggugggccccgguaggcugcuguucgccgcuaagccggcgggcggaggcugugguugccaugccggguguacuuugguuuuguuuucuucuguccguucuuggccucggguugucggagaggguggccuugggaagcccgcggccagacggcggcuggggcugagggacgccguugggcgugacgguuuggggucagucagccacagcuaccccccgcuaggacugcugggaaugcuguagcugguuugccaccuaaauguacucauuuugaguuucgugcuuucggcaauacuaacacaggugaauuuucuccgaaaaucagaaaugcuccagcaucugaacuugacgccuaaaauaacauccucaucaugaaacuuuuuuuuuuuuuuuaaauucauuccugcucagaaaauaguaucuacaguuaaccgucugguuauguagcuaauguauauuuuaaguauacgugaguuguauuuagaauggaguccccuaccugauguaugugucaauaccuagaaaucagacacacuccugaccccgagcaguuggacuaaagauacuuuucaguugugauaacugguuccaggccauacgcagucgcuacggccugaggggggaaccuuccaaagggaagaaauaauaauucauaaucuaucauauuucuaaguucuggggacccuauaaugcaacaaccugucagcuaaauaauggugcacgcuguuucuccccaggugacgacauagcuuaagagauauucucagagucacugcugaaagaacagauuauguauucagaauucagggccugggaaauggcuuagugggucaaagcugccgaaccugaggaccugaaucccuaagaacuguccugguaaaaagagaaaauucaguuccugcaaguugcucucagacuuccccaauuuauuacaauuaauuaaaacuuuuauguccagugucuaaagcuaggucuuacagcuucagauccuguguucuaaauuccuaugcuacuuugccacuaguaaacuagaguucuguaaaguucaaaaaugaugucuggaauauaguaggcccuccaguuuuuaaucauuuuaguggauaccaugaacuacguacuaaagaaaaucuaaauacaaugagaaguaguucuuguuugcagaagcuuccugucuaguuugaaugaccaaaacauucuuaaucagaaaauuaacaaaguaaagaaaauugaaauguaacucgguugcccauacuuuauagauuucuaucaagcacaaagguuaaaaugacuuagaaguguuagauaauacggucaguacuugugucauugagcaacagacuguuuuggguuguauguaguugugggauaugacugacuggaaaggaaggaaaacuuggucgauaacuucuaaauacaaagauggugguggaagaggacaguuuuuggagaaugacuagaauaggugauuuuaggugauagacugaaaugaagcuauaaagauaauuauaaucauugcgaaccuuuguggaggauauuuuccaaguuacuucuccuucagguucuuuuuuuuuuugagacaggguuucucuguguaacccuggcuguccuggaacucacucuguagaccaggcuggccucgaacucagaaauccaccugccucugccucugccucccgagugcugggauucaaggcgugcgccaccaugccuggcuuccuucagguucuuauuucugguguuguauaauggagaguaaaauaagguuaaagcagaugaaagcagggcuacuuacuugccucagaacuguugauccaguuucaauuuaaguaacaguuugacuagauguuaaguuucccauuauuauaagcagagauguaugcuuaccuacuuauaaugugguaaauuuuuuccacagcauugucagagauaauagcuauauuaaccaggagugguuacccuuuuacucccggugcuucagaggcagaaacaggugaaucucagaaacaggugagguugaggccagccuggucuacagagugaguuccagggcagccaggguacacagaguaacccuuucucaaaaaccuaccaccaucaccaccaucaaagcuguauuaaauauagcucacauagaaaguauugauuauuuagcuguacuuccagauaaauagaaauuaaauuuaaaauguagauauucuuuugcuuuaucauaguucuuagggaaccaaaugguuuucuuaaaauuuuuucaucuuaguaucuaggcaaaaaguuguacauuacaaaaguaguuuuuucauuauuuagugguagguugggcacauuugugucaagcugugcauguggauggcaggggacugcuuucaggaaccacguaggccugagaacuuaacuuggcaggccugugcuaagcucucuccuuggccccauuguauauuucccuaagauucuuuacaacaaugugaaggggcuuaugagacuaucucaggaaaaaucugaaauaaaaccccuaucuaguagacuauuuggcuuauucuuagaguuuauuuuuuauagguuuuaauuuuuaacacugagaaaugggggaaaauuuggaagauuugugccaucauguuucaaguguuuauucacgauaaaucauuaaagauaugaaacaugucaccaucuuucuguuccaugcagcucauccugugcugauaacaucgagaaguguucagugccugguaaaguacauagaccuugcuucacuuggaacucggccuugauuucugccguuggucauaaucagcagaguucucucuagugagucaguucuuuaacucucucagcucaauuuccacauuuguauagcagggguacaagucuucaaaucauuuucauaaucaccugauuugauucucacaaugguuccuucagaaaaauaugaacauccaaaaauuguaaguggcuugcauaauauuaucugauuuuucuuagaaaacagccuuaagauuuaaaguuucauuauggcaucuucauacuuaguuuugaccuguuccccucagugcugccuccuacccaccuacccuuucccuuguuccuucccucacuagccccucuugccuuccuguuaccugucccauugcccuauuucccuccucccuaaggaugucuaccuccucucaugaccaccuuuuguuuccauggucuacaaaauacauacguaaaugcacacacacacacaacacacacacacacacaauuucuaacgcuuuguaccuucuuauuacgugagucauugcucuauuucucaacuuccuaaaaaucacaaccucuucucaugauccccuucuaguucugaccuacaaacacauauaaauguguaugcacauaaaaucucuaaaucuagauuuugcauucugaaugucuuauuuugcauagcguaagauuuucaguugcauugauuuacugcaaaugucaggauuucauuuuucuuucuuuuuuuuuuuuuuuuuaugguuuucgaggcaggguuucucuguauagcucuggcuguccuggaacucacuuuguagaccaggcuggccucgaacucagaaauccgccugccucugccucccgagugcugggauuaaaggcgugcgccaccacgcccggcucauuuuucuuuuugacugcauagaacuucauuauguauuuauaugucaucauugauguacauugaaguuguuuuguuuuauggcugcuguaaguacuauaguuauaaacauggauacacuagcauuucuguggugcguggacuuagaauucuuggaguauauacccaagaguacaauauucaguuuuuuuugagcagcauuuacauugauuuuucuaguggccaaacaaauuagcauuuccacccccagggaauaaggguuucucuuucccuauauccuugacagcauuuguuuuguugaugacaacuauucugacugggaaauagaaucucaaggcaguuuuaauuugcauuuccccaugacuaagaauguugaacacuugugcaaguauuuauuagcuguauuucuuuugagaacugguuaguucauuagcacaguuuuugauuggaagauugagggaucguuuuuucaguuuuuuauauauucagaaggguaugugugugugugugugcuaaugaguguguacauuguggccaaaagaaggugucagauccucuagagcuggagucacgggugguugugaguagucaugugguugcccuguccucuacaagaacagcaagugcucuuaacugcugagccaucucuccagccgccuucacauuuuuguagaaucuuguaacuggucuggggucauagcuuagucuuagugaagugcuugcuguacaagcauaaaaaugaaaguuugauccccagagccuauauaagauaucuggcugggaggugguggcacacgccuuuaaucccagcacuugggaggcagaggcagacggauuucugaguucuaggccagccuggcauacagagugagucucaggacagccagggcuacacagagaaacccugucuugaaaacaaaacaaaacaaaacaaaacaaaaaaagaaaucuggacaggaaauaugguggcacauacuuguaaucaugcuguggaggacaggcugguccuugguguuuacuguccaaucaaccuguagccuacuuggugagcucccauucagggagagaccugucuccaaaaccagaguggacagugcuugaggaaucaucuucuccaccccacaggaggauauuuugguucucuuguauuuaguaagac

SEQ ID NO: 39 - RNA, 36095 nt, Mus musculus
cuccuagccauuaggaauuucuuugcugaagaaagcaagcccuuuuagagagggaggcugccuuccucauguccugugcccacuguucccagggaguggaucucauaggaaggguagcggugagccccgagaccuuagauuuuaaacuuacuuauuagaaaaggauuuuguagaguaggguuccuuuuuaugagagaagcuaaaauguuuguaagccuucuugaacuuguauuuacauaucaucacguguguuguacaugugcaugaguaugugcacacgugugugcaugcuuguugaggcuaaaagcugaaauuuggugccaucuugaauaaaguccuaagcccuaccuuuuuuuuuucuuuuucuuuuuuccuuuuugagacagagucucuuauugaacucaaagcucaccuauuuagcugaugacaauuacaggcauuggcuucagugucugaaauucuacauggggauuuaaagacaggcucucaugcuuggguugcaagccuuuuaccuauucagucccucuccuucuccucagcccuggauugcugcuuuucucuuuucuaacuuucuuuuuagauguauugguuuugauuuuuauguucacaagugcuuaccugcauguguguguugcaugccauggcugccuggugucuucagaggucauaaguccugguguugcuggaguuucagguuauggugagacacucuauagguuuugggagacaaacccaggucuuccacccgagaaagggcugcgacugcugggccaucucucuugcuuccucuuccucuucuuuuucuaagugcacaguuuuuaaauaacacacguuagcugaaaagucaugagaggaaaaaaauacauuccaaauccauuuacucagaacaacuaucuguccucucaucacguggggagggguugcucucuaacuuucucagugaccccugcuuuggaaaagaagcccugaagagcaaaaccccuucucuuccacauuauguauccaguaagauaaagcaagggcuaauucugucugguaagcgauuacccuuggguuacugcuggccuuggcuaugacucaggcugauauagcacaaacaggacaugcacacaggcccugccaugaagcacugcagucugucagcgagugaacuuuacucuuggucuucugcauaaagcucgggaccaauuuuucuuucugcuucuacaaucuggccaacucuucuuugcaagcucaggcugcaccccacugaggagccagacuucagggagagcaggggaccucugacacuggagaucuggggcugcugugccuucuagaggagagguccguauccccagaagauggggguucucuugauuaauacuuucugaguccuucuuuuccugaugguaccuagcacagcaggagaaacagccccuuccaacucccaaagaaacccagccuaaagacccuccuugucuaugcuugauaggaagggguuaggaaacauguggcucagagauguugauaucuggaggacagugacguuuacgggaacucugaaaaugcuauucuggacagcauuuaauugcuauuuuacaauagcccucagcaugguuuuacaagggcauuauucuauguguguuaggaagggguucggaagcaugugucccagagauaucugggcaucuggauaucuggaggacagugacguuuagaggaacucuggcugcacuuuuccggguggcacuuaauugcuauuuuacaauggcucccaacauaguuuuacaagggcauuauucuagguguguuaggaagggguugggaggcaugugucccagagauaucuggacaucuggaggacaaugacgucuaggggaacucuggaagggcuauucugagcgggcagcauuuauaugcuguuuuacaauagcugucaggaugguuuuacaagaguacauuguuaaccuaugcuugggaaaggaaaaaagaccuugcguucacucccuagcugaaucugaggauaucuguauauuugaccacaaauauguacaugagcuaagaggcugcucauguagcuuuauuuuuuaauuuuauauuuuuggacaaggucuuacuaugucuuggcuggccuugaacucuaagauuuaucugucucugcugggauuagagacucaggcugccacacccaggucacacagcuuuuugaguuccuaaauacaaauuuuaaaaaaccaaaaaaugaauagauaaauaaaaacccuguuagaaauuccaaaagccaagaugggggaauuguaagacugagguuagccuggacuauaaugaauccgaggcuggccugggguacccugucuuuuuuuuuuuuuuaauuagguauuuuccucauuuacauuuuuuuggggggggguacccugucuuaagaaaauaauuaaaaagaaggaaaaaaaucuauauaccaugaguuagaucuccagggaagaggaggcggagaaggcuaggcaagccacuggucuggaaaucuggcugcucuccagccugcaggagagccacguuguaacacucagagagaaaguacucuuucucaaauguggaccuguucuccuguuuuccuucauagacaccaaucugagccuucacagauccauuuugaguagggcuaccuacuagcauugcccagacagagaaacagaucccauccaaacauuagcauagguuuggcuucuuccagaauuucucccacugcuuuggaccacuaaauauuuuaaaaauuagguucugagcuccagagaagcugacaaacacauuuaagcauauggauuauuuuuuuaauugucguuaaacgguaagacuuaguagagauucguuuacagcauucucuggugccccccguuaccccauccuuauuuuugccuuuauuuuaggaagccagaaggacaaacauguugccauggaguucuguuuaaaauaaaauaaaauacaauggaaagaaaagcugcaagaugaaguaaccacauggacuacaaaauacaccugauacuaauuacugucaugaagaauguucuggaagacauuugacucgccugauguauacauucaaaucaagcaaagcaggacuggaaggcucccuggggacucuccuguccaacucuuuccuuuuuccagaugaggaaauaggggcccagacuggggaagggccuggaccuuggccuaccagcugggagggaacagggcugagauuccaaccacugcgcaguuugucagaaacacauagcuuccagggucuguuaccuuggccugucaguaaaggcuuugaagcugagggauacgguuugcugccaggaacaggcuuaggagcaagaggcccaggggggaaaaaaaugcaaaggcugacuuugcuguggaggcccuccuucucucaaggacacagggcuuggagcccagagaauggcuguugggugucugaggguccugucagugcuugccagaggcucacaccaggcuccagcucacguucuuuugggggcugcaaugcugacagccuucagggaccccuaguacauggcuacugaugcucucuaguggccgcugcaaucccacucgucgugggccacgaacaugagccuccaugacaaugcgcaccccuugccucugcccccagaggcuagcaacugggccuucuggugucugauuggccacaggggcuugacgacagggucuccuugcugaugauuggccccagccagcucuggcuguuuccuagcuaauaauacuguggguuaauaaaugucuccuguugacuauggugcugggagccauguuuuuugcugcauaaugacgucuguggcuggagaaggccucuuuagcuugucaggggccuucuuuuggggggcucuuugcaaaaaugggguguuuucuuucucucccaguaucugacacauucagaaagcucuuuuugaugcccccaaagcccuaaaccuucauuuucacccuccgaagugcaucgguuccuaccuuaacaacgcccccaccccugaaaaggccugagucaccucgccggcaagcugcugaucgguaacccugggcucagcgguggcuuuucucagugccucucagccccaggacccgagucacaguggcauccuaggcuugcuggccauagggggcuuacgcgaaagcagcugcagaggcguaaauaaggcggcggcggggggguggggguggggggcucuuccagcuucauguccuccacagggccucugacuuuccuuuuagggucucaaucauucucgcuccuuuucugucaccagacgcuucuucuuuggacucacaguugccacccaccugucaccccaagauagauccuucgucccuuucaacagcauucugaccuuuucgagaggacauuugauggacauguugcccccuuugccacuuaggguaggcagagcagccggagguaccaccuguuaaggauuagcucuccugugccaagucucagagcguccgcagccagcagcuacgcaccauagcaacaugugucugcuugggcugcggagaggggggggcgcccuucaaaguguggggaaucagcccgauuuggggguguacucuaagcauuaccacagggaccccauuuucacuaauuaaguacuuuucuuagggggcacaguugcgccuauauucacaguacacuccggguugcuggguaccccuguaacgggcagaaauggguccuugggaaagggcggaauagcgcaagguuuuuggugcacagguuguaucuucuguaaagccugggacucaaaaucaagguccuuuugccucaacaaugccaaauuccccguaucaagauaguccgucagaaucgggguacccuaugugggggugacagccuccaggcuaacauuugggaaucaauuauuuuaucugggauuuuuauuaaaaauuuccagugcaauuaggaaaaaacaacgcucuccuuuccuaagccggagccccugacugauguucugagaaacccaggcaagccaucugccgauccccgguaccccaccuuuauccuuggucgccugagaacaaucaccaguugggguuauuuccccccaguuucugucuacaaaucgcccuuccauccacaacuagggcucauguagggaaaaaucaccagcgaccacaggguguuggucauggcggccaggggcacugcggcagauuuuuuuuuccuucguucuuugcugcagucugggugcggcuacagcaauuugucauagaaucuggggggcucauuuuuccggccaaucacuuuuagagaaaugagcgcauugcagcagaaugcgcugacgucaaagaccaccccuucugcgccuuuauauaaaccccacccagccagccccuagcacagaagacgaagagcuggaauagagcucgccucggcucugcuggccuuggcugcagcucuuccagaaacccggggcgcccacagaagaaucucuuaccuggugagugguuagccauccuuugccugaaaggaugugcaaaaaugaagacgacaucacuaucuggcuucggcuccguccuccuggacaugccgaaaggccagugcuggggaccuucucccaaagccagccccuuagccugguccccagcauccaacacgaaauucugcaaggaaaagaauccucaggcacauuuuucucgcggguguggggggguccgguccacuagggcuuuuuuucucacuagugugggcagcgcgguagagacccugauuaagaaaagcagcaauaaugagauauuccgcccccaaauccaguguauuuuuguuucuggggucuaaaaaccugguuuugguggcugaaagccccccuuagaaucgcauuaauggugagagacauggcggcgaugcaucaucccgcaagccccauaaaaugggggggggguaccugaaaaggggggucucgagccaucuuuuucuccuagccagguucucggcggaacgugggcguaagauuuagagguucauguugaccagcaauucugaauccagauacucggguuuaguauagaccuaaccucgggcaaaauauagugggaaaaaaaauguaaccauuacuagccguuuccugacgcagcuacuuuaacagcggaaagagagggcgucaaaggcaaaucuagccggagacccccagaucacagagaaggcugcggaaccggggggcaaaggcagaauagauguggggggugggcuaggguagaaaaaaccccacguccuugcgucucauaggaaggaaaagauaaaaugcagaaaaggggguguguggagguguggggggugaucugagugcuggaaauuuggaggcaggguucuuuuuggcauugcgcaugauggcugcggcuagauucugacguguugaaggcuuuugacuuuugguaaaucaccuuuugccguuuccuuuguccccgugaagcccccccuggccgcccccuccucauucugggcuggcuggcugagggggggggcagccugagggcugcgacguggcagguuucuagaauguucuauugauggccgcaagagggcgcugguggcacugcggaauuuuggggggcgggguggggagggaagaggagguggccuuuguucuccugcaggagggggucgggagcgagauggguugcgggaccauggguucauuuaccuauggggaaauguuaguagauaccuggauucacuaaggugcgcuugcaggacuuacaauaggucagagauggcgucaucugcaguggcugugugauuuagggugucauggacgcagauuaauuuauuuucagugauuuguguuuucuggggucuuagaaagguguggcuuuuugaggaagaauugcaaaaaauauuaauuaauuaggcgucauccauaagggucuugagaguugacguggcaaagggggggcaagguuuugaggagaaggguguuaauuggguggggggaggcaggguggucugccuuuauuuugucauauagcugaagaccucaaaaaugaguguucuguauuaagaauugagucuuuaaauuuuaauuaugcuuaauuggauuuacuaauggugggugggggcagcguccugcuuuuacuuaucaggaguagaauuguggucugggggcagccccuuacugcagggucucuuuggugcaaggcggcuccuggaugccugugugugugcugcgucaugucuggaaaauggcucaggcagaggcgaugggggugcauagcgacccuuaaagauggcugaugugggcucugccccccccccccaagccugaaaccuguugggcgcccuccccccuccuacgucagucuagcucuagcagcugcguccuggcgccugugggggugccucaggugguugggcuauuggagucuuagugagugcgggccgcgcgcccccuagcggucucuaugugcaaaugguucuuggccugccagacuagcgcuagaguugcgcaugcgcacacagcuaacacuugugaccugucaaucaauucaucuguaccccucccauugcuguccuccccucccauuucuccuccuacuucuccucccauuucuacuuucccucuucccccucccauuucuguuuucccuccuccccccucccauuucuucucccuccucccccucccauuucuucucccuccucccccucccauuucuccucucccucuuuccccucccacuuuucuccccuaucuucccccucccauuuuuccucacuucuucccuccucccacuucuccucccuccucccuccuccuuucucccccccacccacuucccucauuccucuuaccccucccuuccuccuccuuucuccucccgccccuacccauuucccucauuccucuuaccccucccuucucuuccuucccuccaccccaucccugcuucucuucccugaucccucccaccccucccucuuuccccccaagccuuccccucccuucucuccucuuucacuugcccccucccucucuaugcuguuccugggcuggccguuagaggucaucaaggugguuucuaacaacccccucccauauccuaggcucucucuucagggaugacaucaucggcucacaccagucuuccaggaccaccuucuggaugccaaggcugcugcucgaguaccugcugugcaccucuaccuccugguaccccagccacucccucaaguugccugcauguuauauggccugugagcucuccugcccauugcacauucaucacccccagacccauuagccauuaaagacaacuuaaaauguuaaauaauuagcugaaauuauaauuaguuauaauuaauuagcuuacauuguaauuaauaccuauaccugggcauuuaauaaauucucuaaccuuugguuauuuguagagccaaggagcacggauuccaggaacccacuaccauacagagcaacuccuuguggaccccccugggaucaggacagcgagggacaagcgacaaagaggaucaucaguggccagcuaguuucucugggguucaaaccuugaaccagugcccuagugagggggcacuggccauggcccuugaccuuugcucugcuugugucuugagucugagcccuuuccuguacaucugugcucguguucaucugcuagugaacuggagugcugcccuccccgaggagggucgucccuugugacugaucaugcuguccuaacaauguccugagcaaaagggucccuuugggaaccucucaggagggggacccgggucaggggcgaccagcaucuugcuggcaacuccguggguggggugggguggggugcuuccuucuggaaugagcacguggcugaccccccaaggcauguccccucccccuccuccacccaccuucucggagaugucccuuuugggguaguggggacauuaggagcaaccuccuaggguuguugugagaauuaaaugaacugcagcagccugaggcagggcugggcagagaccucagcacauguuuguugaaagguuugcagguggaucuaguccucccguucauggcucaugugucucaaccauucucucgcagacuccugcagccccuaugcccagggcucuccuugcgccagguaggggcucuuuagacaacaggauguccgggagacuuugaguaaggacacgagugugcggucauuuccagggcacuuucuacauaaugugaccauguuauuccugucauucaugugucaaaggggguagccuagugucuagagaggaggggugaauuggcauugauuuuuauuuuuauuuuuuauuuuuucaugauuuuuaaagagguaggugggaaagagaacugggagagcccggacucacucaugagauugaacuuaaauucacacggaggacacuuggacucuugccacauuagguaagagaaggggucaaaguuggacacgggugccauuguggcgaccccugaugguccaguccccuguccuccaccuaaaguucuucgauccauaccaaacauuucacaaugggaaauccuagcuucccaaggguggucuuggggagcugcugggggugggggugggguggcccaagucugguagcaugugcugagaucaccucuuagggauggugugaccuuaaacaagucauuuagcuuccagguuucaguuccuuucacaccuaaauaggcauuucaaaaaaaaaaaaaaaaaaaaggagaaauaaagagagaaaaaguggaggguggggggagguggggggugggggguggggggaaagccagguugucuaccccacagagcgcuucugaagaccaaacuacauaacucacaagaaagugccuuguaaaucgcccggaaauugcaaaaaaaaaauccuuaauuagccaaugaggcugucccuacugcccagcggccagcccuagucucucacaacagugagcacccaguaggugcugggugucuuuguguucaacaaauaauuuccagaauucaaacaaacaaacaaacaaacaaacaacauucauucaacaaacauuuucugagacacugaccaugugcccagugcaccaggcuauggcugagguacaaagacaaugagaacagucucuuuuuggaggcuaauuaguacucucauuucuaccagcacuuucuuuggccuuuuaaaccaaccauuuuuguccagacaagaccaaaaaaaaaaaaaaaacaaaaacaaaaaacaaaacaaaacaaaaaacccaaaaaaacaaaaaacaaaacaacuggguugcuuuagggaagcccggcuuggaguggacaaugguguccaggccccugaaaggggcugauuggauuaugaggcaaauggaggcagaaggagcacgcaggagacaaaugcagugggcggagacccgcucugaguuaaucaggcugauugaagggaccuuuucugucuugccgaguggcccgggggggcucucacuagugcacugcugugugcacauggagacuggagcuacccuggucccucucuggcaacuguucauucauuugaugcucacaacucccuguccugacccagggccggccugccaucacgcagggaagcagaggucgccaagcgguuuccgacggggcccccccacauaacguuagccucgcggucucuucgguuuuagcagcaguggacaugaaccuguuuccagccugcauccuccaguuccucucgggacuccuggcuccacugugcucaccuggagccccgccagcccgccucccccuguccuccuuccucgccacuccagugucugucuuuccuucacagccccggcuucucgaggccugucuacacucgcugcuuuccuuccucaccuccaauuuccccuccaacccacugcuuccugacucgcucuucuccaucgaacggcucucgcucagguaaagacuuuucuguagcuugacccuuggcacaaugccagcucuggcuggacacaaggacacacgcaucuccuccauuccugcugcuccauugguuucacggcucugguucccuucuauuuccaacauuacuggcuucacggacacagcucuucuuacuuucccugggagcuuacauuccuagccccucucaguuucccaaaccugccuugugccacccagcugccaaggccaccuagagcacucugggccggguggucuggguucaggucuuagggaaagcucuuaaagcugggaccacgguguaggucagcucuuccaggauaccuuggcuaagacaggguuaauaggcuucacuuggaaggccaggugagcuuccaucagguaagacacugacuccuuagcugagggacuggaagagaaauuaauuagauauuccugagcaaaugcaauuugggacacaaguuuucucaaaguuagguucccacagagaagaccaaagagcaggggcaggggguggggguggggcugaagggguguacaagcaugacagacaguaaaggcaaagaaaggggauuaggaaccacuaagaccuccccagaccucaccuagcaaaagcuuuccuucuaggcuagccugugagaagaaccagaaggaagcuuuuaaguugauuacccagugacacaucccaggaagucuccguaucacauagccccauugaaggguuuugaguuccucuccugagguuuaaccucugcaccccuugccccuucccuaaugccuccccagacuggugauuaagucccgaugguacaggaggggucagaagggucuuaaggaaugauuggcucacuggacagagccaccccuaccccccccccagcuauguuuuuuuuuuucuuuuuuccaauucuauucuacuuuuugcccuuucuccuuaaugaacacagggcuaaucuugggccuuguggaaggaggaggcugcagcacuaguuaaugaggaagcugcugagcuccaaucgucaucucauaaggagcccucuuugucugcgaaggaaaaacacugauuaucauaaugagcugagcugguggcugagggguagggggccuuggguucuuaaggcacacuuuaaugucaguguuguagauuucccuccccccauugaaugggguugcauguugaagguagcuuugcuucaaggaacuuuaagagcuccacacugcccagccauuccuugucaccuagacuccugccaaguuccccagucucaccccagcaaucaacaagcccggugaaggggacucccuccucccacccccuuuccucaguggguccacuacagcaccaccccugugcuggacuugaagguaggguacuaggauagagcgaaggucuaggagaguagaagccacacacaaggcucccugcccacagugcagucaguuauagagacuucacugucugcagggucccuugucucaaguaucuaucaauaauauuuauauugagauaauaggucccugaagccacuucugauauucacaaguccuaggucaccgguucuccaaacuuagcagcagccuugagcaauucaaacaagauccccccccagccccccaccccuucugccaccagcucagcugcccuugauggcaggaagcuucuaaguaggauuccagguaacuacuuccugaagcacaguuugcucuccccccccccaccccaccccccaguccacuucccgggacucucaagggugcuugugugcauccgaggguauaaaaguccccuuccccuuuccguccaggcauccaggguggcuucagaguaguuggcccacaggcccagagcauucuggguacucaacaucuaugggaucaaucaggacauauuggggaguuacagagaugaagccaaggagggggagggaggaggcaggaaaagcacugcccccccccaacucuucugagaacaaccuuuucugccuuuacugcccauuccccuccauucucugucucagccucccucuguuugucucccucccucucccaauuggaucuggccccuguuggggugccccuaggccaccccuuccucuucugggugucccagcaccaacccgguaaauaguggggcucaguaagaguaugugggaugauguacggugggacaggcggacgaauggacgggcucaacugccacaucugggcagcuaagggucaggggguguggggggcucaagggaugugggaucaguagcaaccugcccuaggcucagcccccuuugagggguccuaugguugcgcccugcauucguccgcgcguuuacucugucauccacaguugauccuaacugagcgugcccaugguccuggcccugggcuuggcaccugccaccuagcuugucccuugauggccucugcuucccagggagggcaagcugggggguugucugggagccagagcacuggucucuggcuccauagagggcauucagagggcauggggugggccugguuugccugcccugccuucacgcagaccugcccacccccagggccuugccccccucucugccucccuccccauucauggcugaguacgggcuacuugccccccccccccgccuccccaaacucaccucaguugccaacagccuccuggugccuguuggaccaucccuugcugguucuucauuuccugugggccuaguuuccaggggcugagugaccagggucuuaaaacagguuuaaggcuuggcuugcuggcccuggagaucccgucgccgucuucgucgaacucgaaauccuagccaucguccuucccugguggguguuuaccacacuucccaccaccuuguccuugagaguccauggccccgcccuccuaggccccuugcugaccauuugguguuguuuugggggcuacuauccaggccugucgcgucuuccugugccauuugcuguugugcucagguuccacgagcugcccaucuccacagaagagcaggugaggccgcugccugucuucaugcgugugaguacagguggcuuuucuuuuuaggguguucugcuuuguaggaauucuaauuuuuugccuuuccucaaagcuggcauugcccaccggccaugccggcugaagaaaagaagacugaggaccccaggaugcccagcgcgaggaccccaggaagcccagcgcgaggacuccacccacgacgcccagcgcgaggacuucacgcacaacacguugcaacccuccuggauuagggugagucacuugcgccgguaaacacaacuuuguuagaauccacuaacauuacaucuucacuuuagaaguuguacagggggagggugcaccuuaccaagcgccgcacacucgccuggacgcugccuggagcugagagaaagacuguugccacgagacagcacgcgugggagucccuccuggacccugucuagcagggaccagagacgguagguggggguagggcacauguacacucccagaaauagccagggcaagaaacacaguaggcacacaacauagucaacccgacugacuauguucgugauaugaagaauccacaggcccuuggcuuugucccaugcagagauguggacaugggugguuauccauccacccuugguggggagacauuucuccccaccagccaugguggcgcuguuuacucagaauuucagccuugccuacguggggcuuugacuaaugagaugcuguuuguuuuuuuuaugugagcuugucuuugcuuuccuuacuccugacauugcuuugagacagggaauaugcuggagaagacacagaagacuccaucacacuuccaucgcuuguuuuugaaccacaaagaaugguucacuuacucaagacauauuuguagagccacugaaggguuguguguuguguugggguggguaggaccgaaacauaggguugaagggucaggugaggagggcagcuagccaucaagguggcuuaaagaggaggguccuccugcuuugccccacaugggguggugggagacauuggagcaauuugacuggguccaggucugaccuuggccuaguugcuauccuuuuuaacaccuugaccuccaugccccugucucaagauuccucccaacuugucacccugcuuggaggaggccuugccuuucccauggagcagcuuccaugauauucucauuaaaugagauuuuguagaugcuccuauagcgcucagccuuucucccucuggaguggaaaugggaugggauccuauuacuaaacaaccuaauucacaaaggggccaugcaccuaggccuggcguuugccugccuguuuuuuuguuuuuuguuuuuuuuuuuuuuuuuccucucuagagggcccaguaggcuguagagaggaggggugugugccuagggcaccagaaggcucugucuugugacauuuacuccguagcuggcauuuacugagcaaccugcaaacacagugacguggcuagcgaggagggcugggggguggggggggaagcuuugcucagggcaggauacaggcucccaggggcaucgaaucccgagcuuagacaaagccacugccuggguagucugagucgagugagccaagggcuugcagcucugagcuuguucauuagggucaagcccagaacuugggagguaggcugagccaagugguuaggcuagguuaagaugaugcgaacagacccaaccaugagacaauaugcccacuuauccuagaguacuccuacacucugcagccggccccaccuaccuucccaggauucaaggacaggcuuuacaugaagguacauuuugagugacugacauuucagggacuguggaagcuaaaucucgggcagauagauuugguagauuuugugugacauuaguuuaaagaacaaggaagcauacuagguucucaauuaauauacaauccaccaaccucucggacuggguuuaggaacugcagaggggauacuacuccugagaaucaauagaaaugauagcuuucuggaaaauucuuuuugaugcuuuggagacugccagagggugauaaaaaggguggaaaugaggccuggaaugucaagagaacaggcacagggaccuugccaccuggugggaagaugggaggucauuugccaugguaauaggcacuuagcuccccaaaguucuuuccacuugguucuucaugaggagggcagacugggggacaagauaguggcuucuugugggagagagccuguccaucuaucucaggagugggcaggcaagggaggccagagcuaagcugagguuacucauggagggggcugccuuugcuucuacauucccuccugcaagcugcuggcugcaguuuucagggccccugauuugugugauucaaaccccaaauguauucaaaaguacauuucucuaaaugaugucaaaaccuggcaagacuuuggggcagcaggacgcauauguuucuuauuccuucauuuacaugaaguaacuuacauuuuuuuuuuuccuuuaugagcaaucugacuucuuagaaugaaaaaaaaauucuaccgaucuuuuaacaagcugguuagugaagaguaaggggugucacacaaaggggguguggagggagguaaauuaaggcccucaaagguuacagagcaguggacagugaagggcaauaaagaagccaugcuggaggaacugggugggggcagcugucuggggagcccuuucuucucuagggacuggaauuuaacaggcuggaaacgagucccaagagcuacccccucuucugcagccuugagcccccaucccucucagagaaaaggaggaaaggaagauucaggccgccauuccuaguuagagaagauggaaauuucuaugagagcugggucuuucugagugagacuccauaaggcacaggggucucugaaagagagaggcacugggugggugguggggaccccugaauaaagccuagcugcucguggacaccuuggucucuagaagguuucugaggaaagggguauuucagggugaaguugccuuuguggcauagaaaaauuaguccaguaggaguuagggacacuuuaggaaggagucucugaugguguuuccuucuggguaccuagaaacacagcaacagggcuacagagcagagcagcauuaggagaggggaccugggucuccaucucugaugcaaguaucugguguguccugguuuugucuggcccuggggccagugucuggggccccgccucuuccuuugggaccugguggcuuuagccaggcuucucaggcauuguccauguuuguuuucucaucuuccuucauccccaaguccagggugugugugugcgugcgugcgugcgucugugcgugcaugcauguguguguguggugugugggugugugcgugugugugcgcgagcaugugugugaagggcaggugucaagugacggaggccaguaguccccaucccuccagcucaagcaggaugugugugggagaggaauuaauuaaggugagagcagggguggaggguacgguacaaucuugacuuucuuaauugcucucuaguuucuuugggcuuaagagaaaauugcagauggugaggucuucccuccccgagccugggaguggggccccagagccuggcuccccaccaccuugacuuggccuucucuucucucagugaauagggucuuuggcuagggcuuaaggaggagacucuuagccugggagcuccgaggcccgcugcagcuggaaacaaaggcucaagcagaaaggaaugugggggagccccgcggagcacagccaccuggggauaauugggagagcuagcuucgaugaguuucccagguccugugaauggcuccugucaauggaaggugcccuuucuucagaugaaaggaagaaaacucaauuaccuacucgacaugguguguguguguucccagggugcuguguggggcuccugccucuguguguguguguguguguguguguguguguguguguguguguguguugcaccuaggagcagaccccuuugguauaauccccaauguugucacugucugacccuggggacucuucagcuuguccuucccagggcuuagauuuguguaagucucuugggauagagcgauaggauuaacuauaggcaagaaugugaucacauugggcccaaagcccaaaagaugcuuuagagacagaauggggccaagggauaguccagaaugaagaguuaggggaaagaggacugugggaggggccaaagagugagcacaugucuuuucuggccaccagggaccacagcuguguggcuuuuuuuuuuuuuuuuuuuuuuuuuuuugccuuccagcauguucucugggucauucuguauguggcuagguagcugguccuccaggguuaggaaacugggggugggagggcugguggugauggcaggggucugaaauuaaaguaggguaugacaaguauguaagguuagggacauagagcagaaaaagcagagugaccccccccccccaccccgaccagggguuaucccacuacugcccuagacugucccaaggcaaaaagucccugcuaggagaaaaaguccugguuaucagucaaaguugguguuuuugugacuguuucugagccucaguuuaccugucuguaaaucggccuaaucagaccagagccuuucuguaaucagacacaguccuuguuuaaccagagaagggcacgcagagguccauaacuggacacuguggaccuccacuagcuuucugguaggucacccuauugcuccuuagaaacugucagguagucagcggacagagcccagaauggguacuuagguccaggauagacagcugucuggagcugccuuccacugucugaacccagcccugccuauggaugugaccucagccucugccugcagcccucggggucauccuuucuccauccuuaagaugaggaguacaaauuuguagucaucugagaccucuggaauuugagucuguaagugcugggucuuuggcacaccaggcgccuuggcagccuuguuucuauugcuauugucccucugcuuuggaggugagggggcuggagauuccagagggucagaguguccagcuggugcagcccugggugagggcugcugauuguagguuccugagugacaaguguggucagggggucucagagcucagcuaguucaucacugacagcuuuuagaaaucacaggucuucguggaagccguugcugccccuugugcuauggcaaagguauuacuuauuacagggaauuauucaaacaucccauaggccaggcuggaaaacccuuuuugggccagagagcaucccuuguguaaaaaaacuagacccauauuuucccugccaggaggaugugucccaggggugcuauccagaaggggucauugugcacccauuggucaagaggcauccugacccacucagggaagaauuucuaguugaagccaccaagguagcaacuuguaaaaacagugagugguacccacucaccgccacccccuuguguacucuucccugggccucagcaugguaaucaggaacgcacagaccuuuucugucagucugugcccgucauuaccgugguggaccgcagcuuuuguuuugugaccuugguugcuacaauaccuacgagcugaaaugaggaaucaaaaaauugccagcuucaauuagacuggcagacuguguucuuaaggcugcuucagccuuucuauccauuaaggguaaacauguaccaaauagguccuaauucucucuaauugccuacuccugaagcaaagaggugaaauuccaggaagaggcauauauaaacauccucugaaacccgaccaacgaaaauuagagggcugaugggggcccggugcauagaaggggacaugguuucaaaagaugucccaauuaccgcucccauuuucauaaaugggcccguaauguccagggccugggucucaacaaagguacaggaaaugagcucugcaaagagcuuccauuugucaggggaacuugcaagaggguaguauuuucucaacagguaggaagugggaaaggcugaucauuugcguaacugcagacucgauuucuugaaaucaacauuuuaguaaaaauaguccuuugacguuuuuuuccucuguuggaaacaucagugagauauuuguacccaaaacaagaucaguuagguccugugugccuccggaagagagaaacuuuuaaaaagauuaucucaggaugcagaguuagauguucuuauccuggugagcugugggggcugcauugacuacgcccacccuuguuuuguauucguagcaugagcucaggacauggauuuacaaggucuuccaucaaacguuugugacagugguuccugcggacucuauaaaaucuuguuuuuuccuuuggcugcagugagucaucucugcagcuuuucugacauuuguuaagauuccaaccccgcacugcguuauuaauacaucacgcagaucuggagcugguacaugcagcuuuuaaaccaaggcacgacuuugccaggguuacgugcuagcguagcagccuggggucugcaugccgaguucauuaaggacagucaggcgcgccuaggguccacaggggccuggaggagaggcaggaaaaaacccagaugcccugggcugcuucugauuaccucccugccauuaaaaacaaaauaggggaaaacaggaguggacgagugaaagcccccagcucagguuccugcaaagaaacagcagcgucuuuggucuugcuguguguucuuggucuggagucacccagagaccaugguugugaugaguggccaccauagccuucaggggucauggggagagggguauucacuaugcaguuagguaguucugagcuauaagaugaccgagugcuugggucacccacaucuucugguuguccugugaacacuuauuuuuaagauacagaaucaagcaguuggguuugggaacacaggccagagaagggauuugcaggaggcuuggaaauaagagguguguccuaacugugaccuggaaggguuuggggguaccucagucagagagcuaccuggcaauggaggguauagguggagaaaccugucuguagaggaugaaguaaggauaggguagagagucucuggagagccagcagggcagguaucuggcagccugcgcuagguguuuuucaggucccgugguucugugcaucccagucuauaacauccuagagcccaucacacuaaagucccccucauugucuaucucucaggaguguccccagccucccauuaauuccucugggucuccuguuucccugcaugucacuuaaagggguuuauucuccugcucccauccugacccucacuuccagacacagcagacucuccucuuugccaccuaguuugaccauaaccagaugcuaauaacacauuuuaaaaaucaacucauuuaaaacauguuuuugaacagucauuuuauuuuauuuucuucucaagcaguuugaguuuguagaacaaucagggcagugacuauggggguuggggauguagcuccaugcuugccuagcagguaagaagccuuaggguccaguccccagcaccaaaaucaaacucauaggcaguggugcauguaugccugucaucacagcacuugggagguaaggcaagagggccagaagcucagcuuuagucucuaugacauagcagauuugaggccaguccgggcuacagaagagccuauuucaaaaguaaaauuaaaauaaaaaaguauacagaaacgcccuugccccuucauuggcacgucguauacacauagcucauuuauuguccugccauaguacgauccugacgcaugguuaguagaauggaguccaugcuaggaggcugccacuacauuguacuuuuugugggccuugguaguugucuagugaugugagucucacaguuuuaccucauguuugagauaaacccuggacuuguaaagacuugguauacugguguucuguugggucuguuacacuccugugauaugguuagcacagaagugacugcacggguaccguagggagucaccugucauccuuuguguggguauguauguguguguguguguucaaugguuauuuaagacacugcccacugaaaacccuaugguuguagcauagcccacauccuggaauccugaccucuguuguguggcccucuggccagcuuggcccaugcugagucuugcuggcccacugacuuguccagggcacaaccugugcccuaccuucaggauguucucagagcucuuguucucagggcuacccacauagguaucaguuugcauuuuauaguuacagaaucucuaaagcuuagcuuacacuuagcagcccuuagcccaccaugcaggcuaauaccaaggcuuuugguacaugccccauccccucuuagguagcugguaggggugagcauggaaugagugcguuaucuccguggauuucaaauuuguugaacuugagagucccugcuuuaagccauacuugugacuuucauaggugcuuuuagccauacuugcugccuucuuugccagcccccuccugguacuugcuuuccugggugggauucuaucccgugacugcaagcuuucugauuuuuagccaaagccaucaucuggaauccugcgugggacccuggacacacggacacagacaccugcccccaggacccuccaacuguaaaucguaaguggcuagagaacagagagcauacguaauggcugauuggguggggguuccaaguacccugucaggcgagcugcagucugugcagauggaggcgggcaggggggugggggguguugcccagugagccaagucgaggguugacccggugcuuguguuguaagaugggagccuccauccgccuaguguugucucugucucaaaagaauucuauaggcugcuucaagugugggaccccaaaagaauuucuucuuuuucacuuuuccaaaugaaugggccuuucauugcggacucucccucuggcucuuguacugacuaggauuggaagcgcccuugugagcuggggccuucaaagggcugaggagaaaaugcaggccgagagaccagcuucucaaauaggcuucaagccuccaugaccugagcucacccccuggaaaugucuggaaaacauaaugggcagguuuucugucuucaaaguuuccaucaaaaccucuucaaguucuuuauuguuuaggacugagacacuuggggacaguaauggggacuuucuuuuguaucugucuugaaaggccaaaauauuuuuauauugcuguagacaaagccaccuauuuacaaauggacucuuguuccgucguuucccaccaggaagaccguacuauguuugugucucuauguauucuggggucuugaaacagguuucucauggggauggccauucacuagagcccagaggggcagaaggggaagugucuacccugccaagggggucuggggaaggaggggggcuagucucagauuugcuccuuguaugucuaggguaaacccugggagaaucuggugguaaaagaacauaugcuguguuugccccacaucugccauuuguguguguuucugggcuacggguuugcacacuuuggugguuaacauggugggaggaaguaagaagggccaagagggcacgggugcucugguuuuccugcugggaggcuguuucacugguguguguuacaucacauaaugcauguuuagcugggugagugacaacaguaugaagggacagagaaacaaauagguguagaaagagagucacagagcacacagucaccauucugugcccaggcguucauuaaauguucaauagaaugcugagcucugauagacagagcgggccauggacacacugguauugggucaucauggaccuaaggaguuuuuuuaauugaagaaggaaucuuacauaacagaagaaagaauaagaagagcugucaaaacgagcucugagguuuuugaagccccuuaauauaaacagacagacaauggcgugaucaggaaagggagaaaacaaacaaacaaacaaacaagaugcuuacagaaauacgagaggacgugugagcaugcaaagagaacccagcuagguuaguaucggggugcugguggaucguuaauccugucuggguaccccagcuccaaggggaugagaggcagcaagugagaggacacauaggaaacuguaacaagacagaggcgagcagauggggagcuucagcggaguguuaagcuaggcuucgcaaucugaccacuuaacucucccagcaaagaaaagaaaggcuuaaauacuaaaaagaaggaaagcuggaagaaaggaugguagaugugaaaggcauagaggauagaaagcaauagggaguggagugcaggugcuguggagagacgcuugcaggugacucaauucaccagccugugcagcugagaaagacagccagugacaaaggagaagaagaaagguaacaauacacucacaaauagguagaugaauguagcuggaagacggggccuggcuagggacgggaugagaggcugugucagcagacugguuaauucccaucugugcuucugagauggacaaugacccacccgaccaagagaccuuucaggcaucaauaugucagggagggcuucaauggggcaauggaggcgaggcccauuaauagcagauuaugauguauccaauuaggugcaccugcccucuggaagugcagaaaccaguauugaaauggaaagaaagacugaauggaaguccgagaguacaaaugaauggaugggaaaaaagauuugcauucgcucuuagggggagggugcugcugagccccagggucaucugaucucccggagaauaaaagggcgagggagugauagagaguaacaauaagauggagaagaaaugaaaaggaguacagagagaauaaguggggacaaugaagucuaggagcgcggcuuguuuaacacaagucauccauauuaauucaaaauugaggcccugggaugggaugggcuguguccaagggaugaagcuguugccuagcaugugccaaguucuggguuccaucuccgccuggcaagacaaacacaggaaacaaaauuauagcccagagguuguaaauguuguuuuugaugguuuugggacaaagagcuagaucgguuggaagauagagaaauaggaagaggugggaaagaguuagaugagcacaagaggaagcagcaguucuuaagauaaguguuuaaauauggugaaugcguagcucuugggugugucaagaugaaaauaacgaaaagaaacaaguuuagggaugacggcacagggaugagcggaagcggugacuuuaguuaaucaccguggccaacucaagcccugucagggauuuaaaaaaagguacaaaggcgauaaaggaagacacaugcaauacggaagagagagacaggacagacagacacagcgaaaaggcugaggacaugccugagagggucgcgaagggaugagagagagaacagcgagaauucugcuuaauucaaaaccgggcuccugagauagcuaaauaucuccugagcccaaacaccagcacaggagauuaaauaacaaaagagcugcaggcagacccaaguggagaaggcuugggacccucagaucaggcuucaacuaaaucugugcaccugagguccauaaauaaaagaauaaauauugaaauaaaggagugacagaaaggaugaaugagcacacaugacugaauuagaaauggaaauggcuagagcagccaguaaggaguggcccaugggacuucugcucaucuuauucugggcaccugaggucccuucgugagaagaugcagggagaagaggggaagggaaaggcaugagagcaaaugaaagagaggcgaggagaggaaaugagaaaguggcagagaggggaagcgaucggugggugccucggaagaggaauguccacgaggauuaauaacgaggcucucauuaauccuaaagaucgaugagguaauccagacccagguucuuaaggggaaggagaauggagagaauuaaaaaaaaaagacgcaaaaaaaggagagaaagauaauaaaacaagcaacaugaugaauggguaauuaagagaggcugucuggacagaaauaguaaugaguucccaugcauaguccuuaaauagauaaauacauuauaccuuucaaagaaugcgugaaaaaucgaagaacaccauggcccccaaacaaggcugcaccuuccauugcuguaauaaaauacaugcagcggagagccauaaauaacggaaaauacuuaaauguaaaaggugaccagacagagggagaagauugcaagcccagauacacgagggagggaggcgauguuugcuuugcauguguaauacaauuauguucacaggaaauuaauagauuuaaaaaaaaaauccaaacuaagacugggagaaaaaacaaggaagagagggaagcgagaucugagagauggggcugagacucccgggguaggcucagcaugguuuugacuauucugcacauccggacuuagaaaagugaguuugucagggcaggaagagaaaggugaaaucuggagcgggcagagcugggcagauggauagaaaaggaauggaaacuacacagguugugugugugugugggggggggaagugggggcucuaagaucugagguuaggcuuguuuaaagcugagccauuguuguccccagaggaaucaaaucuuacugcuuuugugaaggaagagaggauggcaacgauauugcaggaaaagagggaaggggguaggcaaggaggcagggaggaacuuucaugugcuauucgcugacugggauugguaauagauagcucuuggcccaccacaagcugcuuccacacagccuaacugacugggagcagcuauggaucaccauggccauguuuugcuugcagggggccauuucacugucugucacaucuucaguccauagacacaucccugcacagugcccuuuccauagacguggauaggagggaagggcucaggccuggggcuguggagaugauugcaugaauagggggcgcuaugcccaguggguaccuugucuccucucugggaaaggaucucuucugauccugaugggaaggggcuuagccagccaaagggcagggauaggaggcuuugucugcugccugcuggcuaccaucuugagugugacuuacaccagggugcagacaaagugagcuugaccuggaagccuagaggcccaagaggcccgggugaagcaaguaucucugagaucaagccuacccuucagcucagagaguggaccccugccuaggcucccacacaugauccuaggucccagauaugccaccccuggagcccguuucaaggcccaucuuccagaauguuuaaaccuguguauguaaccaguaaaaugggaguuuguacuguguauugaaucugucuucuuauuggccucugugggcugcugggggagaccuggagaguuguuuauucuagugucccccacccccugggacucuuugcuuuugcccaguuuucuuucucuguuguggauaagauuuuguagaguuguguguuguaugcuuguguuugaccauuaaaaaaaaaaaaaaagucacagcccuccuugauuucucaauuccuauugggggugcuaaauuccaaaccaaaccaauccaaaccagauucaugucaagugcccaacaggaggauaauagcuuggcuggaucaagggagcaugugcagacccaagaacagaguggacagaugggcuauaccgcaagggggcuuugagagcugagugcaggcuaaguagagagaagguauggaagguuggggaggguggggcugcugcuaccugaguugcugagggucugagacaccagcaaggaggaggggccccuggaagaagcguuuugagaugacugaagauggaagaugggcgcucccuacgcuucuagcuucaagguuuuuaguguacgccagccgccuccgaucguggaagacacagccuaaccuugucagaagccaccuucugugcccccagcaccacgugucugggccacgugagcaacgccacgugggccugacguggagcuggggccgcaggggucugauggccuccuguuucagaaucuggggcguuuaucauccuugggacaacugcugaccuggcuccggaagauuguccacacaagucugagugacggagugagaugagggggcggguggagaugcucagaagaaaacagccuuugcaugggguucauuuccagcuguuuagagagucagccaaggugacaaggugggguuggaugcggagaagaaugcugggacuacaugugggcuacagcugugaagucagugacauggggcagcauggggaugggucucuaggugggccuugucucaacauucaugccagaagauuggaagggguaccauggguuacugugggucagugggaccuuggaaggaacaagggcuuggguaggugacuuugccaugucaccuugggaucuaguuguuuugagucuuugacucuuaaucugaucuugaauaacaaaugucucuaguucugggguucugagagucugugguaggauucccuaggauucguguggggagggcggucugcaugugcucccaaguuggugucccagcccuucugccugcucagggcugucuuagacauauuugcuuuuccuuucaacaucauaaaagaaggcaaauuuugucuuuugauugacacucauaugcaaaccacaacauccuuucucugauaauacugggaccuacagcucuccucggcuccccccgcuauuugagcccaccuuuggggcagguaggccaaaggcccugguguuuucugaggugaaguuguuaauguaaagauguguaacucagagcagggggaagaaacacacccucaacucugcuuccccgugcuccaucuuccuuucugccuuccaaauucuuaugaacaccguuuuuuuuuuuaaauuuuuuuccauuuaaugagcauccuuuuuuuuuuuuuuaaagcuccauugguggugcuuacuuuucuguugguguuuugugucuguugcaaugagcaucuugcuguccacguuuucguugcuccauggucucucucaccugcuugaguuccauugaauggcuaugacauaaugaucuacccaucuuacuguugcugaugcaugaucaucuccuguccuguuuuuuuuuuuuauuuuacauuaccgaugacaccauaacuaauggcuuugcacaaccagcuuucccagcaucccuagcgcccccuacaucuagcucuucccaugguuccuuucuuuucuccuugcuuccuucugcuagacugugagcccacucagggcaaggagcuuguggaacugcgcucuguauuucuuguaggaugucuaugaauguugacugcguguguguguguguguguguaugugugugugugugugugugugugugugcgugugugcgugugugcacgugugcgugugugcgugugugcaugugugcgugugcguguguguguguguaaggguggacagguaugagugauggagugauugaaagauuggcagacagaugagaggcuagaugaauggaugagugaaugaaugaaugaaugagugagugaauuaauggauggguauauucucugguugagcuucuuggaugaaaggguaauguuugaauggcuguugguugauugaagaaagccuacaguauuuuaucuugucugauaauguauuagcauuuaagcugauguauuaguauuuaaggugucugcugacuuuccucaccucucuguuaaaaaaugcuuuuguguguguaaaacuuguucuaauuacuaaugaaggcugaauacuuuucacccauguuuguuaacaaauuguaucuuaucuucugugaacuguuuguccaaguccaguggcucauggcucuuucaggcucuugguugaggguguccuuagacuaggcaauggccuuucacagauaucuacagaaugaugugagaggcucagcugacuucuagcucggcauuagaauuuacuuacccugggaaacagggaggcugauaucuugcaccagcagguagaaaacacuuuuaggcuugugucuggguucaccaugcauuucuagcuugugagcccugaccugugcucuguaccucuugugguguggcaguccuccaccuuguccuccugagugauagacuacauauaugccucuccccuguucugggguguagucucugaggccaugucuuagaggaacuggcuucuuagugcucugucuagacauccccuuagcucuagucuucccaugcaccucaguggcagguguggucuuaauuuagggaaugaaugagaaauucaguucaggacugaugugacccucagguuaguucuaggagcaaggccauuuuauggucucggcucuucccaaccuccucacagggcaguuauagccaucuggguaggguguguguuccgggagagcucauccugccauccagaacucccucccacacucuauuauagcacuuagcgugucugccuguguucagcccucucaccccaugcuuaucuggacauugaagcuuggaaagccaguggugacuucaacugacuuuuaauucauccacccauccaucuggcuauccaucuagccaucugucagucaauccauccauccauccauccauccauucauccauccauccaugcauacacacauugggccuccaucacuugaccuggugcuuugggccucucucccucuccugaaagcaaaccccuucaccuugggcaagcugugugauaccaugggcuguggucaugaagcaaggcccccauucacagccuccuccuccuccuccuaggucacggcucugagcacgucccagcuggaccccuaucaccacagcuuuuucuccauaaggcuucucacaccucacacccuccuccugugauccaggagggccagauucccagagugcccuggggcuggcccuucccaccauccgcggagcugccuccccaggcuucacacugccuggugcauggucccugucaugagcuuggccuucaccuuugcagcuuccuccaccagauggcagugguugugacucgugugcccauuccuucgcaccuucauucauucauucucuuacagccagcaagcaucucuuuaaaaaaaaaaaaauuagcuagugcuauacuagagccggcucacaagcacccauugcaccacuguccuuugaaagaaaagauggggacauuuguaaagaagcuguguuuguguggccaauaagaggagcuccuugauuucaauucaaacuucaggucugaguucuauugccagcuugauugcucucuccaauuuuguuccucacaaaacuagguugauuaguaaucagcaaacuguguucccugggugcucagaaaucauagcccagauccuuaagaggcccaaauggggaguggacuaagcacgaagcagcugccucuggcugcgagcaggcuuucaaggcugugagacacucuguucuucuaugaggaugaucugagagccguucuggccacuuuggagcucagcuaaugcuuggcuccuuuuuagagaaaauugcaggagauggaugcucguacaagugacaaggaucaugucccaauguccuuucugaauaauccauucgcagacccaggcgagcaaggcacauggcacuuugcaaaccccuguguguuucaggaggacccaugcuaggggaggccuccuuucagcuuucugcugugaaggggaagagacgcagggcucuucugaguucuccucccacuagacgcaguaggggcggcaaggccagaaccuggagcuggacaaauugugugauggaucuugccucagggcuguugugaggauugguauaacuggacacuucugacugugacccuaaaaggcaguguaugugucccugggggugugccagagcauuggaaacccuagcccuggaguggggguggccuugcuuggguauaauggggaauacuuuguaucuguuaaauuuguauauuuuccuauagagacuuuaacaccacgggauaggggacucuuuagauaguaccugugcccuccgccccccucggacacauccacaccuaccucuaggagagguugggguugucuuuagcucucugacugaggaccaagccucugacucagaacuguauauggcaccuaguuacaucccuuuccaaaaggcucuucccaggggagcacucggcccgaucuggcagaccccauugucccuuucccaauguccucucucccacuaacagcaucaggccaaacugccugagaucuggugccuaccacagugccuggccagggguagggcuucagugaccuucuguuguauuuguguagguagaugaguagcuaacaauuguaacagguccuaggggcagauguguauggucucauucagugguuuguaauggagaauguaucugaacccauaucaagccaucucucuuccuuaacauguuaagcagccacugcuguccuggguuguuuugcaccuugccuuguugucuuucaugcuaaguaaaaaaaaguccugcuuucugcugagagucuguuucuucuggaacucaccuaggugugaucuggcagggcugcuaagcugugucucugccccucugacccguagucuucuucucucucaggugugcgucacuggcaagccuaccucacaggguuguugugagggcuaagggcugaucggcuguaacagugugauguccaugcuggcugucaccagggauggugccaugaugggguuggcuugaaaucacaaccuauaccguuauuaguggucacugaauaaagagucucacuguggacacugagguuguauauccagccgucgaugugguauucgaggcuggcugugugguccuggcuaaaucuggugugguucauucaugcauguuagcgucuaagucccucuguggugcccuggccuucccuuccuuuccaucaugguggcuggugcugcugguugugugaaggccaaagcuggcugggccacuaugcuuuggggcauuaggagggguggugucuguugguagaugcuucuucaagcuuguguuucuguguauguggugugugcauaucugcccccugggacagugccaagaaccaagggucaauagaggggcuuccaaauuaugacauccuugaauuuuuucuuacugcucucucacuuuuagcugguaggucuggguggcuguucuccuccccgcucccccuuucuuccccugccaggagaugagaaaaauuagcuuucucuacaccaaauucugcuuuggacugagcuuagguuuacacacuuuacuguuguccucagcauggucccauucuauggaugggcagacugagaaccagggacaauagucauguuaugugugaauaacucuuuccacuccaccaaauaaaaccucagcaagcccagugucuuaggcucaccccugccugauccuggcaugcacucagaauggucucccuucugcuuugugucccacuauccaccuaguauuuuccuggcaggguaaggcauggagggaggagcaaggaggcuguguccucccaggucucccagucccggagugucccaguccaugucugucugagauucacauuucccacgaggcucuuuccaugauguuggauuccauccccaguccucguccugugaaucugggcgagcagccuuccacuuuuccacucuuguuccaaguccacgccaagaagcccccccacccacugcacagaagcccagccuccgcucaguuccuuguguuacucuggcuuucaaagcccuggugucucagcccuagaugcucuuaaacccuugguguugucacuguguccucgggcucaggaccccguguuuucauuguucccucuggcugccaugucuuucccuaucauacuccauuaccaaaaucccgacucugccucccucaggcugugucugugacugcuacaguucauccugucuuugacaacuucuuggaaccuuugcuucugugcucuggggucuugugguaggcacaugugggucaggucauuugcucagguaauuuugacucugugucuaggugccuggucucagaugggccuuuggccccuugugggccagguuuuugggugacucuuagguagcuuaugucucuuggaaguaaagaaagggaagccaggggccuggcaaaaagggaaugcuuagauugugacuaagcucuaggcuugcuccaacucaaugucacccugccucuugaaguagugggcaccuaauacuugcuccaugaugaaguagggaaggcuaagugaauguggauaggccggugacuaggaggucuuuaaggacuuuccccaggaucuagucagcuacaggacacccuuccugguagaaacacugcuuuggagauauuauguccagaauaaaacuuucugagagcuaaaauguccucauugacauuuugaccugagugauccugaaaaggaguuguuuggcaguucccaaauucuaagguggacuuggcugugcccauaucaucaccgaggccccucucucugggugaaaggagauuauuucgcccccaaagccuuuguucccaccauuggugacaaucagcacugacuuagaaguuaccugugagauuuggguacagccucaagcaccuggcagacuggggagauuggaccccuugaauucuucuuuucuacagagugcuccguaggcacaugggugggggagggguucccagggucuuacccauuugggcaucagaccuguuuuuguuuuuuguuuuucuuccaacugaaccuugagcagcuugccugaaucauccccagccuuaguuucucuuccuguacaaagggugucauuagugacugcccaucauaugguggcucaugagaaucaaggucugaguucuggucauccuugucccuuguggaacgugugguggccuuggcuguuugccauauccuagaaauagucaaaccaaccugguuugauugggggauucagugagguuuuuuuugugugugugugaaaacgaguguuuuguugcuugguaugcaggugcucaugucugcuaacccauacugacuguuguggaggugggcccuggguacagauguaccuuaguuucugaaacuucagguccaugugagacucggacagaguggagggcaggaggguagcaccuacccagcucuggagcgacauagaaagccuugcuuucaaauguuaggauucagcaguuuugaugggaggcucugagauacaagaccaggaagacuauuaagaacaccccucuaggagggcaaggccaaagucuuuggaaaaccaccaagguuuaauagacugugaauuggcuagaagucuugggggugguaugagaaagauggaaaauccuagaauagguuuuuauuuauuggaaaagucaggagcugguguguagguguugccccacccccauggcuguccagaaguugggccuucuacauagcucaggcuuucugagcacagggcuggguugcccccuccaguuccuacccugccuagugcaugaaaacucuuuaucugccauggggauggggagcagauggcuucaucugcagcugugucucucucagccucuacagccacggggacgccuugcacauuuccugugggacaugcuggacccaagacucuggacccuggccuccccuugaguagagagacccaccuacugacugaugaacugcgcugacccuggggucaggcauguggccuugaucccuacccauggacccugagacuugggggggugggagaaaggcuguugugucuucacuguugagucuacaucugugaaaugggcucagguuccuaccucacagggcuguugugaggcagccgcaaugugcuuagaagcauggggccuaguggcucauggugcuuucaauaaauuu

SEQ ID NO: 40 - RNA, 25235 nt, Mus musculus
cucaccucuggccaguccaucaccuuccucaccuccaucauccucgcuucugggcucacucuggccgccagggccuuguacaugguaggcuuucauucauuuuuugcacauucggugaagguccuacugugugccaggcccugugccaggcaucguguagauggacguugcccuugagagcccacaccucggggagaugcuuacaaacugcuggaugggaagggagccugugucaaggcugcuuggguguggaugcagggaggagguguaggugcagccccugcccuacgauuuccaaaauaaucuguaaggagaggccuuaggugaccucuuuguuccaaguggguggcuugucccagaagugguacuagguacucaguccacuagcacuaauacccucccagaauggcucacucccagauuccugcccccagcagccuuguuucccuaucaucuacacccaggucucugggucagcaaacccaggagucugcuuuguuggagauugaucccuggccuauuuucugugcacuuuggggcucuggguggggggagggugugggaucucucugucugcuguuauuaaucauuuuuucuugaucauaugcuguuaaacuacuauguugggaguuccugguucugagaaaccugucaguuuucuuugaggguggguaaugggacuuaaagguucccuuaagguuugacacguacuugacauuuggguacugugguggcccucaggccuauaccagggcucucaggaauguauuguugcaaugaaucuauuuauacauuucaggauguucaauuaaaugugugguuuuuuuuuuuuuuuuuuuuuuuuuuagauuuggaacuggaaugggguuggcuauguuaaugccuuggugccuacagggcugagguagagggacaucaaucucuagaugcuuaaggaggagagcccaaaccccaccagugaugugacccuaccgcccccuccccaugucacaaccaugugucucaccuccuuaccugagucaccugaaguuucugucuaccugagaugcuuccccgcucacagauccccuucagucccuccuucuacccaugugugauguucaggcucucauugucacacuuaaccucugucaccucuguguuacacuagguccgauaucuggucacagaucacaggcuuccuccuaccacaaugaaucccucucuaucuacccuuucaucacaccgaaucccucugugacucaugccaagcugccuccacgugugaacugagccuccugagguucucucacucuugucagaccgcccuccuggcuacugugucuucuuccuuuaccugagacacaguacgggguacuugaccaaaccccucuuucagguguguccuauccugaccccuuuuccacucugugucucaugaacuccccuccaguuaucauaugaacccccaaccuaaauugagucuaauguguccugacuaucucgucuuccaaugccauaacaaagucccccuuuuauguccuacuaaguaccccuccaccgaauuauuacuuggguccucugcccucauuccugggucacauugaacuaugcuucuauucuaguaucacacagagccauuuacuaaccuauaaaucucuaucuagucaugugucacaaucugugacccuacuguaugugacauggacccaccuccucuuuugauaucaccucgaacuccuccccuaccccuuuagucccugccccaccuccaugucaccccaaguugcuccacacuggacugucacauagacauccuccugcauccagaagucacacaaagcucuccccacagugaccacacaaguaguucaguaaaagcugguaucuucuguaucuuguguuguuucagugcuucaggcugagucuacuaaugucacaccaagcccacucuccuccuuagugucccaccuaggcucaugcagcugucccuuaucugagcucugcccugucuccucaugugucacacacacacacacacacacacacacacaccucuuccuucgcccacacaccacccucucccacguuuuagguagccacuccucucugugcuacuaaugcaaacuccugccaggccaagugcagaguuucucccaccucccugucaguaagaaacacgugucacacaaaguuccuccauucaugugucacacaagccccugugugucacaccaaacgcccaccgcugggauguaucauccauagcccccacaccuaagugacauugaauccugccuccaccccugucaccuggagucucucuccucacuuacacagccacugagucauggacuucucaauuugugugcuagaccaagucuguuacccuccccugugacacugagucccccuccccccuccccucaguguucacccuugcucuucaggcauguagaaccccgccugccccucugguuuuaccuaaagcacagcccucuugcucucuugagguccucuccucuucaugggucauguugaccucaugcuugugaauugcauaguccccuccccuuuuguguuucacaccaauucccccucugccaccaggugucacacccaugcgugugucaugccgagccccuuuuguacccaugugccacaugaagcacuaccuuccuguguguccuccccugugucacuuugaaccucucauccccauuugucauaccaugcuccagccuaugugccucaaacagaaaagauucuccaugcuucuuaccaugagcacaauccaccucuccugacaccuggagucuugccuccuugugucucucuacuccugccucacaugcucuuuuccugugacacacugaaccccuuuccucucacacagacuccccucggucaccugucacaccuuucucacagaaccguucuccuucuguucaucacauggggucaugccaccuagguaucaaacugguccucacugugcuauccuaagucuuuccuuggccgugugucccacaguuccucaauucuccuuuguguuaggcuaagucccuuuucaacaguggcacucagaguuaugagcucucuacccucgcacaagacauuugugucucuuuuccaaguguuucucaucuagaccccauuacaugucaaaacuuucuacaccuaugucacacacagagccccucccaccacccaugaaucacaacaaggguccugagucacacugcgucucaucucuccacggguaucacauucagcuccacuccccuaccugggucagaguaaguuucucuucccuaucuuuacaugguuucccacuacaccugcuuugucuuggacagaccccucccaucaggcugcacuuccaagacccucuguguucauguguuaacauuucuuaugucuuauugcuggccucacacugaguccucuccucuugucauccuguguuaggguuaggcuauugucagccaugugucuuaaagagaaaauuccauaauggggcacgcuuugccuagcuccacccauauguccugaagagcaccauuccucuacaugugucaugcuuagccuaacccuuccuacguucuguaugcccccucucacaccugucguggucaccugaguucuacccauguguccuagagagagaacaccucuccccacgugugucaugcuuagccuagccccacccgugugcccugugcacccgagcuucaucccacuuacuccccauucaccuuaggccccucccugacucugagcuccuccaucgugagagggccccuaaaucaugugucccauagcccucguuccuuuuagucaccacaaacccugcuggugcuccagaugcgguacacggaacucuucuccucucgcucucucuucauguugggaagccccaccucugcacgcagcacguugagacauccaccccuugccuugugacauggagcgcucugccucuacacauaccacacugugacgugcauguccuccaggucacaaagcaacucauaggugucacaucuaguccuucuccccacuugugaugaacacuuuccuugacagaugucacaccgagccccuauuuccucuaucagagccccuccuccuuaugucccacaugcagcccagucucuuucucaggagucauaggcucuccuguacaagagucauacugagccccuccucuuuuuaugugucauguuaccccuccucugcacaucacauuuacauuuuuucuccccuguaccauggauucucucccccauguauagccuuggaccacuccccauccgcuagauuuaaucccuuaaucucuccauauguuacugacaccccccuguguagguaggcaucaugggaugucccuguucuuuucuuuaugacaugaagacccccucuuugcgugggauaucauauccuucaucucucccuugugacauacgucacccugagacccuccugcuucccgugagccaugucccuaugcucccauacacauacaugucccuuugcaacccucuucugcccuggaugaugugcagcuguguuccacaugcugcccugagccccccuucucucucuccccugccccacugacaucugcagcaucuuaccacagcauugagcugccuuaacccuuugucauucacaugucgugugcagcucccuuccucccuggcuuaacaccgaguccucccuuccccaccuguguucaccugucuucuggccucccauccuuacuacucccucccacccccauacuaccucuuuauacccugcucucugagacuaugcugggacaaguguuuguuggcaguuggugggugugccagacaaggaagagaagagcacaagucaggaaagauuuuuuuuuuuuacuuuauucauauguaaggugauacacaugugccauucaagcuggccauggugacagaggccugucaaucauagccacacuuggaagccugaggcaggaagauggagaagucgggauccacucuggauuacacagauccuguuucaaaaacaaacaaacaaacaaaaaaacuaacaggcaagcaaaagcaguuugugguuuuuaguuauucauggaggaguguaacucaaguugacacucaaagaaccuggggagcgguuguuagcuguaccugcaguuuguccccucaccacacugaguagcuuuuaacccaugcaucuuuuugggggauccaucuggggcgucuaagcuccugcugguucccaugagucccuucuaggucugcagaggaacccacuggauacucgggauggaccuuagcaggacacuccugugaccacagucacccuuccuucccucuccgcuuccccaccccuccuucagugcucccuugccccuccucucucccucccaucccucugcucccucuccccccuccucauccccuggauuggcuccagucacuccaugagaguuuauaagaagugagguugggcaaggaggguagaugcuuccacugugcugcaggugcccuagggcuggcuggccuuugguuuccuuccucuaacacuaagcccugggagucuguccuaccuguugucugugcuucuugccuugcuuuuucaggagaggagggucccaguguagugagaaguuggggggugggaacggcgucaugcaggaguugauugcacagccauucagcuccuauaugaugccuuucuucacccccuucaaccgcgugaggccuccggacccuccuccgcgcaccuugggccgcuuagggacgcgucuucagcucgcucuuuuccccuggcaugcuuucucgccauucuccacaguuccuggaggggaauacccggggcugggccauaccugagaucauuccuuggcgggggagcuauaccccuggugggacauucccuggggcugggccaagggucacccucugacucuguggccaaggguagacaggucagaggucgauccugggccuacucuggggcuccucccacugggauuccaggagccguucucuccuggagguccucugaggggacccagcuccuagcagaaaggguggauccuugagagauggggucuuuguuacuagagcagggcacagggcugagacagggcagggcugagcauuaccagugcucccagaacagggucuccuugaggggccucugccucuauccaggauuauguuuuuaugaccaggaggcugaggucccuuacaggcggccucuuacucucuccuugagcccuucuggagacgucucaccucauucaguucaaacucuggauccccuaaggagugcagaagaucccuguucauccuccucccaggccgggugcccacagacacuucaguagcacaaugagcagcuggcguagagucugaaccccaauaccuaggucauugcaugcauacagggcccaucuccauccccacaacaccaccauuauuaacugcauuuaccagcuauggcagccagccccggcacacaggagcacccugagugaauagccuggaagcugugaaaggauuugagggcaggacagggaggacccaggccacacccagucccccuccccuucaccacugucucucccuucccugucccccccucugcccccaaucuccuucuuccuacuugugcuccugcacggucuugguggcaagauggucaugcgugucucucagcucacacagguggaucaaaguccagaugagguuugcugcucaggucucagaucgugucuaacgaugugguccccugggcccagcaccagggcuuaagguguaugggacaguugagggguggguaauauuuucuuuuccuuuucuuacuauggggguagcccaaguuagcccagguuacccaggcauguggagaucucugcuccagccuggugaggagcugguaaaacucuggacucaggguccugugugugugcugucacuggcucugguaccugcagggacaucuuauaaggggaagcaauggagaggacagggaaggugggcaagggagggccccugcuccucuuuguuccuggaugcugucagagcucucugguuggggacugaagcugggaagugggggcagcuccuugguggguggagucugcagccagggccuggccucugguuuucaccuugacaggguuggaagugauguuaucauccccuagcaggaacuuucacaccaauuucuuucuuuucuuuucucuuccccaggagaaaaaaaaagguuuguguuguguuuuucaaucucuauaaguggcuccgccgauaaccugauaaccuaccguuuuagcacguuuuagcacgucaccagcucucuucacaguccggaccaccuccuuuugcuguuaauggggacaaaucccugcuggguagauugguaggccugcgggccuuuauuguccuuuauggucuguguucgugcgggcuguggguaaacgcaccucugcagucaacaucacuggcagccucuuggcgggcugcuggcucacugaguucuccuucacucucacuugcuuggggcccucagggccuuggggccccuggcaguaguccugaccuaagucaucucugcauucacugggccagagaaguccucaccaagcagggacaggauuguuuuguuuuguuuugaggcccaguuuuguuggaggugcccagguaaacuaagugaggguacaggacugguacguuuguucuccuccaauaggaccccagucccaccuuaagguuauggacgcuccuuaggaacaggaggaagugcugagugaggcugagccccugaccuugaaccugggauccuauccaugaucuccuggugcuaccgucagggguagauuccuugucaugaggccccuuaggacccauaaggacacagugaccccagugcaggcuggagggggcguggagggaugcaaucuugcguucuaaguaggguuuuucugggacccaagcuuauagauccuguauagaugggaucaaagagcugaaagcagguagggggaggugucaugcuggguauccaggggucugacacauucucaggccaaagagggccccuugagguuaacucagggguacauuuccaggcaagauauaaagggcagaguuaagaaagggcccuugggcgugagggcccugcucauugcaccugcccacuaucuuugaggucacagugggagggggcccuuguuuuuauacuccuagcuugugugcagauuuucuggguaggaaguauagaguuugugaguaagggacuauuugcucaauuucccucuaccccuaggagcuccuuccccaucccagaguaucccucaagauagcuuuuuuuaaggcaaggaucucaggggccaacugugggaaugguuccaguggggggccacuggagccuccuuagcaacaggaggaagugcugagugaggcugagccccugaccuugaaccugggauccuccccaugaucuucuggugcuauggucagggguagauuccuugucaugaggccccuuaggacccauaagggcacagugaccccagugcaggcuggagggggcguggagggaugcagucuuggguucuaagaacuguuuuucugggauccaagcucaaacauccugccuguugacccuccucagcugugggcauugagcacagucuggccauuccucauuucucaugugacuagagggcugggaccagaugagggcugggaauucuggguacccuccuucugccccaugaaacccuugguccauuucccagaggagcccaaaguuuugagagugaauugacuucccucccuuuaggagaagacaggaggccuguugcuccaugucuucaugagcuguuucuggagagucaagcccuccuaucccugccccucccacccuugcccuugcccaucccaacccucucuucacacuccauccuuucugaccccaugcuccauguucuccaguccugccuccuacuauccacccucucccuuuuagaacaaaccacaaagucagauaaucuuuucuucucuuuauucauggggcaaaagcagguaugaguugggaaagcaauggaaggaccucuccuuccuguggcagugagcagugggucuggucagagcacucuuggcuccuuggcacaguacucuggguaucuggggcuucaccagugucucuugggggcucccuccuuuauggaaggucucuguccccugcacuguccauauguccauuuggggagggaaaagggagccccacuugguugcuaccacccuuucuuggguccucugagucucagggaccuucaggguggaucaguccaucugguaagucacacugguacgucgaaugcuccuuggagcaguucugcccagguaagaucagaguucagggucagaugaggugucaauggagccggaccagaccgguaguggguggguggguuguggggggggggguggacuugcuugcagggugggcugggguuguggaaagcauggaaccacagcaccuugggagacugggagggaguaggggcguguccaggggagucggagcaccgguguagagguagaaguccguggagcacccaaggucagugucccaggaugcacagguggccgccugccacucaggggguggugguggggucacuggcaucugcuugcuuggcugcaccugcuguaucugcucugcaucuggccuggggugacggggucacuguugcucaucacugcucucuccucauuggucucacucccuuuugugggccuggggcccggacaguuaggacaguuaggguuacacagucuuggcugguucugggacgcugauaguuggcuaguucuuuagcacagaugauguugcugguugaugaaguuguggcccuucacaaguggguuccccuuggguuaggaguagcaagagggugugcuggaucugagcgaagcuggccgaggcacaagggaaaaugacagugacuugguguguuuucagucaaguucaucaucugagucugauagcucuucuagccuugccuguucccuggcuggggaaggcagcgccauucuggaggccauggccaggaaucgugugagggccugggccaccugaucucugcuaagcagaguaaggcggccaucggugcccaggguguagaguagccgguuguugaggaaaucuaggaccucuggguccaaaagauuucguggucugaaggugaccgcuuccuggucgccaaacagguccucuugcacgucguuguccugcgcguccugcgaggugucuugcaggccgucaugcaggccacacugacgguaacguugcaggucgucuugcagggcuucucgcaagacgacaucuucauccccaacgacgugcaguuccaaguaccggugcugguaagggucaggaaagacgucauccucaggguugacucugaccccaaagaacucacacagggucaaccagaacccaggggugaagcgcaucccccguggaggcugggaaugcagagcauuccgaugccagcaccuugggcccaggaaaagcucagccagcucucgagcugggaggguguuggcacccacuagagggggcaucuggcugagcaacugagcgauggcuguggccaugccacuacucgcaaugagggucgaguccaggaugagucggagugugugccggugcugaggccuggccacuuccaaauuaggggcaggcacuggggagaggggcugccuugcucucaacaucaccaggacagcugccacacccaggagacucuuccaguagagcaggccacggaagaaguuuaggacaacggcccggaucugggccacacugaagugagccaguaagccauugaggauaugguccaucgggauggcagccaguagcucccgcaccaugcugggcaccuccucaucuucuuccuccucauccucuucuuccucaucuuccuccuccucuucuuccuccucuuccuccuccuccucuucuuccuccucuucuuccuccucuuccucuuccuccuccucuuccuccucauccucuucuuccuccucuuccuccucuccuucuuccuccuccucucccuccuccuccccuucuucuucuucaccaucuuccuccuccuccccuucuucuucuucaccaucuuccuccuccuccccuucuucuucuucaccaucuuccuccuccuccccuucuucuucuucaucaucuuccuccuccuccucuucuucuucaccaucuuccuccuccuccccuucuucuucuucaccaucuuccuccuccuccccuucuucuucuucaccaucuuccuccuccucuucuucaucauccucuuuauccucagucucagaggaucugucaaaguaccuuagauuugcccuaauggacauaagcagcagugggcgcagaaaccuugcucugaagccucucugguuccaacaucugcggaagagugcuugugugucaccuucagcuggcaucuccauaacaccaaaauugaagugugagaagaagaagacccaaugcccggggagaaguacggugagccugucauuauucagagaggcuagauccucuguguugagaaggaucaugaugggcuccucgguguucuccagguagcggcaccacaccaugaaggcagcccggauuggaaggauccucaucuccacucgaggguacuccaccuccauuguagagaggggucuugaauagaaagcacagguagauuucuugccaguuucgucgucgguuuggaccagggaggcagacaggaaugacccagugaugucuguuuccaaguagaauggguucugaggcuuagggugauagagaacgggcgacuugcggaaagcccucuucagggauuccaaggccuccugcuccucuucuccccaguaguagggcucugaacucagcaguugucucacuaggggugcugcgaugacagcgaaguucuccacgaaguggcgauagggauagacaaggucaaucacacuuugaagacaccuccugcugccagggacagggcaccccacgaugagguucauaagguucuuguucaguuucaccccuuugggggauauguugaagcccaagauuucagcggucuggcgauggaacugaguuuuguccagugaacaguagauguugugauaccgaaagcggaccaggacuuggcggacaugcugggaguguuccuccuggcucauugaguagaccaggaccucucugccauggcaaaucacaaacaacccuaggaugucuuuuaggaugaagugaacaauguuguucccuucgucagaguaugaguucauugugaagggccgguagcaucucaucuggugaaggccgaaaccgaacgaugcucuccaagugucuuccgugugugugaccgugugccucaucucacuuuccuuaaucccaagcagcuccaguuuugugaaccaugccgcuccauguagcuggucgaauagcucugguaccaucugcguguagucuugucugucagucagcaugucauacaguauccaguauuccucuugcucccuggcuuucucuugcugccuggcuuucucuugcauccuggcgcucacagguuccaaagucucucgggccccagacucguaaaagacgccgcuuugaucacugucuccagccugcugaagcucagagggcucugauucagaaagaucaucggauccgucugagcuuggcuggucggaagucucaucaucugccucccucggguuaaacacgucggccaggucugaguauguguguggcaauccgggcaguaggcuuaugcuguaugucucuagugcgaugcaugguggagguggggugaagcaauuccgcagacaguagggagaguggaagguacaccggccucucauccagucgacuucaggggcauggguucggagccacuucaugccuaagacgauggagaaguugggcgaagguaagaugucaaauucgauguacucauaaugcuucugguggacacauaccaggggcucggugcacagccagacggguucauugccaauugggaugccauccacaccuuggauuaucuguggauaaggcuucucauagaguuccacauaguguuccugggcaaaccucucauccauguaguucccuucugcuccugaguccaccagggcccgcacugcgacacugugguagggguccacucucaccaagagcaguaagaagaggugaucgcgaucaaugucuggguggaacucauugggcagccagcugcuuacccuccacuucucuggggcgggagcauccauccaggcuacgcuucuugggcgcgacucagguggcagccugaguaaugcucuucucucugccagcuuuucuucaaguugcaggacaaguacaaucagguugucuagggaauucggcugagggauccggaacagauagugccugaucucuucguugagccccuggcacaggugggccugcaggacuucaucuggccagccuaagguggguaucagaccccggaacucauugauguaaucggccgcacagcgguuccccugccugauguugaacauggcgucuuccgccacacgcagggucugccgauacucaaacuuuucugacauggccuccaggaaggcugagaaguuguuuaucacugggcuguucugcucuacgaggucguuggcccauuccaaggcuaggucagucagguggcggaugacgaauuucacccgcagcucaucauuguauagcauacuuggguaguucugcauugucaucuggcagagcacgacaaacucaugguagucucugcgaucuccagagaagggccugagggagggcaggcgaccuucguugauagccugcaucaugagccuuucugccacucucuguuguucuuuuaggucuugcauccggaggaacagcgagaugacguuccccaugguggccacgacuucuucuggagaguucuugggcugaccuuccucuucaccaccuuccucuuccuccucuuccucgucaucucccaggucaguaucaucuuggucugacugggucucggaugaguugauuguuucauccaugcuauaaucggaugccucacugagugguuccgacccuuccugguuugaaauaucacuugacugguuugaacugucgcuugacuccugguucgaauuaucgcuuaacuccugguuugaauuaucacuuaacuccggguuugaaucauagcuugacuccuuuugugaaccaucgcuggacuccugguuugaaccaccgcuugacuccagguuggaaacaucgcucgacucuggguuugaaccaaagcucgacucaugguuugaaccauuacuuaauucgugguuugaaccaucacucgacuccugguucgaaccaucaucacuugauuccuccaugucuugggguagaucguuagaugaugccucacaggggucgcuggauggcuccuccacuucccggaguagaucaguggguagcucuugcauuuccugguaggggccacuggauggcuccuccacuucccggaguagaucaguggguagcucuugcauuuccugguaggggccacuggauggcuccuccacuucccggaguagaucaguggguagcucuugcauuuccugguaggggccacuggauggcuccuccacuucccggaguagaucaguggguagcucuugcauuuccugguaggggccacuggauggcuccuccacuucccggaguagaucaguggguagcucuugcauuuccuggugggggccacuggauggcuccuccacuucuuggaguagaucagugggcagcucuugcauuuccuggugggggccacuggauggcuccuccacuucuuggaguagauuagugggcagcucuugcauuuccuugagggggccacuggguggcuccuuuucuuccugggcugggccacuaucugagcccgccugggccucaaccugggccucaaccugggcuucagccugagccuccgccugggccuccaccugggucuccgccugggccuccgccugggccccugccugggcccccgccugggcuccacugcugccuggugucucuucaacgguguuggaugagcccucggaggacuccauuuguuuugaugauggauucuuaagcuccaucaucgucucaaaugagucuucagaggguucuaucaugucgucgguuggaaaggagugugcucugaagacugguaagauugugauguguguggucagagaccgcaacuguggagaccaaaaccuagggacagagggauaaaagacaggagaaaauguagcaauuuagguucucaagauggcagggucagauucuaucucaaggacaaagcagaugccaaguuacuagaaucagagagaaaauggagaaauuccuccugcauucaguucagccuccuuuucugguuacuuggggcaccuccaggggaaagaccgucacccccugaccugccuuccaggcggagucugacuaccccaccugccuacuuccucuaguggaaugagaaauucacagcccauaaauuuuguggagcaacuggccuggagcguccucuguggcgagcuagcaccuggcagggcacacuucuggcccgcuuugcccuggccagguucccuucccauuuguagucacccaaaagucauaaaggucacaucucaaugccacucaaagcggcugcuggcaggcuugguggucuagagccagcccagugagcuugguuggaggcgggaaucugcagggagaugccugcuauuucacaaacuggggaaagaggagaaauugggcacuuggccacuauccugccaguugggucaacagccaaaaauagcucuuauuuccuccucuaggcuccaagccgaaauaagugagagagagccauggcuuuugguuuuaauuuugcuccccauaaauguuuauaaaaugccuacuaugugcugaaaacaugcacuuucauggcuucauccuaggucacacuuugugcauaugcaggauaagaggggggugggggagggauaguaucauuucucuuguucgguuugaucucuguccaaagccacguuuucuccagcucugagcugagucggagcuuucuaaacacccuuucccgggcuuucaaaaaaacuguucucccaggauugccuggucugcagggcuccugcagcuuuaaacaucuggccucaauucugcucaugcaaacauuucugcacgucucacaaaugcuaucuuuccaaguuucuccucugcuucggcaggagcaggguuuucguucucaaaagugcccccccccccuuuucugucacuguugauuucgucugguacagggguauaucuaacagagguaugaaguugggugaaagggggggcaugggaccuuugaaaucugauuguuccguaauuuuugaaaaucuagccauggaggguuuagugcacggaaauugaauuuaaagggauguauugguuugcaaaacaaauuaagcuaguuauucaauagcucagccauauagcuauugucuuuaugaauucugcaccuucuguuacuucucaauuuucuuuuuuaaggucacugggcugaccuauccaaaaacagaaacacacacacauacacacacaaaaccaaauaaacagaaaucucccauguugucauucauguaaaacucccguuggccauccuccaaaccuugcagcaggaugcuuuugggucugcaguuucucagaauuagacaucuccuuguuagcaugacacuuaaauucgaucaugcaaccccucugauuaaagccucucacuguuuauuuacugucggcaauauuaaauccaaaccuuuuauauaaacaugucugacauguaaacuuaccaaaaaaaaaaaaaaaaaaaaaaaaaaacuccuggcugaaauugaaaggccuuagcauaauguccacguugggcuucucauuccuagaacuggagaucacagguccugagccugcuguacagaccaucagcucagaaacaugcacagcauauuacauaaaucaacuuauuuccucuuucaggaaaagucgucuauuauuaaaauauaaaauuugacuaauucauccccaaguucaucugcgggacauaaaaaucucagcaggucuccaccuaaaaauugcucaugguuucaauuuuuaaauuugcagcaauccgauuuuaaagcuaaaugauacccguucuaaauaaaaugccuauacuuaaaauauuacagacaaauuugaucauguaagggauuagauauuucugcuuuccagcccucaaccaaaaaucucuuguccuaaaaauuuuaauaugccuggauaucagaauaaaccuuuaguugagauaaacaauuuucaucuuaugauuuuccuauuuaacgcacacauauucacauacacagacauuucuuuucuuuaccaugaaguuccaguugcuuagcauaaauuauuuuuaaaccaugugauuuaaucaacauaaucaauacaaaaacccacaguuucacaggccacaauaaaacaucuuugacaaaguccaaagcuauuguaugguaacaaaugucgagcuuccugcaacaugcauguacuuauguucugcuuaacgccucacaaagucucugccucaccuauggagaccaagucuuaaaguaugaucauaaagccauacguuucucagcagacugagacuauccaacaugcaaagcucaugauaucacucuccuaaaaaucucaucguggcuggcauccaaauucuucagcauggcaugagaggacuccucacaccccucaccaccgugucgaaccugacacgcuauguaaaugucauucaaccucucaucuggaggucaccccauuucucugcacaaaaagaaaaaagucccacuggaugcccugguacugagggggccaguggacagucacccacgcaguaaacagcacaccaaauccacauaccuuagcauaaaaacacgcuucaacaucaucagauuccuuugaacacaaaacucuucaccauuucacuccuuaaaauccuuccuuggccaaacuccaagcaucccgcagcaccccccgcccccaugcaaaaggaucagaaaugauaucucaccccucacucaggaugcaauagugccuucaguuugcacaugggucaaaucuccuaaauauauuacaguguccacucccuucucugcugaauucacaggcuguaaggagucacucccagauuuaaaacguugcaaaguuucuauguagcaugaagcuccaaauucuuaacagacaguacaggaucuuaucaugucacguaccaaaaaaaaaaaaaaaaaaaaaaagaaagaaagaaagaaagaaagaaagaaaaagaaaaaaaaaaaaagaaaccaacaaaucucccaucacacuuugaagccguuuguuggcucaaguccaaacuuacucaagugauauuauaaucugauacgucaucccuuagaauaaaauucgcacgucuuagcacaguucauuaaauuugagcuugugaccccaccuuaaaaacucggcaaugucucuuaauugugcaggacauaaaaagucuagauucuuggcaugcggcgagaauuugauuucauaacagagcuauguuauaucuaucaaacacagaaaacucaccaugucacuccguuagaauuggauaaaucaaauuuuuaaacaugugcaaaaaccucaucacgucugagccucuaaauaaauuccaaacuucucugcauaguccccaacucggccauguaacuccucuaauugaaaccuuuccuuggugucuacauuaaucauagcuccuuggcuugcccugagagucaaacuuuggcauucucuccacauagaaagucagaguguuugggcacgaucuuaaaugugugccuguucacuuuccuaguuaugauuucucgguguuucuuguugcuuguaauaauaaaguccaaagcuguuagccauaaaauauguuuuaucauucauucuacaagcuuaucucccacaagcaagcaaucucaccauuaaguuuuuuuuuuuuuuuaaagccuuuuggcagaagcccaaagcccuuagugugauagaaauuuuugauuucucaaaauaaaguccagauuucuaccccagaaacuuaaauugauucacaaaacucccacuuaaaaucuucuccuacauuuccaguaacacugaaacaacccacugucuuugcgugacacccucguuugacuacuccauucuucacguccagccuuacaaacuuccugcccgcaacacaaagcccacgcgcuuuagcacucaguggagccuggggcaaguaucgcuccuguggaaaacauauaggugcuucccugauuugggaaauugagagcuuaaguuguuuugcaugaaacauaaauuuuaaacuuuguauagcuuccuuccucguuucuccacagguguuccuguugaaagacuugagucuuuccuaagccaaauuugauuuugcuguuuuucaaucaaaaaguuuuugcauuuuguauuuuuuuagucuucaguucacccaacagucuuuucucuuuuuuuuucuuuuuuggcuuagguauccugcuuggacccuaaagaacuugagacaguaccaccggguagccaccaugccacgaacauuaaggaucugcugaggguacgagccccccugucgcaagagaagggaagugcuacaccagguagguggcccagcucaggggucugccccucugaguggacuugggacauguuggaaugcugucuucccucucugaugucuuauuuuacaaucaccucaacuucccuugccuccucuaccgaagcccauucugcuugccucuaggucaugcagacgagacacuuguccgucuuucagaugugucucaauguauguucucaaaccuuacauaauaucuuuuugaaaaugucuauaaaaaucuagaccuagugccuagggugggaauguacccuuugggucuuucucagacccucugccccacaacauugaagacagacaccccagucucaccacuguuagcgccugcccgagagcgagacuuggucacguuagcuccuugauugccucugagcaaguggcccauggugucagggcugccacggagcaucuaugaaggguucaguggggggggggcagggggggcaaaucccucagcgaauaccuuucccuguacaguaaaggaaaucugauuuuaaaaauagagcuugggagaggagaggagaauguauuuaggagcagaguugaauguucagcaugggcugggguggggugggggugugaggguggaggaauuaggggaaaggugaggacagaggagaaggacaugaggccccuaagagcucaggaggacagugaagccacguagaggaguugagggcagccauggcucucaaagaccuucuuugcuauaccuggggucuuggcugcaggaugaagaccccuguuacuuuggauuucuuuuaugagucauucgguggcacuuaaguggugcuuaagccuucaggccuauagaacuaaguuuccucagaauaaagacucuuuuuuuuuuuuuuuuuuuuuuuugucauugcuccacugcccuggccuucuggugguauggauggacauggagcacuagaacagggguaauugugccaggacaauaagggacacaaauuauguuauuuacuuauuuuguuuuucacaaaugucagggucaagaugugcccuugguggguggagcccuaggguccuuguugcaucuccuaguggagaagaguaguuuuuggucccucuuccuauucagcuugcuggaugggcuaagccauacccucaucggggcuucuuaaaaggagcuugggucuaaugcugugguuccagugccacuggagucugcagggcuacccacuggucuugcccauuccacccuggcuugggcauuugagaggagagagccuuuaucuuucuuuucugcauagccacauuguucuccuuacucuguagucuggauaaaaagccuccaucaucaggccuucaucccuaugguggggcaacuaagcucuuuugaagggagaauccaaugacucaggauagagagugaaucaaaguaaguugaugggcauuucuugcacuauacccucagcuuguugcauccggaggcagagcugugcccuugacccagcagccuuguguccuggcuccuucauguuuaacuggaagcaugggggucagcucggucacucucccagaauaacuguggagggguggggggagaguaugccacucugggaggggcuguggggcugugcaggagcaccaacccccccuucuucuuuggguugcccaguugcauagccaaucagcugcuccugagccuaaacuuuccuuucaaggcaugugggcagagaugagccuuggauggagaugcagccugcgcagcugcuagccccgcuggggccuugacuuugcacauggccuucucuuccuaccccucaguuuccccuuggcuuucuuacuuucuucuggcaacagcauggcccaaagaaacagguggcgcucagggacuccuguucccccuugguucuaauacccgcaccuagaaauuaggcuccuacuuucauuuaaauccaagucuucuaauccaagcaaugguugaaaauuuacagguugucuaauccuugccuugaaucuacagcuccugccuggcucuggcaaauucuucucuaugccugguacucuuuuaacaacguggucgcaccuuaaugccugcaggcauagggcugacaguacuuguaucuuagagauggugacuucaggucaggaagaacucauucuaagcucugugagagguacagcucuagggccagggauagaggguagccagcccuauaacucucucuuugcccauuuagaaugggaagaggguauucccuuuguaaacugugaaaaaacaaaaacaaaaacaaaaaacaaaaaacaacugauguaggagucuggccuguucuuguuauuaggcuuuaucuguuaauugcuuuuagagcacggacucuaauugcaagggucagacagcauugaaugugugguaucaacuuuagccccaugaggggagcaagcucugcauugaaagagacuaaaccuaaaccagaggguuccuguucuccaggacccuucagcaagagcacagccucacuccaaugacaaccacuuuacccauugcaaacagugguuaugacuauccuguaaaaggcaggguagggccaugcagaagaccuaaggcauccagucacaucuggagccccugugccacagacagggcuaacuagaauuuuccaaucauaaugaaaucugcccagcucugauuucuuagccucuaaugucaugguuggaggauuuucuuaccacuuugcagaauuaaacugacauguagagacuuugguguuaacucccagcagccaggaagguugagguggcggggcagagcucugaaacagauuuuugcccccugguagaugacacaggcagaaacagguacccaaagagggaucaggcaguugccauuuagaaaccuggagagccucguggccagaggaugccuucauuccacgcuguugaugcaguuagucucguggucugacaggcagccagacauagaagugggggccuuagugucugcuuccaucgccccaaaaggauccugcugucauucccauuucauuuuggcuuauauggugucaacagagggacaggaugggauaagacagcuggcugaggcuccacuaauuauaacugcucaaguauuuggacagcagugguaguguguaccccaguacaugcccaaacuaaccuuuaaccuuuaguccugagcauggccauacccuugccacugaccagguaagccccucuccacugggcagaggccagcaugggaccucuaccccugcuuaccuuggcuucaaguguccaaguggaucuccgaugguccugcucgguuccugccucuuccuuagaagcuguuggggaaauauguuuucuucuuagucacagacauaccaugcuguugcaacuccccagcccagcccccuccuguuccccaaaacaggauuccuguuuucagacaucucugcccuucuguguguuucccgugugccaggcaugacuggugagaaaucauacacuugagguuuuuuuuuuuuuuuucacuccuuagaaugaucucugcaucguugucuugcuuuuuaaaauugccacauuggagaggaggaccaugaggcuuggggucaugccaccaccuuuggugugccugacaguccuaauggagaccaagcaaaagcauuucacccucagauggacacucagugugccuucucuucaugagggagcccuuuaagucuccauaaugaccucuuaguucccaguauuggucagcaaauguugccuuucaagcacacaguaggucuacugguagcagugaggcuugggucaagggcucagggagacaggggacuccugacucucauucuuucucuucuagguaacccagagauaagaugcuuucucccaggaagggagcagaugccuggcccaggaucacagaaaaaggucuguggaauguucucuuaccuucuaaaauauuaauuuagagaacuugcaaauuugcagauuuucccagaauggaacuaacuggaacucuucauuuuacagcuauggcucacugccccucagggggcagggggcuggugauuccugagggagcccugcccccuuccagggugaauuuuccuaagucaccauggagaaccagcagcccagaaucagugcccugccaggcagguaagcccaucucucuuguacuuuguucuuuuaaggguaaggggcuuccuagaggaguggaggucacacagccuuaauaagcuggcauccuugucucucuguguguaacuaaggaagacuuaguuaccugcagagaggaugcugaucaucaugaugccccugauggggacuagaggcacagggagagcagaauaaugcccuuuuaggagggagaagaucuuagaacccuaacuauagcuacuaacccccucgguaagaucagggaagcaaugccccgguaaaucugaaauagaaaagcgacaauaccugguggagagggagaguccuugccccuugcaaagguggcuguuugaggaucuuaauccucuggacucauuuauaaggccuucucaggauuuuggaauucagaggaaaacaaaggaaaagagccaaacaggaaagcagcguugggaaaguugcccccucccuguccccccacccucccacccagggugggugguguuuuccugaggcaacuuuagcuuuuuuauggggaugucuucaggcuguuucgaccuggaaguaacccuaaacugcagggcaagcacagggaguguccaucugaauauugcuuuuuauuuuuuuaaaaaaaucauauacauuauauaugucauaaaaauauuuugcauuugugaaauccuugccuguuccccaaggucuucgcagguacaggagcccacuccacaaaucgugugggcuaaagagcugaaccucaagugauuacagaccagccauaaaggcaacacagugcuuaaugcuccucagguuuuauuuuccccugccuaaagucauggcaggagacuagucugcauuucuucagagaagacaguuacccaguaaaugaaacagcagcuuugcaacggcagaaaaagguggaugagucuucagacugcugaguuuagaaaggguuaauuuuuuuuuugguucugagggucucugagcaucaagugcuucucugaagacguggguguaaucauauuaucuuugucacacacucagcccuaugcgcagucugagauccugacagccccugacagcugcagagggacucacuagcuaggucugaagcucaggaugcaagccagacuugggguaccuugaagagaaaggggucuucugaggaguccagugugcagugcgcuacuuggaugauuuagugaugcugaugccaggacccucugcguuagacccugaagguacacaguaauaguguggguugcucaagagucaagcugucagggcacguagcauggccucggcucguuaccagcaagcaggcugcacaguugagacacau

SEQ ID NO: 41 - RNA, 25235 nt, Mus musculus
augugucucaacugugcagccugcuugcugguaacgagccgaggccaugcuacgugcccugacagcuugacucuugagcaacccacacuauuacuguguaccuucagggucuaacgcagaggguccuggcaucagcaucacuaaaucauccaaguagcgcacugcacacuggacuccucagaagaccccuuucucuucaagguaccccaagucuggcuugcauccugagcuucagaccuagcuagugagucccucugcagcugucaggggcugucaggaucucagacugcgcauagggcugagugugugacaaagauaauaugauuacacccacgucuucagagaagcacuugaugcucagagacccucagaaccaaaaaaaaaauuaacccuuucuaaacucagcagucugaagacucauccaccuuuuucugccguugcaaagcugcuguuucauuuacuggguaacugucuucucugaagaaaugcagacuagucuccugccaugacuuuaggcaggggaaaauaaaaccugaggagcauuaagcacuguguugccuuuauggcuggucuguaaucacuugagguucagcucuuuagcccacacgauuuguggagugggcuccuguaccugcgaagaccuuggggaacaggcaaggauuucacaaaugcaaaauauuuuuaugacauauauaauguauaugauuuuuuuaaaaaaauaaaaagcaauauucagauggacacucccugugcuugcccugcaguuuaggguuacuuccaggucgaaacagccugaagacauccccauaaaaaagcuaaaguugccucaggaaaacaccacccacccugggugggaggguggggggacagggagggggcaacuuucccaacgcugcuuuccuguuuggcucuuuuccuuuguuuuccucugaauuccaaaauccugagaaggccuuauaaaugaguccagaggauuaagauccucaaacagccaccuuugcaaggggcaaggacucucccucuccaccagguauugucgcuuuucuauuucagauuuaccggggcauugcuucccugaucuuaccgaggggguuaguagcuauaguuaggguucuaagaucuucucccuccuaaaagggcauuauucugcucucccugugccucuaguccccaucaggggcaucaugaugaucagcauccucucugcagguaacuaagucuuccuuaguuacacacagagagacaaggaugccagcuuauuaaggcugugugaccuccacuccucuaggaagccccuuacccuuaaaagaacaaaguacaagagagaugggcuuaccugccuggcagggcacugauucugggcugcugguucuccauggugacuuaggaaaauucacccuggaagggggcagggcucccucaggaaucaccagcccccugcccccugaggggcagugagccauagcuguaaaaugaagaguuccaguuaguuccauucugggaaaaucugcaaauuugcaaguucucuaaauuaauauuuuagaagguaagagaacauuccacagaccuuuuucugugauccugggccaggcaucugcucccuuccugggagaaagcaucuuaucucuggguuaccuagaagagaaagaaugagagucaggaguccccugucucccugagcccuugacccaagccucacugcuaccaguagaccuacugugugcuugaaaggcaacauuugcugaccaauacugggaacuaagaggucauuauggagacuuaaagggcucccucaugaagagaaggcacacugaguguccaucugagggugaaaugcuuuugcuuggucuccauuaggacugucaggcacaccaaaggugguggcaugaccccaagccucaugguccuccucuccaauguggcaauuuuaaaaagcaagacaacgaugcagagaucauucuaaggagugaaaaaaaaaaaaaaaaccucaaguguaugauuucucaccagucaugccuggcacacgggaaacacacagaagggcagagaugucugaaaacaggaauccuguuuuggggaacaggagggggcugggcuggggaguugcaacagcaugguaugucugugacuaagaagaaaacauauuuccccaacagcuucuaaggaagaggcaggaaccgagcaggaccaucggagauccacuuggacacuugaagccaagguaagcagggguagaggucccaugcuggccucugcccaguggagaggggcuuaccuggucaguggcaaggguauggccaugcucaggacuaaagguuaaagguuaguuugggcauguacugggguacacacuaccacugcuguccaaauacuugagcaguuauaauuaguggagccucagccagcugucuuaucccauccugucccucuguugacaccauauaagccaaaaugaaaugggaaugacagcaggauccuuuuggggcgauggaagcagacacuaaggcccccacuucuaugucuggcugccugucagaccacgagacuaacugcaucaacagcguggaaugaaggcauccucuggccacgaggcucuccagguuucuaaauggcaacugccugaucccucuuuggguaccuguuucugccugugucaucuaccagggggcaaaaaucuguuucagagcucugccccgccaccucaaccuuccuggcugcugggaguuaacaccaaagucucuacaugucaguuuaauucugcaaagugguaagaaaauccuccaaccaugacauuagaggcuaagaaaucagagcugggcagauuucauuaugauuggaaaauucuaguuagcccugucuguggcacaggggcuccagaugugacuggaugccuuaggucuucugcauggcccuacccugccuuuuacaggauagucauaaccacuguuugcaauggguaaagugguugucauuggagugaggcugugcucuugcugaaggguccuggagaacaggaacccucugguuuagguuuagucucuuucaaugcagagcuugcuccccucauggggcuaaaguugauaccacacauucaaugcugucugacccuugcaauuagaguccgugcucuaaaagcaauuaacagauaaagccuaauaacaagaacaggccagacuccuacaucaguuguuuuuuguuuuuuguuuuuguuuuuguuuuuucacaguuuacaaagggaauacccucuucccauucuaaaugggcaaagagagaguuauagggcuggcuacccucuaucccuggcccuagagcuguaccucucacagagcuuagaaugaguucuuccugaccugaagucaccaucucuaagauacaaguacugucagcccuaugccugcaggcauuaaggugcgaccacguuguuaaaagaguaccaggcauagagaagaauuugccagagccaggcaggagcuguagauucaaggcaaggauuagacaaccuguaaauuuucaaccauugcuuggauuagaagacuuggauuuaaaugaaaguaggagccuaauuucuaggugcggguauuagaaccaagggggaacaggagucccugagcgccaccuguuucuuugggccaugcuguugccagaagaaaguaagaaagccaaggggaaacugagggguaggaagagaaggccaugugcaaagucaaggccccagcggggcuagcagcugcgcaggcugcaucuccauccaaggcucaucucugcccacaugccuugaaaggaaaguuuaggcucaggagcagcugauuggcuaugcaacugggcaacccaaagaagaaggggggguuggugcuccugcacagccccacagccccucccagaguggcauacucuccccccaccccuccacaguuauucugggagagugaccgagcugacccccaugcuuccaguuaaacaugaaggagccaggacacaaggcugcugggucaagggcacagcucugccuccggaugcaacaagcugaggguauagugcaagaaaugcccaucaacuuacuuugauucacucucuauccugagucauuggauucucccuucaaaagagcuuaguugccccaccauagggaugaaggccugaugauggaggcuuuuuauccagacuacagaguaaggagaacaauguggcuaugcagaaaagaaagauaaaggcucucuccucucaaaugcccaagccaggguggaaugggcaagaccaguggguagcccugcagacuccaguggcacuggaaccacagcauuagacccaagcuccuuuuaagaagccccgaugaggguauggcuuagcccauccagcaagcugaauaggaagagggaccaaaaacuacucuucuccacuaggagaugcaacaaggacccuagggcuccacccaccaagggcacaucuugacccugacauuugugaaaaacaaaauaaguaaauaacauaauuugugucccuuauuguccuggcacaauuaccccuguucuagugcuccauguccauccauaccaccagaaggccagggcaguggagcaaugacaaaaaaaaaaaaaaaaaaaaaaaagagucuuuauucugaggaaacuuaguucuauaggccugaaggcuuaagcaccacuuaagugccaccgaaugacucauaaaagaaauccaaaguaacaggggucuucauccugcagccaagaccccagguauagcaaagaaggucuuugagagccauggcugcccucaacuccucuacguggcuucacuguccuccugagcucuuaggggccucauguccuucuccucuguccucaccuuuccccuaauuccuccacccucacacccccaccccaccccagcccaugcugaacauucaacucugcuccuaaauacauucuccucuccucucccaagcucuauuuuuaaaaucagauuuccuuuacuguacagggaaagguauucgcugagggauuugcccccccugccccccccccacugaacccuucauagaugcuccguggcagcccugacaccaugggccacuugcucagaggcaaucaaggagcuaacgugaccaagucucgcucucgggcaggcgcuaacaguggugagacuggggugucugucuucaauguuguggggcagagggucugagaaagacccaaaggguacauucccacccuaggcacuaggucuagauuuuuauagacauuuucaaaaagauauuauguaagguuugagaacauacauugagacacaucugaaagacggacaagugucucgucugcaugaccuagaggcaagcagaaugggcuucgguagaggaggcaagggaaguugaggugauuguaaaauaagacaucagagagggaagacagcauuccaacaugucccaaguccacucagaggggcagaccccugagcugggccaccuaccugguguagcacuucccuucucuugcgacaggggggcucguacccucagcagauccuuaauguucguggcaugguggcuacccggugguacugucucaaguucuuuaggguccaagcaggauaccuaagccaaaaaagaaaaaaaaagagaaaagacuguugggugaacugaagacuaaaaaaauacaaaaugcaaaaacuuuuugauugaaaaacagcaaaaucaaauuuggcuuaggaaagacucaagucuuucaacaggaacaccuguggagaaacgaggaaggaagcuauacaaaguuuaaaauuuauguuucaugcaaaacaacuuaagcucucaauuucccaaaucagggaagcaccuauauguuuuccacaggagcgauacuugccccaggcuccacugagugcuaaagcgcgugggcuuuguguugcgggcaggaaguuuguaaggcuggacgugaagaauggaguagucaaacgagggugucacgcaaagacaguggguuguuucaguguuacuggaaauguaggagaagauuuuaagugggaguuuugugaaucaauuuaaguuucugggguagaaaucuggacuuuauuuugagaaaucaaaaauuucuaucacacuaagggcuuugggcuucugccaaaaggcuuuaaaaaaaaaaaaaaacuuaauggugagauugcuugcuugugggagauaagcuuguagaaugaaugauaaaacauauuuuauggcuaacagcuuuggacuuuauuauuacaagcaacaagaaacaccgagaaaucauaacuaggaaagugaacaggcacacauuuaagaucgugcccaaacacucugacuuucuauguggagagaaugccaaaguuugacucucagggcaagccaaggagcuaugauuaauguagacaccaaggaaagguuucaauuagaggaguuacauggccgaguuggggacuaugcagagaaguuuggaauuuauuuagaggcucagacgugaugagguuuuugcacauguuuaaaaauuugauuuauccaauucuaacggagugacauggugaguuuucuguguuugauagauauaacauagcucuguuaugaaaucaaauucucgccgcaugccaagaaucuagacuuuuuauguccugcacaauuaagagacauugccgaguuuuuaagguggggucacaagcucaaauuuaaugaacugugcuaagacgugcgaauuuuauucuaagggaugacguaucagauuauaauaucacuugaguaaguuuggacuugagccaacaaacggcuucaaagugugaugggagauuuguugguuucuuuuuuuuuuuuucuuuuucuuucuuucuuucuuucuuucuuucuuuuuuuuuuuuuuuuuuuuuuugguacgugacaugauaagauccuguacugucuguuaagaauuuggagcuucaugcuacauagaaacuuugcaacguuuuaaaucugggagugacuccuuacagccugugaauucagcagagaagggaguggacacuguaauauauuuaggagauuugacccaugugcaaacugaaggcacuauugcauccugagugaggggugagauaucauuucugauccuuuugcaugggggcggggggugcugcgggaugcuuggaguuuggccaaggaaggauuuuaaggagugaaauggugaagaguuuuguguucaaaggaaucugaugauguugaagcguguuuuuaugcuaagguauguggauuuggugugcuguuuacugcgugggugacuguccacuggcccccucaguaccagggcauccagugggacuuuuuucuuuuugugcagagaaauggggugaccuccagaugagagguugaaugacauuuacauagcgugucagguucgacacgguggugaggggugugaggaguccucucaugccaugcugaagaauuuggaugccagccacgaugagauuuuuaggagagugauaucaugagcuuugcauguuggauagucucagucugcugagaaacguauggcuuuaugaucauacuuuaagacuuggucuccauaggugaggcagagacuuugugaggcguuaagcagaacauaaguacaugcauguugcaggaagcucgacauuuguuaccauacaauagcuuuggacuuugucaaagauguuuuauuguggccugugaaacuguggguuuuuguauugauuauguugauuaaaucacaugguuuaaaaauaauuuaugcuaagcaacuggaacuucaugguaaagaaaagaaaugucuguguaugugaauaugugugcguuaaauaggaaaaucauaagaugaaaauuguuuaucucaacuaaagguuuauucugauauccaggcauauuaaaauuuuuaggacaagagauuuuugguugagggcuggaaagcagaaauaucuaaucccuuacaugaucaaauuugucuguaauauuuuaaguauaggcauuuuauuuagaacggguaucauuuagcuuuaaaaucggauugcugcaaauuuaaaaauugaaaccaugagcaauuuuuagguggagaccugcugagauuuuuaugucccgcagaugaacuuggggaugaauuagucaaauuuuauauuuuaauaauagacgacuuuuccugaaagaggaaauaaguugauuuauguaauaugcugugcauguuucugagcugauggucuguacagcaggcucaggaccugugaucuccaguucuaggaaugagaagcccaacguggacauuaugcuaaggccuuucaauuucagccaggaguuuuuuuuuuuuuuuuuuuuuuuuuuugguaaguuuacaugucagacauguuuauauaaaagguuuggauuuaauauugccgacaguaaauaaacagugagaggcuuuaaucagagggguugcaugaucgaauuuaagugucaugcuaacaaggagaugucuaauucugagaaacugcagacccaaaagcauccugcugcaagguuuggaggauggccaacgggaguuuuacaugaaugacaacaugggagauuucuguuuauuugguuuuguguguguauguguguguguuucuguuuuuggauaggucagcccagugaccuuaaaaaagaaaauugagaaguaacagaaggugcagaauucauaaagacaauagcuauauggcugagcuauugaauaacuagcuuaauuuguuuugcaaaccaauacaucccuuuaaauucaauuuccgugcacuaaacccuccauggcuagauuuucaaaaauuacggaacaaucagauuucaaaggucccaugcccccccuuucacccaacuucauaccucuguuagauauaccccuguaccagacgaaaucaacagugacagaaaagggggggggggcacuuuugagaacgaaaacccugcuccugccgaagcagaggagaaacuuggaaagauagcauuugugagacgugcagaaauguuugcaugagcagaauugaggccagauguuuaaagcugcaggagcccugcagaccaggcaauccugggagaacaguuuuuuugaaagcccgggaaaggguguuuagaaagcuccgacucagcucagagcuggagaaaacguggcuuuggacagagaucaaaccgaacaagagaaaugauacuaucccucccccaccccccucuuauccugcauaugcacaaagugugaccuaggaugaagccaugaaagugcauguuuucagcacauaguaggcauuuuauaaacauuuauggggagcaaaauuaaaaccaaaagccauggcucucucucacuuauuucggcuuggagccuagaggaggaaauaagagcuauuuuuggcuguugacccaacuggcaggauaguggccaagugcccaauuucuccucuuuccccaguuugugaaauagcaggcaucucccugcagauucccgccuccaaccaagcucacugggcuggcucuagaccaccaagccugccagcagccgcuuugaguggcauugagaugugaccuuuaugacuuuugggugacuacaaaugggaagggaaccuggccagggcaaagcgggccagaagugugcccugccaggugcuagcucgccacagaggacgcuccaggccaguugcuccacaaaauuuaugggcugugaauuucucauuccacuagaggaaguaggcaggugggguagucagacuccgccuggaaggcaggucagggggugacggucuuuccccuggaggugccccaaguaaccagaaaaggaggcugaacugaaugcaggaggaauuucuccauuuucucucugauucuaguaacuuggcaucugcuuuguccuugagauagaaucugacccugccaucuugagaaccuaaauugcuacauuuucuccugucuuuuaucccucugucccuagguuuuggucuccacaguugcggucucugaccacacacaucacaaucuuaccagucuucagagcacacuccuuuccaaccgacgacaugauagaacccucugaagacucauuugagacgaugauggagcuuaagaauccaucaucaaaacaaauggaguccuccgagggcucauccaacaccguugaagagacaccaggcagcaguggagcccaggcgggggcccaggcaggggcccaggcggaggcccaggcggagacccagguggaggcccaggcggaggcucaggcugaagcccagguugaggcccagguugaggcccaggcgggcucagauaguggcccagcccaggaagaaaaggagccacccaguggcccccucaaggaaaugcaagagcugcccacuaaucuacuccaagaaguggaggagccauccaguggcccccaccaggaaaugcaagagcugcccacugaucuacuccaagaaguggaggagccauccaguggcccccaccaggaaaugcaagagcuacccacugaucuacuccgggaaguggaggagccauccaguggccccuaccaggaaaugcaagagcuacccacugaucuacuccgggaaguggaggagccauccaguggccccuaccaggaaaugcaagagcuacccacugaucuacuccgggaaguggaggagccauccaguggccccuaccaggaaaugcaagagcuacccacugaucuacuccgggaaguggaggagccauccaguggccccuaccaggaaaugcaagagcuacccacugaucuacuccgggaaguggaggagccauccagcgaccccugugaggcaucaucuaacgaucuaccccaagacauggaggaaucaagugaugaugguucgaaccaggagucgagugaugguucaaaccacgaauuaaguaaugguucaaaccaugagucgagcuuugguucaaacccagagucgagcgauguuuccaaccuggagucaagcggugguucaaaccaggaguccagcgaugguucacaaaaggagucaagcuaugauucaaacccggaguuaagugauaauucaaaccaggaguuaagcgauaauucgaaccaggagucaagcgacaguucaaaccagucaagugauauuucaaaccaggaagggucggaaccacucagugaggcauccgauuauagcauggaugaaacaaucaacucauccgagacccagucagaccaagaugauacugaccugggagaugacgaggaagaggaggaagaggaagguggugaagaggaaggucagcccaagaacucuccagaagaagucguggccaccauggggaacgucaucucgcuguuccuccggaugcaagaccuaaaagaacaacagagaguggcagaaaggcucaugaugcaggcuaucaacgaaggucgccugcccucccucaggcccuucucuggagaucgcagagacuaccaugaguuugucgugcucugccagaugacaaugcagaacuacccaaguaugcuauacaaugaugagcugcgggugaaauucgucauccgccaccugacugaccuagccuuggaaugggccaacgaccucguagagcagaacagcccagugauaaacaacuucucagccuuccuggaggccaugucagaaaaguuugaguaucggcagacccugcguguggcggaagacgccauguucaacaucaggcaggggaaccgcugugcggccgauuacaucaaugaguuccggggucugauacccaccuuaggcuggccagaugaaguccugcaggcccaccugugccaggggcucaacgaagagaucaggcacuaucuguuccggaucccucagccgaauucccuagacaaccugauuguacuuguccugcaacuugaagaaaagcuggcagagagaagagcauuacucaggcugccaccugagucgcgcccaagaagcguagccuggauggaugcucccgccccagagaaguggaggguaagcagcuggcugcccaaugaguuccacccagacauugaucgcgaucaccucuucuuacugcucuuggugagaguggaccccuaccacagugucgcagugcgggcccugguggacucaggagcagaagggaacuacauggaugagagguuugcccaggaacacuauguggaacucuaugagaagccuuauccacagauaauccaagguguggauggcaucccaauuggcaaugaacccgucuggcugugcaccgagccccugguauguguccaccagaagcauuaugaguacaucgaauuugacaucuuaccuucgcccaacuucuccaucgucuuaggcaugaaguggcuccgaacccaugccccugaagucgacuggaugagaggccgguguaccuuccacucucccuacugucugcggaauugcuucaccccaccuccaccaugcaucgcacuagagacauacagcauaagccuacugcccggauugccacacacauacucagaccuggccgacguguuuaacccgagggaggcagaugaugagacuuccgaccagccaagcucagacggauccgaugaucuuucugaaucagagcccucugagcuucagcaggcuggagacagugaucaaagcggcgucuuuuacgagucuggggcccgagagacuuuggaaccugugagcgccaggaugcaagagaaagccaggcagcaagagaaagccagggagcaagaggaauacuggauacuguaugacaugcugacugacagacaagacuacacgcagaugguaccagagcuauucgaccagcuacauggagcggcaugguucacaaaacuggagcugcuugggauuaaggaaagugagaugaggcacacggucacacacacggaagacacuuggagagcaucguucgguuucggccuucaccagaugagaugcuaccggcccuucacaaugaacucauacucugacgaagggaacaacauuguucacuucauccuaaaagacauccuaggguuguuugugauuugccauggcagagagguccuggucuacucaaugagccaggaggaacacucccagcauguccgccaaguccugguccgcuuucgguaucacaacaucuacuguucacuggacaaaacucaguuccaucgccagaccgcugaaaucuugggcuucaacauaucccccaaaggggugaaacugaacaagaaccuuaugaaccucaucguggggugcccugucccuggcagcaggaggugucuucaaagugugauugaccuugucuaucccuaucgccacuucguggagaacuucgcugucaucgcagcaccccuagugagacaacugcugaguucagagcccuacuacuggggagaagaggagcaggaggccuuggaaucccugaagagggcuuuccgcaagucgcccguucucuaucacccuaagccucagaacccauucuacuuggaaacagacaucacugggucauuccugucugccucccugguccaaaccgacgacgaaacuggcaagaaaucuaccugugcuuucuauucaagaccccucucuacaauggagguggaguacccucgaguggagaugaggauccuuccaauccgggcugccuucaugguguggugccgcuaccuggagaacaccgaggagcccaucaugauccuucucaacacagaggaucuagccucucugaauaaugacaggcucaccguacuucuccccgggcauugggucuucuucuucucacacuucaauuuugguguuauggagaugccagcugaaggugacacacaagcacucuuccgcagauguuggaaccagagaggcuucagagcaagguuucugcgcccacugcugcuuauguccauuagggcaaaucuaagguacuuugacagauccucugagacugaggauaaagaggaugaugaagaagaggaggaggaagauggugaagaagaagaaggggaggaggaggaagauggugaagaagaagaaggggaggaggaggaagauggugaagaagaagaggaggaggaggaagaugaugaagaagaagaaggggaggaggaggaagauggugaagaagaagaaggggaggaggaggaagauggugaagaagaagaaggggaggaggaggaagauggugaagaagaagaaggggaggaggagggagaggaggaggaagaaggagaggaggaagaggaggaagaagaggaugaggaggaagaggaggaggaagaggaagaggaggaagaagaggaggaagaagaggaggaggaggaagaggaggaagaagaggaggaggaagaugaggaagaagaggaugaggaggaagaagaugaggaggugcccagcauggugcgggagcuacuggcugccaucccgauggaccauauccucaauggcuuacuggcucacuucaguguggcccagauccgggccguuguccuaaacuucuuccguggccugcucuacuggaagagucuccuggguguggcagcuguccuggugauguugagagcaaggcagccccucuccccagugccugccccuaauuuggaaguggccaggccucagcaccggcacacacuccgacucauccuggacucgacccucauugcgaguaguggcauggccacagccaucgcucaguugcucagccagaugcccccucuagugggugccaacacccucccagcucgagagcuggcugagcuuuuccugggcccaaggugcuggcaucggaaugcucugcauucccagccuccacgggggaugcgcuucaccccuggguucugguugacccugugugaguucuuuggggucagagucaacccugaggaugacgucuuuccugacccuuaccagcaccgguacuuggaacugcacgucguuggggaugaagaugucgucuugcgagaagcccugcaagacgaccugcaacguuaccgucaguguggccugcaugacggccugcaagacaccucgcaggacgcgcaggacaacgacgugcaagaggaccuguuuggcgaccaggaagcggucaccuucagaccacgaaaucuuuuggacccagagguccuagauuuccucaacaaccggcuacucuacacccugggcaccgauggccgccuuacucugcuuagcagagaucagguggcccaggcccucacacgauuccuggccauggccuccagaauggcgcugccuuccccagccagggaacaggcaaggcuagaagagcuaucagacucagaugaugaacuugacugaaaacacaccaagucacugucauuuucccuugugccucggccagcuucgcucagauccagcacacccucuugcuacuccuaacccaaggggaacccacuugugaagggccacaacuucaucaaccagcaacaucaucugugcuaaagaacuagccaacuaucagcgucccagaaccagccaagacuguguaacccuaacuguccuaacuguccgggccccaggcccacaaaagggagugagaccaaugaggagagagcagugaugagcaacagugaccccgucaccccaggccagaugcagagcagauacagcaggugcagccaagcaagcagaugccagugaccccaccaccacccccugaguggcaggcggccaccugugcauccugggacacugaccuugggugcuccacggacuucuaccucuacaccggugcuccgacuccccuggacacgccccuacucccucccagucucccaaggugcugugguuccaugcuuuccacaaccccagcccacccugcaagcaaguccacccccccccccacaacccacccacccacuaccggucugguccggcuccauugacaccucaucugacccugaacucugaucuuaccugggcagaacugcuccaaggagcauucgacguaccagugugacuuaccagauggacugauccacccugaaggucccugagacucagaggacccaagaaagggugguagcaaccaaguggggcucccuuuucccuccccaaauggacauauggacagugcaggggacagagaccuuccauaaaggagggagcccccaagagacacuggugaagccccagauacccagaguacugugccaaggagccaagagugcucugaccagacccacugcucacugccacaggaaggagagguccuuccauugcuuucccaacucauaccugcuuuugccccaugaauaaagagaagaaaagauuaucugacuuugugguuuguucuaaaagggagaggguggauaguaggaggcaggacuggagaacauggagcauggggucagaaaggauggagugugaagagaggguugggaugggcaagggcaagggugggaggggcagggauaggagggcuugacucuccagaaacagcucaugaagacauggagcaacaggccuccugucuucuccuaaagggagggaagucaauucacucucaaaacuuugggcuccucugggaaauggaccaaggguuucauggggcagaaggaggguacccagaauucccagcccucaucuggucccagcccucuagucacaugagaaaugaggaauggccagacugugcucaaugcccacagcugaggagggucaacaggcaggauguuugagcuuggaucccagaaaaacaguucuuagaacccaagacugcaucccuccacgcccccuccagccugcacuggggucacugugcccuuauggguccuaaggggccucaugacaaggaaucuaccccugaccauagcaccagaagaucauggggaggaucccagguucaaggucaggggcucagccucacucagcacuuccuccuguugcuaaggaggcuccaguggccccccacuggaaccauucccacaguuggccccugagauccuugccuuaaaaaaagcuaucuugagggauacucugggauggggaaggagcuccuagggguagagggaaauugagcaaauagucccuuacucacaaacucuauacuuccuacccagaaaaucugcacacaagcuaggaguauaaaaacaagggcccccucccacugugaccucaaagauagugggcaggugcaaugagcagggcccucacgcccaagggcccuuucuuaacucugcccuuuauaucuugccuggaaauguaccccugaguuaaccucaaggggcccucuuuggccugagaaugugucagaccccuggauacccagcaugacaccucccccuaccugcuuucagcucuuugaucccaucuauacaggaucuauaagcuugggucccagaaaaacccuacuuagaacgcaagauugcaucccuccacgcccccuccagccugcacuggggucacuguguccuuauggguccuaaggggccucaugacaaggaaucuaccccugacgguagcaccaggagaucauggauaggaucccagguucaaggucaggggcucagccucacucagcacuuccuccuguuccuaaggagcguccauaaccuuaaggugggacugggguccuauuggaggagaacaaacguaccaguccuguacccucacuuaguuuaccugggcaccuccaacaaaacugggccucaaaacaaaacaaaacaauccugucccugcuuggugaggacuucucuggcccagugaaugcagagaugacuuaggucaggacuacugccaggggccccaaggcccugagggccccaagcaagugagagugaaggagaacucagugagccagcagcccgccaagaggcugccagugauguugacugcagaggugcguuuacccacagcccgcacgaacacagaccauaaaggacaauaaaggcccgcaggccuaccaaucuacccagcagggauuuguccccauuaacagcaaaaggaggugguccggacugugaagagagcuggugacgugcuaaaacgugcuaaaacgguagguuaucagguuaucggcggagccacuuauagagauugaaaaacacaacacaaaccuuuuuuuuucuccuggggaagagaaaagaaaagaaagaaauuggugugaaaguuccugcuaggggaugauaacaucacuuccaacccugucaaggugaaaaccagaggccaggcccuggcugcagacuccacccaccaaggagcugcccccacuucccagcuucaguccccaaccagagagcucugacagcauccaggaacaaagaggagcaggggcccucccuugcccaccuucccuguccucuccauugcuuccccuuauaagaugucccugcagguaccagagccagugacagcacacacacaggacccugaguccagaguuuuaccagcuccucaccaggcuggagcagagaucuccacaugccuggguaaccugggcuaacuugggcuacccccauaguaagaaaaggaaaagaaaauauuacccaccccucaacugucccauacaccuuaagcccuggugcugggcccaggggaccacaucguuagacacgaucugagaccugagcagcaaaccucaucuggacuuugauccaccugugugagcugagagacacgcaugaccaucuugccaccaagaccgugcaggagcacaaguaggaagaaggagauugggggcagagggggggacagggaagggagagacaguggugaaggggagggggacuggguguggccuggguccucccuguccugcccucaaauccuuucacagcuuccaggcuauucacucagggugcuccugugugccggggcuggcugccauagcugguaaaugcaguuaauaauggugguguuguggggauggagaugggcccuguaugcaugcaaugaccuagguauugggguucagacucuacgccagcugcucauugugcuacugaagugucugugggcacccggccugggaggaggaugaacagggaucuucugcacuccuuaggggauccagaguuugaacugaaugaggugagacgucuccagaagggcucaaggagagaguaagaggccgccuguaagggaccucagccuccuggucauaaaaacauaauccuggauagaggcagaggccccucaaggagacccuguucugggagcacugguaaugcucagcccugcccugucucagcccugugcccugcucuaguaacaaagaccccaucucucaaggauccacccuuucugcuaggagcuggguccccucagaggaccuccaggagagaacggcuccuggaaucccagugggaggagccccagaguaggcccaggaucgaccucugaccugucuacccuuggccacagagucagagggugacccuuggcccagccccagggaaugucccaccagggguauagcucccccgccaaggaaugaucucagguauggcccagccccggguauuccccuccaggaacuguggagaauggcgagaaagcaugccaggggaaaagagcgagcugaagacgcgucccuaagcggcccaaggugcgcggaggaggguccggaggccucacgcgguugaagggggugaagaaaggcaucauauaggagcugaauggcugugcaaucaacuccugcaugacgccguucccaccccccaacuucucacuacacugggacccuccucuccugaaaaagcaaggcaagaagcacagacaacagguaggacagacucccagggcuuaguguuagaggaaggaaaccaaaggccagccagcccuagggcaccugcagcacaguggaagcaucuacccuccuugcccaaccucacuucuuauaaacucucauggagugacuggagccaauccaggggaugaggaggggggagagggagcagagggaugggagggagagaggaggggcaagggagcacugaaggagggguggggaagcggagagggaaggaagggugacuguggucacaggaguguccugcuaagguccaucccgaguauccaguggguuccucugcagaccuagaagggacucaugggaaccagcaggagcuuagacgccccagauggaucccccaaaaagaugcauggguuaaaagcuacucaguguggugaggggacaaacugcagguacagcuaacaaccgcuccccagguucuuugagugucaacuugaguuacacuccuccaugaauaacuaaaaaccacaaacugcuuuugcuugccuguuaguuuuuuuguuuguuuguuuguuuuugaaacaggaucuguguaauccagaguggaucccgacuucuccaucuuccugccucaggcuuccaaguguggcuaugauugacaggccucugucaccauggccagcuugaauggcacauguguaucaccuuacauaugaauaaaguaaaaaaaaaaaaucuuuccugacuugugcucuucucuuccuugucuggcacacccaccaacugccaacaaacacuugucccagcauagucucagagagcaggguauaaagagguaguaugggggugggagggaguaguaaggaugggaggccagaagacaggugaacacagguggggaagggaggacucgguguuaagccagggaggaagggagcugcacacgacaugugaaugacaaaggguuaaggcagcucaaugcugugguaagaugcugcagaugucaguggggcaggggagagagagaaggggggcucagggcagcauguggaacacagcugcacaucauccagggcagaagaggguugcaaagggacauguauguguaugggagcauagggacauggcucacgggaagcaggagggucucagggugacguaugucacaagggagagaugaaggauaugauaucccacgcaaagagggggucuucaugucauaaagaaaagaacagggacaucccaugaugccuaccuacacaggggggugucaguaacauauggagagauuaagggauuaaaucuagcggauggggagugguccaaggcuauacaugggggagagaauccaugguacaggggagaaaaaauguaaaugugaugugcagaggagggguaacaugacacauaaaaagaggaggggcucaguaugacucuuguacaggagagccuaugacuccugagaaagagacugggcugcaugugggacauaaggaggaggggcucugauagaggaaauaggggcucggugugacaucugucaaggaaaguguucaucacaaguggggagaaggacuagaugugacaccuaugaguugcuuugugaccuggaggacaugcacgucacagugugguauguguagaggcagagcgcuccaugucacaaggcaagggguggaugucucaacgugcugcgugcagagguggggcuucccaacaugaagagagagcgagaggagaagaguuccguguaccgcaucuggagcaccagcaggguuuguggugacuaaaaggaacgagggcuaugggacacaugauuuaggggcccucucacgauggaggagcucagagucagggaggggccuaaggugaauggggaguaagugggaugaagcucgggugcacagggcacacggguggggcuaggcuaagcaugacacacguggggagagguguucucucucuaggacacauggguagaacucaggugaccacgacaggugugagagggggcauacagaacguaggaaggguuaggcuaagcaugacacauguagaggaauggugcucuucaggacauauggguggagcuaggcaaagcgugccccauuauggaauuuucucuuuaagacacauggcugacaauagccuaacccuaacacaggaugacaagaggagaggacucagugugaggccagcaauaagacauaagaaauguuaacacaugaacacagagggucuuggaagugcagccugaugggaggggucuguccaagacaaagcagguguagugggaaaccauguaaagauagggaagagaaacuuacucugacccagguaggggaguggagcugaaugugauacccguggagagaugagacgcagugugacucaggacccuuguugugauucauggguggugggaggggcucugugugugacauagguguagaaaguuuugacauguaauggggucuagaugagaaacacuuggaaaagagacacaaaugucuugugcgaggguagagagcucauaacucugagugccacuguugaaaagggacuuagccuaacacaaaggagaauugaggaacugugggacacacggccaaggaaagacuuaggauagcacagugaggaccaguuugauaccuagguggcaugaccccaugugaugaacagaaggagaacgguucugugagaaaggugugacaggugaccgaggggagucugugugagaggaaagggguucagugugucacaggaaaagagcaugugaggcaggaguagagagacacaaggaggcaagacuccaggugucaggagagguggauugugcucaugguaagaagcauggagaaucuuuucuguuugaggcacauaggcuggagcaugguaugacaaauggggaugagagguucaaagugacacaggggaggacacacaggaagguagugcuucauguggcacauggguacaaaaggggcucggcaugacacacgcaugggugugacaccugguggcagagggggaauuggugugaaacacaaaaggggaggggacuaugcaauucacaagcaugaggucaacaugacccaugaagaggagaggaccucaagagagcaagagggcugugcuuuagguaaaaccagaggggcaggcgggguucuacaugccugaagagcaagggugaacacugaggggaggggggagggggacucagugucacaggggaggguaacagacuuggucuagcacacaaauugagaaguccaugacucaguggcuguguaagugaggagagagacuccaggugacagggguggaggcaggauucaaugucacuuaggugugggggcuauggaugauacaucccagcggugggcguuuggugugacacacaggggcuugugugacacaugaauggaggaacuuugugugacacguguuucuuacugacagggaggugggagaaacucugcacuuggccuggcaggaguuugcauuaguagcacagagaggaguggcuaccuaaaacgugggagaggguggugugugggcgaaggaagaggugugugugugugugugugugugugugugugacacaugaggagacagggcagagcucagauaagggacagcugcaugagccuaggugggacacuaaggaggagagugggcuuggugugacauuaguagacucagccugaagcacugaaacaacacaagauacagaagauaccagcuuuuacugaacuacuuguguggucacuguggggagagcuuugugugacuucuggaugcaggaggaugucuaugugacaguccaguguggagcaacuuggggugacauggagguggggcagggacuaaagggguaggggaggaguucgaggugauaucaaaagaggagguggguccaugucacauacaguagggucacagauugugacacaugacuagauagagauuuauagguuaguaaauggcucugugugauacuagaauagaagcauaguucaaugugacccaggaaugagggcagaggacccaaguaauaauucgguggagggguacuuaguaggacauaaaagggggacuuuguuauggcauuggaagacgagauagucaggacacauuagacucaauuuagguuggggguucauaugauaacuggaggggaguucaugagacacagaguggaaaaggggucaggauaggacacaccugaaagagggguuuggucaaguaccccguacugugucucagguaaaggaagaagacacaguagccaggagggcggucugacaagagugagagaaccucaggaggcucaguucacacguggaggcagcuuggcaugagucacagagggauucggugugaugaaaggguagauagagagggauucauugugguaggaggaagccugugaucugugaccagauaucggaccuaguguaacacagaggugacagagguuaagugugacaaugagagccugaacaucacacauggguagaaggagggacugaaggggaucugugagcggggaagcaucucagguagacagaaacuucaggugacucagguaaggaggugagacacaugguugugacauggggagggggcgguagggucacaucacuggugggguuugggcucuccuccuuaagcaucuagagauugaugucccucuaccucagcccuguaggcaccaaggcauuaacauagccaaccccauuccaguuccaaaucuaaaaaaaaaaaaaaaaaaaaaaaaaaccacacauuuaauugaacauccugaaauguauaaauagauucauugcaacaauacauuccugagagcccugguauaggccugagggccaccacaguacccaaaugucaaguacgugucaaaccuuaagggaaccuuuaagucccauuacccacccucaaagaaaacugacagguuucucagaaccaggaacucccaacauaguaguuuaacagcauaugaucaagaaaaaaugauuaauaacagcagacagagagaucccacacccuccccccacccagagccccaaagugcacagaaaauaggccagggaucaaucuccaacaaagcagacuccuggguuugcugacccagagaccuggguguagaugauagggaaacaaggcugcugggggcaggaaucugggagugagccauucugggaggguauuagugcuaguggacugaguaccuaguaccacuucugggacaagccacccacuuggaacaaagaggucaccuaaggccucuccuuacagauuauuuuggaaaucguagggcaggggcugcaccuacaccuccucccugcauccacacccaagcagccuugacacaggcucccuucccauccagcaguuuguaagcaucuccccgaggugugggcucucaagggcaacguccaucuacacgaugccuggcacagggccuggcacacaguaggaccuucaccgaaugugcaaaaaaugaaugaaagccuaccauguacaaggcccuggcggccagagugagcccagaagcgaggaugauggaggugaggaaggugauggacuggccagaggugag

SEQ ID NO: 42 - RNA, 54161 nt, Mus musculus
cuuuugaggauucuguuuagguuuguauccuauuuuuaguuggguuauuuguuuucuuuauaucuaguuuuuugaguuuuuuaaaaauauauuuuggauauuaguucucuaucaauuguauaguugguaaaaauauuuuaccauucugaaggcuguugcuuugucugaugaaggaguccuuugccagauuaagauucagucucaugagguccugguuauuuauuuuugaucuuagugccugugguaaaaggauaacuaagacaauccugaacaauaaaagaagugauggagguuucaccauccccaauuacaaguuguacuacaaagcuauuguaaugaaaauaacauaguaucagcacaaaauagacauauaggucaauggaaucuaauuuaaaaccuagacauaaauccaugcaacuauggacacaugauuuuugaaaaauaagccagaaauacccugcuugcuuuguguccauugaagugguaaauuuuggagaaagguucaugaggagcagaaaagaagguagauuauuuuguuugggggugaaauguucuguugauaucuguugggcccauugggcuauaacaucaguuagcucuagccuugcucuauuuagcuguugucucaaugaccuguccauuggugauaguaggguauuuaagucucccacuaucugugugugaaggucaauaugugauuuaaguugcaguaaugauuuuuuaaaaugauauuggguacccuuguguuuggugcauagauguuaagaauuacaacaucuugauggauuuuuuucuuuccauauguauugucauacauugucugaaaaguuaguuuugaagucuauuuuaucagauauuaaaaugguuacaccuaacucggucccaaaaggacaugaaugguaugaacucacuuacaagcagauauuagcaauaaaacuaugcuauauuccacagauccaaagaagcuaaacaagaaggaagguguaagcaaggaugcuugaaucucacuuagaaggcagauuagaaggcuguuaugaggcagauaaagagagagaccuggaugggagaggguauggggaggagaaugggagggucaggaucaguuguggggagggacaggagagauggccagauggccgugagaauaaauggaaaucuggaaguggggagguggggguaucuccaggaugugacagagaccuguaauaagggaagaacccaggagucaauagaggugaucuuagcugugacucacagcauuguggauauggaacuugaagaggccaccuccuguagccaggcagaaaccccaauggagcaauaaggacaccaacccacucacaaaacuuucuacccaaaauuuauccugucuauaagaaaugcagggacagggaaugaagcagagacugaggaaaugcccaaccaaugaccaacuuaagaacaguuccaugggcaaaacccaaucccugacacuauuaaugauacucuguuaugcuugcagaaagaagucuagauggcuguccucuuccauccagcaacugacucagauagaugcagacacccacagccaaauaguagaugcagcuuggggaugccuguggaagaauagggggaaggauugugggucugaaggguauaggaacuccacaggaagaccaacagagucaacuaacuuggacuccuaacagaccugggcucucagagacugaaccaccaaccaaagagcauacauggacuggaccuaggccucccugcacacauauguagcagauaugcagcuuggucuucaugugggccccaaacaacugaaacaagggcuaucccaaaaucugcuaccuguccuugagguauguucuagcugggcgaccuugucuggccucaguggaagagaaugccccuaaucccacagagacuuaaugugccaggguaggggaaauaacaggauggcucccaucuauuuagaggagaaaaggagggggugggggaaaagauugugggaaugagugacugagaggggggcagugugugggauguaaaguuaauaaauauaauaauaauaauaauaauaauaauaauagucacaccagcuuucuuaaaucauuugcuuggauuauccuuuuucauuuuuuuaacccaaggugaugucuaacuuugauguuaaagugugcuuuuuggauccuaucuauuuccacaucuauucuuuuagucugugucuuuuuauuggggaauugagaauauugauguugagagauauaaaugagaguauucguuaaauucuugucauuuuguuguuguuguuguuguugguggugguggugguggugguggugguguguguguguguguguuuccccuuauuuugauuugcuggucugggauuauuuauuuuuuguguuuucuuggguauaguuaaccucuuuuuguuggaaauuuccaucugucaccuucuguaugucuggauuuguagauagauauugcuuaaauuuauuuuuucaugaaaaaucuuauuuucuccauuuaugguaacugaaauuuuguuggguguaguagucugggcugccauugguggucuuuuagagucugaagcacaucuguccaggcuuuucuguccuuuagagucuucauuaagaagucguguggaauucuaauaggucugccuuuauauguuacuuggucuuuucuccuugcugcuuauaauauuuucuuuguuauguauguuuaguguuuugauuauuauuugccaaggagacuuucuuuucugguccaacuuacuugguguugugcuccuuguacuuugauaggcaucuucuucuuuaugauacgguaaauuuucuucuaugauuuuuguugaaaauauuuucuguaccuuugaccuuuauuuuuuuuuucuccuuccucuauuccuauuauuuuuagauuuggucuuuuuauagugucccagauuuccuggauguuuugugccuagaguauuuuuagaguuaacauuuucuuuggcugggguauucauuuauuuuauugugucuuuagugccugagauucucucuuccaucucuuguauucuguugaugaaguuugucucugguucaaguucaaguuucguuuccggauuucccucaguuuggguuuucucuauugauuccauuucuacucucuggucuuaaauuguucuacucauuuucuuccacuguuuguuuguuugcauagauuucuuuaagggauuuauuaauuuucucuuuaagucccucuauggcauucauaaagacuaauuaaaugucucuuucuugugcuucaucugugugcugugguaggguugcuaggcucucauggaggcauguuguccaguuauuguguuuuuacacuggcaucuaggcaucugggauugggaugacuguaauucuaggugcuccuaucuggccuugccuuuguuaugugagugucuugauccuuguuuucuguugcccuuucuguucuuaggagagagugcuggcuguguguuuccugguuaucugggguccugacaguguggccacuggggacucugucuaugucuauguauugggagcugacacuuaggaauggggauaguauaggagaugauuaaggaggggagcuacauuccaccagaaucugcuuagucuccugugaacagguuggggugggacagagugugaggagaggccacaacagguagacuacuacacuacuacacuacuacacuacuacacuacuacacuacuacacuacuacacuacuacacuacuacacuacuacacuacuacacuacuacacuacuacacuacuacacuacuacacuacuacacuacuacacuacuacacuacuacacuacuacagagcuggggaugagccuggggauuggauuuggaagagcaauaggagaggugaaagaucugaaauuacccuccuugcuuccaucaagaauuucauacaguguuuuuuucauuauauucacccucccccaacuccucccuaucuacccaauuuuuacuccuuuuuccauuauuuuuuauuauuuauuauuaauuaucauuauacauuauauaauuaauuacaauuuauuauuacaauaaauaauuauuuaauuaauaauuauuuaauugaaguuauuaguaauuuuuaauuccauuaaguccaguuuuuguuggccaacuacucuuuguacuggggccugcccuggaaugugguugcccuaccagggguccaugaaagaaagcugaccuuuccucuuagagcagcuauucaaugccaauagcuucucagguacuugugccuaccuccccugcuccaugcugggauuucaucuggcuugcauuguaugggucuugugcaagcugucauagagauccuaugaguuuauguguguaucugcucugucgugucuggaaaacacugcuuccuuaaagucauccaccacauuuggcucuuacagucuuuccacacccucuucugaaaagaccgugagccuuguggggaggggcaugaucaggaugucucagcgagggucgaacacuacagguucauauucuuugaauauuaaguagaugaagauaucggugugacuaucaggcuaguuauuauaguggcuagcaguguucacagcugggugagauugauguauuuguuuagauagcuucucauguuauaccauguugguguuuagcucacuauguucccaaagaugaccuugaauuuuagacucucuagcaucucccucccaaauucugggauuacaggugugugacaucaugcccaguguaugugguacugaggcuccaacccagagcuuuguacauucuaagcaaguacucuaccaacugagccggcuuccucauugguuuguguauuuuuucuuuuuauuuacuucuuccuuuaauauuucauccugacugcaguuuccccuccauccccuccuccaagucucucuccccaaccuccccuuuccccuggcuccauucucccacuucacuuucccucagaaaagaacaggucuuccagggacaucaaccaaauauggcauaacaagccacaauaaggccaggcacauauucucacauuaaggcuggucaaggcaacccaguaggaaaaaagggucucaaaggcaggcaaaagagucagagcagccccacuuccacuguaaucccacaagaaugccgagcuaaaaaccauaacaugcgugcagaagaccuaggucagaccccauauaggcucccugagcucugagagccagcccccuugagucccagucaguugacucugugugugauguucuugugauguccuugaccccacucgcuccuccaauccuucuuccuccuugucugcugguuguuugcuuauuuuuaagagcagaaaauuuuuuuuaaauuaaaaauauauuuuauuuuagugugugugugugugugugugugugugugugugugugugugucuguguaugugcgccauaaugugcauucauguagaagucgagucaaaggagucaguucucuucuuccaccaugaagguucugggaaaucaaacuuagaucaaaggcacagaggcaagccccucucuauguagaaucaccucacuugcccuauuaaguuuuauuaagaaggcagaagaaugggucaacaaguggcccuugacucugacuguccaacuacuaccaacacugggcaguggggaagugauggggagaaagguuaccaauacuaucucuugucuaccaguggccccauucucucuguuccccuuuccaugaacaggaucagaaaaugucccuuaaucuuaauccaugccaaguuuggauacucagaaguagaggcuguggucagggguguccucuguugcucaggagggcacagcccuggguugcagugucagcuuguguaauaccuuccaucuuauuguccaggcuucagaacagcuuccagugggcaccaauccugccuccccauccuguuaauaagaacuugaugauggacacagguuuacugacugcagcagucuccuugggaguuauaauccuguuucugauugauccuagcaggaaccugggauccaugggugaaugcaauacagauuuugaugagccagguggaagauaggcagaggcucaggacaccuuaagaaacuugaauauaauaauuugcuuuucucuagugaagaaaggcaugggacaggaugguacccugaggcaccuuggcuuugucaccugggccagagagcuuugugaggauagccauaaucuggugccuuuagcuacuucucacuugccaagugaucuugacuccaagaagauccuguuuaucauuaaugguguuccuaccauuaaaaaucuucuaacccucggggcagaucauauccaucuccaaagaaucuuauucuggcaaugggcaugugaauaucuucugcccauauggagugccaugaacagcauacugacaagcuuaaagauuggaaauaccuagugagaucacuaggacuugguaaccuaucuccccaugccacccacaaccuuggaggccaggagcuugauaauucauguucccugaaccucuguaagacccagucucuguguucccaucacugucuugccucuugugucucaaaaguucuaagcaaccuuccuuuuuuuuuuuuauuaccucaugucuuugcaucagcaccaaacuuggcagacuugucuaagugucuuuugaauuuaaugcaguaacaacaaaaaagcuugggaaaccuguuggguacaagguagggucuguaggcuuccaucuuccuucucaaucuuuaugucuucucaucauaacauggccucacccuuguggccugugccugcaugaugaugcugaugauggaggaggagaaggaggggaugaagaagaauaggaagaagaaggagaagaagaagaagaagaagaagaagaagaagaagaagaagaagaagaagaagaagaagaagaagaagaagaagaagaagaagaagacacaauucccagccugccauagccucaaguaccaaccauuguauuaauuucagauaucuuggcuccucacuaaccagggacaauaauaguggccuuccauggccuucacugggacuucuccaacuacagcaauaggcaagugccccucagacaugacacuauagccugggggacaaggaaauuuuuugaggcaccauauguggcauugaauucuugggaggcaaagaacagcagcucagacaagagggucugcuggagucuggauaugaggcuagggaugaugaagaggggucagccuugcuaguggauuuucagcaugaacaugcaaggucaguguguucaauagagagcucuggcuuccugacagagagcgggcauguucagcugcaggugggucaccaggaagagggaaucugccagacccugguacucaauagaugcuccagacugugcuacggagcugguucaagucaaaagagagucuaaauuagucucuagaaccaagacugcucauuuccuugcaugccuuuagccuggagcaguggcuuuugaaauggcuuucugggaccugaugcugcuucacccacagguaguuccauccuugagugaguuugggagucccccauaauaguacuaguauuagugugugugugugugugugugugugugugugugucugugugugugugugagagagagagagagagagagagagagagagagaauccuuguuagcagaccaaagccuuucagaagacccauauucuccucugcuuaauucaguguuggugaaaugggguacccacagaacacacucacucacauaugaauuguuugggaaacgcuggguaagcuuucugccccacauuggggugcuuuucuuggaaucugacagggcuggaagguugaaaugaaggcagacuacccacugcgccgauugcauggcuuuggagcaugucuaaggcuggagggagcuccuguuuagggggcuucuauuggccacuuuuccuguugucauucuaaaauacucggagacaaagcaacuugagaaaggaaaggcuucuuuugacccccccuuucaggguagauagcucaucauuacaaggacagcauaauggcaggagcuagagguagcuggucauauuacauccacaggcaggaagcagagaguaagcacuagugcccagcucauuuucucccuuuuagucaguccaggacuccagcccaaagaaagcugcuguucacaguuaaggugggucuuccuacaucaaucaaccuacuguagcugaucccuccgagcugugcccaaaggcuagcccauucuagauucuaucaaguugacaaucaguauuaaccauccagggcucccugguaggaagcuuccacuuccagcuggggcuaugagagaacucagcuucaccugcagaacguggggauaguucugugcccucugccugcauucagagagggagauaugaaugcgacaaugcauuuggcacucccaacgauucaugauguccagggagccucugacagugcuggcuucuucucagccaaaagaaauugcccugggcuagcaguggcaccagccugggauaauuggcacagagugcuguacuucccucucuugguucccucccucccucccucccucccucccucccucccucccuccuuccucccuuccucucucucucucccuuccuccuucagucccuucagcagcaaccccugugguuagacacacagugggguguguguguaugaagaaguacuggcuugggaguucuguccucaugcauuguggggcuaggauaugcccucucuggugaaagggcuggaggaaggguugcagacauguguguacagaacagaacaaacaaguaggcggcagaguuauaaaaccaggauguguuuuauuagcuaauaagaugcaucugcuuuuauuaaagagagagccaaaguggaagggaggucuagggacugacucccaaaggggcacagagaggcugugagcccacucacuggccacagcugugcccuguauugaugcccucaaagccuuucucuucuugucucugcuccuccuuaaaccucuuacucaugcccaagucuagucaagaugccccaggguuacaccuacgaaccugcagcacuacggggggggggggggagagcugucauugacucaaagguggacaggggagcccaugccagacaaaagacaaagacaggaagaauuucugagcuuaauuggcaauuauccaacagacaaaaacacuguacuguuuuuugggguuuuuuuugagcauuaaaaaaaaauccguggguucagcacguaacccucggaggugaaacucccagaacuaccccugguguguguguguguguguguguguguguguguguguguguguguuuguugccaccauccuagcaagcacucacugagcaucauccuggagugggaacugagcaucuuucccaagagaauggggacuagggaugcaggccgaauagucaggacccaggcuccucuccaaggagucaaaagacauucaaaaacuggguugugcgauguggacaagaaacuggaauccuggaggaaacucuggaaagaagcccggggacaauggguucuagaugggaguaauucuguggucuuggacaggaggccuuuccuucaccuauaaaacaaacugaagugccuuuccgucuuuccaaaacgcuguguggaacuggagcuucucugagcaaagccuggacuccagucaucagagcucagcccaucccccacagcuccugcacuugucuuuggggacagcuuggaccucgcugcagucugguuggcucaaacgugggcagaucugugggucggagucuagcgcccccugguggcgccgagacgcacaagcccuaucggaccucuugcuggcccgacggucaggccaugacucagggugccaccgcugccagagcagcgggaggccugacugggguuccgucguaggcugagccacgacucaauuaauuaccagcugcugggaaucuuuguugcucgcuuguggugacucacuccgcagccaggcucccuugcaaagcacgggggccuuggcuuccaaaaugaauuuuggggagcgcaccugaucagguggagcuccccauccggguaccaggaagaccacacggagacuugacuguucaggaauagcucacagcgcccgaugccccugcccuguggugcacucaugauccuuuaaauuuuaccugggagcauacaugaagccccuaguccaucgggcuaugcgucuggguagacagaggcuggggcauggucuaggaagcugaagaacacaggguuucuaagucuccgaacucuuucaacagcuggggacgauucacaggcugcuccuaucuccauggacagcuucuagcucccgccuuuuagcuguugcuugguggucaccagaucucuucaucagcguccauggcuagggacagagaagauagccuggucgaggaaaccaaagcccggggucucaaaagcgugauucugucugucccaguccgcagcagcacugcucuaggggagcuuugugagcaagaaaaccucugggcaaccuaaagaggauggguggguggggaacccagaagaccuaaacaggaauccuggcuucuuccuuaaacucaaaggcuaguagcucccuggccagauccuccuguucuauuuccaagccuuaaccuggagggugccucgccgggggagcgcgcgcgggggggggggaaguuccugcacucugcuccucagcagaggaaucaagaaaugaacagugaagaagcgcgcgcacugggggaaguggggauggggggugggggcggggaggcuacugcuggagaggggaaaugagaauuccuguccauccuuucuugagguguaacucuuaaaagugguggucugcgagaucucuagggaaaaguagcggggaagggggguagcaggugcaagaccacccgggacacagccacuauccgaacuaagguggcugucaaaaccccaacaaucuagaaggcaguauccaguagggcgcugcugagccagguggcugcugcagcuggacguguguguguguguguguguguguguguguguguguguguuacaagggggagcguguggccacugcuguugcacucuccagggcucauagccccuuccuuuucuauuuccaacucucccgguuuuuguuguuguuguuguuuucccccauaaaagguuaaucugucuccacuggucaaauucguuuuucauccccagcugcagggcccucaaacucucucuucacuuugccaagguugggugcgcucuuaggggagcaguacuuuuucagaaggaagccacuucauccccaucucaaacccucuagcagcuggccucccauccccgaacccuagcagcaccuaguucaaccccuuuccuuuucucucucucuggccaucacuccugggcuccuucaugugcacccugcgcaguaccaggucugcugcaggagcugccacugccgccucaccagcuggcuggggaccaggcgggagguggcgcgacccagaggcugcaggagggagggagggagggagaaaagagaggagggagggaagccgguccucggaguagccugccccccucccucccgccggagcggggccgucaaacgcaaacacgcgcgcacgcacacccgcgaauacauacacucgggcucccuccggcgcgcacgcacagcgccucaggcagaccagagcggcggcugccucucuggacuccuggacgccagagucuuaggauccucgggcagcugaugcgccuuugccuguccccaucccuacccuucaguuccuccagggcugcgggaccccucccgccgccgccgccaccucgcccgccacccggcgaggagcuggcuggccggccgcugccgcgcaguucccucuucguccccgagguagcuccgucgcggcuccugucuugggcuucgucguguuccugagcuucagaggcugagcagaacaaacuucgcagaucggcugucgcgcggcgggcaccccgcgugccccgcgcgcccaggugggcacggggcuuucggaucuuggggcaucggguuuccucgcccguugccccugcuagauagacuuuaucccugcuugcagggauucuagagacuccuucacuuagcaaacuuucuauuucccccaacccaaagggggugaagaaagcuagagggagaagcagguccccgcggggcaaccgccacacuggaggcgauuagcugggccccgcuagccggggaacgcaucagggauggggaaccccuccccgggucucccucugucccggcuaccgauccugccccaaccgagcccgcaggcucgaggggcgaggugcccaggaccagacagcccgcgcggaacgagcuugggccauccauccgcacaaccauccgcacuggggcaaaccgcuugacccaggccuggcauagggugucccggguucaggaucgcuggccuccgcgccaaagcaaugucaucaacauguccaccauuucgcgcgccccgguggugaucaccacgcccgcggaccccccuguguacgcggaauccguugcacugggugcucccgaagagcccgcugugcccgcggaacccgcugcgccggcggaacccgcugcgcccacggaacccgcugcgcccgcggaacccgcugcgcccgcggaacccgcugagcccgcggaacccgcugagcccgcggaacccgcugagccggcggaacccgcugcgcccgcggaacccgcugcgcccgcggaacccgcugcgcccgcagaggaagccgagccugccgagcccggggcguccgcuggucccgcagaauccgcagaguccggggagcccggugaggucguugagucccaggagcccgcggcacccggggagaccccucagccuucaggugguggugaaguucgugaaagugaugaugcccaagaggagaccgaaauuuccaacaucagcuguggcaucugcugcuaccaccgcuugcaacuucgacuccaucguagaggaggcuuggucagcgccgcgcugcauugggauucucguggucugguccaacuucccuuuagcaucuccuucuucgcggccaugaagcggcagaacgugcguacccuguccuugaucgccuguaccuucaccuaccugcuggucggugccgcgguguucgacgcccucgagucggaccaugagaugcgcgaggaggagaaacuuaaagccgaagaaguccgucucagaggcaaguacaacaucagcuccgaugacuaccagcagcuggagcugguaauccugcagucugagccccaccgcgcugguguccaguggaaauucgccgguuccuucuacuucgccaucacugucaucacaacuaucgguaaggaaugggugugccgccaccgggcucgagggagacacgggaggggucuaggagauguagcgcacacgaagcaaugcugaggugggggugggggcuucccagguuuaagacagacccuguuucagugucucaucccucaggggcaugaccucacucuuccaggggacccuaucuggugccccagacugcucugguguuugggccaggcuugggaacucucagagucagugcuguugucuugaggguggaggcgccacuuuugcgaagaguggagcgcuaagaauaaucccacagccgaacacccacccaccuaacgccccaguguuggcugcgcuucccugaguggguuccaagccuuaaacuuacuaucucuuggggaauuugggacaaagcuggugggacauuaaggugacaggagguuguuuauagagcuguauguaggagggggugguacugguccuuccucaccuggggaccuuuugagauuucagcacccaauauccuucuuuuggguugcugagaguguuagguccugagagaagaguuuucucuucuaugguugggguggggguggcagcaggugaccugcaaugcgguccugguggguuggauguggcagugcuuguuugcccuuguggacugggacugcggaccagaggagucuggguguuguuugaaaacugggggaguuuaacccuuucugggaaagaguccaucuaguacaagaugagacugccuguauguagcuucccugauucacacagguuacgguucagagaucaaucucugguggauggaucccuaugacugcauucccacugaagcuggugguugggagacaccccuggauuugcacauggaaaccugugggaaugggaaggccagacuuuaucccagggggugugguaaauacccuucuggcaggaggcagaauggugucucuggcuggucauuugcccugucuuggcacaauaccuugguccaucucuuuggaucugugagaaucagaauguggacucaaaugugugccccuguguccugauaaaaaacccucuucacuuauuuccuuuucuggaucuccccucgaauuuucccaugcauuuuuaauuaaaacaauuuuuuuuaaaucugaaaagcucugugcuguugggguaggggguggguacagaggauuugagggugccagccauaugcaacaggaagcaccagccugggacaaccugucuuuccuucuuguuugaaagacuuuuugaggguugcuuuauuuaaauaugcacuaaaucaguguaaguuuucaugucugggggaaaaggcauccccuuuauguuacucauauaacauaaaggacaugcuggcccugcuggccccaaagcccccacccccacccuguggcauuuccagguuggaagagaggccacuggucacugcaucauuucugucuuugaacugugguggugauauauggauguguucuggggacagguauauuuucuggaaggcgagaauauugccugugacagagagagaggggugagaaaucucauggugcccuuaacgugccuuuugugaucuaggucuggaacagagacuuugguuuucaggcuaguucccuguggcaaaaucagcauagaaaacuguugacuacuccauagaggugggcgacacugugagagggcuggguuuguuaaaaacaagcguugucauguugccacauuucuuaaaaaaccaaauagaacaaaacaguaauugagcuugagguagcuugcacuaaccauugauaugacuggcaguucuggacauaagcguccaauguuugaaacuccaaagaaaaugguguagacagaagaggagcaagugcaacugcuguccuggccccuagagaaggaugcugccaucaguacaggaucagggccacuugggaaagaggaaaaugaugauuucucuaauuucuuuuauuggguuuuuuacugauuuuugaaagguugaaaacacacacaaguacauacgugugcucacauacacauacauacauccacauucucaugcauauucauaugcaugcauacauacauuuacacacaugcacagacagacacacacacucucacaugcaugcacauauguaugcacuugcauauauacacacucaaugcauacauacacauguacauguacauaaacacauacauacauaaauaaacauaccuacuugcaugcacauuugcauacaugcaagcacacacuuguagucagacacacaguuacagauacauucauauauacagucauaugcaugcagauacacauguauagguauacacacaaacauacauacauauauacauacauuuacccacuuguaugcacauuuacauguaggcagacacauaagcauacauauacauucauauauacucauaugcaugcacauacacaugcauagucauauacauaugcauauacauacauauacacauaugcacauacacauacacauuugcauucacauuuacacacauguaggcaauauagccauacauacauacauacauacauacauacuuguaaauauacacauacucaaauauauucaugcauacauauauacaugcauaggcacacacacaggugcacacauagacauaccugaaucacacauacaagcauacauacauacauaagcucacaugcacgcgcgugcacgcacacauacacacacacacacacacaccugaaggcagcugagcuugugugggaagccuggaaucuggagccuuccaugcaggaagacuacagugaugccauuuucugauuuccagccucaguuuccucaccuggagacgggcuguuauauaguaaccacuugacaggcugccuuuuaucaucagccaugggcauguaggaucacuccacagcccugcacauuaaagcacuuaguagaugccaaaucuauacuccugguuuuggcugacugugucucauggugucugguuaaacuauaggaaauaaaacaccuuugcaauucauuuugguuuuuuuucuuuuccuuuaaaaauauaaguagaagugaaagugcuuuuaggccuaagaauaaaaagcaguccaagccaugguaccauaggaauugucuuuuauugggcaacaauaucagcaagugagcuucauugucacagcuaucccuuuuuggccgacuuugagugauuucuugggugugugcacauugccuuugcacccaagacucugguuguggcaggagcccccggagcaggcuaaugagcauugcaucucagauguagcuuuaacucacucuuuggaauggaguuucaaaccauguguaauuaccauuuuauucugaaucuguaacuaugauuucauggaagacuuuggaccaguaugucaacuccagcucuagcugucugggaguccugugcacgacaacugcccuuucacguugcucucauguugcagaucucuugaauggaguuuuccugguugguuuugaacuugggugagagcccccucucuuguagcccacugaccugauuggcugugcaguggggaccuaggcaagugggggaaguagacagugcugagcagagucuacauggguccaggggauucauuggacauuuuuucugcuugggggugaggucuuggagcuugcauaauauaugacugguauaaacuuaccaccucccacagugggagguucaagcuaaaacugucucacagucagccucuuugcagaauguaaaagagacgggauuuucaucucacuguuuuuuuacugucuaacaucugugaucuagguugguuaccuuuaggaucauuaaaaaggaagacaccagaugccaucugccaagcuguggaggacaauuuaaaggcugguuuaucauggaggaaggagggugggcuuguggaauuuucucucuagcuacaguuuugagaacagggaagaagcacacacuuuucugacucucugagucauucugaaacugagguugcugucauaggagugaaggucacuguuuuaggauuggggucugcagaaagaggcgggaccugcgagaggaucccuagggauucuucccuguucuagacagacaucaaauuccuucccaagucagaagcagaucacugaacagacuuuucacaaaauggacagcagucaucacagguuuugaggugguuaugaacuacauucauggcaagcaccugcucugacuugcuugugcugccugcuuugagacccuggggacaguauagaugacaagauaaagucuggccuccagagaagguucuggaagcccagugugguaguccagugugaaucaagcacagcuaagcucagcgagagucuuuaccuguccugugccauccaccaggcuaaacacacacacacacacacacacacacacacacacacacacacacacacacucaugaaugcauucacagaauccuuacacacauguguguauguacuuguacacacauacacauggcauccuuacacacacauguacagacaugcauaguacauguacacacuuacucacacacagcaugcuuacacacaugcacacauaugcauaguacccuuucacauacacauauacauacaugcacacauaugcacacauacacauacaugcacacagaugcagacagcaucuuuaaacccacauucacacacacacauucaaauacacacacacacagcacccuuucaaauacacacacacacacacacacacacacacaaguauagcaucuuuauaaacaugugcaugcaugcacuugugcacuaauacacacuugcacaugaacacuaaugcacacauacccagaauccuuacacacauauauacauuuaaucauagcacuuuacacccccaugcaugcacagcauccuuuaugcaaacauacacacucacacauaagaacaacauccuuacacacaugugugcaugcacuugugaaaccauacacacacaugcacacuuaugcaugcauacaaugaauccuuacacacacacacacacacacacacacacacacacuuaugcacacaugcauacacaugcacauuuacacauagcauucuuacacacacaugcacagcauccuuucauagacauacacacacaagcacagcauccuuauacauauaggugcaugcacacuuacacauguacagaauccuuauacaugcacacucacucaaagagggcauccacacacacgugugcacauacacacauacacaaucauggauacauucauagaauccuuacacacacaugcacacuuacuuacacacagaauucuuauacacacacgcauacagaugcacagcauucuuucacauauguaugcauguacuugugcacacauacacagaugcacaccuaugcauguaugcacagaauucuuacacacacacauguacacucacacaacauccuuacacauacaugcacacacaugcauagcauccuuucacccacacacauacacacucacacacacaagaacaacaucuuauacacaugugugcauccucuugugcacucauauacacaugaacacucuuacauauacaugcacacucacuuacaaaccucauucuuauacacacaugcacacacaugcaagcauccuuucacacauacauacacacucacacacacaagcaaagcauccuuagacacauguguauguacuuguguacacauacauacaugcacacucacucacacacacaugcacacacauguacacucacuuacacagcaucuuuacacacccaugcacacacaugcauagcaucauuucacacacacaaacucucacacacaagcacaucuuaaacacaugugugcaugcucuuaugcacucguacacacaugaacacucaugaaugcauucacagaauccuuacacacauguguguauguacuuguacacacauacacaugcacacuuacuuauacauggcauccuuacacacacauguacacacauacacacucacucacacacagcaugcuuacacacaugcacaugcaugcauaguauccuuucacacauacauacacacucacacacaagcacaacaucuuacccacauguaugcaugcacaugugcacacauacacacauguacacucaucuacacaugugcagaauacuuacacauaugcacucucacucaaacacagcaucuuugcacacacacacacaaacacacacacacacacacacacacacacacacacacacacacacacacacagagcauccuuacccaccccaauucuucaagugccacccuugcccuccucuucuccagucaaucucagcuuugugaauucuguucauucucccucaggucuaaacugccuuuucccccugaaccuacagugucccacauugaacuuagcauagaauaggcaucccacaaaagacugcaaagcugaagguggaucaaugggacaggcugaugccugaggaaucauggagccuaaucucucucucucucuccauccauuuacugacccaugagcugauaaggacacggcucugcuugacagaugaggaaacugaggcagauaaggcaauggacacuaaaggggagggcacauaagagcauaaugcaaacagggugucuuuacuucaggcucuagcugggaagucaucccaagagucauggugggccuaugugccucaccucacuauuuagggagccugcucagccaaacccaggugauggguagcacugggagcaagaggguucugaguucuccauaucuagguggccagcagguaucaugccaaggaugcaggggaugccuguagacagcucugcuucccuggauccuuucuaguccuagccccagccguccucacuuagcucaaggcucuugagcaaccauccugcuuacagguaccauggaggaagcagggggcagggcuguugauuugggguagcaucacagacacuuuucccuagaugugcagagaugcccuggugcucugaaacaauaaugagaccagaggcaaggacccccaaggcaucugccacauucacaugcucuguucugucuuaacuaaccuaggaagaucagagagggaggaguuggagcaggagguaaauguccuaugguaggugcccuaauaaagguuguccauguacuuacuauggacaccucuauccaaccaugucuaugcacacaugcacucauucacuuugugaccucacagccacccaaaucauucugccacucaccauuguaucuuuuaaucuucugugggccuugucauucauugccucgcccacccaacacugucaucccuacccauauaucaccaauucccuauuagccagucaucauccaguccuugaugcacuuggacaguuauuccaucagccaacaucacaccacucaccugccauccagcuucuucgauggaugcauacugugguccuugcauaucaguaucggauuccgugccacuccucuucugagaaccugucauucauuuccccaccagccacaguauugcuuaguccuacaugugcccaucuuucauuuccuauuagccaccagugaaaacucacuucucucacugucccacccacuuucauaucaccauucucccaugaaacuccucuaccugacacgagcucuugcuuuguccuacauuaccugucaucaguugccaccugugcauugcucaggcugcuguacaucugccuuccuccacuuucaucaaccacuacaccaucaaguuuucuacacauauacaauuccuucacacaucugucacugugucacuugaggagccuccauuccucugucauucauucuucuaccugacacuguaacuauugcucaguuacugggcaccucucgucuauuccucuacauugcgaucaugucauguggucuuccauagaacaacaacucauuucugucucauuauuggagcauuuggucccuccacccacaugccauguacacccccauucccuuagugcuccccuuucacuacacaucacuuagugcucccuggacuugccauccacuucuuuaucucuaucaacuuuccauuacccuuccucccuacccuuaucucuucaacuaucuccuucuugcauacuucuuuuguacaguccuccccacaauugucacucaaacauccagcugccaucacaucauucaguucucucaucacucacuugucacucaguucuccacacuccuguauuguaucuaccauugucuuagcuuuccauaaucucauauacuuucccucugagauaucaucacucacgugucugggaaguguccauacuuccaccugccauuguaacuuaguucuucacacauaucacccacuuccuuggccaccauccucucagucaccuacaggauggauauccaucuccucaucuuuuauugugucacuugaacuuacagcuacucacucagcccccaucuaccacuguaacucucagcucucuagcuucccucuuauucauuuccccauuuaccacugcaccacacauucuuccauucauuugcuauucauuuucuauuggacccuaaaccacuccaaccuccauggccucccucugugucacuauuucucuaagcccaccauucaguccauugucucacaugaauuguucaguucuugcccaccuggcagucauucucccaccugucacugucuacuucauuucuucaagugcuuuccauucauucuccaucuaccagggcccagguaguuccuccucccaccugccuuuuuuccuccauucacaauugucccaucaguucuuucuauacuugucacuuguucccugucuaccacagugccauugagcuuuuauuuuuugucacccaaacauguuccuuuuucuguuauccgccauuguauuacucaguugucuagcuaccuacuguucacuccucuaccauuccuuuagucacccacauaguccuguccuucugcuaucugcuaguguaucauccacucugagaugcaccugcuaugcacuguuacaucauuaaauccuccuugcaccucucaucuguucccagacgcaccacaucacucuugauucagggcacagaccauccacuccacuauacaccaucaaucccacugucuaccuugcaccugucauuaauccuccuuugcaucauuacaucacacaguccuuuuuuauucaguucuccuaaggacugucccucauucccucugagaauuauuagaucauuuaauccuccacacacucgccacucauuucccuauggaccaugucaucccccagggucccauguugucacuaaaacuauugcaucacucaguccucauuguacccaucuucuauucccccucuaugucgugacaucacucauuccaaacaucacaaccucguucaguccuccacacagcuaucauuaauuauccuauacaccaugaaaucagucaguccuccaugacugucucuucauuucccauauccaucacacuauucacucacuccugcuccugucauuuauuguccucuucagcaucucauuaguucucuguguguuugccauucguuccuccgugugccuguuguuugcuccccuauacaucauuaugucacccaguucuccaugaaccugucacucauucuaagcaccaaugauuucacucuauccucuaugcuccugccaaucaucccucuguacaccauuauaucauucaguucuccgugcaccugccacucauucucucauggacuguuuuguuacaugguucuccauguaaccauaauucauuacccaucagccacuggaucuuuuagccauucacuugcuuaccacauuuucucccuuuguuaaggugucacugacucuuccaugcaauucucacagguuccccauuaguccccaugugucacauuaugcucaauacaccugucaucauuuaucacuuuccagaaugucacacaauucuuuuuugagacaggguuucucuguguagccuuggcugcccuggaacucauucuguagaccaggcuggccucaaauucauagagauccaccugccucugucucccaaaugcggaaauuaaaagcaugcaccaccaaugccggacuguugcucaauuauacaugcaucuauaauucauucuuucacuuaccauuguauuuuaucauucaucuccauuucugcagacguagccugcaucccuaucugagccuuagccugcaucccuguauaagccagucauuucuccuuugcuugcaucaucacugucugggcacaucaucccuucuccaaccuuccaccauauccucacuccuccauuugcuauugccucgccuaguccuuuaugcaccuguaagucaauccuuccucuggucuaucaaucuucuaugcacuacccauccauccuuccauucaugguaacaccccaccacacacacgcuagucuuuuauucuccucucugacuuugucucaugucaucaucucgagcaucugauacuguaucugucacugccuucaucucuuuccuuucuacaucugccauugugucuguaaauguauucauccuccuaucuucuggucucuuucuccuucauacauguaucaccaguuuucuggucugguguuuuucuuauucccccucaacucugccauuuguuuuccuaugcaucuuuguguaaccucaucuucauccacccucuacuauuauguuacucacucuucacuugcacuggccauuguaucacaauugcaccuuucauuuaucugcucuuguauuauucugucauucaaauacuugucauguuccuccaagucucccuuguauucaagguuuacucuacacucaccauccacuucuuuaucugcuauuaaauuacuaagaucuuucaugucaucccuucccacauuugccaugauaucaugcuuuugggcaccugucauucaucuaagagacccuucucuaucauuuagcccuccuuguagucauuccuccaucaccauuuaaucacucuguccacucugauccuuucauccacuuccacauuuaauaagacccugauguacccaggcaaucucccucacaaacuggggugguguuugagucacuuccuaauuguugauucugggugggauaugaugguagcugauacaggacagggcaggaaaaacugagcauggaguccuaguguaaggaugcaauaggguuugggauacugguuuaaaaagacauccaugguaggagguccuagagauaagcucuuuucugacaauacuuggaugaugaggaauucuggcugcugagaggguuaguaugguguuugucggggacaauguucaggccaggggacccuaaacacaaaagaaguggaagcuaauguguauugagcuacaaagugaacaucucaucacugggaagaaguaguaagugaugguagagaaggcuuacacaauauacaaaaauacacucacuucuccccuuucaccuucuugguauuguccaugcaugcuucuagaaucauccagcaauuguacaguucugcuuauagcauagaacccaagaaacugaacugauaaaauaauaguugucuuuguaaauuggaaagccuggguaagcaaauaccugcagagauucaguucauaucuuccagcucagcuaucuagcucaaaagcucugauuggcauauguguuuuauuuggcgcuuacauuguucaaaaauaugaagcacuagcuaacaacaucuaucgauuuuauuauaguagguuuccuugauauuugcuuuccuacuuaggaaagcuuauucugcuuuauuuaguuuuauucccccaacccuagcuucaaguauaagccuuuuucuuuccguuaaaauacaaaaggcuauguguuguccuuuguuugccacuuuggcuggaucuuaucuucaccgauuuguaaauaauuugcaaauaaguguuuuucuuacaaccaaugaucugcagaugauuuucaaauaaacuuuuuauucuuauaaucaauuauuuauaaauuauuuacgaguuugguuuuuuuuuuuaauccaaugguuaagugugugaguuuuaaagccaugcaauaugcaugcacaugaaagcuuguuaccagagagauuagaaucaugagcuuugaagcugauugucauaggcuguugcuuguugagcaaccuugggcaugagauuugaccucucugugcuuuggccuuugccauuuauaaaauguggagaauaauaaucacaaaauggcugucaagguguuuugagauaguuggauuuauuucuuauugcauucuaaacauuuaaaacagcuaacauguacugugugccauagucuauaagcacauuucaaauuuacaguuucucuauuuuaaauuuuuuugggggggguuucuuuguugcuaaaaauuuaucuuuugcggaguccuacaacuauuugaaaacauuuauuucucuguuguauguaaaguuauauacauuucucuuaguuugaacucacacauguuuucucuuucaagaguuggaaaagauuauuggcuuacacgcacugaauuuagcacagugucucaggcuaucaucauauuaacguguaugccuaacuaguucaccugcucucuaggcucaccauugucccaggacccaucacucacacaccccagucacucggcuccuuggauauuucaguguaugauccuugcuuuauagucuguacauugcuauuauuaaguuggcuuggauccugagaaugcuucacuagcaucucguuggaugcuuugcuauugagguuuaucacugucucuuugagucaggaaaacuuugcuuuucaugcuuugaagcuaugugguuagaugcauccagguucaugcuugugauuuuuuuuuuuucuugguagagacaacaagauucuuuauuguguaugauacuuuuugccugaagcuuccuuucuguccuaacgauucuggagucugcuuucuuucauuagcauuuguuaugugaauguuaauguuuuuagcuuguuuuuacacuuuuucuucuaggaagauuuuugacauggcuuguaacaaaagauacaaauauagguguacaggugaaaaguuagugugaaaaucuggggauccgugcacacucaccccuguaggaugugauagugcacacuuaccucuguaggaugugauaggagucacaguuucuuggauagaaggggcaagaaggaaacaaaugcucuagguggcaucacgaggaacaaauggcgcugagcugcacagguauguagccuuguggcuucacugaaugccauugcauucauacccggaacauggaugagaaccacgcuaagcccaggcugugcagaaacaggggaagccuuggaguacucaggugagugaugcuucuaucagucuucaggccccacugcucaggauuauuuggggcuuaagcuccuuugauauuucuacuuuaucuucccugacaugauccugugccaagcacauuguuguucaaggcagaaaggaugggaaaugccagaagaguuauuuuagccgagauuauccuaacaccuuucuagaaguccuacccaauuuuuuuucucucucuauccuauagguuauaagugggucacauggccacauuuaccuucucacuuugagguuuagacucugauuaugaaaugagucugagcacagguuuggcuauuaaacgugaugguucaugauggagcccuagggcuugcuccuaaaggcaaaagccacuagcugcuguuuugcuaucucaggauauccucagggaccccauaaaagugagaauagaugauggagccaaaauaggugcuggcaggggagcaccccuaagaguggaggggugggggugugagcaagaggaagcuggcaucggggaggacuuuuuagagcagaggggaggaagcugguggcagagaguacuugagaguagaagggggaggugaagggugggugaaccucuuucuggcggacuucuuuuccuccuguucucuagacaucuguucuguaccccaucccucaggagaggacucaaaagcuaacagaauauaauuuuucucauccucuuaagcaucugcccugagcccagcaguauuucuuuauaaagcaggugcuaagcacccauuuuccuccaaaugcuuuuuccuuccuacagguggcaauugccauuagugccaggauuuugcccucuccauacaguagaagggagcugcugcguucccuuugguccuugauguuccugacugaagucuucccuuuccccacacucaggagacccagucauugggacugcuuucucccucuccuuccuccccuccuucccccucccucuucccuuucucuccuccucccucuuucucuuuucuccugcucuggguucugcucuccagcucagccuagauccauucugggcauguguaaguccccugucugguuuuuggcuuccuuuggaggaugaucuaagcacuuguuuuaaagggcuggcgggggaggagggacacgggcauuaugcaacauuguacucugacgauguuccacaccuggccuccucccaguugcaugcauuugugguggcucaaggcugguauuaauauacauuaagucagugccuuguuugagagccaucauugccucuuugugaaccacauaaaugauuaccauggccuuugaaguccaaacucuugcugagauguagccuugacucucauuucacccccugcuccaugcagaccaagucaugggcuaugguggacucccucaacacucaacauuccuucucugugcaucccucucuggcuguuagaugcuucuccugucucuguagccucggggcucuggccagcuaagcaccugucaaccugugucauaucaguuuuuucccaagccagauuuugugcacugcccccaggaccucuggccagggaccauguuguuaccugcccguggcugaguuguccgcccgccagugucuagcaccaagcaggcccucagagaauguuuguugaaugaacauaggcauguaaaugggacagcuuucacgagagcuauauuuaacuguucgagaauauucucugggucuuucaaaaaaagcaaaucuugaaaaacagcagcccacgaauccgaacagcagguguucacaagaagugguggguggucuaccaggagguugucugcuucccaugggcuugagaucauccugugccccucugacuuucuguaugguccaggaugccugcuggcuucccagguucuguuggaacuuucagaaggagaugcccuaggaaaguaucccuuccccccucccucccauggcucguauuucugagcuuuuggcacagugcuaacuguccccguucuuagcuguccaucugucaguucaauccuggggucacugugcuggcaucuuugccaauaggagaaaucuacauggauagggcagcacuauggguugcuggggaccucaccaccaugggccauugacucugugggguuucuagagaggccgacccuaauuucuggaucugagggcagaaggcauucaguggcucuguauuaugugcccucugcuugggggcaaacuuccucuaccacuaaccuugacuucgguuccaaauaaaccuucagggccauaaggaaaucuucagaggcagguccaaacuuaugguauguacagacuaccugucacaucuuccccuuuucuucccuacuauuguccauacucaguguuuccaccuguaaaguggguagaaauggcugcuucccagagacucugugagaucugaugagacaguggaugaggcacuuggcuggggcucugggucagagccagggagacagacaguacauggcucuuuaguauucacauuauugccugcagugguauaugcugcagcuucaaaaguagugaaacagccauggaugucagaacuaugcuuggggugauggaggccuugcuugcugccucuccuccagcacaggacugucucaugucccauccaagguaugcugugggacucacaagccuucagaauuguuaccugcuaaaucagggcaaugggaaguugagcaggagaccauacagggcgcucuaugaucuggccauagagcucuuggccacagcuaggcuaccugacucuuugacacacuaagggugcaggcauugcaacuuuaggccccugcuucccaccacugcuguccaaugcugugcaugaguucuuggcuggucuaggcagaggcacugccagcaggaagagagggugccaguuccugccagucucaggcacaacucccaggucccuguagucaugggaugagaccaggugccucaaaggaagagguugauggggaagggucugugucugggagggucugguguuagcaagugaugacacucacuucuuccauacagcugugacauuguaggguaguuaguuauuagaaaggccaguaagugagcaggcaagagauauaugcuuucaagcagggauaaacuuuggaaggugaagccucagugugggggagcuuaguucaagcuauaguaacaagcuuauaaauaacagcaguuuauuuacugcaauucuggagccuagaaggccgaggccaagagcagacaaguuagagacaaagacagaguugacaucucaccucccaaaggcacuauaagcaagaccaaggcugccuucugucugccaggugauguuuugaaccugcgcuggguggauaauuaugucuucaaaccuaagugccuaggaagacuugcuggccucauccuagucugaacggacuuagcuaguggugaguggguuagacugggauuuguuagacauagcauuguggagacccuaaagaugaggaggauccauaugcuacaguucaaaucccuucccagugucaugucccuuacaaugcagggggcucgccagucccuggacucaccaagcuuuuucuccacucuugcucccuuucaguggcacuugagaccccacaggccccucucugucugugugccagcugugggcaaugggacucuugcauggaguauucagagucuggggccuccccugucccacacccuucuguccuccuuccuuagagacaguccucagacccagggcguugccauggggauugugagcuggagucuauuuugagaucauguuagagugugauuuuuaguucugucugggcugccuguugguuucacuucuuguccaaugacuagcuagagaguuuggaaugguuuugcuacagacauacuacuccuugaugugacagacaggugauuaucauccagucugaccagucugcaccugcuagugguccacacaugucccugugaccaggggacaguaagguagcggacaccuuccugcaggagauguucucagccaagauucagcacuccuagcugcucacucagcugacugcugcuggcugguccugucuacagauggcaagggaacaguagaugccccaguagagaggggggaggggcccuuuagcagagagauuagcauggugaaggccagaaauggaggugcuggugacaucugagauuagggguuaguucggaggaagcaaggaggaguggguucgcagcuggagguugcuaugcucuaacugcagaccccucccaucuccuauuggcauuuauuauccgcucagcucacuccuaggcacuaggugaggcuaauucaccuauacccagggaccaucuccaaccuccuuugccauccucaugaaaaguaugacacagagaagcuuagggguggggguggggcugaggacaaagcagaguucugauucccacuuuauuugcccaccuuucccccuuccugguuccauucuguagaugggcaaacugagacucaaaggguuccagggacuuuucccagguuccaugucauugauuuaucuuucacuugcuguaggcacaguucuuucucugaacgcuguccucuccucaggaaagccccuccuuggugacccaggguggcuacucucacuagcagagccuugagauguggggugugagaggggauguuucucuagcuacaagugagcuauuggggagagcuauuugcugcauuuacuuacauucuagccuauguagccuuuucuccagaaauuucucuuugaauuuacuuacaugagaauguguggggaauugucauaggauauuuuuuuuuuaaauauagaugaucacaaaguccccaacacaggauugggcaucucuugauugagugcucugucccucccaaggccaugacauccuugguauucucucaccuggaucugcuaggagucaccaaacccuaugcuucauuuguccccccaacccagcucagggcuugggaaaucugcagagucagguuugagugggggagagccagccagccuugugucugggcggugagaggcuauuuugggagcaagucagggaaagagugcucuguuuuguuugcuccucgugacuaccagaggugguggagcccugcacuccuguccuggacaacuagugagcuccaagccagggauugaguggggaaggagauggacugguauacugcaugacagcuagaggccacaugagucuaacccccaccuuuuaucacugucagcuugcucaccagcaguaucugagagaggagaauagaagaggggaagaaacucucucugauccugacauaguaggcucauuccuaggucuuccaccugacuccacucaccucccuggccauucccagaaaaccuuugucccaccuauuugcuuacucauuuucucucuuacauucauuugcccauuuaaacuauuuggcuaaucaucucucuaucuacccaucugcccaucuauccuccauccacauucccauuaucuagguacuaauccaccuuccaccaacauuccaugugaaaauccacucaucucuucauuauccacuccccaucuauccauuuguccauuccuuauucaucuauccauuuuuagcuugaucccaugcaucuaugcauccguguuccauccauauaauacacauguauccaucuuuccauuauuuguucacccacucauucaucuuuucauucauuguccauccauccauucaucuauccauuauccacucaucugucuaucuacuguucaucugucuuucuuccauacaucccauaacuacccaucaguccacccauuuauccucuuaccuuucuauuccauacaucuaccuguucaucuauuguccaucaauccauguauccauucaucuaucuguauauccaucuauccacucuccaucuuccaucaaacuuguaucuauccaccaauccccuauccauuguaccuccauccauauuccaaauagcauccaucuauuaucaauucaccuucuauguaucacauauucacacauuuccccaucuauuggcccacucaucaauuuccaagaagccauucuuucaucucucaucuaucuacccauuugcacccaaugcuguaaccuguguuuccugucguacugaaucccaaaguagaugguacacaagauacacugauaauuugcuuuccuuacuagagaccaucacugacaauaaauuuggcaucuacagucaacuguguuaaucucauaauaucccuagaggcuuggauggauuugaacaggguucugugacaagagauggcagggaucaaauagacaccugagcaaaagacucuuggagaucaauuuucagcuugagaaccacuuagaagucuuucuguucucugcagucacuguagcugagggaagagcuuuggggcacggccugaguagggaagaccucuguggucuuauagggaccauccagaaagucauggaucugagguuuacugagggcaguugauaaaaaggagaaagauauggggagcuagacaaugucaugucaagggauaugagaaugucugucuaucugccuauugggcacagacuucuggcaggaucuguaugugcucugaggcuggcuucuuuucuagaagcucuguuccuugacaacugcagagaugggagcucagugcuauggaccuuggguaccaaaggucugauggcucacgccuuucauguaaauaauagaaacagucccagcuucccugcuguuuauacaggaaauuugaaucaaucucaacuagcuccaacuaggugguuucauuuucuucagugacagcauucucaccucccacagguuggggacacuggguuaggcacaucuuaggucucuauuuagcuugucuuguggccucuacaccucugagccucugcuuuccauggguaauaauaggagggcacuuaggauuucaguuugucuuuuugugcucugagguucuagaacuugggcaucaggugaguccucauacaacauggagcagaaaauuucaggagucugucaccugagagugaggcuggcuggcacgggggugggggagggggugguguguacucagcauaggccucugcgugcugaagaagauggauuuuacuugagcuaauaaugauguuuuguauuugcagaguggcuuuauagguuuucaaaguauguccuuguaagucuucugauuugaauguuagaagugaagaguuuguauauaguggguaaaucaagacuaguccagggccugggaugaaggaagcaaccucaaucuuccuuagacuuacaucaaaagaccauaugguaguuccuguuuucuucuuauuuuucuuaugauuaaaaaauggacacauuguguuuaugauauuuaccauuccaaauuguaaauuugagauacauuuuaagacaaugaccucugccccuuuggaaacuauagggcugauaguugugacuucauuaauacauuaguaguugguauguguuggacuugguaauggacacacaggucacugcuucugcauagcauuacauggauaucccugaguagcugagggaugcuuuuauggagauaacagauggggauccuacaaacuucaugagauauggcaguaaaccauuuucacaaugcauacauaugcgugggcagcugaguucuuccucagaucuugacauaccaaguucagaggcuaacacaaaucuagaguacaaaccugcaaucuugguagcaucagauuuagagagugccaggugaccacugaacuuuggacggcuaggucuggaaaggccuuagaccuuaccacauagaggcaggauuuccugggcacuaguaguuaguaacauuuggcaguaccagugcuuuuauucuuagggacccccccccagagaccaguaaguuccauauuccuccauuuggaauauagacaaguuggcauuuaguuacucccaccccacccccagcccuaagcaugagguuccccaggaaaacauuauggcaguuagcauuaguagagucuucuucuaugaugcagggaugggguuucaauguuaggcgugagaaguuacagaggaaagagcaggggagauccuuauuacacauauguguucuuccuuagccauauagacagucccaacuuaugguucaacuccaucauagauaaaaaguaauauaaaauuggcaaaaaaaacaauuuaaauucugcauuuuuaucuccucucaggcuagugcucuguggggugguauuccgucuacagucuagacaguggaagauucuacagcucccacuugccaugugagcauauggaagaacucugaucucuagacuagugcucuguggggugguauucuguuuauaaccuaagaaguggaagauucuacagcucccaguugcuaugugagcauaaggaagaacucugaacucuagacuagugcccugugggugguauuccgucuacagucuagacaguggaagauucuacagcucccacuugccaugugagcauaaggaagaacucugaucucuacacuagugcucuguggggugguauucugucuacagucuagacaguggaagauucuacagcucccacuugccaugugagcauaaggaagaacucugaacucuacacuagugcucuguggggugguauuccgucuacagucuagacaguggaagauucuacagcucccacuugccaugugagcauaaggaagaacucugaacucuacacuagugcucuguggggugguauuccgucuacagucuagacaguggaagauucuacagcucccauuugccaugugagcauaaggaagaacucugaacucuacacuagugcucuguggggugguauucugucuacagucuagacaguggaagauucuacagcucccacuugccaugugagcauaaggaagaacucugaacucuacacuagugcucuguggggugguauuccagcuacagucuagauaguggaagauucuacagcucccacuugccaugugagcauaaggaagaacucugaacucuagacuagugcccuguggggugguauuccagcuacagucuagacaguggaagauucuacagcucccacuugccaugugagcauaaggaagaacucugaacucuacacuagugcucuguggggugguauuccagcuacagucuagauaguggaagauucuacagcucccacuugccaugugagcauaaggaagaacucugaacucuagacuagugcccuguggggugguauuccagcuacagucuagauaguggaagauucuacagcucccacuugccaugugagcauaaggaagaacucagaacucuagacuagugcucugugggugauauuccgucuacagucuagacaguggaagauucuacagcucccacuugccaugugagcauaaggaagaacucugaacucuagacuagugcucuguggggugguauuccaucuacagucuagacaguggaagauucuacagcucccacuugccaugugagcauaaggaagaacucugaucucuagacuagugcucugugggcugguauuccgucuacagucuagacaguggaagauucuacagcucccacuugccaugugagcauaaggaagaacucugaacucuacacuagugcucugugggugguauuccgucuacagucuagacaguggaagauucuacagcucccauuugccaugugagcauaaggaagaacucugaucucuagacuagugcucuguggggugguauucuguuuauaauauaagaaguggaagauucuacagcucccacuugccaugugagcauaaggaagaacucugaucucuagacuagugcuuugugggggugguauuccaucuacagucuauacaguagaagaugcugcagccccaacuugccaugugagcauaaggaggaauucugaucucuagucugguacuuuuuuuuaugaucuaaggaauauaagaugucaguccacaugacaaaaaggggaggccaaagacccuguggugugaugugcuacugaguuagugcuccucaggcauauucauugcacuuuugacuuacaguaucuuuaacucacacuagguauauuuggacgucaccaacaucaucuguuggacaucuguauuccacagagaacaaaaucuuggugguaugauaagagacagaggagagagggugggcauggagauaggaacaguggauuucagauaucaggucaagcaaguccaugugccaaguccuaagcugugugggacaccuggcuuggcacaauauggaacuucugggacacucuuuguugcucccaacuguguuaucauuucauucaauguuugauuauccugucccuguuugaauugaggcaaaaauacauaguguagaacuauuggaaagcaugcaguucauauuuagcuuucaacauugagcaacaaucaccucuaucuaguucuaugcauuucaacacuuaaagcaauguaucauugucagucaccacauuccauugucucuuccucuaccccuacaaccaugaauucaucuucugucucuauggagcuuggcauuauaaaugguauccugugauacuuggccuuuggaaucuggcuucuucacuaacaggguauuuugggggcucacacauguagugagcauuagcuuuucuuucuaauuuacagcaagaugcuauucuacuaaaagaugccacacucuguuuguauguuucugguuuugaggagguuggagauuucuagcucugggcaggaaugugucuauguucauguauguauacuuauuaccaggauuccugcucuuuugguuauguucuuagggcuggaguaguuggguuucauggcaauucuggguuuggguuuuucuuaucugcuauaguggcaaccuucauauucucugguagccugcuccagaggaggaaauggugcaaugggaaccucaaggcuggagugcagagaagacauaaaaauaguguaaugagacuguugaagaauuaauguacugguguggugaaaccauggcccugaaagagaaagaaaaggaaucaggcuuucugguaauuguuagaccaaaggaauagcauggccaccccagagaagaaacaggaucuagguuccacuccagggcagcugauuugugauggccucaucccauccuggacuggacacacauguauaacacacauacauccccauucugggcccuggagaauaaggggugagaaaucaaguuuguuugucacuagacauugugccagucauggauagagugaccagagguccagaguugagcucucuguggcuccugucuagcauggaaagcaccugcuagauuaauguucuaugcaggaccuuggagagggaauaaaaaaaaauuauagacuuucaggucuccucaaaggaauaugagaagggcaaucucagugguguggcuguuuggugagucugggacaagguuuagguagccauaucaggacauucuguuugggauauaugcacauuuauguuuguggcaccuuuugaaacaccaacucuuuuauuacuucaaaaacucacuaauuuauuuauuuaguaucuagugauaguauucauuuuggacccaauuucuuaucuggugcuaggacagacaugcuggguuuuguuuguuuguuuguuuguuuuggcuuuuuuuguuuuuuugagggggggcaguuugccuugggucuauccuuuuauuuauuuaaauuugcucaugucuuugaauuuuagguguuuauuuuauagagagcagcauuggauuguggcauuuggguuguagcuuuuguuuuguuuuugucuaucugccaaccuccaacugcugauuggaguguguaguuaauuuacacuuaauguacuuacugaucuggaagguguuaaaucugccauuaugcugcuuguguucuguguuccuuuguuccuucauuucuccauaacugguuucuuuugugauaaguagaccggaaagugugucauuuccauucuccuguugcuucuuuuguguuuugaauuagcuccuuaguaacugcucuggaaauaacaaugggccucuuuaaaaccagcuaguuggagaugauaguaucuuacaacuucagugguuuacagaaguuuuuuuuuccccuaaccgguccauuucuucucucauuauuguuguacaagugaaauauuuauguaccuaucucucauugcuuuauaauuaaguugcugccuucaacacuguuuuauaaguuaagugguugucuuuuauacagaaggagaaaggguaugaauaaaaccaucugaugcuuuuauauauuuacacauguaauuaccuuuacugccacucuuucauucuuuucaugaauuuguacuacugacuguaguucuuucauuucaaucagaaagacuuuuaaaaauaaucauugaagugaaaaaucugcuaucaaagaauacuuuugguuuuaguuuuguuuuuuaauguaggaaugucuuagugucugguuuuauuuuuguuuuuuguuuuuuguuaaaggaggauaguuuaguuggauauaaaauuuuugauugacugucacuuucauuuggcuccuugacaaugucauuucacugucugagaacauuuuaauuuaccugaauuugcaagauaguuuaaauggauaugaaauccuugguugacauuuucuuucagcauguugaucaugucauuccauugucuucuggacucugcuuuggaauaagagucacucauggaccuuauugaggaguccuaacaaugaguugguuuucccuuguucguuuuaacauugcaucauugucuucuugcacuuacaguaauuuaaaucuaggcacucauccuucuugucauuauguuaagcuuuuuagauguucagaucaacauuuucauuaaaguuugaaaggucuuguuuauuauuucuuuagauaaucuuucugccguuuuuacucuuccuccaacucucccaagagcauggaacauugugugucuccaagguguuucuuccauuuauuucaguucccccccccccccaggaacauuuuauauacuuacggauuugaauaguuuuguuuacaucuauccacccaugccccuaacacccugagaugagaacccaugguggccaucuuaguuucacugaguauaauuuauuggaacaaggcaaggaaguagaagugaucaccuaauaacauugggcaugccauuggaggacacaucucacugguauuaggacagaguucagcccauuugcuggcacuuccuugauuucucuccuuugcuuuuggaauaaaacuuccgaggccaggaacugugugcuuuuggccaaaacacaaaugacuguuagcaacagaagcaaauuagaauccaacacauuccacauuuagucuauuuaggcgaagaaauuguggcgccucuacuugaagcugaugaauuaaaaaugaugcuuaugaagaaugcuauuggcaauagacuaguguuagcauuuuuaaauaauugcuuaugugaaguuuucucucagucauggaaaaaguauuuaggaauaggauuugggaaacauaaggaaauguucccaggucugagcagaaagaugguacauagacauucaucaguuuugaucucucuucuguuugcucuuguuucuuucuauuaugugaauuuuuauuccuauagccaguaacuuuuaaaguggaaaagucuaaaaagcaaaaaggacacuacaaauaauuggaaguguaagagauaaucaggauuggguggguggggauaguuuuaucuccuuucuugcuuggguuuugaugucuccaccccuacaugguuagaugacuuaccuagguuauauagcugagacauggaagaaguccauuagggcuacgaucauccaucucuaacugcuaucaugcagcaauuaugguuaucaugcguccccuggcaaugccugccucuacccuuugcuuguggugucucgcgaugcugguugaugggaaucagcugugacagaugcacaaguguccaccccagcaacugucauccuugcuuuuugggggaaggauaucaaggacaauguuccacuugagcaugguuuucuuucugugaagcuucaaccaagaagcucaaauagguagaugcuuaccucuggggaccuuucugccccacccugggaaucuauccaacuccuugccuuaccacagccuacaaagagacacugcaucauaaaccagcauauagcaaggcuguaaacuuaagucuucauccggaggcuggaaauccagugcucucguggcucuuuggagagagacacacaagcaaaacagaggucagugcaaauaauacaggcuagcuucuagaauggacuuuuguagagagaucaucagagaugauauuguaaaguguggagguuucccugugucaaggucagagcuuugcuuaccucugaccacccacaagucuugcuacacuauaacuggccugaagccaucugagccuaacacuauuagcugagggagggaauguaccucuucccacugaaccaucccaacccaaguccugguggcuuccaacuauuacugauuuucuuauccuaucacagacuucucaaacaucagccagcuuucuacccuuauuuuuucuuaugagucuuugauuugucucuccacauuuuuuugcagagauuuuuggaugguggagaauacaggaaagcguggcagaagggaagguuuuaugugggugcaacaagaagaccaauaggagaaccuggauuuccugacccagggggacaauguggauaccucauuugcacuguggguguggcugacaacgggggauaaauuaggaucaaggcccagaucagccugacaugggagcuuaggaagcuaucaugcuaagcccaagaucaugaacacuaccacauccauguagaggagaauacuggcuaccuggaaagggcccccuguuucccccaggagaugaguuauuguguguaaaaagguuuuagcuuaguuccugguaccucaugcuauuaguaaacacuggucauuacuaguuuuauuuuuuaucucugccaacauuccauugacugaugauaccuucugagagaaaaaaaauccaccagguaacauauguuuugccaguaaaaaaaaagacacuuuagugacuuuuucucgugauucuuggacucaucccaggagggaaccugggcaggugucaggaccuaugcuugcauucaugcucugcagugacagaucacccgccagagggcacccuugcaccucugguggcaggcugagagagaccacaggccaaggcuuccaccauucugccacccuguggacucuuuguggacagcauuuccuccgcugcuuguagaaaguaagcuaguguggaggagagcccccaucccccuuccuuaaaagcagggugagaggcugugaguccaauccuguauggaggaggauagggaacgccagcuuuucuucaaagcauggagaugcuguggacccaagucugagauacuugggggcugaaaugugucccaccccaggcaucuucauguuuggcaugaacucacaucacagccugggcauugacaggugccucagcagcacaacauugcccugugagacaggguuuuguggccccuuuacagaugggagacaucucagcccuucccuuugcccacuuucgaugagaaauucaugcuuugcacacuuccguguuaaaaaguguauuuggggucccuuuguucccuuaagauacaaaguuaaaagaagccuguuucuccaccccccgccccgggaaucaggaaaaacacacaugaagggauuucccucugcagaacacagagggcccugugaauaagcaauggcuuagcauagaaugccacaaacauugauaccuucuuccagaggaaagacuaaaugcaggaaagcauacuauaaaacgcuagauaacauaaagagauugcuucacuucauguccuuuuuacagaaaagggaagaaagguuuagagaauuaauuuaggaaguuacaggaggauagaugggaggcuagcugcaucaugggcugaaguaggaaccaucuuggaagcacaaggggccaagguuagcucccuucccuagcauaucucuucucaaagccacccugagucauucuuuauugggauuugugccuguuuuaaucccuauugucagaacccccuuucugccauuuauaaauauuuuacuccucuccagcagcaaauucccccaacacaaccuucucuaugcacugcacccuuagcuggcaccaguaagcagucacaguaaacauggcaagcauaaaaaugaggcuggagaauggaggauacuuguucucccuaaggggucaaucagcuucaagacgaauuggcccgcuguagggaccaauuuugaccucugggcaagacugcauuguagugugaacucaaagauggcuuucgagagccuggagugguagcacaugcuuguuauccaagcacuugggaggcugagacaggaggauuucuguaaauucaagggaagguuauguagugaguuccagggcauacuguacuagagagugagagcuugucugaauuuaaaaaaaaaaaaaagcuucuauuggaggauuuggggagcacucuuugaacuauccuugaagaacaugagugacagauaaggggacccagcacucagcuuuugagucauaugaugcuauguuuauuuccuacauuaaguauaucccagguagaacuguuaagugcuuauugaguccaccauuauuauguuacaucccagagagucucugucaacugacacgugggaugaugaugucucuagguagacuguugggcaaaucuucugagaccagagaccuaauagaaccuacccaacccuguucucccucccacuccuguuucuauucuacccacauuccucugcuguaguuugucaccuuuccagaagauguggccucauucucucuaguccccaacccuuccaccccauccauuggugucugcucugcaggugagcuucgugcaggggggagaggaaauaacaucugugcauuuuauauuucucaacacaugauucauuuuuuuuccccugaaguccuaaauuuucaucugcugucuucuuugggggaagagcucccuccuccaguagguaugcugugcugaucugaugguguugcacucuccagcuuugaaaagcugaacaugcagauuguuuccuuaggacaggggauucugggguaacguuuuuuuucccccugacucuuuauugacauggcuccaauugcuucucggccuucauuguuuaugguuagauaucaguagucuaagagguguuggccuugcagaaucaguugugucauuuuuuuuuccugucugccuuucagcaggucucucuuuagcuuucuuuuuaacaucacuggugugugguuuucuuuacauuuaucuuucuuaaguuugcagagauaaccaacucugucaaucugccuuuuaccaaggguggcugauuugaagccacuauuucucucauuuucauuuuaucuuucccucuagaauaucuccuugucccuggagcuuucuguggugcuuauuuucaauccuuuccucucuucauucuucacacuggguuauuuguaucaaaauauacauugagguccuucucugcuuuucugccucccuacucuggccugguuccaacuuugcaucaugcccuguaucuaccuuuguaauggacgagggguaucugaaacaacagaguucaguaauggaugggguggagggguuggggacuagagagaaugaggccacaucuucuggaaaggugaaaaacuacagcagaggaauguggguagaauagaaacaggagugggagggagaacaggguuggguagguucuauuaggucucuggucucagaagauuugcccaacagucuaccuagagacaucaucaucccacgugucaguugacagagacucucugggauguaacauaauaauggugguaugugaccaugagcaugccacuuggggaagcauacaugucaccuuccuugauggggcaggguuugaauucuagccuccaaauucccaguccaaacacucuccaugauauauuuuucuuuuuucuuuuuuucugggcaauauucauuucagaacuuguacuagaaugaaacugguacugaggucuuugagggcuguguguucucucucuaucaagguuacccuugauacaagguuaaauccuauuaccagaucaacuuucuaccuuagagacacugccuagguguggggauacaucccugaacaaagugaacaacagaaaagucccuccugcucugccaugacuucuuucaauuuugacucuugcuuuuagccucauucuugguagacaaaaauaccaggcuccggcucugaagaugugauauuaguucaccugcuaaaucacuuauuggcuuucuuguuugugggcuuggagucauuacuccaucugcuuagggucauuauacacuuuuagacagagauggcacaugaggagccagccuccugccagcccacagcauccauucuuucagacuucccucuuuauguggaucugugguagggauaguccauuuucucucuuggguuuuugcacuuaggaguaaggacgcuguauuacucuaagaacauugacgugccucagccuaucagauaucaaacuaguaagagggacucuucucaaaugagucuucuuugccucuuagguggcaguuaaggcugaaaagcaccccaaaaugcuucagccuauuuuuuguacuugagguuuggaaccuuuucagauuuggggauuuuuguaucuauauaaugagaucuuuuagggaagugacuccagcgucaaggcaugcuccauuugcaugucacacauaucuaauaaauagcuuaaggagauuuuuagaucaaacaaaguuucauugcguggaaauuucuuuuugcggcaccauguugauaccaauaucgucuugagagcggacgucuacaguuccagcacuuggagguggagguagggggaccaggagucccgggccagccucaucuacaugagcuugagguuaacuugaacuacacgagagacucugacacaaaacaaaacaaaacaaaacaaaacaaaacaaaacaaaauaaaacaaaacguuguggguuuuguagcacuuuugaguuuacauuuugagauuagagguacuuaaucuguacaccgaaucccuuuauagcgacauuuuccugaaucccuccugccccggcacuuaugugacucuugaaaugguccuuuuuauuuuuuauuuuuuucaucuuuuaugcucuaaucuccagucuguucgaaaugucugauguuucuguaucugaaccccacagaaccuuuccuaacuauuguucccauucuucuccuccuuuccauaggauauggacaugcugcaccuggaacugaugcuggcaaggccuucuguauguucuacgcugugcuggguaucccccugacgcugguuauguuccagagccugggcgagcgcaugaacaccuucgugcgcuaccugcugaaacguaucaagaagugcuguggcaugcgcaacacugaaguuucuauggagaacauggugaccgucggcuucuuuuccugcaugggcacccugugccuuggggcggcugccuuuucccagugugaagauuggagcuucuuccaugccuacuacuacugcuucauaacauugacuacuauaggguucggcgauuuuguggcccugcaggccaagggugcgcugcagaggaagccauucuauguggccuucagcuucauguauauccuggugggccugaccgucaucggugccuuccucaaucuugugguccugcgauuccugaccaugaauaccgaugaggagcuacuggagggagaaguugcggagauucuugcuggaaauccaagaagagugucuguccgugcgccucagagacgcaagaggcaccacgccauguacuuccucaggaaauacggcagaacccugugcuaucucugcuucccugguaccaacugggguaaagaugaugacgaugaugaugaugaugaugucgucgauaauguuguuguuacugcuccuauuucugcuccugcgccugcuccugcuccugcgccugcuccugcugcuguggcugcuggugccacuaucaggaguguccgggcuaccguccacaccguuuccugcaggguugaagagaucccuccagacgugcugaggaacaccuacuuccgguccguuuucggcgccauuccuccuggaaugcacaccugcggggaccauaggcugcaccuccgucgcaaguccaucuaagugugggagggaaguacauggaagaaucauuugucaugcagauguaaguuucauugucccaacuccucuuucccuccuuauuuauuauuauucucuuuuuuugugcuuacggucaucaucauuccuuucucucuucccuccuuuccugguuucauuucuuuccggccuuuccagccaggcagagcuguccaaagggaaaauagaggcccauccucucugaagcucgcaccugagcaugaagcauggauuccuuccuuucuccccaccagaguuaugccuuacauuucuccccacccugccuccucucucugggguggcuuuccuaggacaggugugagaacaggagcaccaagacagagcugggaggauggccaacugaagucuuugacugacuacccguagugaugucuccgaccuaacuccucucuucuucccccaaggacuggguggcuguguguacgcguguguaauaugagcgugugcgcuucugugugcagguguguugugcgacaagguggaaaggaucaggcauucacuucccuucucacgcauacaauuucauacgcagucuccuagaggcugcuuccaaacuagcuaaacccugcaagguuggauuuaucaaccuugccaaauugagcacaucccacaaagcacuuuuaacccaagaugaaucagauggccauagcgucuaaaucucauucacuucucuucaggguguaggcaggcaagacuacagguuuacccugccaguuuaaaugaaaucuuuaagaaucaugcacuuuguggaacugguaugcaucauugacacaagaaagcagagaucacagaggaguagucguaaagccacuagugucaacuuauggaagaccuauugaauuuucagcauuucuaguuccagaaguuuucccugcagcuggagaugucaagguaaacagggaaauaggugggacccaagaguaucuauuuuauuauuucccucuuccuaagaaugacucugacggggagagcucugugaagucucuaccugcguggaguagagucccaguuuuggaaugcuuggaugagaauggguaucagaauggugaugugguuuuucuuuuccuaauaagaaagcgacagggcauuccuuguuuaaauauauauagagagguauauauuucaggaacgagugucucuaaaugcauuugaucuguacauagggagaaguucauguuggucucaggaacguuuuagaggcuguaucuuggccugcugggaacuugucaagcucaggggaugcuuugucuagguagucgagauauuccuccccgcucucaauaaaggaugacccuggaggggacagcuuaggcuagagaauauggcaccucguaugcaggcccucucaaucgcaggaguccgagggcagcuuggccuccauagucacugagggacucuaauuucucucaucgccaucccugccaucucuaaaagucaccccauucacucauccucccacuccuuuuucgcacacuggaaguuccuggcuuuuggauggaaaugggcuuuggcuacacuacgcacgcacaaggagcgcacuuacuggucuucaagauuucuuaaaggacacagcauccaaaugccaccagucccaagcaugugugccauugggcugaaaccaggagcauccaggacuccucuggaaagucaaugcaugcacuuaaugcuacaccccuuguugaaauauucccuucgucuaggacacgggaccuucaaaaggagucugugaaccuuagacucucuuggccaaaguugacauauuccaacuucgaggucuuucucaguucacuuguuugagauguuguuguguggaaugcccugcacagggcucucaagucuguccagagaauagaagcaaucacuauucuugaauguuuuuuuuuugcucugcaaagagauuguuggcucuuuugggucacaaacgugacacuccugaugccuauaugcagaguacuuuaugccucggaggagguuuccuggaacacauguaggaguuccccugagacuguuguaagauuuuccuucaaaugguggguagguaugugugaucaccucugaucuguacaugguguugaggcacugagagaaccaaggauccacucucaguuccuacccagaaggguccagaagguggacuucccaacaccaagguguccugacucaguccuacaguggaggacagauccugcucggugucuucacagggccaagcauuaggcucaggagucaagucagagggacauaggcucagccuaucuuuagagcuagcuucccauucaugcaucugugugaaguggucacacagugaccauugugugggaaggaucgaaugacagguacaucuuuucuucccagaggaauauagacaacaccuucuauauucucacagaaguaacccccccuccuucugcaagguaaagggcuguagagcgaauucucuuuccuccuuaugugauagcuacugauagaaguaauguagcaacuuguacuugguuaucauccuuguagcccucccacgucuuuggcuaauuauugccaguucagcuuuggagggaagggcaccaaauugucucuuccaagcucaacauaagagcaccaagggaaggaaugagucuuggcuuaugucccuauaaguggaucuucuccaaugguugauuuguuccuuagcguaggaccuggugauauuguucucugggcacauccacugaugugcucucuuggggugagagcagggaggagucaaauucugaaggacucuccauuuuaccauaugggaguaggccauuucuaugaagaguccaccaguagaguugaaggggcuccaagcaggggcagcuccacuggcuccuucauuuucagaggaggagacugagauuuagggaagucaacauaucugaggucauguguaaagaauauaggucuucacacuuccuuuugcuguuguccuagcugcuuuguugauguuuugcacagcauuccaaagauucccuacuacuggacuuuauugugucucuggccaagacccuuuucccucuguugugcacuuggcagcuucuuuuagccaagugauuguuguacccuucccuccaguuaaccaaaccccuucaacagaccucaugccagguuguuugcagaagggauucugucccaggaacuggaggcuggcuugcuguccaguuccuggaaguuaauuugccuuguauauauauauacuuaauaagauaucugacucacuugaacucuucacuaagugaucuccaucuuuauuucaucaaggacaguaagaaguaggcaaugauauggaguaacccagagcucugggcuugcugauuucuaguguucaucccauuuggauccuuaaagguaccccaucccaggaagaaggugcugucucacccaccugccuguuagacuuugaacaucaagagaacuucucucucuggguuuugagauucucuauuagcccccaaacuggaaccagaucuauucuuccugguugccccauucagucuugaggccaaggcaauagccucuaagaccugagcccaugaugggugauugacugacagaggugcuggcuucaguauggccauagugagaugggcacaccuguauguucucuguguaccugaugaaggagauaucuggagaguagauaagcuaagacagggaauuuuuaucaauuucauucagauaugaaaacuguacagaucuugaauuccagugccaaucuaugucagcuggaauguagacggauaagggcuccucagagaucuuucuugucugugugcuuugagagaaagaaaguucagaaaaugauuacccaucacggaggcucucagcuuuaccucaauauauucuuucuaaaauaaugagcccaauucagagacucauugagugucuacagagcuaugugaucugagaugccugcuugaauguguucacucuaccagcuccuagcgucagcaucugugaguugugacuuaguucugaaaaugguagcugcauuuccuccagagucaaggucuuaucaggaccagaaggcauccuagaugaggaagagugguagggcagggacugguucuucugccuugccuuacugggcucuuggaagucauuucacuucuugagccucuguaguuuuucuuuaaucugauggucuaguuaugguggggauuuugcacaagaugaggaccuuugguuuggaugaucuggucacacaugaagauugauccaccaaaaaaaaaaaacuuagcuaaaauuguggcaggagauagagagcuggugaagaaacacaaguguugacacagagcauuggaccauggaaccaucauggguucccuaaagugcuaggcuuagauugacuuucuguggucccaucuugaccacauguugguagagguugcugcuucaggaaaaugaaaguauaugaucaugauuucccugacaccaacuuugaaaaaaaaaaaugucugaaggugacagaaaaguugauagacuagcacuaugggauuccuuagaccucucacccagagccccaaccucaguaccccccccccucaacacugagaugguuggaagauaaaguaucauggugucuacagcuuuuaggugguucagccaaagauaacauuguauaucucucaugaaaagugcauucucuuacauaguaaugguaauuauugucacaccuaagaaacuuagcauaagaauaucuaauauaauaauauaaucuguauaaagaauuccccaagugucccuaaaauguccuacugaacuuguuugugaaucuaagaugccauccaagaucacaccccacaccugcuugucuuguuguucccugaccccccuaauugagggcaucucccucacuguguuugugucucuugauaauugauauuuuugaggaccccaggcccguagucuuguagaaugccuaugaucugcugucgucugcuuguucccucggcuugaggaacugucgacaagaaaaugauguaguugauguuguuuagcccugauuuaugcauuugauguuugucucucuggggaccucugugguuacugcuuuguugugaauaaauaagacauauuaaauguuguuuuccucuguuaggggaccuaacugcaucuucaagagaggcguccauggaugcugggucucacugugaagcccaagcaggcuucggauuucugaccucucccggggaccucuuccacgaggggcgagugucagcacccuuuccccuaaucaccugugggaauggcccagcuauaccuagacagaaggcacagagacaugcuccuuguagggucccuugccugcaaaccuguugggccaucuuggcaccuagcagcaaccucaugaguggugaugaccaccacacaaucuccucauucacuacaguaaaagacaugccucacugucaugucacuggccugcccugcccaucaagaggcuaucauuuguuaucucugccuucaagauguuugcucuggcauauucuagagcacauuccuuuccccgccaacccaugacccauaccugcuauggcuauguaaccuuugcuugcccuccuagaggguaucccuguugcucagcaacauggaggcagagaugaaaugccuuaguccuucccucuuuaauccccuaugggauccuucucuguguuccuguguguuugcuucucaugggugaacacacugagaagcaaaugcccgaugggucagccuuaugugcagaaaguuaagaagugcucacagaggggagggaagccccaggauaaagcagguccaagcaugaguuaucuggcugaaguagacaugggguauuccaaugcaaacccuuggaaacaacgaaaauccugguuugcauugcauugcuugcuauucaauugcacgugccuugggaguugagcgagccuuuaccaauagguccaggagcuauccacacagcaaggcacuucagcgucggaggggugggaacaucuucagacuauagaagcaugcugggauauuucucccuguaguaggugggguuuggugaugggaacaucacaagggaaucagguaggguagugucauuuucuugagggugguaggguggcugggggggggguguucaugcgcaaugacacaagacccugcaccucuggagcccugggagagacaagaacaccugcuucuuggucccucuccuauccccagagcagcugggugugccgaaagcugcuuggggccaguauuuuauacaucugggaccaaccucuguccuugacaggugggugguggauuuccacgucuguuuucacacugcacacggugcuugugagaacuacaugugaguguuuaccgagcaacuccuggaaauguauguccacuuggcccaacaagaggccucccuucacaucaaccaucuguugcuuugugggggaccaaacuguaacuguaacuccugagccauucuggugcagcgcuguacagaugaaacaccaagcaagucgugcuguacgcgcgagcuccgccgccucugcuggcggggguugggggguggugagggguggugugggugguggguaggagggcagccagagcacuuccguucagcagguggcugacaagguuucgaaaagcugcaagacuggaucuccgagccaggugucuguggaucccagaggccugguacugaaguguggguggggugggaugggagccucaaacacagaaagugauacaagggcaugccuuagggagaggagggagggcuugggaggagcggaggaaaucacaug

SEQ ID NO: 43 - RNA, 107252 nt, Mus musculus
guuguuagcuauuuccuucuauugacacacucccuccuggaggaaggauggggccucauaagauccaggaagcucagguccuugcaagguucaucauaaggcuccaccccaagauccucugagcaguaaacagacucagggagaggcuuaccagagggguuaccugcaugcugcacagugagauccagggaugcagcuuucaugguggaguggcuugaugauacagcugucccgagucacccaugguccuguaggucacccuucuauaaagucacuggcuccaagcuggacuuaggugggaugacuucuuugguuuguccucgggacacuaucuggacgagcaggccuuuguucacaucucuucaagaaauguccuacaauagccacuuuguagcaucaaguccagaacggaugaccagcacacacugguauggacgaaugugcccagcccuccaggaaacccucuucugcagagcccuuaggaagcuagaaagcuuagcaucaugcucauuuaacaggcaaacuaaaggcaagugugcugucugcauacuacagcacagggugaagggcauccuuaaagcugauuacuggcacauggggucuuggcaaacguacugauucuccugcaaggugacaaucacacacuggucuguauuuccgaggcuugaggggaguggccaguaguggggucccggaccucggucuuuuccauuuuguucccacaguguuggcuguuguucuagcucugguuuuguugcuaugauaagcaccacgaccaaggagaaaaaguuugucuuacacuuccaggucacaggcaaucauugagggaaaucaggguaggaacugaaggccaggacuugaagccaagaccacagaggaacauugcuuucuggcuugccccucggucuuguuauagcaggccaaucaucuuagggaucuuacuaccuacagugggcugggccuucauauaucaaccagcaaccaagaaagugccuucauggacagaggccaaucugaucaaauuuuaucuuauuggagagaagagcauuugacagcaugccccagguuauugccuaccaagccucugucaggaugggguugaaagguauugacucugguuguaagcauaguaaagccaaggaccucaugcucucaaucuagagauauccuuugcuggccagaagggaaucaggagccuacaggaagacagcaagcuccaccugcccauuccccucucugcuccaugcuauaggccaggauuccaguccuaagcagauuuuuaccaacuagaaaauaugcuguugaggagaaaaagcuguuggcuuucucuuuuguugcauuucccccuuugagaaaggcucucacuuuguguccuucguuggccuagaauuaugaaguucagguuagcuuugggaacaugaugcaaccgacucagcuucccaaaaguugggguuacaagugugggccaccacagcuggugacuuaguuacaauuuccauugcuccagugaaacaacaccaugacccaaaggcaagccaggagaaaaggguuaaccuggcuuacaccuucacauuacuguucaguaccaaaggcaaucaggacaggaauucagacaggucaggaaccugggaacaggagcugaugcagaggccauagaagggugcugcuuacuagcuugcucuacaugaauuguucagccugcuuucuuauagaacccaggacuacaagcaccaucccaaaugagcugggcccucacccaucaaucacucauuaagacaaugccuuauauauggauuuuauugaguuuuuuccuucaguugagguuccuucuuucagauauucuagcuugugucaaguugucagaaaacuauccaguguacacgucgucauauuaauucuuguugacuugcuucuugggcuacuuuauuggguucuaguaucuaccauccuuccaacccuuauucuaccccaaucccguccaacuacccaacacuagguaggggagaaagaagaccaaagaagguguagauucuccugguguaggccuccuuagacuacuucuugcugacuagcagccuuggguuucuuggggcaagaccaaucuccaucaucaggauaucucuaaccagcaaucuagcaaaauagcuaacauagcaggggagcagcauaggcccucuuggagcucagacauuuauaccgucucaagagucaucagaauuccaaacaaacuaucugcagcuggcaaaaaucacaccccuccuagaguacuccagcaucugugcacagccugcaucagccccauauaccuaccacaccugggauuaaaacaaaaacauucaccuguuuuuuuuuuguuuuuuugguuuuuuuuuguuuuuguuuuucgagacaggguuucucuguauagcccuggcuguucuggaacucacccuguagaccaugcuggccuugaacucagaaaucugccugccucugccucccgagugcugggauuaaaguccugcgccaccacgcccggccuaacuggguuuuuaaugaaaucaaaauucuaacuacagauucugacgguuuggggcugacagaaugcauaagccaauaaaagccuuauaacuugaugugaggaauccgcaguggauggagagaacugauugcugaaacuguucucuggccuccauuagguacaccauggcauccauggcaugcacacccaaagaaucacacuuugagacaguuccucacugugaucccacucucuguguaguccagguuagacucaaacucaagagaucugucuuccucuggcuccuaugugccgggauuaaaggugugugccaccauguccaguuccucucuugcuguucaaagcugggggucucacauaguccaggcuggcuucugacucacuguguaucaaaggauaaccuugaacuccugagcuuccagcuucugccuucauucugggauuagaggcauaggccaccacaccuauuuauuguuuugagacaggguuucacaccauagccuaguugggucuggaacucacuguaaacauaaaaugaccuugaacucagagcaguucuccugccuccaccuugggaguucagggacucagauuauaggagugccuacaacacccggcugccucggguccuuugaaugaggcagcuuucaucaauccugcaacaagaugggucuguaucccagugaccauuucucucuugcucugagucucucucaacuuucuuuaggcacaaauguuuggcaaccuacuuuuaauaaggguucaaccucuccucuagcccaccacccagcagagguacugggagagaaaaguuauuaggauauggagggaagugaacauguucuacaagaguucuucgggggcgagcucaaucuucuugggcagcaguuuagucucuuagcaaacaccaaauacgacucagcagcugcagaccaguccucuaggcaggcagacaccacacacgaaccagcagcuacaguccaguccuuucagcaagcagacacccggcagcuguaguuuaauccugaagaaacugccaggcucuccaaccagccugaggagaggccgcugaagggcaagcugcugcaggaaccucacgagcaguucuuaguccagcuucucacaaugcugguguuaucacaaauugagcucaacaacgcuauguaaagugaacaaauacaugugugucuuuagcgaagaauagcaagggggagcaaaccaaaccaaacugagugcuugucucccacugucuguggggucauauuucuacuccaucaucaugcguucuuucacguguuugcuauaucaaacauacuuucaucugugucugccucaggaaaaauucuuucaccuguuugcuuuagcaaggcauccuuucaccugugagcccuagcaaaacaucauuugacacaacuuuccaaagaaucuagaaguuuucacuucaacuuucuuuucuucuccuucuucuccuucuucuucuuuuuuuucugccaggguaugacuucguugcccugguaagccugaaucuugauacauagaccaggcuagccuugaacucucaagagaucugaaugccucugccuuuggaguucuaggauuaaagguguguguguguguguguguguguguguguguagauccagcuaaagaacuuccgggucucucugagaaggggcaacagaugaacugcagagaacuguuuucugacugugcuucuucaagucugagaugcucaugcuucauaaaugacaagaacaaaaggacccaggccaaggggcuagagcagggaugguaucaauguggcuuugacucagagugagccucagugugaacugcugucaucugccagcauuuccacuuuauggcuaauuaaaugcaccuuucuuaaagaacuagagccucuaagaauggcuagaagacaccccccccccaaauuuauacuaaaugaacuaucauccgaaccugaucagcuugaggaaaggauuaugcuuuauaagcucgggauuuagcaccauuuucagccaaaaauaguuucuauucccacgugacuucucucaagcuaaaggccuugcauaaaagacaggucuuucaugacuuguuuugccugugacuuucaaucgccuucaauguccuuucucuguauuuucaaccugcucuccugggcucaucuccaaagcuaucugugauuuuuauucauucuuguucucaacuucucuuuuugaaaaaaauaaagucaaaguuucagguaaggucaucccauaguccaaggucaggaaagcuucaggaaaggucaucccacaguccaaggucaggaaagcuucagguaagguuacaccacaguccaaggucaccguaacaguuucaccuacgaugagcucuuaagcauuuuucagaucugcuuucugucuguuucccaaagcauuuggaaguugcuagcaagccgggcggugguggcacacgccuuuaaucccagcacuugggaggcagagacaggcugauuucugaguucaaggccagccuggucuacaaagugagcuccaggacagucagagcuauacagagaaacccugucucgaaaaacaacaaaacaaaacaaaacaaaacaaacaucccccccccaaaguugcuaacauugagaacucucguacuccuaagaacagagccauuuuucugcauagcuaaauaccaauaucuuaccucagacacuaacauuaaugaaauauuaucuacuacauaguuuuuuuuucaaagcugggcauugaacccagagucuuacacaugcuaggcaaguauugaaccacugagcuacgccaucagaccuccaguugaguuuugaaaaaacaguucauuuaucucugaaggcaagggacaauuaaaggaauggaaaaauacuuccagaaucuccauacaaucagguucuuccuguguguucugggaagugucuggaauuuucuuuaagccucuaucugagauucacaagguacucuggacacugucaguuggacagcuuggggcuuucguguuccacaaaggcaaggguuagcuuugccugcccuacuacugcaccccacaggaaacacgggugaucugccacuugagaugugguucuagcaucaggccaagacagcagggacaaaaaaaaaaaagccagcauaaugauacagagguugaaccagcuggauucugagccuauuuugcccuacagcagugauagaacaaagcaccacugagggaagggaggucacuaaguaauuccucuggguuuugcaggccagaagcccaaaaugaaggugauggcaggcucuggcucucacuuagguuagggagauguuaacccuaggcccauucucugaguuucuuguguuaccagugaucugaggcaguccuuuggcuuguagaggcagugucaccgcuacccuugagugacauccucagguuguucucauccugucggucucuuuccuacuucugacaaaacacucgcauauugacugaggagccuguucuaguauauuaucuuggcuaauccaaccccaacucugcuuucaaauacacacacauucugcagaaggcuuagggcucuuacagagcuacaaggggacauaguuuaaacccucaaagagagucuuguguacaucuuccagacuucugagagauagcguuucuuuuauuucuuuuucuuugauuucagauaggguuucucuuuguaguccagucuguccuguccuggaauucauccuguauaucagcccagccucaagcucagaucugccagccugugccucccagguguugugauuauagugaugcaccaccaugugugauguuucugauauauauuuaaaacauuuuaacuuuaaauaucaggucucauauagugcaggcuggccuggaaaauacucguagcuaaagaugauuuugaaugucugauccuccuacuuguuccagagcuggaauuacuaugcccaacaaauuaaacuguuauagcuuguauuagaacugagaguucuaauaggcuggcagaugagacccaaacugcugguuuaaaggcagcacuccugggaacugggaaccuaaaagagguguugggugaguuuucuuggugagggucaugguuaaauguagauacuuuaggcucuucaggccaugguuucuauuaucucugcucuugugggcaaaaucagccaguccgacacauaagcaauggggauggcuguaucccaguaaaaauauuuacaaaauagcugugugaccugauucgacccaugggcuauagcaugauccagugcucuagggcagugucucacggggagggagagugcuggagguuugcagagcguuuggaauccuccugugcaguuuuugucaaucaugcuuuacuaugcggauuuaaguuaagaugaacuucuugguaaggaugccaauauaagucauagcaugccuugucuagaacauugugaaagacagauauagaucaaaauauuucuggcuagggcuggggauauaaaguuaguguuuaguaaagcucuugccuuaagagccaaggcccuggcuuccaucuuuagcaccacagacacaaaugugucucucugugugugucucuguguguauaagcuucaaugaaaagcuacguacugcuuaauaaauccuuuuagauuuucaagucucccuuauuuccagggucuauauucccaaacccuagagcuagccuggaacaacugugugugugugugcugugcacguguuuauauguguguuuucuaccaauacauacuuaugaaaguuuauaaagacuuuuaaauaaauuuuacuuuuauguguaugaguguuuauguauacaugugugccuggugcccacagaggccagaagagggcauuagauacccugaaccugaaguuacaggugaucgugagccaccugcuguggguacugggaacugaaccuggguccucugcaagccuaggugcuuuucaaccacuagcucucucuccagcccccaaguuuguuuuauaaaacagggacaauaaaagcacaacauacccauacaguagaacaaugauaauaacaugcuaauagguuauugagaccuugugacuuaauaauucuggaaccuuucguuuaguauguugaauaugcccuggucuauggugagaaaaggggaccaaugguuaaucuauggcacccgagcuuuucauugucacgagguacuuuacaacucuguaaguuguagaauacuguuaguaaaauauccaauuguuugacuugagaaauuaaagcugugucugagucagauaaguauuugauuuuuaaccaacccuuuaucuauuggcuaauuucucuucugcauucccaacuuuccguugucuguauuaggguuuguuuguuuguuuguuuuuaaauucccuuugagucuguuuuaacaugaucucaguucuuacuugaauaacguaagggauauuuuuuugacacaucaauucuguaccugugagguggcucugugcuuuagaacuccgcuucacugaauuuuuauggcaucacuucaagaagagauaaugaagucuuuuuuuuuuuuccccuccccaaauuugugauaccagcugccauggaacacucugagcagaagcagcuuggggaggaaaggguuacaauggcuuacauggcacgucacaguccaucacugagaagacaggaacucagggcaggacuggcuuacauuccacgucacaguccaucacugagaaaacucaggacaggcacucagggcaggacugagacaggaacugaaacagagccacugaagaaugccgcuuaccagcuugcucuuccuagcuucugcccagcuugcucgcuuacacaguccaggauucccugucuaggggaugguacugcucacagugggcuguacccuugucgcucaauuuuugaucaagaaaaugcuccacagacaugcccauggggccaucaacauggagacaaccucagacagcucugggcugugucacauugagagcugaagcuaacuaggagaugccaucagaucaugaaucaaugaauggauuacuucauugaucaggucacagucuucgugauacaaccaccucucaauaaugccaucaccuggggacacaagacuucaccaaaggcuugguuuauggggugcuccauuuccaaagccauccaaagaaaauguauuuuggggaugauacuuugaguggaaguuuacauucugguucacagcuaacucuucauuuagcgguuuucucacugacaacacuugccugcauuaguucuaacacuagagaggacaaacaugaacuccagcuucuaucaagggacuacuccuguaccccugacccucaaaugguccuucuucaucaggaacaggccauccucuuccauccagcaggcagcuccuggagggaugcacguggagugaaggaauggaauaucugccuagcuaguaagaucaguugaccaauccuggugucacagccagauugucuuccugcccagugaccucuucuugguuucuugguaauaacagcggaccuggccacauucagccagccuggcuggccagcaaacaucggagaugcccucgucucugccuccccaccaaaguuccagggguugggugcuggggcuugagcucagacccgcaggcacauuacagucugagccauuuccuaaggcucauuuacuguacuuucacuagguuaccgccuuauguaauauggaugcugcauauuaucuuuacagaauaauaaaacuuuguaacagagguggugguacacgcuucuaaaccuagaacucgguaggcuuaaguagagggaucugaacuccaguauagccugagcuacauaguaagcaaucucacgcuaaaaguuuuuuuuuguuugucauuugcuuguuacauuuugguuucucugcacacugcauauuaguccaccagucaccuaacuugcuguagaaagcccugcuugggaagucacauuuccacagagcugcugugaggcucuccggggcaugagucggaaacucccacgcgggauucuagaaagacugaccucuuaacccugcauccacuugcaacacuaaacaucaaccugggcuuuuccaccuaacuccaucucggccaccguacuggucucgguugaagaagagagaguuaggaagcgcucaagcgcagacgcaaccugggugcuggacggggaaacugaggucuggcucugaggcgucaccccucgccgcgcgugagcaacccugggguugucaggccucgaguagguaccuggcgcucgugcccggcccgcaacacuuccugucccgcgcgcgugcgaugcucaugugacccgggacugggcggagagcaccugaacgaggacgucacgugagcaggaggcggggcgggggcgggccgacucaggucacgugacgcuccggggacggccacggagcgccuccucgucgcacuccccccuggcuccaguucucucuccucuuucucccuccagcucccguugcagcuucgacuccgcugugguggcgcgaccgugucccaggcgcggcuccaaacggccagccgccgugagccccacgccacacgcgaugcgggccguucagcugggaccggugcccuccgggccgcgcgucgcgcuccugccgccgcuccugcugcugcugcuccuggcggccgcgggcuccgcgcaggcccaggccgucgacuuggacgcccugugcaggugggugucuugcguggcgggcgcggagccccgaggacacgcagaccuccgccccgccccgcccccgcgggaaaguugcccgcgugguggccgcggcggcgcaggaggacgcgccgccguggcacuggcccccggagccccccgugcccggccacuuguggcugucauaagucgggcggcuuugugcgacucccggggcccgguguguccgucggaaguugcagggggcagagcuaaggcugggcuuuugucccgcugcacguuuccauugaaguuccagccguggggcuucggaggcguccccucuagugugcagucuccagggagugcgaacccacgcgaugcucuuggaguuggguaguggugguuucaacugcagauugaccccuucuguggcaacucucaguuuuccuuauuuaaaguagccauuugucagugguugaagcuuuuucuucuuuugacaaggguugagagguggucaucucuguaggcuuucaagacuuuacccuucacgucucucaguuagcuuccugugugguugcucacaugaugucauugucuccagaguagauuauucuaguggagucuucugcucugggauccaagguuguauaauuuccaguccugucgaaguuuguugguguuggacacagacuugugggccuagggaacuuccaauaccauuaguuuggagacaggccuccucugggcucuuuagggugaagggaaaccaaaucuuuucuuguuuuaaaaacuuugauaagaaggaagcgggaagagaaucuugaagccagcuuuacccuugacuuucaaaagugacucagaaugagacggggcugagccaaacuugauguuucuaaugguaguccaggcucuuuaguccuuuguaucagagaguuuuguucucucaccuggaguuaauaauuuguaggacuuguuaguguaagaaugagcugaccagaauucuauuucucauuuuggagaguauuuggagggagacacugcugcacugcggcuuauagaccaauuagcugcccaaagauagauugcugccccgguaacuucaugauauggaggaagggugccccuuaaacaauaguaggcccaggggggaacauuuagaacagaaaauuuuggauuuagggcugcugugaccaagaauuaacacagcuggucuagugcuguggaagucacggucuugcuagauaacuggaauuuguuucuuuugaaggcguugguacaggggauccaaccuagggcccaggcaugcuaagcaaguacucuacuacagaccugcggccuuugccuuagaauucacuuuuuuuuuuuacaccauuauuuuuaaagugugugugcgcacaugcguguccauugugucugccaugcagaggccagaaaagggucucagaguccuuggagcuggaguuacagguugugagcagccugcguggcugcuaagaauugauccccccccccuccaaaggccaacucucuagcuauaguagguuaauuucuucgaaaaaauuaagagaauauuuuuuuauucuaugugugugaguauuuuguucgaauuuaugucuguuuaccacauaccuuacgguguccuugaagaaggcaccagauuccccugaaacugaaguuacagauggcugugaggcuccacguggaugcugggcauugaacauggauccugugcgaaagcagcaagcacuccuaacugcugagcuguuaacugucuagucuccuagaguuaaguuuuuuuuuuuuuuuuuuuuuuuuuuuuggugaggggaaggaggggagauaggguugcucugugucacccuggcuauucuugaacucacucuguagaccagacuggccuugaacccauaaaucugucugccugugugcucccaagugccaggauuaaaggcggcacuuuaaucccacccaguuuagaguuuauauuuuaguagaguagaauuugucaaggagaacugagcgucauggagucucagagcugcucacuugugcauggucaucucauugucuugaacuuguggucuuucaccucaucuccaguggagaugcugguccuuaccuuguggaaugaauggccuuuguacuagucuacuggggccacugucucacauggugugacuuugccagugcuagagagggucuaagguuguguuagaggugcccuucacagcuucugacgucucuaagguucuucuuccucuagcuuuccucaggaguagugaacuucccaguccuucucaccuauccccugccuguaacuaugcucuuucuuagaaacauuuugagugucuuggagccugcagaguguaguuugucuuguauggucuguuuaguuuuuuuguucugggagcuuaaacccaggagcucaaagucaggggcaagcuaggcagcuguuuucuuccagagcuggacucacagcccuuuaagagucucugccacaggcuuuuagccucuuccuugggaaugugggcaguuacugcuagaaaacgucaccugcaaguuccuuaggguuagcgcacacacaaggagguuagcgauucuuucuaaauccaguauaaugcccauaacguaucaagggaguauggcguguuuguccgccucaccgccuacagacuccauggcugagauguaaauagcccccuggggucuccugagugaacaguagacuccuguaguuggugcccuuguguuuguuuuuggcaccuggucacuuggaggcagcuccuuauguggucaggacuguauuccagggguugguaaaccaacugaaacaggggcuacauuuucccuguugaaaaaaaacccagauggauguggugugguuuggugcccagagcacuaccggaaauuauuucuguaaagguauuggccugcccaggcaucaugggacguuccugagccugggcaguugguucuuggacuugugggagaacagccucuuucaagagaggauacuuuucagagagcaggaggggaguccugacccauuucuggggugucugguugguguggagcguugggaugagcuagggcucugaccacugggauaggggugcaguuucuacggaaucuggcuuugggggaggggucaaggaacccaaguggagggaucauuucagcagcaggucucaggauauuugcacaguggagaggccugcucugugaacuguauguacaguagacacagcagaggggaguauagguuacuggaacagcacgguacacagccugcuuacucuuugaagagacuggagagauguacaugcacacagaugcagucacacagauacugggcaccaacugacccuggguccucaugcaugggagggaagugccaucccuucuuuuaucuuuuguucugagacaaaggcuugccaagcccagacuggucuugaacuugccaucgaccugccucagucucuguuguagccagauuucaggaacugcuagaccuggcugaucauacauauuugucaaaugucuggagggaagugugcuguagaagaaguuacuugggucucucaagaugugggaugcugguguaaagaaaaggucacuagacugaugagccugcuggugguggcacuggccuggauaaggucugguguagggaacaugugaaggucaguggggcaggauaagugagaacaacacagggaggggggaagaggccagguaaugcaggacccucagaguggaccgcaugcacuggugcucuuggcugguuguucagugguucagcuuacuacuuuaaacuuugcagaaugccguguuaaguauguaaaaugcuucccacccuugauuuagguguucacaguguuuuuuggggaaggcuuaacaguuggaacugauuauaaagugcuuggucuggugguuaacuacuuugaaauuuauaccggacacguuuucuccaaauuguuuggguaugaauacuggagaguuuuuauuauauugaggacaagagaauaaugaagccagcugggaguugcaguagguuuaguugcuaucucuagagauuuuuccccccuucuccuguaacucuucgcaaagaauaaugcuuaugugccuaauuugggccacauguuagccuggaucaccuccguuuguguacaugcauuuccuuuaaccauaaaaguguguguuagccuaggauuguuaauuaugguuccaauaugguuuuuguuuucuuuuuugacaggauaucacaaugcccucacuacgaccuugaacuccugguccucucgccuuuaccuucucucaguucuuaaaucacaucuuaaccaggcggugguaguccaugcccuuaaucccagcagaggcaguuugaggccagccuggucuacagagugagucaaaaccaaaaccaaaccuaagcaaccaaucaaacaaaccuagcauuuuaauaaacucccaggaaaugaauagcuccuuaggcuucuaucuuuuaucaguguuucacguauagaaagaguuuuagaagcuggugugacucacgccuuuaaucccagcaccugggaggcagaggcaggcagauuucugaguucaaggccagccuggucuacaaagugaguuccaggacagccagggcuauacagagaaacccugucucgaaaaaaagaguuuuagaaaauggaauuccaaaaauaaucaggaugucuauucuuuuaaacguuuugggguugcugggugugugauguggucuugcgugcgugcuaggcaagcagucugccacagagucuauccccagacccaucuccucucuucugagcuuggcacacagcauauugugcugugcagagauuucagcaauguccagagcaaugugcaggggcccacagugguccaccacuuaguggguuacugacauuacuuuguuauugacaucauucucuugggcuugucucagugaauggggccuuucuauagugcugcaccuggugguuuuggguggcagaagcagagcugccucacugugugaacugccaaucuggagcccaagucggcuguaccguucugcacccccauccacugcaugcaagaauucuagcuguuccacauucuugucaacauuuggucuuagcaguuuugaaaaggcaucuaaucucaccauguuuuugagucucuuuucuucacucuccacuccccccuuuucuauaaggucuugcuagaguaggcuuggcuagccgagugcucuuccugcuucagccuccuaagugcugguguuacaggugugugcccucacaggcucaugguguaagcagaacugucccugucuucauugcuagacuuaaugacagacuuguuuauuagaaggacuagguagggcuuuuuuuuuuuuuuuuuuuuuuuuuuuuuuuuguaaauaauaauuugacuuuugaccccuuggcaguuuguuuuuaucauguacuuauggaaacucaggaguuucucaggugucgagggucaagaucuuagauauguuuccuucccugccucccuucccucucuguugcugaaacaccauggccaagaccauccauagugguaggcgaagagacuguuuuggcugggucauuguggcagcaaguggcggcuuuaccugaagcaaagucugccauauguccucuaccaaggccacauccccuaagccuccccagaugucacaaucaacuggggaccaaguguuuaaauaugggagccucugggugcuauccucauucaagccacagacccuaagaaaucauagcuguggcagaauuccaucccuggaggagccuuccugugcauuguuggguguuaggcaauguuccuggcccauacccaguagguccagggcucuucaccauaugcccuuaccuuggugacacaaaggaaaaugucccuagacauuucggaugaaacuccaaccagacaaaaucucuccucuuugggaaucacugggcaccccaaggacacagauuuccuuauuguuuaacucuaggaucugugaggggacggggaagguucauuucccccuaacugucauuguauucaccauccuggaugcugaggugguuuguuuguuguuguuguuguuuuuaaauuuauuuuuaucuucuguguuuugccugcauguauaucugagggcagaguuacagacaguugugagcuaccaugugcaugcugggaauuuagcugggguccuguagaagaguggccagugcucuuaacugcugagccauuucuccagcccuggcagcugagauuuaaagugguaucaugcuguaauuuuuuuuuuuuuucugacuguguuaccaugaauaugacaguuuuguggaaucagccaaccuuuuuuuuuuuuaaugcauugggaucaauuuuuguaugaacuagacguuuuccgguccauacauuuuuguagaacuuagcaguaauguucuaguaaucugguacuuugggagaggagggguaaguaggggggaagacccugugcagaguugcaaggcuuuaccuuggggucccugucucagucucuggagucacaagcgcuugaugccuuacucaggcuggcugaccuuugagcuuccagggaccuuccuaccuccucacucccaggcucucccaucugugggauuguaagugugugcugugccuuuuuaacaugggcuccaggggcuggugagauggcucaguggguaagagcacccaacugcucuuccgaagguccggaguucaaaucccagcaacuacaugguggcucacaaccauccauaacgagaucugacucccucuucuggagugucugaagacagcuacaguguacuuacauauaauaaauuaaucuucaaaacaaaacaaaaaacaugagcucuggagcuccaacuuacguucaagugcuuugacuggcaaaggcgucuucccauccucaaaaugucuuuaaaacguacauuagggcuggagagauggcucagugauuaagagcgccgacugcccuuccaaaggucccgaguucaaaucccagcaaccacaugguggcucacaaccaucuauaacgaaaucugaugcccucuucuggagugucugaagacagcuacaguguacuuacauauaauaaauaaaugagucguuaaaaaaaaacuuacauuaauuagagauagaggcugcugucuagccugggcuggccaacuugagaucugccaucuucagcaguuuuugcagucacgccuggcuuucuuuuucuuuuuguuuguuuuccuuauguuaacauuuuuaauguguauagguaucuugccuguauuugugucuaugcaccaugucuuuguaggccucagaagaggguguuggauccccugggauuggaguuacaagcaguugugagccaccaugugugcuggcaauagaaccagggguccuuuagacccgugguggugugaaugaaaaugguucugucggcucauagguguggccuuguuggagugggugugguuggcguuacugaggaacugugucacugggccugggcuuugaggucuuagaagcucaagccaggccuagugugucucuuuucuauuuguugcuuucugaucaaaugucagacucugagcuaccucuccagcaccacgucugccugccugccugccugcuugccugccugcuacuguguuucccauugugacaauacuggacuaaaccucugaacuguaaguaagccagccucaauuaaacguuuuccucuaagaguugcuauggucaugguguuucuucacagcaauaaaacaauaagacacaguaagacaauguucuuaacugcugagccaucuuuucagccucuaaaaauuucuugacauuaacuugugggcaucuuuaucaaaggcuugucaaugcagaagcucuaguauucugauucauauauuguggacaccuuuuuucuauuuuauuuaauacucacuugcugaccucuaauuuuccuguguuuaguuuaauugaaagcuuaaaucuuuaaaauuaauuuacauuauaucaaggcaugucuuuggauucuggaaaaagagcuacuuaagagugccuggugcagaggaugugggcuuggugcccaguauucauaacaggcaaagucaacccauggauauauaauuccaggcccagaggauccuggguguaccugcacauacauagacacucaggcaugcacacauccacaugaaauaguaaaauguaaaaaccaguuaaagccauaugucuuccccugagcgccacagcagucugacagucuuuaagcucuccguuuccauuuucuaguuuuaaccuuccugggccuacugagauguauaguccuccggaagcugugcuuuaaacguagguugggguccccaaagcuucauuguugacauuuaaaucccugucaugaggaauuaacagguagauguuuaaucccguauugguguugagagguaaggccucuugggaggggauuuggauuacgugguacuuuaggguggggccugugaccgagucccagagacuuuauaggaggagggggaccacacacaccaccugggcgcaugcauauucccauaccuugacgagugacacuacauguacugaaaacuacaaucgccugugucacccugaccucagaccuucaagaacugggagccauaauauggccugcuccagucauuucuuuauggcaaaaugugcugauaaagcaagaaacgacuuuuaggggguuuauuuaucuuuuccacuguggccagugaauggaauuucccuuguggccugccaccuagucaguuggaagagccauguauguuuggaagaaauggucucuauuugggucagaguuauuaauugugcugcccagcugccucugcccugaguuauuccugucccacuugaguuuugucuuguuuacuuuuuguucauggcucuggguuuggauggggugugccuaugggcuuugcaacuucccuugauauagacccacagcuuugugguuguuuuguuuuguuuuguuuuguuuuguuuuucuuuguaggaaaaaaaggguuucucuguguuucccuggcuguccuggaacuuugaucaccaggcuggcuucagacucacagaaaucugccugcuucuccccccaaccccuaccauccccaggacugcucagcuauuuguuuuuuugagauaugguuucacuacauagccaaugcugugcuugaacucagaauuguucuacuuuagcccccagaugcugggauuacaaucaagcaguaccaugccuggcuugcccaacuuuuauuuuuugucuugggcccauuucuguugguuguugucuuguguucauguugcccucagcuggcggcucuugauugugcucauuuuggacaucugucguccuugcagcugcucagggcagggcugggaacauuuguuggaacuuggcuauaaauugucuugggggagaugaggaaugggcgggacaugccagagacuggucuuuccuuauucuccugugggucaccuaccucgugcugcuguuccugccaggaggcagcuguuggcuccucuugauaguuggcagagcguugugugcugccuguuggcaggccguguaaguccuaucugagacagcuggaugacgaagcuggugucagaucaccuuugggucuuugucccucccccacacagcugccuuacuuuuugagacuggcucucuggccccagacuugugauccuccugucuuaguguccugagugcuaggaauguggggcguacaggaguaccaccaugcuccacuggaagccacuguuggaagucaccgucuuuuugucaccccuuagugccccaagaguuucugccucagugagugagugcuugcucaugagguuuaagaaaggguucuacuuucugaaaguauuugaagcuguggguuugugggucacuagucccaccucacacucaguucugagauacugagcuagcagauugcaagacuuuuuccuagcaccagaacuugugggcacaauagguguggggugugggcaggugccagugccggugcccccuauugggcugggucccguucguuuuugcuuuauucuauuuccuggaaguagaaagaggcagugguguguguguguguguguguguguguguguguguauguauguauguguguguaugcgcgcucgcgugugcaugcauauaugucuagagaucagcguagccugccucugucucccaagggcuggaacuaaaggcaugagccaccaagcccuguguuguuuguguauaguggaggcagcacccuagagguugggaaugucugcuguacauauagccccaagagguuagugggaaaauguuuggucacuucaccuugcucuaaaacuggaagucggcuauugcugacaagauuuugaggugccaaagauugugucauguccuauuuuggacucugacagacccacugcuacacacacagucauuacaguggaggaaaaucccguuguccuguucccucgggugugaaacaucagaucagccacugaccuuuagcaguuuucccuugcucaguuagugcuggagggcaaguucccuggggccuuacugauuccugcaggcauuugugacuacugauuguagcugugucuuaaguguaggaaacaccaagcgaugugcuaacaggccuggcuagcauuuuaaaaacagaugugaccagugaagaguggccugcaagguaaguuucaaagguggucuuuuagguugagucuuuagguuugugcugccacauggccacugagcuuugaccaaauguaagauuguucuaauuccagcucuucccuucucuuuuggggcaauaccagggauugaaguuagggccuugguauauagguggcaagcacucugagcuguaucuccaaucuguauguauguauguauguauguauguauauauguauguauuuauugaaaacuuugagacagggucucccugaguuaccauaagacaacucuugagcuugugaucuuccugacuuagccuccauugcaauugguuuuaccaaucuaugcuaacaggccuggcugucagcugcacauuuuaaagcagauguuuaguguggaaaaacucccuacuccuccgccuggccugcaaauagaacagccaccaaaccagaaaugacccagaagagggcuucuuagaagugacaagggcagugcccacugagucaucacugcuccuccggcucccuccugucaccucgccagcucacacgcgcuacucucuacucccaagugaaagccaccaucuguuccuguaucuggucuuuuagaggaaguguggugagccaguggugucaugaggcuuggcaucccuuaauaaugagagagaggauugaggagcuuuugggaauaaacaaggguguggguccaaaagggcucaccaugccuaggcucuucuguaaggugcgaaucuaaagggggccuggaaggaaaugagggguauguguguuacuguauguaauggggaagagucuuugcaggaucuaagugugccuguuugagaccaaagggucaaugugguugaaguggggugggugguggaggggguauggacagggacuggacaggaugggguggggcggggcggggcggggcaggacgggaugggaugggacgggacaggagagaugucaagaguuagcuggggcuggaucccagacgcgaccauauugacuuuggagcuauuggaaaucagcuccaaaauuggaaugaagcacaauggcucauaucgauaaucauuuggcagcugaggcaaguggaugagccugaacuuaaaggagacugaaaaacgacaaaauaaaaaaugcccgaaaguucugauuucuuugcuuuugugcagagggcuucuuaucguucagguacugaaguuggugacaguucugcagccagaaugcagugggaagugguccgugcugggagcagagggcauggcaaggcucuuccugcuguguuuggucacuuggugaucugggacugccugccaaguuacacccacgcucuaguuucaagucuccaaaauggggagguuggugugcuccuugacagacggugaggacuaagugauuauguucagaagccguggauggcaugccccaggugugucacuguuucuaagugaggugcagcugugcugcacaggauugggccuugggagguucucuuugcccaguggaguuucuugcugagccccugguaugaucccaguacuugcagagcaggacucuuuagacaugucauauggugguccagguuggccuugaacucaaaguaguccuucugccacaggcuaccagccugggauugcaaguacaaguccuggucugccuacgugguuuuugugaagaaauagcauguguagccucugauaaccuuauuaacaucacaaaccaacaagcugagcugacuguucagcaguuaaaaugccagcccucccuguguccagggccauaaaggaagcacauuggguccccaaagaauuggggccuugcuagcaagaaguuuugagugggucccugugcuagcauugccuuccugcauccucacagcagagccugugccacacacuggcuucucccuuuccuucuuugggacagucuccuguugcucagguuggcauugaacuuaguggucaagggcgacccuuaacauuuggcucuuuuguccccaccugguucuagcuucaugucacugcuccugguuuauacugugcugggcaguauugaacccagggcuucuggcauggcacucaugcacucccagagcucuucuguggagcuaggauucugugcacuggguuccagcacacagcuuugguuuuuuuuuuuuuuuuuuaauuuuugguacuaaaaaugaacuuaggccgacacacauugagggaaaugcccagccguugaacuuuaaugcagcccucuuucuuucuuaaguuaagaauaaagcaagagagcauccagaucauuacuguuuacgaugagaaacuaaccuuagucuuagauaaaugcaccaguuuacacacacacagggaacccacguggaguaggucugcagucugagugguggaguugaguugagcaaagccacauuuugggagauuccugguagcugugugucuuagagggcggguauugcuugcuuauuagaguucuggcuccugaguaaccaggcagugcagguuuaccuggccacuguuugugguggcagcuguuagugguuacauuuggauaguuuagggucggggaggcucagcugcuggccuguccagaggagacaaccaggaggaagcugucugucuuuguggucuggugucguguaguccuugguuguguugugugucaucuccccccucccacuucagaugggguguguguguguuugugugugggaggaggggguggggacaggggcagggguggggacgugggugggggugguuuagguaugaaguguguccccucucccuccccugaaaagcuuuggucucuagugacagaugaagucacugugagguagcuggguuaucaaggaccuugauguaauaagggaauuauucacagaaacauucauaguuuuacagcacgccugggagacaacggcagugcugagguggugccuagauggaggaaggggaucaucagggugcugucuuguucaggccugcccaugccuuccacuuucccuuauucccuguguuuuguggcucagugagguuaguagccucacccaucgaauaccuguugcagugauauuuggucucaacuuaggcuauagcaauggggccagcugaccauguacugaaaccuuagaaaccaagagccaaagcagccccuuccucuuuuaaauugucucacauguuaucacagccaugcagaagcuagcacugugugugcaugcauacgccaugcuucagugccucuggaguuguagcuggagcccagaugcaucagcauccugguggguguggcccaggacaagggucugcccuugccucuccuccacccccuucagugucauguggcauuuuucuugggaggccucaagccggcuugucuuuuuugugaauucagaucuuaagcaaucuaaauccuugugcuagaucacagugcuguguuccucaucuagguuccuccuuauucgugaccuuuugguuugcucgguuuguggacaaggaaguauauggauuccacucugcccauaggcccaggucuguguguucuucuacugugaccauggugccuuuccagaggcaccugggcucccucuuccucacaaugccucugcuaaaccucccucaugauguggcucaaagacauuauugggcccugguugccugccagcccugucucucucugccucugaaaauggacuuaggugucacaguugauuuagggguucaggcuagaccccucuuuacccaauugauuccugcauucagagccugugcagcucucugggaaggcagacuaauaaugcccagcacucccaucugcaccuucucucugugauuaggcuucagaucuuuauccacagucuuguggguugguuagaauaggaagugaaguacuuccuauauaauccugggcucugcugugucaaacucaugugcuuuccacugucaucgucuggucagggugagucacccugccagaccagauuuuguucuuauaguacacagcccacaagauacacuuuucucuaccugccuugcuguaggcccacuagggacccuaucuugucccuuccugaucucucaguagagacccgugugcugaauaugagcugaaacacuggugcugaggaagaguaagcagguugcagcuugugugcacugcuggagcauucuggugugugagcccgaagcacagucacauuuggaaguucagguugagucagauuugugcucacuauagagucagaaagcacccccagcuagugacucuacugaguguguacuuugcuguguggaccacuaacuuguuuuuuuaaaaggaagacagauuacagauucauacaugcaaauggaaaggucaggagagaaccucugcugccagucuuugccuuaacuguagcugugauacaagguccuuguguuucucucuugugcacaccaggucucaaucucuuaaaggggugcugagcugacagacuuuuggcuuuagguggguucuggggauuuuuuuuuuuuuuuuuaagaaguauguguguguaguuuuguaauuuuaaaaaauacuuaaaacauggugcacaccuuuaaucccagcacuugggaggcagaggcaggcgaauuucugaguucgaggccagccuggucuacagagugaguucuaggacagccagggcgacacagagaaacccugucucgaaaaaaacaaaaaacaaaacaaaacaaaaaauuccuuaaaacaauuuguuauuuguuguguauguguuguguaugugauaucuguuucccauggcacauguguggaggucagacaauacuaaggaaauuguuucuuucuacuuugugggucccagggaugggccucagguugucgggccuggcagcgagagcauuacccauugagcugucuugccuuaacugcccaguuguuaggacacuucaccacaugcaguuuauuguuuguuuuguuuuuuuuuuuuuuuuuugcauauagauucuuggggaccucauaucuguuaguaugaaagcagcccucuuuuguguagcuauugccuuagccuggcuuccuuucgaaugcuuuguaaguaguaguucccuggaagugaagugcaggugaccuucagaguaguuguggccaggcgcucuuaguaguuuagacugaagaacuuaauugaagaaagcaguuucugugucccagaaccauccuguuuuguaauauuuuugagacagucucauauagccuaguaugauccccaacuugcuauguugcuaugacucuaccucccacaugcuaggauuacagacauguaccaccgugccuaguuuauaugugcuacuugggauggaacuuggggcuucuggauuaguuacuuugauaaaaugucaagaccaaagcuggguguggcugggaauccucaaagccugcccccaguaagaagguucuuucagcaaggcuccaccuccuauuguuucauaaucugaccagagcaccacuaacacgugugccuaugcgggacuuuuuucacucagccaccauagccucauguaugguagguaagccuuaauacuggcugagcgauguccuuagcugagaaugggcuguguguuucccugcuggcuaggguucuagaggcaggaguuagauuccagaggaacgaugugucaggucacagacaccguauaccugugcuaagaucccucccacuucuacuguguggcuuaguggagccauuguggcacaugguaucaagaauuggagcuuuucaaggguguaugaugaguugggaaauuggggauuuaguuugcuuuucuuuacuuccauuccuuuuuucuuuuugaaaugaugucuucagcccugacuggucgcucagugaugcccuugccuguguguccugcguacugagauuagaggugugcacucugccacuucugagacugaugcucacguucagugccaagguuucucaguagagcuuagugcucagaaggguaguucuagcuacaacucgguguucucauuugaggagagugacugaauuucucaauggugggacaacgggaucccugggccuugcagguucucccuacuccuccuccucaaugcccaaggcaguuccucaaaugagcuggaacucagagaggagccagugacaguaagcaguacugugagcagcaggugagggacuugacuccugugcuguggcucugcuguuguagcaggucugccugcuacuugggugcgaguggagcccgcccgcccgccugcacagcacagccugcaccgcgcuuuucucagagccuuguguguuaagguuaaaagcuucacuuguguaaacuuggguaaggguggguuggggccuuucagcuaaggggccuuucuugcucagcacugaacuguuguuacaggaugggauuuuaauuuuggcuauccauauucucuguaaauagagauuuuuuuccuaaaagacaaaauuuauugccccuuaaagaugcaaccgcacacuuuaaugcccucacuccgggguucuuuaauauggucauacugauuuuucagccuuuuacaaauaucauuuuaagaaugauugcagcccaggccauuuuggcugcuuggccuuuguaugccaggaaauuuacagucaucuaguuuguaauuucaaaugugacaacuucuacuguuuauuuuugcuuucuuuuucuuuucuuucuugagacaaggucccuggucccugguuguccaagaacucugaauguagaucaguccggcuuugaacucaacagacuaucagcuuccagagcaucgggauuaaaaacaugcaccgcucugccuagccugaaaugguuuccugccuagucugggcuggccuaggccucacuguguagccagggcugucugaacuauugacccuccauccuucacugccuguaccugcaccauuacacuuggcugcaaacaugcggcccucuccuuaauaaacauggcauuuguuuaaaagaauugucauauauuccuaccacucuugggcuuauuauaaacuaauuuuaaaguaauaguaccagagcacauguaucugcauguugacucacuuucacuguucugcagaacuaauuaacuauuuucccaugagguuccugacacauuauuucaguugccugauugugcucaggagccaagcauguuggauuguuuuaaagcagcugcaauguuugcuggaauuaggccuucucaaguguuaauagccugcaggucaucagguuucaguuuaggaaacauugcaacuguuucuuugcucuugagugaugugacuaagccaagcuagugcccuaccccccacccaccgggaacugugggccaauuugauggggcugagugcaugcgccuauggagggcuggcgccuauggagggcugccugugagccgguaagucaguuccagagaaagucuauucaagaacuaaaguaggugauaggcucugccuucuguauguauaucaugacuuccauuuugauuuuguaugagacacagauagaagaaaaguacgcuuucagaaagcagccuuuccuccugaccucugugcagcucauuucacccuuuucaguuuucuucugucugcauuucuuuagaccugguucucauugcuaacuucuuuucugugguacaggcaggcacuucagucaucggacugggaggagcuguaaugaugacaagcuaaggguuucagugaacugccugccagcuuggaaaaacuuaaucacaggcucccaaugagaguuuagcauuucuguaacagaaauguacugauaaccuacaaaucacuaccuaaacguuuaaagaaaguuucuaagugccgagggcugcauuuguuucaaauauauuuaaagacugcaggacaggcguggcuucuguggccuccacaccugccgcugacucaguccugcagccuaggucaaguagcucuccuuucuuuuuucccccaccccuaaagcucugcugcuugucugucagggcucagaagaguaaguuucccagccugacauaguuacggggucugucuguuaccuucgguaaugugccugcucaguucccagcagagcuuguccugugccgaguucacuuacuuuccuucccuuacuggaacagguuagcaggaagcuggggaacuguugccaucuuauacacuuuauacacuguugcguuucucaagcaguaacguagaagcucgguaguggggagacauaggaggaaggacauuuacaauuccaggcuccccccccaaagaaaaacaguauacaccgugaaacaaauuaaguuuccugcugcacccccuacccccccccccccgccccccaaaggaagaaggaacaaggcuuuauugaugguuuucucugggucagcuagauugcuugagauuuuuuuccucuggcauaaucguccuggcucuggagguaaucagucugucagaguugaguaguuccugcuuuaaagccugacaucaccccaggcccagcacuuaaguaaccaguuuuucagguuuguaguaucuuaguggccacaaauucccugguccugccagaugcuuggauagggaugcuuuggggugggaugggggagggguggaggucugauuggacuccagaccuaagguuaagugaguugucuaauagcuguuggugcuggggcagggugggggugguggggguggggacggugggggacagacaggacagugccugguagcuuugggaacuucugugaggccauacuuaaaagagccaaaugugguccacugggaaugggugggagcuggcucacuucccuacuucuggguaaguuuaucccagcaaaucugauuuagccgcucaggcagcuuuguaccuauucucuuccuuuccuccuuguacucuugcugaggaaaugagucccaggaagaguagaggauugaggaugauguacuuggggcagaaggaacaccccucacugauuuuaccccgguguugagguugauagauagcucuuagagugccuuuggcugagcucuguagugaggcagccugcaguagaucuuaccucaucgugaggcagauggcaguucuuagcauggcugucacgucaggacuguagucuguaccaaaagcaggccugcuuacacauuacagcuaguuuucaagaacaaaagaaucccaggacuggggaugaagcccaauugguagagugcucgccuaauguucaacuaagccuguguuugguccucagaccacuuaagucuagguguggugguguaagucuguaaucucagcauucaggagguggaggcaggggcaucagacguuucaccugucucaaagagguuaaaaagcuugagaguuaagaacagucccguggagggacuggagagguggcucagcaguuucccuggcugcuguuuuaggagacuuagguuugauccuagcacuccuuggaaccucacaaacgccuguaacuccaguuccagagggacugacacuuucuggacuccuuggguauuguacauagguggcgcacaauagacauguuggcaaaacguccauacacauaaaauaaugauaauucaaagcaaacuaaaauaauagucauuugggucuucagaacucuggggugacuggaccagucccacuuuacacacaguguauucuaguaucugcuuaauggcguugauguucuuagaacaaacaugggguuguguagucugagggcuuccuagccaucuugaacuccuuuccaaaauguuuugccgaauuugacuugguaucugugguuaaugggaguaacuucuuauuuguaguagucaaagcaaauauggcuagaaugccagacuagagagaaggugauuauugucagaucaauaacaaugacaagcuugccuccuuuauuucuuucuaguuacacaugggaagcuguugacuccaaaaacaaugcaguuuauaagaucaacgucuguggaaauguggguauuuccagcugugggccuacaagugcuaucuguaugugugaccuaaagacagagaacugccgcucaguggguaaguaaagcuguccugugagcaugcccugcgguacagcuguguacacagcugcaugguuaugauauaguaaucaaugcagugucuaauagacauuuccuaaaagagcauucuggcugcuugccuuuugaguucaggacucugcuggggucagauggagcuggggcugccaggugguugugaauccccaggccugggugcugggaagaggaucaagugcugugccugcagagccaccucuccagcuccuagguauuagaauaccuuaaaaaaaaaaaaaagcaggcuaugcuuucacugaaagugucccaccucuuccacacccagguggcuuuuauaauaguuaaaaaugguaaaagacaguuuagggcagguucaaugcucagugguuaagaacguuauuguucuuccagaggaccugagguuuuuauccagcacccauguuggauggcucacauuggccuguuuucuacuggcuaccacaugcaggugacacacaaacugggaaaaaauuuauaacuuuaacuugauuuuucacuuugaauauccaguaugcgauaacaagguuauuuccaugcagugaguagcaugcagacaauaauuagggaggauuauaggguggauauugaauauggaaggauguuuucuaccuguauggcucuuccuucucaccuuuuuccuuaaauuucuuauuuuauauguauggauguuugcuuucauguaugccuguguacccacgcguaugccuagugcccuuggaauucagaagaaggcauugacuccuuggggcugccauguggguucuggcaacugaacucugguccuguccaagaacaagugaucuuagccacugagccauccaucgcuucagcccuaaauugccuuaaauuguccuccuccuucaccuccauuuccuuguaccucuuggaagcgaugguguuguggccucacaguaaaggacaguuguuggacucaagcccuuccuuucuuguuuccuugguucagucauucuagaguauccuuuuugagggucaggaccgcuuggugaggaacagguuccacugagaugggucaaagcagaugugcucaggaggagaggacucugggucuuagcuaucuguggucaguuuugcccagggagcgggaauagugagauuugcacauaauuaacagauuaaucugggaaagagcugaaggcagccauaguagguuaugaguuagggugaugguccuguaguccaggcucauuuuauucuugaccuacaccaucaaaacuuccugagagauaguugugagcucuuucuccuguugauaacugcguucucugcuauuuuuuaaaaaauguuucuuuuaaaguggggugguccaaguuauuacuacuuuaaauuugauuguaaucaucuuuuugucauuaaaaauaggagcauuuaaaauaucaauaguggccauuuaucaauaucuaaaaauuaaguuugcuaaaaauggacuaguuuuucaguaauuauauuaaaaggcauaucaaaaauaggcagagaaaaauagacaaacccauguuuauaguaauugugccgugacuuuagacuucaguaguacauuaguaaaugguucacauuuaaaucacauuugugauuucacaguuuugauagaaaaaaauaccucuuaccucagagggauuaagagacaguuuauuauggagccaaaugugagugacagugccaaugcuaaccuugggcagcauguucccauguggaacaguaaaucaaggcaaucaagacacagcauggugagcgcagaggcagggugcagcagcaggccugccucaguugucaccugauugacucccaaagguuagggcugcugcagagcugggcaaggaauuuuuuuuuuuuuuuuugugguguguguguguguguguguguguguguguguguguguguguguguuggugcugaggcuaaagauagcccccaaaagaaauuauaauuaggcugugggauaggcauccuugcauacuguccauagucauacaaguuuuuuuauuaguauuuuuauuaguagaucaguuuauggggagagauucuuuccaggaauucaugauugaaguugucccuguuggcaaagcaccacaguucaugcugggguggaguuggcccauuucaggaucugagagagaugaggcugagcugugggcagcacacgagucuuuaggaggagcccacaucugaucagagccauuauggagccuaucagagcguguguaacuguaucuaccugacggaaugaagaagggacacuggauguacagaaccaagauuuacuuacugacugcauggcucccuccauguaguuugugcuccauaaaccaucugaccuaaacuuuuaagugauuagaagugaaaauggguccuguagugacucuggagucucuacaggauucauuguuuuaauuagcaaaauacaaauauuguuuuuaguauaagguaaguaugcucuaggacaucuuggugggcauuguaagaagugagggaagaacucagacuccaucuugaguggcugaggcugcucauugaaacagaaugaagguuagcugccuuugaggggcugagggaaauaugcacaccacauacacacagcgcacgaacacagagcuaucaggaaguuacagcuguucuugugguuuaacugggaguagggugaguugugcuuucuauacccagcauauuuuuguuguugcuguugcagguggagggauaggugaggcuggguuaucucccaguacagccugacucaaucccucgugcccugagggcauuacccagcauccuggcucaggagcaaagggaaaacguuucugggagacuacugucuucuaggccuuagaaucuagagguuggcugugauggucucaaaggugguaggggcucauugaccuucuggguuguauaaggacugguacccuuuggccaugaagaguuugugacugucuuggcaauaaaaacuuggagccuuuguuggaggaacuuaguuagacagcugaaaaggagggccaaacagcaaagcuguaaaagugaacauuuggccugccacaugguccccaaauaguccagguaucucaaguguuuucuacucucucucuccuaauaaucguuuagccuuuccccugccgggcuggaugguccugugagccagcagucuucccuaggaaggcacagaugcuccgcuuccagcagcuguuacaucuagugcccacucuucuggaggaucgcuguagccagggcguguauuggauuuuguaaggugaccauacuuugcuauacuggggucaggucuuuccuagucuaacuggucaguugucuguguuauaccuguuggagcccugucacuggugugcucguagcugauggcccugcuaggucuuucccagguggacagggaauagcuugaaguuucucuuucucugacuguuauggacagauaagaugucuguagacuucccaccccuggaacaucuuaguccagggugagaaagaguauccucuggaguagcaaucaugugaguguuguccugaugugcacauaagucccaaguucccaaggcaaggcaaauggggacaauuuguuucugguacugaauuuaguuggucuccccagcugucccagccagggguccugcuaacagauuuauauguucaugguuggugugucuuaaguugaaugccuacccuaguauaaguuauuuggcagcccucagacaaauccaggaguccuuccccagcccuggaucagagauggcuggaauuugccaaugguaguguuucuaugagaggaguguugagauuaaagaaggggugacuguccuugacucucuuugugguaucucagucuugagguuuugugcucaucggaacagaaaugacaguuguaaaguuuggaggaggcucuuugccccauggauguauaagcccaauuugaaguuguagguaccccacguggaggguuuuuuccugggcaacucccaaauuaugucauccuuauguuacccccuuccuguaugggacucaacugcuugccccuuuguaggugccucugccuguacuccugggcuaacaaaaucaacacaacaguauuugaggaaggacuaguaggugucuccccauccacccuuauguuuucaagggacuguagguugucauauuguggcccaggagagguguuggcuccaguuccaauaccacuggaaugaaaaauugcagggcucuuguugagggaauaauugguugggauccaggaaguggguggcccauaggagaauaaggcuguccaaguuaauuugguaauuauucagucacaggaggguagcaguggaagaagguuccagacaggaaugucaacagggggauuucaggcguuggggaggggccugggccugagagccauuuaaacuuagacuguacaguguugcagaugauaugcucaucugaccagagugaaggggaugucaagggguuuuggaaaagcugccaugguguguacugggcccagggccaguuauaggucuuucuguauuguauccaggaaaagcagaacuuggaauguacucaggaaagggagcagacaaagaaguuggugauuauuccucagcgauugauaggaacugggaagucuguauauugugagcuuaaaagguggggcuuagagguauggaaugaaauugggggaaccuucuugagccuggaaagauagacaggguuuuaacauuucauuuuguggugguaggggccugccauuuauguuuuagagaggagugggaugggucugagacacacccuauuuggaucucagggagaggugaguaggguaggauggugucuuacuccagguuucucuugcugugaugaaccaccgugaccaaaaagcaaguuggggagaaaagggcuuauuuggcuuauuuccacaucauaguuaagcaggcuaggaaccuggaggcaggagcugaugcagaggccgguggugguagggaugcugcuuacuggcuugcuacccauggcuugcucagcuuccuuucuuauagaacccaggaccaccaaccaacccagagauggcaccacccacaauuggcugggcccuuccuuauugguuacuaauugagaaaaugcggccuuacagcuggauuucauggaggcguuuuccucaauugagucuccuccuucucuagugacucuagcuugugucaaggugaucccaagauguaccagccaguacaacagaggaggugggaacaauggccugauuaauuuuuuucaggguuuuggaccgagugauaagaacuacuaaggcuuuuuaguaacugagaauaggaguguugugaugagaacugguggguuguuaaaagagcuguuuguaguagccacuuagcaauagccuaaagaccguagugggugggguaccacgugggugguaggcaugaggauaauaauugguccuggugacaaagucagaagggucucuccagguucugaaaaugggaccagacuagagggaauaggugggcccagauauagaaugucacugagaggucgaggguacggauaugaccggacagauggcccaucuuccauuagccccauugucugcagcucagacaagccuuggguuaaaggcacuccuuagcacaauggccaacuugauugcaucgaauacaauguacagucccuugcccagauuugcgcugaacccuagcacaacuaggcaacauaacaugaaaccugaauccacucgaaaugcgcucugaggguccaacccuuugaacucucccuuuguauagaauauggcaccuucaugugccccugagcacagccuggauagugcagagcccucugaauccuccuguccgcuaguggggcaccuucauuugcauggccaaugaggaacccuaaucuugcgcaggaguguggcacccucaugcauagccaggauagcgccaaacccugcccuucccuccgucuccugcaacgcggcacuuuugagcuugccucucuugcaacguggcacuuuugaguucaucucuccuguaacauggcacuuuugagcguuggcccugaucacagaacccuucgaauccuccccuugugcaguuugcacccucaggauaccucggaauccuccgagccgucucuuccccuccccucgcgcaacuuggcauaaccagaaucacagcccaaccggaaucgcauuaaaacccuccgaaccuuugggcagcgcggcaccggggcucacgcagugccgcggaacccucggaacccugcccuugugcagcuucgcacccucaggauagcucggaacccucugagcuuucccuucccuuucccucaccgcaacucagcacaaccaaggaucacggcacaaccggaauugcuccgaacccucgggcagcacugcggcgcagugccgcggaacccucuaaacccuccgaauccccuccuugugcagcuuuucacccuuagccucucucgcaacucggcacaaccagaaucgcagcacaauuggaguugugcuaaaauccucugaacggggggggggggggggggcagcgcacacgccagcacccuggcucgcgcagugccgcggaacccaccgaaccuucccccugccccgcaaaccgcggaucaggucguguagaaauccuccgaucuccacccccccccccaacucuccagcagcguggugcccuagcgcgaaccccugcuccccuugcgcagcguggcacccucgugcucuagaucgcccguaaaccccccccccccccagugcagcagucggcccgcgcuggacgccccccucccuucuccucuugcugacgcggcauggcggcagcgcggcuuucggcuuucuaccggcccuaucggcccucguguaguucagaacacuggugagcaguggggcacccuagugcugaguuuucuuguagcccagaaaucuucacccuagcgcugaaucucgcguaggggaaccuuugagcggccuggaacucuuggucggagcccucgagcugccggaucaguggaacccucaccucgcguagagcccuucccuccuguggaacccuuccuuugcggaauccucuaacgcguggaauccuccccuugcaacggaauccuacccucaucugcagaauccuccccucgcauugccgcgcuucacgcggggaacccuagcuuaccucaguuccccaggaugucugcgugguaacuggcggugcugugcuucuugcugcccgcuagagcaaggagggauagauauaauguugaagccucggcaggggguggagauuauuaaguuccgccccaacugugucacuuaauccccccugcucagcccaaccucaccaggcuuuggcuccuccucuugcuccagccuggagccuguguuuuagauggccuuacaguccuggaaguguuucuauaaauugccugcugagcaggucagaaagauuuagaggaacaccagagagaccagauauuucaagcagacuugaauaacagauauuacgguuauguuucuucuucuucuuuuuaaaagcuguugucuaauugaguaguccuugcuugucuugaaccccgagagagauacacuucucuuagucuuuccauugcuuggaugcagaguaugcagugccacuccugugaagguuuuccugaccaccaagccaccaaaagcauaguuuuacaggacauaaacaggcaguucucuuccacacaacucaguugccaguauugguucaaaauuugagacuuacaguuuauuuuaggcacauuuaagcaaagcacaauuaaaaaaaaguucucugguuuuaauuaacuccaucccauguguucaauaaaucuuuacuuaugacuacauugauucuuuugugagguucaagugagucuucuguauagauagauucuauagauuaaggaaguaggcucaugggaggagucugggggaagcaggcucaugggaggggucuggggcagcugcuguggccuggccuuacagaaauagcacagaggucaccaggcuauuaaccaccccugcccccagccuccugggcuggaaacagguuaucuacucucccuuugaagagacaacccugcguguuuaacauuccuggcuugccuagugcuuaucugugagaaaagagccuacgugcuuuuauguuuguucauuguguguucauucuuauccucuccaaacaggugacucacuuuugagaaguucagccagaucacuccuggaauucaacaccacuaugggcugccagccuucagauucacagcacagaauccagacuagcauuacauuucugugugggaagacccuggugaguggggcccucuucaagcucuuuguuaagaacauuuuccccuucugguguucuuguuacaggaauucugauccuggaggacuaaauggucaauuucccccuccccccaauuuauauucacaucacgucacuaccacccagaaccaccaacuaaaugugucuuaaagauggugagaauuggagugaaacuugaguuaggaugaauguuaauuuuagaccaaccuauaaccacacuauugugcaaauugagaucuuaaagucuguuuguggcagcaugaaccauggaggucauguugcagagcaagcuagcugcugauuuacuucuguugauuguucuuaagagcuugguguuuacuguaggagaaacaggacuuggaggugaacaccuuggucuuucucaugggcuggggaagguagaaguuaacuguugcucugcagggguuaacuagaguuaacuggucugguugccagaaggggcugucuggggugggaucuggugccucugcccaggcucugcugcucgugggcuccucggggaccuccuuacaggauggaugaagucauacuuucuggcccugauuuugcuguuuuuugguucagagaccauuuggcucuugagaagaaggcgaaggauaauuucccaugaguuuacucugcuuguggaauuggggcagcugggcagucaguuagacaggaugucuggagacucucaucucccaacuuacuuuucuguuugggcggauauucuuggugaacuuguugaaguaaggcaguuauguuuccucuuguugcacccuuauuuucaggagauuuuacaauguuucagguuuaaaaacaaacuuguauuacugagugguguguuaacauucuuuuuuuuuuuuuuuuuuuaauagggaacuccugaauuuguaacugccacagacugugugcauuacuuugaauggaggacuacugcagccugcaagaaagacauauuuaaagcugauaaggagguaaugggguuugagacuauuuggucaugaaaucuacucuggagagcuugaaagucaggguguggauucugcuggggaggaggugagagagggaaaccauaaucagaauguguccugaaaauaaaaaucuauuuuucaauaaaagaaaaaaagauagaaaauuaaaacaaccucuuacaaagaagguugugacuuugcgauggaaagauuuaaaugacuuauuacagucucuugaggugagaguuuguuucuguggaugugagguuccauuugcacagagguaccacgagauuuaauuguuaaaaacgucuaggccagcuucuggugcacacagcacagcacagcgcagucuguuuuggcuuuaggguuugcccugcaccccuugggcccucaggaaccugacugcuucaucuuccucuguaccugcucccuacccaugaaacaucucacuuggaugauucguucucugccaguuucuuuucuuuucuuuuuuauaaaauuuauuuauuauauguaaguacacuguagcuuucuucagacaccccagaagagggcgucagaucuuguuacagaugguugugagccaucauaugguugcugggauuugaaaucaggaccuuaggaagagcagucagugcucuuaaccacugagccaucucuccagccccuuucuuccaguuuucauugucagagucucauguaaccuagguagccccagacuugguauguggcuaagaaugaccucagaauuguaaucuuucugccuucaugguaugauuaaaucaugaugguuuacuugauagaucuagaauuaccauggaaauaaaccuuauggguaugugucaggguuucuagaguagauuaauugauguaguguggguggcagcacgcuaugggccgggguccuggagugcguggaaaacagaagugagcugagacuagcauccuucugccuugcacuuccuuguagauuaaaugugacagugacuucccacuccuguuuucuaccaugaggagccuuguucugaaauccagaaccaaauaaaucccuccuuccuuaaguugcuucaaaacugagaaaaguaacuaagauacucugccuccugagugcugggauugcacguaugagucacugugccuggcugugcucugaaguuuacagcucuccucucuucucagccaggggccuggaaugccuguugaguagaacucugucacaguuccuggggacaguuuucccugccuuccauucucuacacugccaccuuguugcuucugcuacuggcuuccuuccuccuggcuggagggcagcugcuuguuuuccauccucauagcagauagcuuguugccuucugagugaauguuucuguguguucuugcuuuugguggugacacugaauugugggauuuggaguacuuggguuugcuguucuuucuggcguuuuugaaauugucugggagucauuacauagcauaagcuguccucaaguuugcaggauucugucucuucuucugaguucaggaauuauccgugccuugguugcucuugacugcagcccaaauagaaaaccuuuuugccaccauuuuucaaggaauuugguauuuaacuggaguucucugccugcuccuggcugucacagguuacuccaccucuagugugugucagggaggcuauuuggcuguguggaggaggcuggcagcccuguggaguuuggauuuuuacuuccugcauaguaaggaccuuuuaaagcaggcaauguaugcucugguuuuugaaagauucaucauguaauugugaugauguaaugggcgaggaaggggaucaaagcuggaauugugggaccuguggcgacuguuggauucugguaguuuggacaaagguggugacucagguggaggugacaagaagugaggacaugaaggacugacagaacuagccacccuuugaaugggggcugaaguuagaugucaugguuuugacccaggucacuuggugacccuccccccaucacugacugagaugaaggagagcaugcuguugggagaaaacuguaaacauacuuuaguauuuugaaaugauuucuguguccaggcagcaauguugguggugugguaagagcaguagauccuucagaugugggucaucuggcagguauuugagccaggcaaaggacagccagggaugacuccuggaacaggacaguaggaucagguguaaauuugggagcacuucuguauuauuauuauuauuauuauuauuauuauuauuauuauuauuauuauuuugaauuuuguuuauugaauguacacgauaugugugguugcaugugucauggugcacauguagagaucagaggacacuggaguugguucucaccuucuacccuuuaaauucaggucuccaggcuuguauggcaggggccuuccuaccggaaccaccucugcauuuagaaucagaaggguggugggguguuuccaggaugcauuugaggcagcaggaaaccagguaucucuggccaggaauccaaaguaaagggggaugaagggcuuuauugaggcugugguucugagaucagggaagccuaggacauggcguucugaucugguaacaggcaaagucagcugucagguaugguuuugcuguggugaagggcagguacccagauauaacaguguuagcaagaggagacaaaggacaggggugguucaggaguuuuucucuaagcuacagagaugggaagguagcugagggagagccaggaacuagaaaagauccuuguaagucaguggauguuuguagcugcaggaaguggucuaggacugggaaagaagagggauguagaugggaggagguacuugcagacauaagccuuaagaaggggagagagaccuugggaaugguacagagggcugaacuguuuuuugagacagggucucauucacuuuguagcccuggcuggccugggaacuugcuguguaaacuagguuggccuugaacuuacagagcuccuccuaucuuugacucuugagugcugggauuaaaggcuugcacuaccaugucugacagaaccauguuuauucuauauauaagggacagaaaucacuguucuguauguucaucacaaguuugagaucuaucagccccauggggugaaggaagugucucacuucuucucugcuuccucagguaccaugcuaugcauuugaugacaaguuacagaagcaugauuuaaacccacugaucaagcuaaaugguggcuaucugguagaugauucugauccugacacgucucuguucaucaacguguguagagacauagguaagaguugguuuaggaagaagggugggguguggucagugccugcccugaccccuuugacaugcacauccucauuagaucucugagaacgcuauuguccugaaaguguucucuggagagcuucguuugucucccucagcaaaucugauccuuuccuuccaccaaauacaaauucuacucaagcuauugauggagguuuucucugccagauuaucugaaaaccuucuguuugacauuuccucuaccagacacucugggauuuggggcuccauggugagcuuuguuucaauuugcuguguuuacccaaaccuucuggcuuuaaguuggagaguggguaaaagggcugagggaugacaaagacucuaagagugugguuguggugugugcuuggggugggauaaccccucugguguucuccguagaacuaugcgagaggccagcauaucucucuuugauagacagaggcuguaaaugaaggucucuaucuuagaagagggguacaguuuuacuauguauuuauuuauuaccugcuaaccucacuaguuuuugugcuucccuuguggguucaauacugggagcccuguagaucaggacugcucuuucugcuguguuagcugugaucacgccauaaagaaauuauacugccaaguaaggaaauuuuaaaaagaaagaaguaaagagggcauacauuucuuauguuucaaucuuacuuucucucucuguauauaugagauguugggcuuaggaaaaauuugcaggaguauaagccaguucaguauaugauacuuagugggugguaggaauagggccgauuuauaguucuuuauauuguauacauacacauuccaucuuacuuguauauucuaauuaauagcuaaaaaaauaauaauuacacucuacccagaacugccagugacaagugguaauuucagguuucucaugcaggguuacagcaacuuaaguuugguuauaaacuucugcaacagugcacuguuucaauuuggaaaacacugagauuucuaguccuuaaauuugauuaggaaaauacauuucuguuccuuaaaagcaaauccuucggaggcuuauuuuaauucuuauuuuagaccccuccuccccaauuuucuggcaguuugggagaaaucagccuuuauggucuuuaaggaggguuguguguccccacugcgcauucuucagccccaggaaacugcucagaggcccaagcuaacuuugaaggugcuccugcugccauguauucacgucugacccgugacugguauuuccugucuugagggggugguacuugccucuccuccuccucugggguccaggcagucucucugcuauuaagguccgugggugcaguagccucgagugaccauugcuguguguggaagcaggcggcuagaucugaguuuucggaggcuggcaggaggcacgguaccguuccuacuguggcugagguggauuuugaguccuggggaugugcagugguguuuaagacucuggccugaugccacuuuagugguucagucguacagccuuaauuguucucaaguuuccuggagcuuugggcugggaggagcaagcaucuggagcgggagugaagugucuggugggggaggcagagauggggaagggagggagggaggaagucauccuguaggaugucagcagcccagaccuaucugugguuucuuuccauugacauaggaguguuuuaacccgucccuagaaugccucauuuucuagugucucaaacucaaagggauagugcuaaaguuagacuuuagggccgacggggacauuucuuaaacacaggugacaaaggaaugucugucaacugggccucuuaugugccagggcagagagguaccugguaaccugcguguuacauggaaaggugguggucucauccagagugagccucagaacgugaagguggagaucgugaagucugucuauggaagagacuggacccgagaauuccuggggugcugcuucugugacgugugcuuuaaaaucaucugugacguuuugcagacucccuucgggaccccagcacacagcugagagucuguccugcuggcacugcugccugucugcugaaggggaaccaggcauuugacguuggccgacccaaggaggggcugaagcuguugagcaaggacagguuagucugugaccaccaugguggcucauuuuagguccucaacaagagaaccugccuuauagccagacuaauagagaagagaagggagugugagcuugguaauggguggcuggcaugaucaaagaaggcagugugugugugugugugugugugugugugugugaaaaugccauugugagacccauuguuuuguacaauuaauaacugguaaauuaauacugguaaauacaacuaauacugagaaaagauacaagaaagaaagacuuugacuucuugggaggaaagcauguuccauuuccaacaggcguauuggucauugucuggucuuaggcugguguccuguugcucacuuacuucacuuauuggaguuuggucccugcucgugguuuucauugugugucacuugccggguuaucuguaaccuuucuuuuagagugauagguggggcagugugcugguggccuuccagcaaugugguuucuuucuaguuggggcaugugggcaccaucgcauaccacuuuuuaauauauguaaguuccugugucacccaugggccucaaugucaagagccuguuccccucucccguccccaaaucccgaccuauuguuccuguauagacuaaaacuuuuuuuuuuaaacuaaauuuauucaauccaauaucagcucuuccucuucucccaguauccacacaugucuucccccauuuccccuuugcccuuucuuuugagaaggggaagucuucuucuggguguuacccccagcccucccccuucgcccccaauccugcauaucaaguugcugaggggcuagguucauccucucccauugaggccaggcaaggcugucccuuuaggggcauggcauucacagucaggcaagcaacaggcuuagggacagcuccugcaacaguuguuuggagaaccugcacgaagaccaagcugcucaucugcuacauaugugcagggggcguagguccagccuguguucgcucuuuuguuggcgauucagucucuaaggguccagguuaguugacucugcuguucuuccuguggagucucuguccccuuuggguuccucaaaccuuccccuaacucuuccguaagacccccugaccuccuucuaagguuuggguaugaguuucuguaucucuucucauuggcugcuagguggagccuaucagaggacaguuauguuagguuccugucuuugcaggcugucccaggugccucugauugccuugugaugguuguaggaaaugaugcaguacuagauugcagacuugugcggacuguugaagcagggccugaauuggaaaaugcugggaguuuucugugucuguauuaaugugcucacaaugccauaagcaaauacuacaggguugggccuuugaacaauaguaguuuauuuccucagcugcaauuucagagacuaagaccugguaccagacagguugguuuccucuuguuuuguuaguggccaucuucucccuaugucuacacagucuucucuggucuguguucucaucuucucaagaacaauagaacuggcucgugagggucccauuuguuaaccucuuuaaugugccugugguccaguaguuucuguugaagcauguuugucaaggcugcaccauugaaguugagagagauugacgagagugacaaguugguaagagagggccccaggugaugccgaggguucagggaaacguaggaugccaggcuuagcaugacuugucucuugucagcacacauguggugguauaugggagguaggugugcaucccgugggugaagcagaagcuaaugacuaguauucgugcuuccugguagggacaugaguugggcuuugggggcagcaauucuagcuuguagcuguuguaucugccaucuugaucagucagccacagguugcucuuuuguuuguacguagauguuagagggagaucaugggaccucgugggcacaguuguauuaugucuacucagcuaugucggucuuguuuuauuaggucucuuacaaaacuguuccuuuaugaagacagcucccuuugguauucuuaguuugcauacugaucauguucauuugacuuucuacaggaagauacacugaaguuuauacuauguucuuguuaauacguggaaauauaguuguaguuguauuguuucuucugcuaccccacccauccuaucuaccccugaggugcacugacuagggcagugcaucaauuggaaaguaaccuacaaguauguaauauaacuucuccacauggcuuuucugcaggcucguucugacuuaugugaaggaagagggagaaaagccagacuucuguaauggucacagcccugcagugacaguaacauuugugugcccaucugagcggagagagguaaguggcuuguuccuaagugacuuuaaaguuagugauccucagccacauuugcccaagugacgugucccuauguaugaguguaguuugcguguguagguaguacaugaagaucagagaaaaccuagggugucauuccucagguucccauaaccaguuaugccagcugauuugcucagugagccucagggaucugccugccugugccuuccccguguugggacuccagcugcguaccacagugucuaugcuuccccuauguauggcuuuguaaaaaguacggguucuggagaucaaaauugaauggcaguaacauugaaugcuaagcuaucuucccagcuugggauuccuguagggagaaaauaaguccggucucccauuuuguuuccugucugccauuccucucacucacagcuauaggcagauugaccucuuagcugcuuuaauuuucauuucauuuauuuaugugcuugcaguugagguugagagccaugccuugggcgugccagcagcuucuuugcuggagaguuguuuuuaagucuuggagagagguagacagucaggugucucuuuugaaugcauaguugauuguccauacauaauaaaggggguggggauaacucauguggaauaaaucuaacaaccuaacagcccaccucuuaagugaugccaccaauauccagaggcagaguucacuuagggacacuugcuagagguaguggcaucaggcagguuauaagucugaugucccaaugcgcagucaacccccauguccacauccaguguuggggaggucauugaugggaugcuggcuccacugcagaugucccuugagagugacgaggcuaacugguaacagccucaguugugcuuagccaggucagccugcaugcuggacacucaacacccacaagggucagagccaggccauuggcagggcaucugcugggagacacggucaccuaaagggucucuuguuagagucaaagcaugguuccuggagccuggauuuuucuugcagccccucugguccaugcucaugaguguuaugggucaccugaucgcagggcacugcugguuacacuugaggcaugcacaucagcacaucuugaugucaggacagagcagaagggccuccauucuaagucuuucuuuugaccuaaguguucacuacaccuugcaaugucaugagucauuccaguugucuucacuugugccugccaggcucguuugcuaaucaagugagaaaagggagggcucuuuuuguuuguuuguuuuggugugugugugcccuuuuguaguagaaauaaagagguuugaauucuuuugucacugaccuguugguaccuguguggaggucauugaacaccuugccguugagcaccccgucugguuuuccuaucucugucagcuugauggauacugucagauggucgagauguaugugacaugaggggcucauguguacucugcaguuggaucuguagacauggacucucuuccuggugagcugcucugguuucuaccaggaugauuaaguaccagcagucugcuugucuccugcauccucagagagcuccaaagcauuucuuggugcuguuugugggccuugagguucuuagcagcuauuggacagaaugugugcuuguguugacucugcuugccuaccauagcccuuggggaguuuguacauuuuuuuuguuguuguugacuuguugaaugcuuuagcagcugguauuuuuuuauuagauauuuucuucauuuacauuucaaaugcuauccugaaaguccccuauacagcaccccaccccugcccugcuccccaaccuacccacuccugcuuccuggcccugacauuccccuguacuggggcauauuaucuuugcaagaccaagggccucuccucauaugcauacauaugcaacuagauacacaagcucuggggguacugguuagcucauauuguugcuacuccuauaggguugcagaucccuucagcuccuugggugcuuucucuagauccuucacugggggcccuguguuccauccuauagaugacugugagcauccacuucuguaugugccaggcacugucauagccucacaagagacagcuauaucaggguccugucagcaaaaucuugcuggcauaugcaauagugucuggguuuggugguuguuuaugggauggauccccaggugguacagucucuggaugguccuuccuucugucucagcucugaacuuugucucuguaacuccuuccauggguauuuuguuccccauuuuaagaaggaaugaaguauccacacagcagcugguauuuaauaaauauuuuucuuguuauauucuuuuugcaacagauaauugaauuuuuacauauuguaaaauucaaaaauucaccuguucuggguccuagcauuuuuuuucccuuaauuuguauccuuuaccacaauuuaauuuuagaaaauuuccaucucuccccucccuuaggaaugcucuugccuguuagcaaucaauuauucucuccucuucuucucacaacauacacacuugagucugcuuucuggcugugaaugaagcuguguuguaugugggucucugguguugaccucuccacucagcucugcaguuccuuggcagcucuaccgagacucaugcugggaagaagcaucaaacuuuaguuaagcaggggaggguugggccugcacuucugccagcuaauugugugaucuaauaugaaccauggcuggccucuagcaggugcuuaggaaauacugagggaauuuaggugccuagaagcaguacugcuuccugguccucagcccauggcuuaguuucuccaaggguuaaaaaggagacacugacuugugugggaaaccugcuggcuuccucuguaguucccaccaaagauugaagaacaagauggcauaugcugaacuggagaagucuucgcuccaucuggagcagcuucuuaacagaauuguuaaaguuacccuuguuugugugcacaugcauguguaaggguguguguacaugugguaccuggacaggacagcuugguucucuccuaccauggguguccuggagauggaacucagaucaucugccaagaguagcagcagggaccuuuaccugcugaaugaaccaucucaccugcuacagaagaacucuugugugugugcauguuauguguguguguuguaugugcacagugcauguguauacgguagccagaggacccugaguguucuuccgucgcuuucuacccugcuauuucaagaaagggucucucucucacugggaccugaggcuugucagauucacccagguuagccagccauugagccucaguacuguguguccaggguguguacuaucacaugugguuuguuaccuggguuuggguauucaacucggguuuucuuguuuuuguuuuguuuucuguuucucuuucuuuguucucuauaucucaagugguuagaaugcucaucuaaccuuguaaauagacuccuccucccccacccccaaauuggguuuucauacagcaaacacuuuacugucugagcuaucucccuagcccgcauuuuguucuuuuuuuuucgagacaggguuucucuguauagcccuggcuguccuggaacucacucuguagaccaggcuggucucgaacucagaaauccaccugcgucugccucccaagugcugggauuaaaggauuaaaugugugugccaccaccgccuggcccccacauuuguucuuuugagagugucuugcuuuguaggucagcucaggcuuaccucagacuuacagaguuagguuucuagugcuggcaaaaugaguauguauguccauacugggcucagagaggacaggguuuggagccacccauaaugcuugccaggguggcaaugauucuccacugacacaguucagaguggacuugguaagggaagcugguguuacucaaggugaucagaaacgguguaggcuuauaacuaagugcaguuacaaguucaauggaaggaaaaagguuaacgaaaguuuuagauuauggugagauggcccagccaacaaacugcuuucugugcaugaguuugaaccccagucaccaugucugcaucuucagugcugggaauaggguguguuaggaaacuggaggauccuugggucucauugaccagcuaguguagcagaaacagcauucuccaggcucagugugauauucugccugcaaaaaaaucuacacacacacacacacacacacacacacacacacacauaaacacacaaaaaaacccaaacaaacaaaaaaucaaggugagaaauaugagaggaagacaucccagguugacccauagcucauucacaugggugagugcacacacacacacacacacacacacacacacacacacacucccccaccuccugcucucaaacagcacacauaugcacacccaugcaguuaaacgcagaauucuaacagccugucuuugggcuuuccaggaauaugggaaguauggaugaauuguaucuaaaucucugccuccuuucacaucgaucccuauaggguaccauuccuaaacucacugccaaguccaacugccguuaugaaguugaguggaucaccgaguaugccugccacagagauuaccugcaaagugagagcugcucccucagcagugagcagcaugauauuacuauugaccuuagucccuuggcccaauauggagguaggugugugggccccucuguucucucccaugcuuuauagaggagccuagcugggagaggggagagaugggcuuggguuugccuaaaacaccacacuuucuggguuuuguuuguuuguuuguuugagacaggguuucucuguauagcccuggcuguccuggaacucacuguauagaccaggcuggccucgaacucagaaauccaccugucucugucucccuagugcugggauuaaaggcgugcgccaccacgcccggcuagaacaccacacuuucugauggugaacaaacacugcugcuuugugcuuuuucuagggucccccuauguuucugauggaagagaauauacguuuuuuaucaaugucuguggggacacaaaggucucacucuguaauaacaaagaggcugcuguuugucaagagaaaaaggcggauuccacucaagucaaaauagcaggaagacaccagaaccagacacuccggugggugagagucaagugguuguguggacuugugagccauggcucugcccuucuuuuccucuucccauuugcccugagcacaagaaagucagagccuagcacggcuuccugugcacuuuggcaaguugccauuugucccugagcaguuggacggucuccugacuuugauaagugcacaucugcuaggacuauggguuuguaaauguauuguuucugggagcauauuguagagaauuuagguaguuuacaguuuauguggcuauuguuuuuguccccccucuucugugccccccccuuuggcaauuugggaaucugaaauacuauuagaauuaugcacaaguuuaaaaagcuaaaacccuacuguaauucuuagaaccuuaagcugcuaguuggcuucacaaaacuaggaacaagagacaguuuucugaaauugagucuuagaccaaaucuuguagauggugguuuuggacguugcuagccaggcugucugacuggcauuauuuauguuguauaaagucccagagugacagcaagagcagcucugcuugccagcagaguggcugccuucccuccaggccguuacuuuacagcaaggccagcagccugagcauuuggaacucauuuccgcagggugcugcccagcuggcuacggagccugcuguuuuaugucaguagugauuugugggugguaugcaaaaggcuuaacaaagcaguuuuuuaaacuucaaauuuuuucuugguucuauaaaacacuguauguucacaaccuagguacucagauggagaccucacccucaucuauucuggaggugaugaguguagcucuggcuuccagaggaugagugucauaaacuuugagugcaacaaaacugcaggugagugugugugugugugugagugugugcugcccaccccugcuuugugugugugugcacugcccaccccugcuuuguguuaguggcuuguguguguacccaggugucuuccuggaaguggggugcugaguagggagugaguuggcugccuuugggccuggccaccuucaguccucaggguuuucuguugcaguaauccucucccuucucuuccccuccaggaugcauacauacauccuguuuccaucuuucucugcucuccauguuuguuuugggaaucugcccagcccuggguuugcugggagagucugugucuuggacucugcuucaggcacacucagcagaggagggaggcccgguggaggcggcuuuggcuucaaccagcagcuucaaguguguccaccuucucauuuaacaaucuuuucagagugauggagugguagaguuugaauuuggaaaucuugggauguuacuggaagaguccaagcugaggucaugccuuccuuugggugacuagaagcaccccugagucacuggcuugucuacuuuucauguccugauauuagguauuccuggcaccuguagagggaugauaaaguuagagaucugucuuguuuaagcuccuuuggcucugucucaggcaccccuggcugacuugcuucugcacuaggcucucauccuguggcugggccugguuuccauuuucauuuguaugcaauuggcccaagcucucauugccuguugcccuugaguguguuuguuuuguauguuucuauggucaaccuuggacgauuugaucaugguccaguuccugugugauucauaguaggaucuggaagcaaccacugugccuagaguuaaguucucacaaacuugcuaguuuuuaagcagaggguagguuaggagcuggacuagggggcucugaaccacaagacucagaggacccugagggcuguggcuuacuggggccuucuuuuuccauugacucuuucuuaucacuuacagagcuugcaugcuuucaugccuguuugcuaaggcacucuccacaggguccugauggugacagauggcucccugggaguucacaggcuagaaacagagauaaggguuuuuauggcugagcacaggguauagugcuaaggcagaaacacugacugcagaguuuuguuaucuggaguucuaggucauucaggucagugugguuguggacagggggagcugguacugggguagccaagggacagauggccagaggagauguugcuuuagcugcccgauggugaagcgcguguacuguagggaagcucacucccaucuuccguagggugaagccaucucuguauggcuguaaugugccccuggcugagugagaaaauagacuuuuuguugggugccucuccacacccacauccaguuuccuucugcucacuucuuuggaaugggccuuaggcgacuugcuuggaauucuggauccuguucugucccugggccacaaagccugcuguugcuucuguguccucagccagcggacaccaggcugggugcuagcuucucugaucuggucucucuugcugcuugagucacugucaggugcugugacuccccaagucuuuucugccucaacuuugcuuccuguagucuugcucagggcuuuuacuaaagcuugagcugagggcucguuuugggacgcugggaagguggauugauaaaccaggagaggacaggucagaggauagaagauugauagacuuauuuauuguugagaccaugacaacguggaacuaaaguccacugaguuaagauuggaauuuaaugcaaaagccuuuuguuuuucaucuuaacuuuuuauuacaaaaguuuucagauaugcaaguaggaagaacauuauaaugaaguuuauacaguugucucuauaaccgugguucucaaccugugugucaugacccuuucacaagcgucacacaucaguacccugcagagcagauauuuacauuacagucauaacagcagcaaaauuacaguuacaaaguagcaacggaauaauuuuaugguuggggucagaacaugaggaacuguauuaaggaguaacagcauuaggaagguugagaaccauggcucuaaaacaaucauuaauguuuuuccacauuuguuuugcuuuaacuguuacugucuggcucauauuccacuugggaugaguuugcuuuuggucguccaauccuagugauuuaguucaagacuuuauagaaauuacacuugagaacucauuugcuuuuggcuauaaaaccuaauuuccccuuuccuuagaacaugaaacugcucagacacaccucaaagauacaggcagacacaugggaggugcagccggccgggauuaugaaaccaccaacgguggaaaaaagggcagcuuugugccaguggccgccgcugggaaaggccgagggauaggguuuccagagggagggcaguucuuugcccaauccuaggccagggagaaguggccugcgaggagcagagccaucgugcuguucuggguagugcauggggccucuguggguggaggaggaugugguguugacucuaguagggccuuacagacacauacacugaaagguguuggugcagccagcauugggaaugugccccuacccuuguggaggaaugugagguccugccuuccucuagcugaacaaggaacugcucugugcuuuugccucuguuugccuuucuggauagguguuggagagacaucaggucuugcucacucacuagucuguguucuuggaacuuggguuccggggccuguacucuucucuuuguacucuggugaguucuuugccaugugacugcagccuggagcagccaaacaucgacugugguccauggcccucauuaauucucucuccaccuccucccugagauacggaguaccacugcacuaagauggucucuggacagcuaggugauuccugggugugggucaugucaccaaauugugugcuuuccuguggcuuugcaugucuagguaaggaugggagaggagagccuguguucacaggugagguggacugcaccuacuucuucacaugggacacuaaauacgccugcaucaaagagaaggaagaccuccucugcggggccaucaauggcaagaaacgcuaugaccugucuguguuggcucgucacucagguauugcuugccuuuccgaggacagcagucaccguguucacaggagaugaccccaaugguuuggggaaacauuuuuuaauugccaguugagucaugacccccauucccgucuagccacaguacaaaauauaaggaacacuaguuaggaggugaacuacuugcaucugaaccucacuuuuucuaguugaguugucuuggcucaccuuacugguucaguuagaauguccaggaccugcuaugacagguauugugcacugugcuuagagacaguuucuccagcaacuuuuuuggguagugacugaggagguugguggagcuucuguccuuucauauggcugccucuuuacugccacugaaagcgggucagcaugccucugaucuauaguccugggaggguuguccagcauggaugacauggugaaucagugugucagugacaagguucauugcagaaacuggcagagccuguguuauguugaaggugcuggguaacugacuaccacugagagcccacaugcuacaccucagaaaugaguggcaucuugccgaaaaucaaugagguagaugagaguaggcuuauaggagccuuacauccccuaagacagagugacuugcaucaguaccaguuguaacugucuguucuauugucuuuggaggcuuaucugaaaaguacuguuggaggaauaucuccuguauguccgguuuaagaucaggguccacaguaaaugauuuguguuagcugauugcuuuaacaguaagacaucuuuaugguuuacgaguuaagcauccuggaaacuguagaaacacaggaaauuucuguaggaguuaaaauagcuucaggaagcugggacugaaucuuguguaugugugcuaaugaaagguuggguuucuacaauguggaagacguucuaaucucugaacuagaacucugccaagacauguguagcucuagccaauguggacuuuagaaagcucucuagucccuagaaaagagcaggaccauggugggaggacucuagugagcaccgcuccucccuucagcucauguguguagcugaguuguacacagcaacacagcauuuucuguuuuuugauuuuguuguguuuuguuuuuaaaguaaaagggggugcauuacuuccaguuuaagaagggauauagucuaucacagcgaggaaggccuggcaauaaggagugcaaauggcugaucacauugcaacucccauuaggaagcagagagagaaacacuuuuuguuuuuuaaguuuuaagugucuguguuacaagacauaaacugggaucuugagaggugauacagaggcacauuaaugcccuuagcagacuaugcuauagucuggcuuuugaggaaucuggaguguuucuguagcauuugcauccagagagcccagaagaugcugugagcugaauguuccgaaagucccacccuggagauugcagcacacacccccuccagccaaugcccagugcuuuuggggaaacuugggcacacaugcugucucucagagugugucugcaggcucuguguggacuugagaaccuagcucuccaaaaacauuggcaagcugugggauuuuacuucugguuaccaacuucccaaaggaucauuucagacaagaaugugugccagcucuggguguccuucagggcagugucugaagugauaggcacauucucaugacuacucuuuucuuugccugauagauacccuuaauacccaguggugguucccuugacacaaacacacacacacacacacacacacacacacucacacacacucacucacuccacccacucacucucuacccauuaggauccauccuuaccuucugugagccagaccuuccacccugcucccagucauccuguguagaagagguagacacucucuuagcugcacaggcccuugugggaucugaagcuuagcaugugaccugugccccuucacuaggcucaggacagcaacugacuuucucauguaguucagaaaacauuguggggaauggucuguuccugacacagucagugaggaaguggagacgccaugacugucuguggaguacuagagauugucugaccuuggcuuagucgcuguuuuaagauaggacugcaagaaaauguuacugccuuuggcuuaaaggacuuuggguuugauugcagaaucagaacagaauugggaagcaguggauggcagccaggcagaaucagaaaaguauuucuucaucaacgucugucaccgggugcugcaggaggggaaggccaggaacuguccugaagaugcugcugugugcgcugugggugagugacgucaguagggacccucucucuaaggugugcagauucccacugcuucccugggggagacauaaaaugugguuugcuuaugucuccugccuugcauaaauacuaaggacgauaaagcguuuuaaaguuucagugucaaagccacugaaguccugauacuggcagaggcguuacuaggcagaaagaaccauguuggaaaaugcuccacgaucuaucuucauuuuguagacauuugaagaauaauaauacugucaguacuaguaaaacuaacuuugaguuuuccacagccccuggucagacacuuaggggaagcaggauaccugcuggugcauucaguggagcagcauguccgaguguuguucuugcugucauuguuggucuuguaugucacauagagguguucgucuuagagacacugagguucgguguguggugugaugccaggaggaggguaaggagaaucuguuacaaauauggacgagagauuagugaggcuugguuggauuuuggggauuacccuggcauucagaacuagagacgcaucucagagugacugaggucuguuuuugucuuacuaagggcucaggcauagacaucuucagaauucaguguggggugccacaguggggugagugccacacaggugugaguuucugcuuggucaugaguaaagcuugugacuugggccgugcuccucagcugcccacguuuaagggcagcugaggcucuagaugcggaauagugucuuuuacagauaaugauggugcccacacaacccuguccuucagaugccuuugggggaaucccauguaucauuuucagcauggcaggagguggccucgaugugauugauaaauuuuuucuuuuaagaaaauugguuuccaucacagucagguuaggugggcugaaagaagguccuggugacccgcuggcauucggcugagucuugguauacuuucaaauguuuacaugaugagaauuuucuacuccaccuucuuuuuuuucccccagauaagaaugggaguaaaaaccuuggaaaauuugucucuucuccuacaaaagagaaaggacacauacagcucucuuacacugauggugaugacuguggcagugauaagaaaauaucaacuaacaucacacuugugugcaaaccagguaaugucacagaagaagagacauacccacauuuuccaucauuucuguaguagagcugggagcaagggcggugcugagcacugcuaguacuagucucuggugaugggaaucaagucguuuggauuucagccuagaaauggagaaaccauaugcucuccacagagaguugugcugacacacuccaaaggagucgugagucucugcaugacauccuguucauaaggacugucagaagaucagggguguggagugcugaguuuccuccacggggggaucauaaacggcuuagaaauauuuucuugauugcagcaucucacccguggcugucccuccccucuugaguuucugcauuugugcguguauuucaguguucccaggaugcuguguuccacacuccacaguucuguuuaugauuucuagggauuuccuuguugacauggcauaguuuuacuauuuuaaagcauuuuacugcugggaauuuagauguuccauauccucucuacacccaccccguaaaguuuccuuuguauaaauucgcagcugugggaaaaggacacaagcuaggaauguuuuguuucuuguuuuauugugguagacuauauauagcacaaaacuuauagauguuacugucuuaacugguuucagauagguagcugagugcuguugggcguuuguggcuguuacugcuguucauccagagagcuuucucaucucuccacacuuaaaccugccaucuuggaaauaauaguacucccagaguucuguccccugcaucugacaccuaccuauuugccugucuguggaguugcccacucuaggcaacuccuaucaacaaagccacaugguauugugggagacuccuuuccuauccacaaagccacacaguauuguaggagacuccuuucccuguggcccccuuucuugagacaagauuccacagagcugaggcuggccuugaauuucuguguccccauuuccaccuucugaagcacuggcauuguagauaggcaggcccugcauaucuguguuagacagugcuggggauggagcauguggcugugcuggcgaagcacucugcuguaugagccagcuguaucuccagcucuguacggccguucuuuaaaccaccucuuuccuaggacuuuuaacagggaaaaagguguuagaaucggcaaauaaguguuugaguguuuuucuccuccccccccgcccccccccgguccuccuuucccuguugacaggugaucuagaaagugcuccagugcuaagagcugcaagaucugauggcugcuucuaugaguuugaguggcauacggcugcugccuguguacugucgaagacagaaggagagaacugcacgguccuugaugcccaggcaggucugugccuaagcagugccucuguugucuggugugcaugacuuagcauggcuguuaggaguaaccugaugcagaacuuuguucaugccacuggacagagccccaagcgucuucuugcugugugcuugagcugcggcggcagugcccaucuugaauuuguggcucugcuggauuuacugguuccagcacaggaggauucccccccuacagucauucaaaaggcuuuuagaugcggccucggacagacccccuccauaguggaguuuacaagaaggccaucauagugugguugcuuggcuaugccacauuugugagaccuggagcuacagguuugaacaggguuguagggcucacacaguggaaaagggcaacggcgaggaccuguguccagguaggagauagucacugcaggaaugguagcuuaaaggcaaagugaccuuucuccuucagcgcuguuuugcucuggcaguaguuucugucugagaagcuugcgugguccgcuguccccugugccaugacuggccugacauaccuguguuguguuuauguuacucaggguuuuccuuugauuugucacuccucacgaagaagaauggugcauauaaaguugagacagagaaguaugacuucuacauaaauguuuguggcccuguauccauggauccuugucagucaaacucgggggccugccagguagcgaaaaggcaaguaaccugauucuggguuugcucuuugggauugugggcuagcaaauguuucguacagagguaguuagguuucucuuggacaccauugcuugacaggcaucuaacuacugagaagaccuggucagaagaaucgcaggaccccagagaaggggccaagccuuauccuuaggcugagagaggccugggcuuauugaugcucaccugggaacuugagcuuuacuguuguugcauacuuauguauguaguucuccuuacuguauagaauagguuuaguuguaaugaauugagcugcacuacaggccaggaguacugagagaaaguugugugugugugugugugugugugugugugugugugacuuuucucuuuccacagccaaaagagccacauaugagauucccagggacugcagugucuuggucuggccuugcuuuugccccuauuuguguagccuuagagaacagaacuccugccccauggcacucacucccagagugacauuucuguguucauuuuagugguaagucuuggaacuuggggcugaguaguacuaagcucaccuacuacgacggaaugauccagcugagcuacaggaacggcacucccuauaacaaugaaaagcacacaccgagagccacacugauuaccuuccucugugaccgugacgcuggagugggcuucccagaauaucaggugggaauuaucuugggaaauuuuccuggccauaccugagccaguugcccacccuuucuguaggaacagagcuauuauuagucugguuuucuugccaaacuaucacauaaccauuccuuuuugcaguuuucaggguaccuaggcaguauguaguuacugguuaagcuguuuauucagaggcccauuuaucuuaaugcuaguccacagcucuguugguuguauuagaaaacaugcagaagcgauuucccuucccccaggccaggcuccauccuagugcuguuguuaagcuaaggccaguuuugcugugggucuuuggggauguuacagauguagguuguuugugcuauccuuuccugucuccuucuugucuugggauuaggaagaggacaacucuaccuacaacuuccggugguacaccaguuaugccugcccagaagaaccccuggagugcauggugacagaccccuccaugauggaacaguaugaccucuccaggugagcacuuguuuuagccgauggcaguagguuugugguggccccagggugcaggguguggucugaucucaccagucugugguaucaauugaucuuugucauagcaaacacucauuguuuaaaauacuaacucaguguaaggugaagguguuggcagggcccucugcauguggagcuucagacuguccaaauguuaugacauguccugugagucauucaccacauaguuugauucauuauccauugauagugucuucauuucucuagugacuaaacaugaacugcugacuuuagcuaguucaccuuuguaaaagcauacuuuugugugaaaacuagucuagugaagucugaagguggcucuggaggaaacugguaugcuauggaaaacucccgggaacauguuacacggaggaaauacuaccucaaugugugucggccucugaauccugugccaggcugcgaucgauaugcaucugcuugccagaugaaauaugaaaaucaugagguaugugugucuuucucauguuuucucucgacucugaggccuggugugugaaggcauagugaucuggaauucuugaucagaacaggccugcugccugcccaggugcagucucugaggaugugccuccuucacagaaacacaucacuugaaucuguucagacgggcacuggccaugguugauccaguacuuugcagggaaagcucuuagugguuaugcuggccugaauucaggugccugcgggauucugcagacauccauagcucagagccuccggugcccuggagucagucgcaugugagaguguugcuccaagugacccagaugcacgugguaaugccacucugggcgcugagugcuuuaucaucuacuggcagagcguucacaucuuuccugugguccuuauauguggugggcuuuggaaguugcacacagaccccagaaguugacuucugcaaaaacaacgugagcaauugcuuuuguugcauaugcuaguggugcccucuggugccucagaggcauuugaggcuguauguguaugaguguguguucucuaucacaacagcagcuucgggguucagccagcccccacucagggcuucccccccacucaaggcuucugcauuuuguuugccugcuuacacaguucuuagcuguggcuucauuggcaauaacuacuguaaguagcaaguugacuuccugaggaaggaagccaaauccacacucuguugcagggcuccuuggcagagacuguauccaucaguaacuugggaguugcaaagauaggcccugugguggaggagaguggcagccuccucuuagaguaugugaacggcucugcuugcaccaccagugauggccagcucaccaccuacagcaccaggauccaucuugucuguggucgaggauuuaugguaagugcugcacaggagaguggcaaggacuucagaaaagcaccagggccaguguguacgauucuauacuuuguuuuaaguugcagcaaagucucuagggcucgaaauuggucauuuuaggcauuaccgaguuaccaagaacauugccuuuaucaugaguguugucccaccaaaauccauguugagaacuuugugugggggucauuuuuuguuugagauuugcgucucacuguguggcccugucuagccuggaacuugcuauguagaccaaacuggccuugaacuuguguagcucugccucuugagugcuauggcaccuaccucauaucuagagcuguuauuuccccaauccaaccuaguuccugcugccaccuuuuuccucuuccucguguauguguguguguguguguguguguguguguguguguguguguguauguuuugggggacaagauuucaggcuggccugaaacucacuauguaaaccucagacucagagcagggauuaaacguuugugccacuguucuuuguagacuccuggauucuccugagcucagugcaguggaugugagaccugguguccaggcacccugcagacaugaaauucauuuuguccuucucugagguuacgaaaugacugaggacagugucuauccauggguggcagacaugcucccuuaccuacacgauccugggcugcuggguguuuguuuguuaguucauuuuguuuugucuuuuccugcuuuggggaagagugcugcccccuuagguuggucucauuucauagccuggcagcugccuccuaggugugaggagcccugccaucgaccauucuuugcuuuuccuuuuuugcugucauuuagaaaaugcauuuaguuccagaaaauucuuuacaacacuucuuaguuuuccaaguauuuucugacaguggcugagcugguuuugccuaugggcuugguguacaguguggguccugguaugacucuugguggagaggagaggaggccagguucacagaguguaccacaggcuagagccugggucuuucuuauccuuagggagccaggguccuuggguugaugagcagagugggugggacauacagguagaaacucugggcugugggcugagaccgggugaauaaugccaguaaagucuuggugugcuguccaguuagcuaacugagccacugcugucuaugauggagacagcacucguggaauggaaugaggcuuuuguggggagacuuuuuguugaacccccauguaucauaagacagcaguccucacaaauuagcacaucuguguaacugaaaccugagucacugacacacagccauuuuuuagaagauuuauuuauuuuuaugugcauugguguucugccugcaugucugugcaagguucagacucuaguuacagacaguugugagcugccuugugguugcugggaauugagcucaggaccucuggaagggcagccagugcucuuagcugcugagccagcucuccugucccacacaagucaguuuugccuuauuccagcugcugucuacaacuauguauaguaacuuucuggcugcuuugucagacucugguuguacaggcuuggauucaagcugagcuuuuccauguacugcuggcuugagcccagaugugcuaacuaaugucugugcauaugaugcccuguagggguaauaagaacagugugguauaggaaggaggugcauaucaggugcugacccauugaagacugccaguggauucuagccugccugacauacugaugcucaacugcuaugcugauguccugcugauuucucuaugcccugugaccuuucagaacucccaucccauauucacuuucaacugggaauguguggucaguuucuuguggaacacggaggcugccugcccuauccagacaaucacagaaacagaccagguauguguguugucacauugcccaugcgcacgccgguuuugaguugcuuccuagccuccuuucugacacaugugucaccaugcucugccuccucccuacuguggguaccuagaucuucaggaccacccauuucacuucuugcucaccacagcccccuucaacugucccuuuccaaugccaaugcauccuagugagcucuccauaacugccaggaucugauggauucacauugcugcauuccagaacauuccaguaucuggcacagugaugcuccugaaguccuuauccacaagauggagcccaguacuucaugugaugucacugacagaguaaagccaugugucugcugugaccacccuccugguggaaccuagugccucaugggauguuacaguuagcacccaggguagggcuuagugaucaugggacccgagccugggauaaagcccauguguccgcucugcccuuccuuagcuccagugugcagccaggcgccucaugcugaugaggucuggacggcagacuccuuauccucugcugaaggccaugcacuuuguuccuagcaucucuccacugcuggcugcucuugucugggcgcuucuccuggcugcauucucugcgguguagcagcauagcagcacacugcucuuugggcucuuugcuacgcuccugggccaggaaguuguuuuaugguacugugugugcccuucuuuauggaggaacauguuucccuccccauccuuuuaauuucuuaccagacuacagagucuggaagagaaaccuggccugauacacaugaugaugaucucagcucugggccaguaguaucuuaggcacccuguccuuggucagggccaugacugcuccccugaccuugguggacauuggaggcugacggcaaacuuagaggaagggagggacugucugugaguuaaccugguuauacucccauaggugcacucauagcaaugagagguaauucuucaguuuuauuuuuuaauguaaaaaucacuguuauucuagcuccaccuacccuucccuuuccccuuaggaauuagugguagccuuacucugcuuuguaguagcucagcacccaugggguguguuccauuccuccacacauacaucccacauugaugcaggcaagggacugcaugagcauacugcuguucucauagagauuuaaaaugagcggcaauggguuucugcagggucuucaugucuguuuugcucuuguagaauugguuugaaugcauuuccuuucuuguuccugauaggcuugcucaauaagggaccccagcaguggguuuguguuuaaucuuagcccacucaacgauucugcucaaggacauguggucuuaggcaucggaaagacuuuugugguaagugaagcaguaaauuucuaguuugcuuuaaacaaggcaagcugcauucaagucacgugggcuguggguuugggaaucaggcauccuuagugcugagagaaggacggcugcuucaccacaagaaaggaaauccagguuggggggguggguaaugagcuaacaucaucaccacaguccucaugcaguuagaugggcaguuuucccuccuuaccugcugcugugcaucuacagguuuccaagaggcagcagcauggugacaguuaggacccgagcuacauaaagaguccaccagaagcaacccagagaggcccugccucguguacuaaccaugcugucaggagccagcgugccgccgaggcucuugguugugggugacagaccaauguaauaauagcagaaauggagcugccuggaaggccgcccgagcuuguggcuugucugcugggccacaccgcccaccagccccucucuuagcaucacagcgagggcuagacuucugcuccuuacucucccuaucuccuacccuacuggguucagcugcccugcacauuugguggcuuuguuuucagucagacuccugcauacccuucucugcacgauuaaagacacaauaaagugauuuguuuugcuucuuaguguaugcuuuauaaucacguacaguaauuauaucuacagauagaaggcaguaaaauaagaguauaaaacacugugcauuuaaccuugaaauuuguguaguuguuauuuggauuuguguuuuugccuuucugacuuaggaccgagaugcccugaaguugauaaacugcuagugagaaccagauacuuagcccauuguugcuuuggguucuaggaauuuuuuuuuuuuuuuugacaggguuucucuguauagccuuggcuguccuggaacucacuuuguagaccaggcuggccucgaacucagaaauccgccugccucugccuccgugcgccaccaugcccggcgguucuaggaaucuugucugugguaagucuuggaaucuaaaugggccuguaaaauuuuuuuuuucccuguuuggcuuccaguucaauaucuguggugcaaugccugccuguggaacgguugcggggaagccagccuauggcugcgaggccgaaacucagauagaagauauuaaggaccuaaggccacaaaggccggucgggauggagaggagccuccaguugucugccgagggauuccucacucugaccuacaagggcucuucucccucugacagaggugagcugagggucacuuggacauaugcauaucucccgccccuucuuuuuacuugcaccucuagcucuucagagguggguguugauuguccuucucuaggugcuaaggaggggaugaguuuauuuauuuauuauuuauuuauaaguuuauucuuuuccuccuguuuuuuucuuuuuaaaaaauuggugauaugguuucuuauguaacaguuuggguauguuaagcuuguuaauacuuauuuuguuaguaagugaaaggccaauucugagcccuucaucgugucagcagcugugacaguggauagccccugcaggugacguguaccacgggugcuauauguguguugucuggugaauucccacgccagcucugugagucuucucuuuuucuuuugucccuuugagauaggcucuuacugugugguccuggcuuucuaggcugguuauguagaccagucugucaucaaacucagaggucuuccugccucugccuugcugggaucaaaggcuugggcaaccacaccuggcuuauacuucuccugugcucaguuaaugcugcacuguacaggugcagcacuggaaggcagaaagucuuauaccuaggacagagccugugcuucaugaggggcagcuucagagugagauccaggggguuuggauucuguucuagguucugccaccuguuuauucuguuuuacagauaaggaaauggaucccagggugagguuacuucacaguccacacuguugauaggcagcaaagugacccucugaccccagucagucccauugaacacugggguguuggugguuugugcgauggguugcacaccaugcucaagcugucugaggggcacaggaggggguggagucuuccaugcuacaugguuugcaccgacacugcagucuuacuuuuucuacuucacuucuccaguuagcagauacuggaauuauaacacuaucauaacuguauuccguagaauacaaaugaucauuaaggacugauguaaacaacuguaugccaacagccagacagagucauaccuucauaucauaucuucauaauaaaaucccccaaaauagaaauacagguaggucaugaccacaccauaugaaacagggaaaacugaaauaauuugcucuaaauucaaaaacaagacagaaugucaagaguuaauacuacucaguuacagaucucagaugugaauuugaggaaauccuaaaauauaggcaacaaaggaaaauucuuugaauuuauuacaucagacuuauacaaauuuuaugcaacaaagacacagucaagcgaggagaaucaaugggaugguagggaacacuacuuacaguuacuucugaauauagaaauaacucagcacaaaaacaucagucagagugaaaaugggcaagggucagaauaauaauacauuaaaugcuaaaauguguguguaugugucugucugucugucuuauuuauuuauuuauuuauuuauucauucauucauucauucauucauucauuucacauggggguaaugcaaguccaaaaauaagggauaagggauggauucucucaucagccaggacugcugcuccugauagaaaagcagguuaugcagggagaaggccggguacggcagcugucaaggaagcagcuacaaauggagcaugguuacaaugcccagugcuugugagguggagaggcagaguucaugucugaggccagccuggaauacaugcagggccuuguuuuaauaaguaccuugugccaaugagauguuugacucaguaaaggcgguugacugccagaugccagccaucaaguuguccucugcccuccgcaugugcaccauggcaggcacacucacagauacacacaaauaguaaaaaagaagaacucaaguccaaaaucaagaaaaccaguuauguagaaacauuguuuaaguucuauagcagccccagugugguauauaugcccagagguauugagcucagcacaucagauacuguacguguauuaauugcagccuuguucacagcagcccauguauaaaauugaccaaguuuuccuugaaugauggguggauacauagagaaaaugggcacacaguggucaauuacuaaaaaugagugaaaaccucuuauuagaagcaauuugcaugucuagaagccguguuuagugaaguaagucagacacagauccuccuguuguuggcaguugaaagcuaugguaaguacuugaucucggagcagacaguagaguagagcuguugagagucugggguggggagggguggguuugaauagcaggguuagcggugugcgggguaggaagaguaaugcucuaaccagcccaggaguuaaguugaccacacugauugugguucugaguagcuaguagagaggagugcugagcucggcuugaggcugcggugaccgccugcuggaugcuuuggcugaaaugugaucacaagucccaugaauaucuaguuacaguguguggcaguuagaaauuaaagauaaaagugaauugaaaauguuuugaguaagcuucugcaaauguaaacauaggaagggguuccagcgcagaaggaggugaggcuccuuggugacaaauaucucuaacacgccauuuccaggcgcgagugagccagcgacuccaguugggagggaccauugugguuggcuaaagacauagucagagugcaguucgugaauauguuugcugccuugaggguggucaggccagccuucaguguccuccacguggguguuuugaagggcugugugagcacaugauuucccagugagcacugcuucagggccuccugaguggcacucuuggaacccuuuccuuggguagaagggguuccgugcucagccuaggaugguucucugggagggaagcucaguuagcacgugcggagggaccacggugggcagucucggcaagcugcuacuguguaugaaaccucuccgucucaguauacaaagcagggugcuuccuuuuguagcuacuuugcucugcacuugcugaccacucguuuaaacuaggaaugcuuaaucauuuuucuaucauguucuuuugaggcuugaguuuugaaagcauuucccacccagcucuauuaacauuggggaacauuuaaugacuggugaggcuccaggcuuggguagcgccgaggguccaguccacuuacaugccuccuuaauuuguucuuaccucauuaacccuguaaagugguugugggggaggaguagguguguagaguuuguggaaacaaaaaagucagaaaacaaauuugcuuuaucugauggaaugauaaacuugugcgagaugugaauucauucugauaggaagagagguaagaucugaucccuggccuaagcuugucaugccacaccagucaauggugcugggacaguccuugcacuggcuccccuuugugauuaccccaggauggcuaugaggccucuugcugcccuugcuguccuaagugugagacccuccugacugguggcuuucuugucccacaggcacagcauucaucauccguuuuauuugcaacgaugacauuuacccaggagcccccaaauuccugcaucaggacauugacuccacacgagggauccggaacacuuacuuugaguuugaaacugcauuggcuuguacuccuucucuaguggauugucaagugacuggugaggccuaggaguugguaggcuggguuucagugaggggguaguguguguguguguguguguguguguguguguggguggguggguggguggguggguggucugucugucuauauuucuuugccucugagucucuacgugcuugaaugugagcuagccguuuguagacguggcacauaugcuuugcuccguaggauuuauagcgauuguugccuguuaaaugaugcuuagugauuauuaaaugaugcuuagugauacaagugcuucucuugaagagaccccuucccacuuacagcaacgguuuaaauugugguuugcgggucagaugcugcauagcaaucuugaagaaaacucaaguuaaaaaaaaucaaauacagauguauguccaaaguucauaugaggaaggaaaaagacauaagaccuaagagcugcucaguugugcccugagguggcugugugcucugacugcuuagcgugugugcugugcugcugugguuuuuacagagggacaguuuggacagcagggcaggaguaugguucugcaguccagguuuccuguggguuuccuugugucuucacacgguggggaaaguggucccagaacaaacaggaaagcgugccuccuuuuguguuuccuuccaccccagacccagcugggaacgaguaugacuugagcgcccugagcauggucaggaagccauggacugccguggacacgucugcauacgggaagaggaggcacuucuaccugagugucugcaacccucugccuuauaucccuggcugccacggugcgcuggaguccuguuccacuacuuccccggggucugacuggaacccaaagcagccuuuccucauucgccauucuugucuguucaggcauugcauugggguccugcauggugucagaagacaacaguuuuaacuuggguguggugcagaucaguccucaagcuacuggaaaugggucucucagcauccuguacgugaauggggacagauguggggaccagcgcuucuccaccaggaucguguucgagugugcccagacgucggugagugugcaccucagcaggaaacgcuugcuuggugguuaccucuauucccauuuccccuuaaucuuggagucuucugugcuguuuaaagucuguguuuauagaaaugggggcauugcuagugucugacuagaguauacuguuuuccucaggcuuauaaucguccgucaguacugaacccuuggcuuaagcgagcgagagacuggagacuuccugaggcucuugcuuguuuucacaaaguagcauacagugaauuguuggcuuguguugcagggcucaccuauguuccaguucgugaacaacugugaguauguguuuguguggcgaacaguggaggccugcccugugaucagagaggaagguaagccacagguugcugccccugaguugcuguacauaucuaguggaauauaugugcuaaacccaggaugucucacauaggaagcccuguggugguggcugccuguggggucaggaggugccagugucugggucaccccuuauccuugaggucuuuauuaagccacuuguuaauuuuuaccacuggccuuucucuaauauacuuggauuggauuuuguuuuuucuugaaaccaguaaagcagucaggaugggcuugguuuauuaaucugugggugucccugggcucgcuccaaaacugucugucuuauacauaaacaagacaacagagaggcagaccacuuucugauagccauugccugacuaaaacuuguaaaacuugccuggucugguggugcaagccuauaaccucagcuuugcaggaggcugaagcaggaggagccuuuguucaaggccugccucccuaggcugugagugaguuugaggccagucucaguaacuuaaugaggccuagccucaaaucaguaaauagagcuaagaauguagcucaguggcaggauaucugcauagggugugcugucucagggucucaguauugcaaagcaaauaagaaauuuuauuuuaaaaauuuguucucauuuggaacuacgaaugccugugugauagcauuugcucuuggcuccuguauguucuugaaggagacaacugccaggugaaggaccccaggcauggcaauuuguaugaccugaagccccugggccucaaugacaccaucgucaguguuggcgaguacaccuacuacuugcgggucugcgggaagcugucaucagaugucugcucugcccaugacggauccaaggcagucucaucaugccaggaaaagaaaggaccacagggauuccagaaaguggcagguacugguguuuucugucuucagcuguaacacgucaagaugugacgccaaggaccacauuucucuaacucgggaggagcacgugcugagugacagacacaaggaagcaagcuuccaucugccuguccauccgcccguguaucuuaucacugagcacaagugcaggucagagaacaauuugcaggaguugguucucuccuuucaccaugaggcuccugggaaugaaacuuaggucaucagauuuggcagcaagugcccuugcccacugagcuaucgugccagaucacugaggacaauuugguuagaguuuggaaaaaacagcagggcaaggcaguuggaagucauggcacuugccaggagaaggggguuggaaaagaggagagaaagcuaugcuuuuugcauuaugcugccauuuucagcuggaggcuuaagaagcagccauaaggcagauaggcagcucugccuagcaacugggaguggggcuucagagaaggagugaggaagcccagaguaccagggaaagcagagaaagaaggcaaaguaaaaguuaggacucagcugaguaggccaugaacugcagggccacagaguguuucugacccuaagcccauagguuuuucuugggacacaccacaugaggugaugaugagugccuccaagcagucuaucccagggcugcaucaaagaagguuagauggaaaacugacaaggcuguacuuggcucaguaguuaagaguauggccugcuguugcagagaauugggauuccauuccagcacccacaugguggcugacaaccaucuguaacuauagucccaggggaucugagacccuuuucugacuuuccaggcauaaacauacaugcaggcaaacacacuaacacacaugacauaauaaaccuaaaacugacagaguugacaugguggugucuguuuuugcauguacacugucacaggucuugcauuagcaccgcagcccaggagccuuacagaugugcuuugucuggagccuuacagaugugcuuuucuugagcaggacuccuuagccagaagcugacuuucgaaaacggacuguugaaaaugaacuauacugggggggauaccugccauaagguguaucagcgcuccacaaccaucuauuucuacugugaccggacuacacagaaggugagccccuguggcacucccacugccgucccacuccagcugcuguucuuucagggcuagucuacucucaacgucuauaagaugcauuauuuacugagcaccuguuugcauggccauccuucaccugggcucccauguuuacauauuuucuccuuaaccuuuccagccaguguuucugaaggaaacuucggacugcuccuauauguuugaguggcgaacacaguaugccugcccaccuuucaaugugacagaguguucuguccaguaaguucacauaucuauuggcuuuuuguguccuuccuuggcaaaauuuugcuucacagguagugucuuggucaguucacccacuucuuuucacacuggguagauggcuccagauagccacauguggggcugguacaucagacgcacauggagaggaggagucaaggacagaaacagagguucggagccuuccugguuuguaaggauggaguggcuucaggucuagagagcaggaggcuuggugaggcagcuuuuggaaauggcugugggugcauacgcuccgagugccaggggguggcuucugcuggccacugaguuauaauugucacuggccuguguguggacagacuuuuccaaacuuggcuuuucagauagcucauuuuguugaagugaacauggacucaucaaagcucaaggcugugccuugcucacucugcauuuggaaaguuauguucugcaguaaagcuugauucacaggacaucagggacacauugaugcuugagcccucugaggagagugccagacaugucauuggagcuaacuggacccugauugugguguucuguucccugcagggaugcggcuggcaacuccauugaccucuccucacugucaagguacagugacaacugggaggcugugaccaggacaggggccacugagcauuaccucaucaauguaugcaagucucugucuccacacgcuggcacaggugagaagugacccucuucuuguagggugguggucagguccuuguagggagucuucugggacagacagagcaggagaggccucaguggaaggaguuuggccuaggagcagcaggggaagggccugagggucuuggugauugauucccauauggcccaggcucuguugauacugaagacucugcagggaacauauuagccucaugagaaccugacuauggguacaaagaaagcaggaugggacacaggaaggggcccacuguuuauccuaucaaggacuuguaccguuucgagagcauucucccugagccugcgaugagaguggagacuagaagacacaugguggucagcaguuuuccagggaauuccuuggaauacugaaggggaaagucacccacagucccaccucagggugaugcuuuuuuaacuucauucucaggguauagggcacaggugccuggagaauaggaaugcugaguuccuaguaauguauugacuaaagagugagaauguaggcucugagagugcucccuugcguugaggacucugaccuuaccuugcgcaguguuuugaaaugauggcgcgggguggguguggagggguuggauaauaccauaccuugagcugcacuuugcacuguaggagacugcagucaccccaggagacucugauuguaucuuguguugcagagccaugcccuccagaggcagcuguuugucugcugaauggcucuaagccugugaaccuuggcaaggugagggauggcccucaguggacagacggugugacuguccugcaguauguggauggugacuugugcccagacaaaauucggagaaggucaaccauuauucgcuucaccugcagugacaaccaaguggugaguuaauggcacccaguagagugugggacccugagccagcgacaaugccaggcugcuuuugggugcaaguucgccugcaugucaggguggcaugguuguggugcaugcugguugcgaggucugugauuuaggguccaugcguccccuugcugucugcuuaggcacacaguccgacacuugcaagugcagggcuaauugacucuuuugagucuacucuggauccuuaaagaacagaagggcagcuaacacuuggcugcuugucccauguuugucagcaagauguagagaggagacuggaaguucccgcaugacuggugcagguguuaugacuggcgaucuggcugcucuccuucugagcugccuccuuacuugguuguugguguuggcaucuagcagguguggguagcauggguagcuucucugacacagaggaacuucuuucugugcuucuguuugugaugggacacaucuguauuggagaagcagggucaucucugaaggagcagaugccuuaugggccaggauacaggcugauguacuggaggguggcgggccugccucugugccucagugcugagaacugugcaggaaggagguagaguugggcaaauggucucagcuccauaaugaugggaaagaccaggagugaucgguagccagugaccagaagaguuaguauuagggacccacucuuugcuggguccuuuuguuuuggcuguaacaggcauuugcuaagcauuggccggugauuugcucauggaguucuuugccugggcuccuugggucuaucauuagaaaaugucuggcucgcuuagcuagcuugugguggucccugggguauauugcugacuuacuugugugagguccauaagaacuuacucaccuuugauuuuuuuuuugaccugugcuuaccucacagagacaccccaagacuugcugugcuuggcuuugccaagcaguguuguggggcaugaguggguacccccuaggcguaaucaguuauucugaagugguucucucugcuugcccuagaacuccaggccccuuuucaucagugcuguucaggacugugaguacaccuucuccuggcccaccccuucugccuguccugugaagagcaacacacaugaugacugccaagucaccaaccccagcacaggugagggacagacaaccacagccccguacagggagggcccuaggagguacauccguugguguuuggcaucuuuggccuuuaaagagaaaaggaucuugugcucauccuauggaggcagcuaccuugugccugggaaagccagucuccaucuuguuuuguacuaugcuccuggcucgcuuggcugaugguacaugagugcuaaggucuacaaagcuggccaccuuucagagccaacagggcagccaccagaagacuucugcccuuccgcuuugcugaguaucaagaggaauguggguggcaggcugcugaccauuggagagaugcgucaggccaaugaugacagcgacaguggcugcuggggcacacagaggacggagaccgugguccagugacaggcgcugcuaugcuaguuggaguauuuuagggccuugaugagugugugaaggaagagucagaguccccacugguuggcugaugugagcuggcucgucacagcccuccuggucugaagcgcccucuucuucucaccuggcaggccaccuguuugaccugagcuccuuaaguggcagagcugguaucaaugccuccuacagcgagaaggggcuggucuucaugagcaucugugaggagaaugagaacuguggccccggaguaggugagugccauagcuccugugcccgcugcugucccuagggcuggccucagccccauucccacuucuaagacccacacucccggcccuugcaguaguuaggagacacugcguucuucugugaaauuaaucaguuagucacugaccccuuaccagcucuuucuuuauccuuccaugugcugcaggggccugcuuuggacagacgaggaucagugugggcaaggccagcaagaggcugagcuacaaggaccaaguccugcagcugguguaugagaauggguccccaugcccuucccugucagaccugagguacaagagugucaucagcuuugugugccggccugaggcuggaccuaccaacaggccgaugcucaucuccuuggacaagcagacgugcacacucuucuucuccuggcacacaccccuggccugugagcaagcggugagugacugcgacgcagcugcacccacuccaguuugcugguuccuagcaguccaaggcugggcggucuuggucaguauuccuuagguuuuuauuuauuuuauuuuaguuuuuauuuuaauacuacuucuuuuuuuccuucuuuuggggguaagguucuuuuuuuuuuuuuuuuuuuugguuuuuucgagacaggguuucucuguauagcccuggcuguccuggagcucacuuuguagaccaggcugaccucgaacucagaaauccaccugccucugccucccgagugcugggauuaaaggcgugcaccaccacgcccggcggaggguaagguucuuacacuuuauccaaaguuggccuucaacucacucuguauuccaggcuagcuugaacuguggcaauucuccugccucaguccauugagugcugcuggaacuguagacauguucuaucauaccuagguuuagcuuuuaagcugucauucauggucauuagaaaaaaaguuacuuguagacucaaauguagucuuuucuuuugaacagacggaguguacugugcggaauggaagcucgauuauugaccuguccccucucauccaccgcacugguggcuacgaagcauacgaugaaagugaggaugacaccucugacaccaccccugacuucuauaucaacaucugccagccacugaaucccaugcacggagugcccugcccugcaggugccucaguaugcaaaguuccuguggacgggcccccuauaguaaguguguaaggucgggguuggcaaguuucuagucauagccugugugcugggcucagacagcuaagugugagaucgaaaguaugagaguguacauggagcgggcggccaaccaacaguacuggccagggagucugagcugcuugaaaauugaauaguugcuuccauuugcauuuugaaaauacauguguaugugugagugugugcuguacauguauuuagccuguggaggcuagagcagggguuugugugagugugagcuguacauguauuuagcuguggaggcuagagcagggguuugugugagugugaacuguacauguauuuagcuguggaggcuagagcaggguuuuugaucuugugggguuggaguuacaggcacaugugagcugcuugaugcagugcuaggauggggaccugagcauccucuggaagagaguacaaguagcccccucauacauuugguauugguggucacaugaccggcauuaacugcuucaggguacuuuugauuaguguggccaucucuccagauagcccagaugcaauuucuuuuuuaagacuuuauuuuguuuuuguuuuuggguacauguauauguuugugcauggguaugugcaaguagguacagugugcagcagacauuggaucccuuaagcugugcuuacaggugaucaugagcugccugaugugggugcugggaacugaacccagguccugugcuaaagcagugagcacuuuagccauugggcuaucgcuccugcuucccaguuaugcuuucuauguuaaaccugaccaagagagguguuaacagagcgggcaucaauagcacuggcacagcacaugcuucucuuucaagcacuuguauaauugaaaggcuuaagugacacaaguucuuucuaguaacgagugacaauuagggcaaaaccaauuaugaauaauaaaaaaauacucugcccugaaaacuuacaguguagauuuggauguguggaguucuauuugugguuugccaagcucucgugagguuuuaaacuauaaauuccccucuguugugaguuccauugcaggacaguagguguccuuuuaaauguucugugaaguggaguaucucgcagaggaccaccaaggcaugagcuacauuuuaauaggaaguucuuuauggcacucugccuggccaucauuucccagaaguccgauuggcuaaguuuucccacuuggccauccuuugucagguuaaacuuuugcuugaguucuuugauuggugaaggucugacuucaucugcuccacagcaaugauccacacaguacacaugcucaugcaugcacucuugcucauacugguaugaacauacugccacauggcacuucauacacaugcacacaugcaggcauguuuccuguccaccugccuuuuauucauucauuuauucagaagaacugacugaagagguauuguguaugucugccgcuguccuaagcaacaacaugaguaagcgagaguuguccccucuguggacauucccaucagacacugcugagaugagcaagaggcaaucucaggguaguguggauaucggaacacuaggaagggccuugcccaggcuccugccuuccuccuucugggcccaggacuguggaauucaugcugugagugaggacagaaguccuuagugcucagaaucugaaagcugaccaugaguaggaacacccuuggccuuuguccaugcaucucugguaucucugcaugcuggugaccuuuuugcaugccaaucacaaagcaguacagguauuucucuaaggcugacagugagaacugcugcaguuccaugugaauuccuaaucugccaaccuuggcaugguuguaaagcaccguucacuucuucuguucuaggauauuggcagagucacaggcccuccaauauucaauccuguggcgaaugaagucuaccugaacuuugagagcagcacucauugcuuagccgacagauauaugaacuacaccucacucaucacauuucacugcaagagaggagucagcauggugagugcccgcccugucagcuucacuggaacccugcuuugggcagugugcugaaaccacccgagaacaugacuuggggcgugaguaagucugaguuaacauggaugcuuucuguuguucaaagucauggaagcuuugagaguagaaaucauuuauugagcacugauucugaacacauuaaaagguuggguugaaauaucuuuauuuuuuuuuuuauuuuuuuuuuaaaagauuuauuuauuuauuauauguaaguacacuguagcugucuucagacacuccagaagagggcaucagauuucguuauggaugguugugagccaccaugugguugcugggauuugaacucgggaccuucagaagagcagucggcgcucuuaaccacugagccaucucgccagcccccauauuaaaaaaaaaaaaaaaaaaaaucuuuauuuuuuuaaacuauaaggugaucgguuuucugauuagacuuauuuuuagcaugugccaucauucauuacauagcuuuauuaucucucaggaccagaugagcaggugggacuguugucugcuccgaccugcugacaucugggaugcacugagggcuugucauucacagggcagcaguguccugagcagcugacgcucuguccuucucaguguuuuccgucuuuaguagaagcucuuuccccauauggcucaguauggagcucagcagcaaguguacagaguuccuacccaccuggcggcggcggcuguggcuguggcugcugcugcugagugauggagagcuaugcucucauucagaguucauggccuguggcacauguggcugaaauacuuuugcccucauggcauuccuggugucuagauaugcaggaugcagaccugcucuuggauucugcuaugcuugcauuuguacuguguggcagggguguaugucuucgcuauucccaggaaagaauaugguggaucuuguccucacacggugguuuuuaagacuaauguuuuucaccaguugugguggcuuacaccgguagaaugugcugaaggaggcagaggcaggaggaucacgagaucgaggcaaaccugggcuacacauuuuuuaaaaagacucauguuuuucuuggccacagggaacuccuaagcugauaaggaccaaugacugcgacuuuguguuugagugggagacuccgauugucuguccugacgaagugaagacacaggguugugcuguaacagaugagcagcugcucuauagcuucaaccugaccagccuuuccacaagcacuuucaagguaagcuugccuucccauagccuugccagccuccagagggcuaagaugcuuugacacagggcuggacaagaaucaguaaccugugaggcaggcccuggaguucugugacacaaguggauaauaggcagagugacuugaggacaugcauuggaacacacaccucugggccagggcaagauuucuauaguuacugggagccacagaggaucacugaguugccagacuuagcucaagguaaagagaugcggucugccaaccacagagacaagugggagaagcagcaucgugcgagccuuucaugcaugagucugugggcugggggcuuucacugagccuggugagugcugaguucugaaccuuucucagggcuugcugccugcaguucagggauaguuuucuacaugagcgcagugagugaggaaagcgaggcccaugcgcacgugggcugucugcucugcaucccaaaggaagggggaaccugggacucagagcagcagccucaggcuggagaaagcagaugguggcugccugggccaccagggagaaggcaagauagaaaagagacuggcccaggaugacuucugguguucucuggagguggucuuggccaggaaaacagcaggggucaugguccgauucaguacagggaugugaacugugggagccugugcucuggucacagcagucaguagccacacauugccauuuguuguccuugcagguuacucgggaugcccgcacauacaguauaggggugugcacagcagcagcuggcuuaggccaggaaggcugcaaggauggcggugucugucugcucucugggaacaaaggagcuucuuuugggcgccuugcaucgaugcagcuggauuacaggcaccaagaugaagcagucauucugaguuaugugaauggugauccuugcccuccagguaacucuucacaguauggucaaguucaaauuucuuguaaauagauugacuuagcagaaaaauacuugaggaaugaagcuucagaccugugagcacuguacccugccacaucuccuucccugguaugaaugccugugucuggaacaugaugcugucuguugcuugucuguuugggugaauccugucuagcagggcagguacacagcuucuuagggagucuuuggguggcaucuaaggcauggcugauucauugacgcuuguguauaauccaugccucuuuccuuccagaaacggaugauggcgagcccugugucuuccccuucauuuacaaagggaagagcuaugaugaauguguauuagagggacgagcgaaacugugguguagcaaaacugcaaauuaugaucgugaccacgaguggggcuucugcagacagagugaguggguagcugaauuugggggaggggagcagguguuguucuauggguggccaagcuaauuagugauuauuauguaaguuuuguucuuguuggcuaaggaugauguucauggagagccaaauuugagcaccauagcuccuuugcgacuuagggguggaaagagaguggcgugaaggcccacacucuguaguucucuacaugaucgaggacaagcauuugacucaugacuagcuccaagucuucuauggguggcccugaaguuuugagguuguuacagaugcuuggcugauucuuuaaauucuugccauuauuaauguguaggcaaguauugaaugcuuucccaggagggauuuugguguggucugaggaacugaguuuguaaguggauagauuaaggagugagacaaacuguggcuggggcugcacuuggggaaacagccaggaguaauaaagaggugggagaagucaagguuugugccccgcccuaggucugaccuuugcacacuauugcuccccagccaacagcuaccggaugucugcgaucauauuuacgugugaugaaagugaagauauugggagaccacaaguguucagugaagaucgugggugugaggugacauuugaguggaagacaaaaguugucugcccuccaaagaagauggagugcaaguuuguucagaagcauaagaccuaugacuugcgacugcucucaucccucacgggguccugggacuuugugcaugaaggaaacucgugaguaugccacacugccuguggucccucaaguuuucaaagucaggaauaucacauagcugugggguuugaggcuuucauugagacacagccuagauugucaguguauggggaguucuggugagcacccacagagaccggagcccugacaguugcucagguuugagggcaggauagguuuucuaagacuuuugccagcucuuuuagcacugccuuugcuuuuugaacuaauuacccugacuguuccauguggggagugccugcugugccagggacccugagccucacagggucugcugcaaaucagggcugcuaugaauugggggacuuaggugagugccugcuaucccuccauagccuuuucuccugucuguacugugucagggaugcauggggacaugccacuacaugugagcccguugagucagcuacucuguauggcugcuucacucuccguuucuucugcacccccaaggcuaucagggagucaguuaccuuccaagguaguguggaguccacaggucuguccaguguacucgaaguagaacuuucauuugcccuuuuuacaccccuuugugucauucuguagguacuuuaucaaucugugccaaagaguauacaaagguccccuggacugcucugaaagagccagcauuugcaagaagagugccacuggucaaguccagguuuuggggcuuguucauacacaaaaauuggaagucauagguaaggcucugggguguuuguacuugacucaguugcugcaucaagauuggcaaggugaggcugucccuggugugauggagaaagugccugagcuuugguggaaacccggugacuaguugaagcauuucuacccccuuccuggaacaugaaguccaugcuguuuugauacucugaggcacagggagccuguucaaagcaccuucgcugaucauguuccggaugcacauuggcuucucaauguacaucuacacacaucuaaaaaagcuauggucacacagggcgcuguacagauggcuccguguucccuugagcucuuggcuaggaaucaugacacgaucaucaagggaaggaagggaucggcuguuagaggacaggcacauuuucccaacuaagggagcacacaaggaccaggcuguguuggggguuagacauucuacucugccucuaaggcuagaguaggaucccgauugcgcuguuugaacuacaaggugacauggauauugaaauggagaggggauucugagggaauucccauggccuuuaauaacaaacucaaucaagaaaguggccucccuuugagaauuaaaaucucaacacaugaaccagcugggcaaacucacaucuuaggaauucucuauucccgaaguuccugacuacuguagagcuggaugcuagucauauagguguggccauggaggcuuagcauucauuccugaggauccaggaagcucauggucuugcugcuuccuuacuuauggugguauggguugaguguaugggccaguaacugccauugaguauggagggcaccuuuagacagccggcacuugccuuugcaguagauuuuuaagccccgauauuguucugcagugcacuagaaauaaugccaacucauugucucauguuucagaugaaacggucauuguuacuuacucgaaaggcuauccuuguggugggaauaagacugcaucgucuguaaucgaauugaccugugcgaagacugugggcaggccugcauucaagaggugagccacaggcgagcacacugugcucucugccucccccauuuccacgugggaguugggaaugugcacacagaggagagggugucugggacuggcacuguguguggcagaaaugcccacugagacugaggccuuagaggacagauugucucccacaggagguaccccuacuccaucugagggcuaaggccaccucagcuuuuuuagccugguuugccuuaagaaacauacuccugaaucagcuuuggaggugcugacgcuagccugagcagugcagaucuggcugcugccccucaucaugggagaauuaagggggugcugauugcaccaccaacaagcagguucuggguguugcaggcaguuguugggugauguuagagggauuguggccaacagggggagcaugugaacugcuguuuuggaaacugcuuugaaagggucuuuaauuucugagacuaagagacuauuuguacaagucucgguucagagcuuccagcuucauaugcuaaggcauuuuuauugaguuugguuuuucucuguggggauggggguugaaccuagggcuucgagcaaaccaggcaggugcugugcucuugagcgguaguuccagcugucuuguuguuugacacaggaugacacuaacguguccagguuggccuuggauuuguucuguaacugugacaggaacuugccaccuuuuaccucugucucaguggcuggagucacagguuugugucccuagggugagcaggcacugcauccucgucugcuucccacguugcuaauguuauccucguacugugcugaagcauagugaccaggacagucguccuggcccagagcugucacucacacaguccccguggggaccaacagcgguggcucccaaggacccuuaagaacccgggcgacugccucuugcaggccucuccagcuauguguguggcagccuugcuguguguggccccgagguaaccgugucugcucccucucagguuugacagugucagcugcaccuacuacuuuuacugguacucacgggcugccugcgcggugaggccucaggaggugaccauggugaacggaacgcucaccaacccugugaccggcaagagcuucagccucggcgagauuuauuuuaaguaaguggaagccugccuguuuggcugacacacacuccgagggaacaagaccguaagucuugcccuguaggcaugcugccagguaggcagucuaggcuucagugacaguugggaagugaccaaguuuggcuuacaccaagcaaaaggacugcuucuuugucauuugacacucaguggugaauuucuuauaaaaagcaguuucccucugcccuuacugcuggagccaagagucucgggacacagagagaacaaggaacucugggcugaccagcauguuagcuaaaaguaagguccaucucuuagcggugucacgggcugucuuggggcaagugcacugcaugugcuguccgcagugugugagauagugcagucauuccaggaggcggggcugggcaggccgauguagcguuaacggcaaggaguguuagagaagggcuggagcaugcagaggaaggaguaugaccgcugugcucuccucugccucaggcucuucagcgccucuggagacaugaggaccaauggggacaacuaccuguaugaaauccagcucuccuccaucaccagcucuucuuacccugcaugcgcuggugccaacaucugccaggugaagcccaaugaccagcauuucagcaggaaaguaggcaccucugacaugaccaaguacuacguccaagguaacucgcaguuuccuguuagugguuccggguacagcuuuucacagggagagcuucccgugcucauccacacacccacggcauggcugucucacacacccacggcauggcggucucacacacccacggcauggcggucucacacacccacggcauggcugucucacacacccacggcauggcugucucacacacccacgcauggugagcucacacacccauggcgugacaagcucacacacccacagcauggcggucucacacacccauggcguggcgagcucagacacccauggcgugguggccucacacacccacggcauggcgaucucagaccuaugucagcucccuuuacgagcuggcgcuacucugaugggccaaggcaggagacgucacagggcacacucacugcggccuggcguuaacaugcuacauccuccuucagaaacggcaaggaguguuagagaagggcaagagggagcuggucaguggggaagggcccucccggcugccaagcccgaagaccugagcuucacuccugagacccacacgauagagggacacacacacgugcaugcgcacacacacgcauacgggcgcgcacacacaugcacaguggaggaauccuggcaagcucagugagaugggugugggaagguuguagauggcaccaggcauucuugugcucuugugacuauguuccuggcaggucacauguguaucuguauuuuaaauaacuuaccauucaccauauaauucuuguaauuuguuuuuuugaacuguguggcccuaugaacuuuuaaaauagcauuuugagaugaucaagagaacauggacugauaagagugagguuagaucaggguccauuuauacaccaaguacuagcucgguggauuuccacuucagucccauuuggaaaugugauugaacacucuuggaauuaacugaaaacugcugucuugaugcaugcaguugaucacaguagauguuuaguagaugguagucacucaugacaagaugcucauggaagggguggggucauguacagcucuuccucuggccucuugcugggcugcaaccacuguggggacacagugaggugugagccucuccuguggaccgaggcugugcugcagccacccccauagugaggugugaggcccugcauguauugcuggccagcugaguuuguucgcugagccucacaacuuaggaccuugcugaauuuaagugucuaggcacaauugguugguguccugguggucagucuugcucuccagguagaaugagaccuccuggccagccaccauaaauuguccuagcagccaaugagguuaaagucgucccuugcuuagggugcuguguaaagcugugaaggcagagugcacacaugggccuuugcggguuugcaccuuuaacauuaagccugugccagcuuugacagaccauugaagcauccucuuggugggugcuaauagugcuugcugucuccuuuccugugugacagauggagaucuggaugugguguuuaccucuuccuccaagugugggaaagauaagaccaagucuguuucuuccaccaucuucuuccacugugacccucuggugaaggaugggaucccagaguucagccacgagaccgcugacugccaguaccuguucuccugguacacuucagcuguguguccucuggggugagugugaugcccaugucccucucacaugacuguucaggaguaagcaugugugugucuccuagguagaacacuggggagguugugggugugcccacaagauuggcuugcugcuaucuggucuguggcaugguuaccauugcucuuugucccagguagcauugacugugcuucccucagcuguuggggagcagggcuggcuguacccccuucagcauucucugugugcucuagugugcacuugacauggcgaagccaaugagaagcucccucugaaugccugucgaguguacuccagaggcuggguuugguggguagcaaggggagugcacuucuguucugagaccuccaggccagagaggaggaaacugguggucuuguguccagggccauauuacaugugaaaacuaaaacccauuuauuuauaaguaauccuaaguuucaaugagaaaucaaagguagaauuugaagaaauuuuaaagucaaccugucauagauauccccucuacccagaagcccugggguuagguccuaaggugacccaguauaggagaagcccuacuuuugccuggcccagaggguuuugcagggcugggcagacccaaaagaaaugauguccuuggcugguccacgucuucagcuccugguauuuauuuccugaucccuaaagcaguaccaucugcagucggccuguuccugacugcuuuaagugaagucuccaggcauuccacauguuguuuucuaugucugguggauggcguguccuggggggccuggcucagcuggcauugguucaguaggcagguccuggucccugggcuccugggagagcuguucgacacaguuccugacaaagcucccucuccucccgugugauuucuuucuaguguggacuuugaggaugagagcgcagggccagaguauaaaggacucucagagcggagucaggcuguuggggcaguccucagucuucuccugguggcgcugacuggcugcuugcuggccuuacugcugcauaagaaggagagaagguaaggugggcagcacaguaggaggacuggguggggcaaguagcacauugaugcuuggacacaggcuuggguuuugagccugacacagcaagcaucuagauugagaauuccaggaguggggcucaugcagagcaguggguguauuucugugggaggggccagugucagaguaggcugggcacaugcacaguguguuccuacugccagccuugggaagcuuaaggugcagcaagacucauucaucugccucgugcugggcccugugguucuguuugugggacacagcccuuaggaguugcacagacucgacucagggccagcuagcugggucccuugucccugcucauucugcuguggacuuacugugcucuccauuuugacagggaaacugugauaaacaagcugaccagcugcugcagaagaagcucgggcguguccuacaaguacucaaagguacuguccgcugagucgggcagcugcuggcugagggcugccccgugcugccucagccuguucugcaugcugggaaggaagaguguguugguggcuuggcauuggaaagaaaccucucacccugacaccacuucuguggacuuucugccuucaaguuucucacagcacaguuccuuuagaugaccugauaucagucuguucccaggcuuuggaggauuuuuuuuuuuuuaaggggaaaaaaaaagccauagugcuggaauuucuguacuccuggcauuuggguaauuucagauaaacuuugauaaacauugaaaagaggccggucagaggauucagaugugcugcuaguuuucauacacaccgccaaaucacuucuuaagcuaaguugaggcugggaagauggcaugguugguaagcgcuugaaaaggaccagaguucaauccucuaggacucaaauaacaacaaaaaccacaugcuagaagcccagcagguagggaauucaaaacggguggggcucugggccuguguggcagccagccagccucgccugcuuggugagcucuaggacagugugagugagaccuucucucaaaaccaaagcaaagcagaaggaccaagguggauagacacccaagccucuccuaugugugcacacuuaagugaaccugcacacauuuggaauacacauagauaaauacaauuuaaaagcuaaaugcccugauauaagcccuuccugugucuucuccuacacacuggacgcccagucccuagauacaguggcccaggagagucccucucugccagcacugcucaacagucaugagcccugucagguccugucugccuggccagcucauuuggcuaugaggcucuugccacaggcucuacuuugcagguucucaucucauaccccagagagaggcccugggguggccuguaucaggagagcucuccugcagcagacaggucucuuugcugagucucauggucucugcuucuguucccuguuaggucagcaaggaggaggagacagaugagaaugagacagaauggcugauggaagagauccaggugccagccccaagacuaggcaaggacgggcaagaaaauggccauaucaccaccaaggcggugaaagcagaagcucucucgucccugcauggggacgaccaggacagugaggaugagguccugaccguuccagaggugaaaguucacucaggccgaggagcggagguggaaagcucacagccccugagaaacccacagcgcaagguccugaaggaaagggagggugagaggcuggggcugguccgaggugagaaggccagaaaagggaaguucagacccggacagcgcaagccaacagccccugccaagcugguguccuuccaugaugacagcgacgaagaccucuuacacaucuaacuccguggugccuacagaagaagguggagccauggacagccaagcaccuccaaccaaauaagacuucagcucgaugaugcgucugucauuuugccuuuaacaaaacugcuucaaagggaagaguuucuguaaugggggagaggaugggggaggugggcaccacuccuucaugaucguuuacagucaauggaacaagguguugcuugaaucggccaaagggcgguacuucgugcccagggguuugccccaaguccucacuuacgaucauagcugcugugugcuuccaacaggugcccaagccacaugcaucucacaacagagggcuguguuugaaaaaaacccuugcugcuuuagacccuacggggugaccauuuauauuuuuagcauuguaauucucuccccuauuuauugacuuugacaauuacuacucagguuugcgaaaaaggaaaaacaaaaacaaaaacaaaaccaguuucuuuugccagcaagggcauaaggugaagcuggccgucugccggagccguuguccauggcuccugaacugguccuugaugcacacuuagugagcugcaguauucuauucuucgcuuugcauuuugugagggcacacacacaugcacagguccccgagugccuagguuugggaaggcccaccugcuccgugcccuaccucaucucuguaguugcagcucuuugcacgaaucccucuggguguugcucuugccagcuggugacucccagcagcucacccaggcgggcguucgcgcacacgguggaguggaggcucuuggggaggagcugcgcuucagguuugagcuguaggucucaucucuucagggucucauagugccaccuuuacugugcuuuuugcuuuuuuuuuuuuuuuuuuuaagggggaaaauguuuaucacccauucgaccuauaagaagccuuaauuugcacagggugacuuauuacagacaccgugaaacgcggugggccaguguugguguagggccaguguugguguaggggcugugcuagggcagugucccaggauggaagggcaggcccaguccacuggcuguggauucuuuucuugauguguucagugacuugucacauuauagaguuguauauagguggcauuuacauacccaaaagcaaaguaccccgcagaauuucuugguuuaugccugauuuugcuagcuuauuugauuucacauugaguguauuuuuaaaaauugauuuuucucuucauuuuuaaucaacuugacuguaauaugaaguauucaauuucaauaaagauaaauuauuaacuagguguaagugacucaccccacccccaaccccccugauuaugauaacuucugagcuaguggccacccugaaugccuggcuuuuccuucuguuuaccuuucagaaggcauucgcauuugguuuuuuaccacaguguccuguaaagcuacuccuccccuuuccuggaguugucuaagucugucuucagcugucccuggaucucagggcuacacucucccuaugugagccucugcugcucugcucuucccgucugccaaagcaaaacugccauucauuucuagugaccagaaaggcccaagugaaugcaucaagugaaugcauggcuugcuugccaccuuagcucgccgagcguugacuuggaagcagaaagcucccacaagucacuguuugcugccuguggcuucuguugaccaguuaaagauaacagacaggauucaugugugccacuccacaugccuagggugugaauugucuguguccaguaugugugugcucuguacacagccaacccaccuuguagucaguagucacgugagcucugcuguggugcuuauauacaaacuguccccccgcugucccccgcaacccccccccccccgacacacacacucuuugagacaauaacuugccuaguggagccuagaacuugcucuuguucuauagccacagaugaccugcugcugccuuuggaaguucaucugagugcugggauuauacacguauguuaccaugcccaugucuugugguauuuuaguaugaggcaagcucuggcauucucuccaggggcuauucuuccagccauacucccuguccauacagagccagcauuugcagagguccauugccacuugguaagcccaguggcagaguaagguucuggcuccugcccugagggcuuagcucuggcccuuaguaggaaagaggggaugcuaagagguauggaugcuuugguccugacuccuccagccucuugagaauauagaccagugacccuuggcagcugaugguacaggaucuuuuagccaaaccugccugacagcaaauaggaaaaaccagaaucuuuugcuguuuuguuuuuguuuuuacuuuuucuuuuagcaagguuuucugugcuuccccuuuugaguguugaaugcugagauggaauggguggagggcaaaggaaaucaugggacauuguaaagcaccugaaagucccaguuucccacuaaacagcacuacccagccaagcccuuacuuaggaagggcugcacccagccuguuagaauaucugcagauaauggucaagaacccauagcuuauuguucccuucugcccccauaggaaucacugcccccagagccugucaggaagguggcauagaggacacagacuucuagaaauccuauuucagcuucggaggggcacuggaucuuaggcugcccaugcccuuuguuguguggaucuugucugggcuccaugcugacccuacucuggccaagcuucuuguagguuccagauccaguucugucagagcaagaagacauaagucauuugauuccagggagcaggcaaggcacagagucacagugcucacacugaugugaagagaauagagcugccuuugcacauagcccgcagagggccaagcagcugcugaaccagucuuggcagaaguuaaguuucagaagcugccuacuguggaaggggaaaguagaugauagagccagugauaacucaauguaggaggaaagagaugcugggcccucgccucuggucuguggucauacaggcaaugugaucacacaggauaaaggaugccuucucaguuucaucccugacucccaucccugggcaccugagccugucauuccuacagaucaggacccucucuaugacuacagugccacacccaaugugagcgugggcacaucacacugcaagcacuaaagccaggguccugcugggggugaagaguuuuggcccuuggcgcaguaaaggaguugagugaaucagugcucacugcugcacccggaugccuucucucucuugaguugcccuaguguggaaaguucuuaaacucuuagguucuugucccaugagauccccuccauacccugcuuagguuccaucuacccagcacacaccuuaaagccagacauccaccuguagucccauugccagaaggcacugcaaaaggauccuuggggcuugcagcugugccagucugaggucacugagacacccaccuucccugucuggcuaagagugacagaagacacgcaccauugaccucuggucuccacgugugcauguguggaaaaacacacuugcacacacggguucaacaaacuguagaaacaauguguggugaugcauauuugucaucgagcacuuagcugaacaagguucagaaguucuaagucaaccucaguugcauuuauagcaagucugucuugguuaggguuuuauugcugugaagagacacaugaccaaggcaacucguauaaggaaaacaacuaauuggggcuggcuuacaguuucagagguuuaguccauuaucauggugggaaagcauggcagugugcaggcagacauggugcuggagaaggagcugagaguucuguaucuugauucaaaggcaaccaggagagacugaaucucuccugcaggcagccaggaggagguucucuuaaagucuaccccuacaaugacacacuuuguccaacaagacugcaccuauccaacagggccacaccuccuaauagugccauuucccaugggccaagcguauucaaaucaccacagucuggauuacauuagguuaucucaaaacagcagcggcaacaacaaagccauacaaggaaaugacaggacaaaaggaaacugcuccaaugguagcgccucacacugggaaccacuggguucaccagaaagccugguucagcuuuccuguugagucauggcugauuuuuuucccuuuaguguguauguuccccaaacccuaccucaguucugcaggacugggucagccccauuuuacagauggccuaugggaaggucaccaggauuuuugggucacacauagagcacccugggaaucuaguacuuuauaagacccaggcuuacccucaaaccuggcuucucccuuuuaagaugagcccagcuucuauucuuguuccuguaguuacuucaaccccugacccuaacaccccuacccaaccuacauucccauuccucccuuggcuccaggagguaccagcacccgggggccacuuuccaacaguggggaagguacccacauggaauuugugucuauuggacauuagaugaguugagcugaugcauaggaaguuuuggaaaaugggucacugguaaauggguagugugcgaauuacugagacaugacucggggcaggcgacuugugaucuuuguauauauauagcgaaacacugcagaccagucaugucuaaaggaagcagguuacuuugggcucacaguagaggcugaaaaguccaagaauauggagccaguauggucccaugaugcucacucaugccagaaauaagggccaaugggaacacaugaaagagaggggcaaaggguacuggaugcuacuuaguagcuuguccuuguaacuaaaccugugucuugggaauaaccuuaaucuaagggucccaaaugacccucucacaggugcaccuaacacaauuggaaacauuuacauuaugauucauaacaguagcaagguuacaguuaugaaguagcaauaacaauaauuuuaugguuggggggucagcacaaugugagggacuguaaagaggcacagcauuaggaagguugugaucacugccuuaaucccuucaugaggguggaacagcauuacccaguaucucuuaaaggucuugccaugccucaauaccauuccauuaacaguuaaauuucaaccugagauuuggcagaaaaacacauccagacuguaucaucagcccuucuggcuuuggguucucaccuacacuguggaguuaaccugggaauucaucagagcauggcucccucucaggaaggagucuugcaauuuaaauugccugggauaucuggccauuugcauguggacuggaaccauagaccuggguaaagauaaagggaaccacauaggcuaagaaagacucucccuccauggucucuguccaaacaaaagaaagaaggccugagcauaguuccucucuaggccagggcagcuauauucugcauggauaagucagaggugggcuuagggcccuguguggugggaggggaugugaggacagugaggggugcugauuucuauucuugucuucuaguguguguucaaagugggaccuuugcaccuuagcuagucugcagacauacacaugacacuucucagggaaguguauauuuugggggcucaaaaaggacaaguauccugcucagaguuaauccauugacugcucuuugggguggggcuuugccuauuuccuccuucuguccuccucacccuaucccucaugccuaccuuccuacuuuucugccuuucuccauucuuccaggauauguucagcccuuccagcagagccccauaggcugagcucuuaugaagaagaagaaagcuggcagagagagcggagcuuugacacagccucaugagaaguauguuuugaguaggccagcuuguagacaccugagcaggaggggaccaacucugaguuccuuggagcaaggaaucuuagaaacacagggacucauaagucuguggggcuguguucauguguaggcugugugacuuuucuuuuagugugauaaaauacugugacugaaaccagacuaaggaagguuauuuuggcuuauggaugcaaagggauggaguucuucaugacacagaaaccauaggggcaggaacaugaagcuggcugaucacacacacacacacacacacacacacacacagagagagagagagagagagagagagagagagagagagagagagaacaaagcaagcaugugcaaacacacaggaagugggguaagauuaauguguucucucucaacccccucucccuuucccuccccccuucuccccuccccaucucagcuccaccuccuaaaguuuccauaacuuccccaaacagaaucaacaacaaggaaccaaguguuuaaauacaugcccuauggaagauauuucuccuuuaagacacauuuagccuccaucacccagggauuuguggucaugucauaaugcaaaauacuuacaauccaacuucaaaaguccacauagucauuaauaaucucaacaccuuaaaaguccaaagucuuuggugacacuuaaggcaauuuuuaaauauugauccccuauaaaagaaacaaaacaacaacaaaucauauacuuccaauauacaguggcaugaauauacauggauauacacuggggaagaauggggcauaguaaggaaagauuagaccaaagcuaaaaacaaacaacuaugccaggaccauaggaugaccgagaacagccacagugguggagccagcuggagcugugugugcggcagaggguagggccaaagaauugacccaaauccuuuggaagaguccagaagaucgugaguggauuccagacauuugacacuggguuauuuacagguggaguuugauuuugauuuguuuagauuguuucugugcccuggcucuucccucuugaaguaaaaaaguauuuaacuaauuuuuuuuuauuguauuggagucuacaguugagagacauuugauuuuuaaaagagacuggauauuuuaaaagaggaugaauuucuaagugcuugaaccuuuaaagacuaugggaugagccuaacggcaaggcuuguuuaaagggagaugaggugcugagcugacccgaaggcuggcaggauucaguuccuuugguugagggcugagggucucaguugcucacuggucauugucuauguucccucagcccuuaccucuuugcugcgugggcuucucagcuaggccgcuaggcuucauugggcccacaaaggaaagagaguacuagaagguggaauagccaaucugugugggggugaccacagagguaccauccuugggauuugccauuugguccugcucaaggcuaccuaacgguggccugccaucccugaaaaaugauggucaugaguaucuuaguuaguuuuugagacaagaucucacguagcacaggcugaucccaaacgugccugcugggauuacagguaugaacuaccaugucuaguuugugugcuguuggggauugaacccagagcuucguacaugccaagcaagcuguccuaccuagcccgcagaaguaauagaauugcucuucagaagguccugagagauuuugugugugugugugugucugugugugugugucugugugugugugucugugugugugugugugugugugugugugugugugacuaugcacacucaagccuguuugccugcuuccuccugccaggccagagccuuggcucacuucccagaagagcaaacaagucuucagguaagccucguguaucccugcccuggcucucacacugguaucgcgggguaaaagguuguuucugguugguugccuuccagauguaucaggcuugaacagcaacuugauuucaagccaccgcaguuccaagaacuuuaaaugagacgcugcacgaacccccaguggcaguccagagcaggccuggcugaguuggugagggcccuacccagccaugcccaccguggacgauguccuggagcacguuggagaguuuggcugguuccagaagcaagccuuccuguugcuaugccugaucucagcuucuuuagcucccaucuacgugggcaucguuuuccugggcuucacccccgaccaccacugccggaguccuggaguggccgagcugagccagcgguguggcuggagcccggcagaggagcugaacuacaccgugccgggccuggggucugcgggugaggccuccuuccucagccaaugcaugaaguaugagguggacuggaaccagagcacccuugacuguguggacccacuguccagccuggcugccaacaggagccacuugccacugagccccugcgagcauggcuggguguacgacacucccggcuccuccaucgucacugagguacuaauggguaauguacacauugaaagcaaaucagugucuuucugaggcaggaaggagaggcccaacuuccuguaugcugagagggagcgggcugugcccuggcccucuguguucgucucaccaauugaugacacugaggcauagcugcuaugugggucccugguugauuuguuuuuuuuaagaauauuuuacauuuaauuauaaguauauauguauguauaugcauguggguauguacaugucauaguguguauacgugugcacguguguguguggguuuaucauggucauaaaacagcguguaguucucuccuuccacccugugggucccagggacuaaacucuggucaucagauuuggcagcaggcaccuuguccuucugagcgucucacuggcucagagcaucacuuucuguccuugacccaucccagaaucuacagucuucccugugccugcuucccugugguuggugcuguggaauccccucaucuccucaggugguaacagguggccuaaacccuggccagagagauaguaugggaauugccucagcuugccccaucagacuaugugacaccagccaggccuccuaucagcuggauagaucuggguaagugccucaguuucucugagccuugacuucucuguagcaggccguaucacaauaucuccacccccuguguuguaaggaucaguugaaaaccaggaagaugauccucaaacguaaacacaauuacacuguugauggccuggaggugccgugaggauauccaaggggauugaccccaccauuauguuaccuauuugugcacuuggcuuugagagucuuuguuuguuuguucguuuguuuuuguuuuuguuuuuguuuuuguuuuuguuuugagacacuguguagcccccauuggccuggacucucuuuguugaucaggcugggcaugaauuuacagagauccucugccucccagacugcuugggauuaaagauuuugccaccauacccagagagggagggagggagggagggagggaggggcaguuuaguagaaaguggcaguagauguuuauccccuucauggacucuucugacagugugggagguuugucccauggacaagcaucaggcccaggcucagaagcuaugcuagaaauaucucggcuguggccagggcacagcucacgugggccaugguccucccccagccagcccugcccccacacaugcacauagaguuucuuaggaucccuuccuucuuucuucccuuuuccuuaaagguuuuaacgucaauacaggcagggcugccucugggaggaagcccagugucucuucccccuggccugcuucugguuaccuacagaaugagugcuagacaccucgauuuauaagauaucccaucucagacuucuuccaaugacagacaccaaguuaagauggcuuaccuggcagggaugcuuugcugggagaucuagcagccgaccaaaacugucuccuugguccugguauacccuuuguuuggcugggcucagacgagucucaaguucacuauguaggaaaagagggccuuggccuuuugagccuccugccucuacuuccugagugcuuggauuacauguguuuauguaccauugcacaguuuaugcuguccugggacuagaacccagggccucauguaugcuaggcaaaugcucuaccaacugaguuauauuucccaggcccaccugagcucuuucuuagcugccuugucaucucccaucucuugugaagccuucaaaccuaucacuaaccugauucagagccacccaccaggcuuagaugggacuguuccucuaguuaaacaaggccacuuacacugggcagcaggguagaguugcugugaaauaaagcaugcccaguugaaguugagauaaacaacaacucuuucuauguagcacaggcuggccucaaacucacaaugacccuucuugccucagccucccaaguacugggaauuaagguaugaacuaccauaccugaauaacaucucuuuauauauaaaugauauuauauauauaauguauauuaucauauuauauaauuguauauuauauuauguaaauacaaauauucaagggauguaguauaauaauuauuuuucaauaaaauuauguaauaaaauuauauuauauauuauguaacuuaaaaauccuaugugauauuuguauuuccaacaucaguuaucagaagaaaauaucauauacuaucugcaaccucauuguucauuagcucagucugggugauaugagauucuaucuuaaaaaacaaaacaaaacaaaaaacccacaaagagauaaaaaaguaaagugauuugagaaacagcauucaacacagauguuguaggacccaacauaggauguaagaggcccaggugggguuuaugggucaugucuaauugaaggguucuggcuuaggggagugagauaggaagcuggggagccagggauugaggaaggaggaaguagacaucugggcgagugucgagguggugcccuguaagguugggguagaggggaggggagagacugaaaauggcagaaagugucuuaggaagaauugacuguucacacauggggaggcucgagcuuggugacuauguuggcuuuuguaguggcacauggagggacagugggggccuggcuuuggaagaaagaaagaacauugugccgggcugaguuugaaagccagugugguauccaucuggaagcauucaaggguaauaagaagcacagaugugagggcugggaaagggcgcauuuggugaaguacuguacugugcaaucaagagacccagugucuac

SEQ ID NO: 44 - RNA, 23699 nt, Mus musculus
ugguggugugaaugaaaaugguucugucggcucauagguguggccuuguuggagugggugugguuggcguuacugaggaacugugucacugggccugggcuuugaggucuuagaagcucaagccaggccuagugugucucuuuucuauuuguugcuuucugaucaaaugucagacucugagcuaccucuccagcaccacgucugccugccugccugccugcuugccugccugcuacuguguuucccauugugacaauacuggacuaaaccucugaacuguaaguaagccagccucaauuaaacguuuuccucuaagaguugcuauggucaugguguuucuucacagcaauaaaacaauaagacacaguaagacaauguucuuaacugcugagccaucuuuucagccucuaaaaauuucuugacauuaacuugugggcaucuuuaucaaaggcuugucaaugcagaagcucuaguauucugauucauauauuguggacaccuuuuuucuauuuuauuuaauacucacuugcugaccucuaauuuuccuguguuuaguuuaauugaaagcuuaaaucuuuaaaauuaauuuacauuauaucaaggcaugucuuuggauucuggaaaaagagcuacuuaagagugccuggugcagaggaugugggcuuggugcccaguauucauaacaggcaaagucaacccauggauauauaauuccaggcccagaggauccuggguguaccugcacauacauagacacucaggcaugcacacauccacaugaaauaguaaaauguaaaaaccaguuaaagccauaugucuuccccugagcgccacagcagucugacagucuuuaagcucuccguuuccauuuucuaguuuuaaccuuccugggccuacugagauguauaguccuccggaagcugugcuuuaaacguagguugggguccccaaagcuucauuguugacauuuaaaucccugucaugaggaauuaacagguagauguuuaaucccguauugguguugagagguaaggccucuugggaggggauuuggauuacgugguacuuuaggguggggccugugaccgagucccagagacuuuauaggaggagggggaccacacacaccaccugggcgcaugcauauucccauaccuugacgagugacacuacauguacugaaaacuacaaucgccugugucacccugaccucagaccuucaagaacugggagccauaauauggccugcuccagucauuucuuuauggcaaaaugugcugauaaagcaagaaacgacuuuuaggggguuuauuuaucuuuuccacuguggccagugaauggaauuucccuuguggccugccaccuagucaguuggaagagccauguauguuuggaagaaauggucucuauuugggucagaguuauuaauugugcugcccagcugccucugcccugaguuauuccugucccacuugaguuuugucuuguuuacuuuuuguucauggcucuggguuuggauggggugugccuaugggcuuugcaacuucccuugauauagacccacagcuuugugguuguuuuguuuuguuuuguuuuguuuuguuuuucuuuguaggaaaaaaaggguuucucuguguuucccuggcuguccuggaacuuugaucaccaggcuggcuucagacucacagaaaucugccugcuucuccccccaaccccuaccauccccaggacugcucagcuauuuguuuuuuugagauaugguuucacuacauagccaaugcugugcuugaacucagaauuguucuacuuuagcccccagaugcugggauuacaaucaagcaguaccaugccuggcuugcccaacuuuuauuuuuugucuugggcccauuucuguugguuguugucuuguguucauguugcccucagcuggcggcucuugauugugcucauuuuggacaucugucguccuugcagcugcucagggcagggcugggaacauuuguuggaacuuggcuauaaauugucuugggggagaugaggaaugggcgggacaugccagagacuggucuuuccuuauucuccugugggucaccuaccucgugcugcuguuccugccaggaggcagcuguuggcuccucuugauaguuggcagagcguugugugcugccuguuggcaggccguguaaguccuaucugagacagcuggaugacgaagcuggugucagaucaccuuugggucuuugucccucccccacacagcugccuuacuuuuugagacuggcucucuggccccagacuugugauccuccugucuuaguguccugagugcuaggaauguggggcguacaggaguaccaccaugcuccacuggaagccacuguuggaagucaccgucuuuuugucaccccuuagugccccaagaguuucugccucagugagugagugcuugcucaugagguuuaagaaaggguucuacuuucugaaaguauuugaagcuguggguuugugggucacuagucccaccucacacucaguucugagauacugagcuagcagauugcaagacuuuuuccuagcaccagaacuugugggcacaauagguguggggugugggcaggugccagugccggugcccccuauugggcugggucccguucguuuuugcuuuauucuauuuccuggaaguagaaagaggcagugguguguguguguguguguguguguguguguguguauguauguauguguguguaugcgcgcucgcgugugcaugcauauaugucuagagaucagcguagccugccucugucucccaagggcuggaacuaaaggcaugagccaccaagcccuguguuguuuguguauaguggaggcagcacccuagagguugggaaugucugcuguacauauagccccaagagguuagugggaaaauguuuggucacuucaccuugcucuaaaacuggaagucggcuauugcugacaagauuuugaggugccaaagauugugucauguccuauuuuggacucugacagacccacugcuacacacacagucauuacaguggaggaaaaucccguuguccuguucccucgggugugaaacaucagaucagccacugaccuuuagcaguuuucccuugcucaguuagugcuggagggcaaguucccuggggccuuacugauuccugcaggcauuugugacuacugauuguagcugugucuuaaguguaggaaacaccaagcgaugugcuaacaggccuggcuagcauuuuaaaaacagaugugaccagugaagaguggccugcaagguaaguuucaaagguggucuuuuagguugagucuuuagguuugugcugccacauggccacugagcuuugaccaaauguaagauuguucuaauuccagcucuucccuucucuuuuggggcaauaccagggauugaaguuagggccuugguauauagguggcaagcacucugagcuguaucuccaaucuguauguauguauguauguauguauguauauauguauguauuuauugaaaacuuugagacagggucucccugaguuaccauaagacaacucuugagcuugugaucuuccugacuuagccuccauugcaauugguuuuaccaaucuaugcuaacaggccuggcugucagcugcacauuuuaaagcagauguuuaguguggaaaaacucccuacuccuccgccuggccugcaaauagaacagccaccaaaccagaaaugacccagaagagggcuucuuagaagugacaagggcagugcccacugagucaucacugcuccuccggcucccuccugucaccucgccagcucacacgcgcuacucucuacucccaagugaaagccaccaucuguuccuguaucuggucuuuuagaggaaguguggugagccaguggugucaugaggcuuggcaucccuuaauaaugagagagaggauugaggagcuuuugggaauaaacaaggguguggguccaaaagggcucaccaugccuaggcucuucuguaaggugcgaaucuaaagggggccuggaaggaaaugagggguauguguguuacuguauguaauggggaagagucuuugcaggaucuaagugugccuguuugagaccaaagggucaaugugguugaaguggggugggugguggaggggguauggacagggacuggacaggaugggguggggcggggcggggcggggcaggacgggaugggaugggacgggacaggagagaugucaagaguuagcuggggcuggaucccagacgcgaccauauugacuuuggagcuauuggaaaucagcuccaaaauuggaaugaagcacaauggcucauaucgauaaucauuuggcagcugaggcaaguggaugagccugaacuuaaaggagacugaaaaacgacaaaauaaaaaaugcccgaaaguucugauuucuuugcuuuugugcagagggcuucuuaucguucagguacugaaguuggugacaguucugcagccagaaugcagugggaagugguccgugcugggagcagagggcauggcaaggcucuuccugcuguguuuggucacuuggugaucugggacugccugccaaguuacacccacgcucuaguuucaagucuccaaaauggggagguuggugugcuccuugacagacggugaggacuaagugauuauguucagaagccguggauggcaugccccaggugugucacuguuucuaagugaggugcagcugugcugcacaggauugggccuugggagguucucuuugcccaguggaguuucuugcugagccccugguaugaucccaguacuugcagagcaggacucuuuagacaugucauauggugguccagguuggccuugaacucaaaguaguccuucugccacaggcuaccagccugggauugcaaguacaaguccuggucugccuacgugguuuuugugaagaaauagcauguguagccucugauaaccuuauuaacaucacaaaccaacaagcugagcugacuguucagcaguuaaaaugccagcccucccuguguccagggccauaaaggaagcacauuggguccccaaagaauuggggccuugcuagcaagaaguuuugagugggucccugugcuagcauugccuuccugcauccucacagcagagccugugccacacacuggcuucucccuuuccuucuuugggacagucuccuguugcucagguuggcauugaacuuaguggucaagggcgacccuuaacauuuggcucuuuuguccccaccugguucuagcuucaugucacugcuccugguuuauacugugcugggcaguauugaacccagggcuucuggcauggcacucaugcacucccagagcucuucuguggagcuaggauucugugcacuggguuccagcacacagcuuugguuuuuuuuuuuuuuuuuuaauuuuugguacuaaaaaugaacuuaggccgacacacauugagggaaaugcccagccguugaacuuuaaugcagcccucuuucuuucuuaaguuaagaauaaagcaagagagcauccagaucauuacuguuuacgaugagaaacuaaccuuagucuuagauaaaugcaccaguuuacacacacacagggaacccacguggaguaggucugcagucugagugguggaguugaguugagcaaagccacauuuugggagauuccugguagcugugugucuuagagggcggguauugcuugcuuauuagaguucuggcuccugaguaaccaggcagugcagguuuaccuggccacuguuugugguggcagcuguuagugguuacauuuggauaguuuagggucggggaggcucagcugcuggccuguccagaggagacaaccaggaggaagcugucugucuuuguggucuggugucguguaguccuugguuguguugugugucaucuccccccucccacuucagaugggguguguguguguuugugugugggaggaggggguggggacaggggcagggguggggacgugggugggggugguuuagguaugaaguguguccccucucccuccccugaaaagcuuuggucucuagugacagaugaagucacugugagguagcuggguuaucaaggaccuugauguaauaagggaauuauucacagaaacauucauaguuuuacagcacgccugggagacaacggcagugcugagguggugccuagauggaggaaggggaucaucagggugcugucuuguucaggccugcccaugccuuccacuuucccuuauucccuguguuuuguggcucagugagguuaguagccucacccaucgaauaccuguugcagugauauuuggucucaacuuaggcuauagcaauggggccagcugaccauguacugaaaccuuagaaaccaagagccaaagcagccccuuccucuuuuaaauugucucacauguuaucacagccaugcagaagcuagcacugugugugcaugcauacgccaugcuucagugccucuggaguuguagcuggagcccagaugcaucagcauccugguggguguggcccaggacaagggucugcccuugccucuccuccacccccuucagugucauguggcauuuuucuugggaggccucaagccggcuugucuuuuuugugaauucagaucuuaagcaaucuaaauccuugugcuagaucacagugcuguguuccucaucuagguuccuccuuauucgugaccuuuugguuugcucgguuuguggacaaggaaguauauggauuccacucugcccauaggcccaggucuguguguucuucuacugugaccauggugccuuuccagaggcaccugggcucccucuuccucacaaugccucugcuaaaccucccucaugauguggcucaaagacauuauugggcccugguugccugccagcccugucucucucugccucugaaaauggacuuaggugucacaguugauuuagggguucaggcuagaccccucuuuacccaauugauuccugcauucagagccugugcagcucucugggaaggcagacuaauaaugcccagcacucccaucugcaccuucucucugugauuaggcuucagaucuuuauccacagucuuguggguugguuagaauaggaagugaaguacuuccuauauaauccugggcucugcugugucaaacucaugugcuuuccacugucaucgucuggucagggugagucacccugccagaccagauuuuguucuuauaguacacagcccacaagauacacuuuucucuaccugccuugcuguaggcccacuagggacccuaucuugucccuuccugaucucucaguagagacccgugugcugaauaugagcugaaacacuggugcugaggaagaguaagcagguugcagcuugugugcacugcuggagcauucuggugugugagcccgaagcacagucacauuuggaaguucagguugagucagauuugugcucacuauagagucagaaagcacccccagcuagugacucuacugaguguguacuuugcuguguggaccacuaacuuguuuuuuuaaaaggaagacagauuacagauucauacaugcaaauggaaaggucaggagagaaccucugcugccagucuuugccuuaacuguagcugugauacaagguccuuguguuucucucuugugcacaccaggucucaaucucuuaaaggggugcugagcugacagacuuuuggcuuuagguggguucuggggauuuuuuuuuuuuuuuuuaagaaguauguguguguaguuuuguaauuuuaaaaaauacuuaaaacauggugcacaccuuuaaucccagcacuugggaggcagaggcaggcgaauuucugaguucgaggccagccuggucuacagagugaguucuaggacagccagggcgacacagagaaacccugucucgaaaaaaacaaaaaacaaaacaaaacaaaaaauuccuuaaaacaauuuguuauuuguuguguauguguuguguaugugauaucuguuucccauggcacauguguggaggucagacaauacuaaggaaauuguuucuuucuacuuugugggucccagggaugggccucagguugucgggccuggcagcgagagcauuacccauugagcugucuugccuuaacugcccaguuguuaggacacuucaccacaugcaguuuauuguuuguuuuguuuuuuuuuuuuuuuuuugcauauagauucuuggggaccucauaucuguuaguaugaaagcagcccucuuuuguguagcuauugccuuagccuggcuuccuuucgaaugcuuuguaaguaguaguucccuggaagugaagugcaggugaccuucagaguaguuguggccaggcgcucuuaguaguuuagacugaagaacuuaauugaagaaagcaguuucugugucccagaaccauccuguuuuguaauauuuuugagacagucucauauagccuaguaugauccccaacuugcuauguugcuaugacucuaccucccacaugcuaggauuacagacauguaccaccgugccuaguuuauaugugcuacuugggauggaacuuggggcuucuggauuaguuacuuugauaaaaugucaagaccaaagcuggguguggcugggaauccucaaagccugcccccaguaagaagguucuuucagcaaggcuccaccuccuauuguuucauaaucugaccagagcaccacuaacacgugugccuaugcgggacuuuuuucacucagccaccauagccucauguaugguagguaagccuuaauacuggcugagcgauguccuuagcugagaaugggcuguguguuucccugcuggcuaggguucuagaggcaggaguuagauuccagaggaacgaugugucaggucacagacaccguauaccugugcuaagaucccucccacuucuacuguguggcuuaguggagccauuguggcacaugguaucaagaauuggagcuuuucaaggguguaugaugaguugggaaauuggggauuuaguuugcuuuucuuuacuuccauuccuuuuuucuuuuugaaaugaugucuucagcccugacuggucgcucagugaugcccuugccuguguguccugcguacugagauuagaggugugcacucugccacuucugagacugaugcucacguucagugccaagguuucucaguagagcuuagugcucagaaggguaguucuagcuacaacucgguguucucauuugaggagagugacugaauuucucaauggugggacaacgggaucccugggccuugcagguucucccuacuccuccuccucaaugcccaaggcaguuccucaaaugagcuggaacucagagaggagccagugacaguaagcaguacugugagcagcaggugagggacuugacuccugugcuguggcucugcuguuguagcaggucugccugcuacuugggugcgaguggagcccgcccgcccgccugcacagcacagccugcaccgcgcuuuucucagagccuuguguguuaagguuaaaagcuucacuuguguaaacuuggguaaggguggguuggggccuuucagcuaaggggccuuucuugcucagcacugaacuguuguuacaggaugggauuuuaauuuuggcuauccauauucucuguaaauagagauuuuuuuccuaaaagacaaaauuuauugccccuuaaagaugcaaccgcacacuuuaaugcccucacuccgggguucuuuaauauggucauacugauuuuucagccuuuuacaaauaucauuuuaagaaugauugcagcccaggccauuuuggcugcuuggccuuuguaugccaggaaauuuacagucaucuaguuuguaauuucaaaugugacaacuucuacuguuuauuuuugcuuucuuuuucuuuucuuucuugagacaaggucccuggucccugguuguccaagaacucugaauguagaucaguccggcuuugaacucaacagacuaucagcuuccagagcaucgggauuaaaaacaugcaccgcucugccuagccugaaaugguuuccugccuagucugggcuggccuaggccucacuguguagccagggcugucugaacuauugacccuccauccuucacugccuguaccugcaccauuacacuuggcugcaaacaugcggcccucuccuuaauaaacauggcauuuguuuaaaagaauugucauauauuccuaccacucuugggcuuauuauaaacuaauuuuaaaguaauaguaccagagcacauguaucugcauguugacucacuuucacuguucugcagaacuaauuaacuauuuucccaugagguuccugacacauuauuucaguugccugauugugcucaggagccaagcauguuggauuguuuuaaagcagcugcaauguuugcuggaauuaggccuucucaaguguuaauagccugcaggucaucagguuucaguuuaggaaacauugcaacuguuucuuugcucuugagugaugugacuaagccaagcuagugcccuaccccccacccaccgggaacugugggccaauuugauggggcugagugcaugcgccuauggagggcuggcgccuauggagggcugccugugagccgguaagucaguuccagagaaagucuauucaagaacuaaaguaggugauaggcucugccuucuguauguauaucaugacuuccauuuugauuuuguaugagacacagauagaagaaaaguacgcuuucagaaagcagccuuuccuccugaccucugugcagcucauuucacccuuuucaguuuucuucugucugcauuucuuuagaccugguucucauugcuaacuucuuuucugugguacaggcaggcacuucagucaucggacugggaggagcuguaaugaugacaagcuaaggguuucagugaacugccugccagcuuggaaaaacuuaaucacaggcucccaaugagaguuuagcauuucuguaacagaaauguacugauaaccuacaaaucacuaccuaaacguuuaaagaaaguuucuaagugccgagggcugcauuuguuucaaauauauuuaaagacugcaggacaggcguggcuucuguggccuccacaccugccgcugacucaguccugcagccuaggucaaguagcucuccuuucuuuuuucccccaccccuaaagcucugcugcuugucugucagggcucagaagaguaaguuucccagccugacauaguuacggggucugucuguuaccuucgguaaugugccugcucaguucccagcagagcuuguccugugccgaguucacuuacuuuccuucccuuacuggaacagguuagcaggaagcuggggaacuguugccaucuuauacacuuuauacacuguugcguuucucaagcaguaacguagaagcucgguaguggggagacauaggaggaaggacauuuacaauuccaggcuccccccccaaagaaaaacaguauacaccgugaaacaaauuaaguuuccugcugcacccccuacccccccccccccgccccccaaaggaagaaggaacaaggcuuuauugaugguuuucucugggucagcuagauugcuugagauuuuuuuccucuggcauaaucguccuggcucuggagguaaucagucugucagaguugaguaguuccugcuuuaaagccugacaucaccccaggcccagcacuuaaguaaccaguuuuucagguuuguaguaucuuaguggccacaaauucccugguccugccagaugcuuggauagggaugcuuuggggugggaugggggagggguggaggucugauuggacuccagaccuaagguuaagugaguugucuaauagcuguuggugcuggggcagggugggggugguggggguggggacggugggggacagacaggacagugccugguagcuuugggaacuucugugaggccauacuuaaaagagccaaaugugguccacugggaaugggugggagcuggcucacuucccuacuucuggguaaguuuaucccagcaaaucugauuuagccgcucaggcagcuuuguaccuauucucuuccuuuccuccuuguacucuugcugaggaaaugagucccaggaagaguagaggauugaggaugauguacuuggggcagaaggaacaccccucacugauuuuaccccgguguugagguugauagauagcucuuagagugccuuuggcugagcucuguagugaggcagccugcaguagaucuuaccucaucgugaggcagauggcaguucuuagcauggcugucacgucaggacuguagucuguaccaaaagcaggccugcuuacacauuacagcuaguuuucaagaacaaaagaaucccaggacuggggaugaagcccaauugguagagugcucgccuaauguucaacuaagccuguguuugguccucagaccacuuaagucuagguguggugguguaagucuguaaucucagcauucaggagguggaggcaggggcaucagacguuucaccugucucaaagagguuaaaaagcuugagaguuaagaacagucccguggagggacuggagagguggcucagcaguuucccuggcugcuguuuuaggagacuuagguuugauccuagcacuccuuggaaccucacaaacgccuguaacuccaguuccagagggacugacacuuucuggacuccuuggguauuguacauagguggcgcacaauagacauguuggcaaaacguccauacacauaaaauaaugauaauucaaagcaaacuaaaauaauagucauuugggucuucagaacucuggggugacuggaccagucccacuuuacacacaguguauucuaguaucugcuuaauggcguugauguucuuagaacaaacaugggguuguguagucugagggcuuccuagccaucuugaacuccuuuccaaaauguuuugccgaauuugacuugguaucugugguuaaugggaguaacuucuuauuuguaguagucaaagcaaauauggcuagaaugccagacuagagagaaggugauuauugucagaucaauaacaaugacaagcuugccuccuuuauuucuuucuaguuacacaugggaagcuguugacuccaaaaacaaugcaguuuauaagaucaacgucuguggaaauguggguauuuccagcugugggccuacaagugcuaucuguaugugugaccuaaagacagagaacugccgcucaguggguaaguaaagcuguccugugagcaugcccugcgguacagcuguguacacagcugcaugguuaugauauaguaaucaaugcagugucuaauagacauuuccuaaaagagcauucuggcugcuugccuuuugaguucaggacucugcuggggucagauggagcuggggcugccaggugguugugaauccccaggccugggugcugggaagaggaucaagugcugugccugcagagccaccucuccagcuccuagguauuagaauaccuuaaaaaaaaaaaaaagcaggcuaugcuuucacugaaagugucccaccucuuccacacccagguggcuuuuauaauaguuaaaaaugguaaaagacaguuuagggcagguucaaugcucagugguuaagaacguuauuguucuuccagaggaccugagguuuuuauccagcacccauguuggauggcucacauuggccuguuuucuacuggcuaccacaugcaggugacacacaaacugggaaaaaauuuauaacuuuaacuugauuuuucacuuugaauauccaguaugcgauaacaagguuauuuccaugcagugaguagcaugcagacaauaauuagggaggauuauaggguggauauugaauauggaaggauguuuucuaccuguauggcucuuccuucucaccuuuuuccuuaaauuucuuauuuuauauguauggauguuugcuuucauguaugccuguguacccacgcguaugccuagugcccuuggaauucagaagaaggcauugacuccuuggggcugccauguggguucuggcaacugaacucugguccuguccaagaacaagugaucuuagccacugagccauccaucgcuucagcccuaaauugccuuaaauuguccuccuccuucaccuccauuuccuuguaccucuuggaagcgaugguguuguggccucacaguaaaggacaguuguuggacucaagcccuuccuuucuuguuuccuugguucagucauucuagaguauccuuuuugagggucaggaccgcuuggugaggaacagguuccacugagaugggucaaagcagaugugcucaggaggagaggacucugggucuuagcuaucuguggucaguuuugcccagggagcgggaauagugagauuugcacauaauuaacagauuaaucugggaaagagcugaaggcagccauaguagguuaugaguuagggugaugguccuguaguccaggcucauuuuauucuugaccuacaccaucaaaacuuccugagagauaguugugagcucuuucuccuguugauaacugcguucucugcuauuuuuuaaaaaauguuucuuuuaaaguggggugguccaaguuauuacuacuuuaaauuugauuguaaucaucuuuuugucauuaaaaauaggagcauuuaaaauaucaauaguggccauuuaucaauaucuaaaaauuaaguuugcuaaaaauggacuaguuuuucaguaauuauauuaaaaggcauaucaaaaauaggcagagaaaaauagacaaacccauguuuauaguaauugugccgugacuuuagacuucaguaguacauuaguaaaugguucacauuuaaaucacauuugugauuucacaguuuugauagaaaaaaauaccucuuaccucagagggauuaagagacaguuuauuauggagccaaaugugagugacagugccaaugcuaaccuugggcagcauguucccauguggaacaguaaaucaaggcaaucaagacacagcauggugagcgcagaggcagggugcagcagcaggccugccucaguugucaccugauugacucccaaagguuagggcugcugcagagcugggcaaggaauuuuuuuuuuuuuuuuugugguguguguguguguguguguguguguguguguguguguguguguguuggugcugaggcuaaagauagcccccaaaagaaauuauaauuaggcugugggauaggcauccuugcauacuguccauagucauacaaguuuuuuuauuaguauuuuuauuaguagaucaguuuauggggagagauucuuuccaggaauucaugauugaaguugucccuguuggcaaagcaccacaguucaugcugggguggaguuggcccauuucaggaucugagagagaugaggcugagcugugggcagcacacgagucuuuaggaggagcccacaucugaucagagccauuauggagccuaucagagcguguguaacuguaucuaccugacggaaugaagaagggacacuggauguacagaaccaagauuuacuuacugacugcauggcucccuccauguaguuugugcuccauaaaccaucugaccuaaacuuuuaagugauuagaagugaaaauggguccuguagugacucuggagucucuacaggauucauuguuuuaauuagcaaaauacaaauauuguuuuuaguauaagguaaguaugcucuaggacaucuuggugggcauuguaagaagugagggaagaacucagacuccaucuugaguggcugaggcugcucauugaaacagaaugaagguuagcugccuuugaggggcugagggaaauaugcacaccacauacacacagcgcacgaacacagagcuaucaggaaguuacagcuguucuugugguuuaacugggaguagggugaguugugcuuucuauacccagcauauuuuuguuguugcuguugcagguggagggauaggugaggcuggguuaucucccaguacagccugacucaaucccucgugcccugagggcauuacccagcauccuggcucaggagcaaagggaaaacguuucugggagacuacugucuucuaggccuuagaaucuagagguuggcugugauggucucaaaggugguaggggcucauugaccuucuggguuguauaaggacugguacccuuuggccaugaagaguuugugacugucuuggcaauaaaaacuuggagccuuuguuggaggaacuuaguuagacagcugaaaaggagggccaaacagcaaagcuguaaaagugaacauuuggccugccacaugguccccaaauaguccagguaucucaaguguuuucuacucucucucuccuaauaaucguuuagccuuuccccugccgggcuggaugguccugugagccagcagucuucccuaggaaggcacagaugcuccgcuuccagcagcuguuacaucuagugcccacucuucuggaggaucgcuguagccagggcguguauuggauuuuguaaggugaccauacuuugcuauacuggggucaggucuuuccuagucuaacuggucaguugucuguguuauaccuguuggagcccugucacuggugugcucguagcugauggcccugcuaggucuuucccagguggacagggaauagcuugaaguuucucuuucucugacuguuauggacagauaagaugucuguagacuucccaccccuggaacaucuuaguccagggugagaaagaguauccucuggaguagcaaucaugugaguguuguccugaugugcacauaagucccaaguucccaaggcaaggcaaauggggacaauuuguuucugguacugaauuuaguuggucuccccagcugucccagccagggguccugcuaacagauuuauauguucaugguuggugugucuuaaguugaaugccuacccuaguauaaguuauuuggcagcccucagacaaauccaggaguccuuccccagcccuggaucagagauggcuggaauuugccaaugguaguguuucuaugagaggaguguugagauuaaagaaggggugacuguccuugacucucuuugugguaucucagucuugagguuuugugcucaucggaacagaaaugacaguuguaaaguuuggaggaggcucuuugccccauggauguauaagcccaauuugaaguuguagguaccccacguggaggguuuuuuccugggcaacucccaaauuaugucauccuuauguuacccccuuccuguaugggacucaacugcuugccccuuuguaggugccucugccuguacuccugggcuaacaaaaucaacacaacaguauuugaggaaggacuaguaggugucuccccauccacccuuauguuuucaagggacuguagguugucauauuguggcccaggagagguguuggcuccaguuccaauaccacuggaaugaaaaauugcagggcucuuguugagggaauaauugguugggauccaggaaguggguggcccauaggagaauaaggcuguccaaguuaauuugguaauuauucagucacaggaggguagcaguggaagaagguuccagacaggaaugucaacagggggauuucaggcguuggggaggggccugggccugagagccauuuaaacuuagacuguacaguguugcagaugauaugcucaucugaccagagugaaggggaugucaagggguuuuggaaaagcugccaugguguguacugggcccagggccaguuauaggucuuucuguauuguauccaggaaaagcagaacuuggaauguacucaggaaagggagcagacaaagaaguuggugauuauuccucagcgauugauaggaacugggaagucuguauauugugagcuuaaaagguggggcuuagagguauggaaugaaauugggggaaccuucuugagccuggaaagauagacaggguuuuaacauuucauuuuguggugguaggggccugccauuuauguuuuagagaggagugggaugggucugagacacacccuauuuggaucucagggagaggugaguaggguaggauggugucuuacuccagguuucucuugcugugaugaaccaccgugaccaaaaagcaaguuggggagaaaagggcuuauuuggcuuauuuccacaucauaguuaagcaggcuaggaaccuggaggcaggagcugaugcagaggccgguggugguagggaugcugcuuacuggcuugcuacccauggcuugcucagcuuccuuucuuauagaacccaggaccaccaaccaacccagagauggcaccacccacaauuggcugggcccuuccuuauugguuacuaauugagaaaaugcggccuuacagcuggauuucauggaggcguuuuccucaauugagucuccuccuucucuagugacucuagcuugugucaaggugaucccaagauguaccagccaguacaacagaggaggugggaacaauggccugauuaauuuuuuucaggguuuuggaccgagugauaagaacuacuaaggcuuuuuaguaacugagaauaggaguguugugaugagaacugguggguuguuaaaagagcuguuuguaguagccacuuagcaauagccuaaagaccguagugggugggguaccacgugggugguaggcaugaggauaauaauugguccuggugacaaagucagaagggucucuccagguucugaaaaugggaccagacuagagggaauaggugggcccagauauagaaugucacugagaggucgaggguacggauaugaccggacagauggcccaucuuccauuagccccauugucugcagcucagacaagccuuggguuaaaggcacuccuuagcacaauggccaacuugauugcaucgaauacaauguacagucccuugcccagauuugcgcugaacccuagcacaacuaggcaacauaacaugaaaccugaauccacucgaaaugcgcucugaggguccaacccuuugaacucucccuuuguauagaauauggcaccuucaugugccccugagcacagccuggauagugcagagcccucugaauccuccuguccgcuaguggggcaccuucauuugcauggccaaugaggaacccuaaucuugcgcaggaguguggcacccucaugcauagccaggauagcgccaaacccugcccuucccuccgucuccugcaacgcggcacuuuugagcuugccucucuugcaacguggcacuuuugaguucaucucuccuguaacauggcacuuuugagcguuggcccugaucacagaacccuucgaauccuccccuugugcaguuugcacccucaggauaccucggaauccuccgagccgucucuuccccuccccucgcgcaacuuggcauaaccagaaucacagcccaaccggaaucgcauuaaaacccuccgaaccuuugggcagcgcggcaccggggcucacgcagugccgcggaacccucggaacccugcccuugugcagcuucgcacccucaggauagcucggaacccucugagcuuucccuucccuuucccucaccgcaacucagcacaaccaaggaucacggcacaaccggaauugcuccgaacccucgggcagcacugcggcgcagugccgcggaacccucuaaacccuccgaauccccuccuugugcagcuuuucacccuuagccucucucgcaacucggcacaaccagaaucgcagcacaauuggaguugugcuaaaauccucugaacggggggggggggggggggcagcgcacacgccagcacccuggcucgcgcagugccgcggaacccaccgaaccuucccccugccccgcaaaccgcggaucaggucguguagaaauccuccgaucuccacccccccccccaacucuccagcagcguggugcccuagcgcgaaccccugcuccccuugcgcagcguggcacccucgugcucuagaucgcccguaaaccccccccccccccagugcagcagucggcccgcgcuggacgccccccucccuucuccucuugcugacgcggcauggcggcagcgcggcuuucggcuuucuaccggcccuaucggcccucguguaguucagaacacuggugagcaguggggcacccuagugcugaguuuucuuguagcccagaaaucuucacccuagcgcugaaucucgcguaggggaaccuuugagcggccuggaacucuuggucggagcccucgagcugccggaucaguggaacccucaccucgcguagagcccuucccuccuguggaacccuuccuuugcggaauccucuaacgcguggaauccuccccuugcaacggaauccuacccucaucugcagaauccuccccucgcauugccgcgcuucacgcggggaacccuagcuuaccucaguuccccaggaugucugcgugguaacuggcggugcugugcuucuugcugcccgcuagagcaaggagggauagauauaauguugaagccucggcaggggguggagauuauuaaguuccgccccaacugugucacuuaauccccccugcucagcccaaccucaccaggcuuuggcuccuccucuugcuccagccuggagccuguguuuuagauggccuuacaguccuggaaguguuucuauaaauugccugcugagcaggucagaaagauuuagaggaacaccagagagaccagauauuucaagcagacuugaauaacagauauuacgguuauguuucuucuucuucuuuuuaaaagcuguugucuaauugaguaguccuugcuugucuugaaccccgagagagauacacuucucuuagucuuuccauugcuuggaugcagaguaugcagugccacuccugugaagguuuuccugaccaccaagccaccaaaagcauaguuuuacaggacauaaacaggcaguucucuuccacacaacucaguugccaguauugguucaaaauuugagacuuacaguuuauuuuaggcacauuuaagcaaagcacaauuaaaaaaaaguucucugguuuuaauuaacuccaucccauguguucaauaaaucuuuacuuaugacuacauugauucuuuugugagguucaagugagucuucuguauagauagauucuauagauuaaggaaguaggcucaugggaggagucugggggaagcaggcucaugggaggggucuggggcagcugcuguggccuggccuuacagaaauagcacagaggucaccaggcuauuaaccaccccugcccccagccuccugggcuggaaacagguuaucuacucucccuuugaagagacaacccugcguguuuaacauuccuggcuugccuagugcuuaucugugagaaaagagccuacgugcuuuuauguuuguucauuguguguucauucuuauccucuccaaacaggugacucacuuuugagaaguucagccagaucacuccuggaauucaacaccacuaugggcugccagccuucagauucacagcacagaauccagacuagcauuacauuucugugugggaagacccuggugaguggggcccucuucaagcucuuuguuaagaacauuuuccccuucugguguucuuguuacaggaauucugauccuggaggacuaaauggucaauuucccccuccccccaauuuauauucacaucacgucacuaccacccagaaccaccaacuaaaugugucuuaaagauggugagaauuggagugaaacuugaguuaggaugaauguuaauuuuagaccaaccuauaaccacacuauugugcaaauugagaucuuaaagucuguuuguggcagcaugaaccauggaggucauguugcagagcaagcuagcugcugauuuacuucuguugauuguucuuaagagcuugguguuuacuguaggagaaacaggacuuggaggugaacaccuuggucuuucucaugggcuggggaagguagaaguuaacuguugcucugcagggguuaacuagaguuaacuggucugguugccagaaggggcugucuggggugggaucuggugccucugcccaggcucugcugcucgugggcuccucggggaccuccuuacaggauggaugaagucauacuuucuggcccugauuuugcuguuuuuugguucagagaccauuuggcucuugagaagaaggcgaaggauaauuucccaugaguuuacucugcuuguggaauuggggcagcugggcagucaguuagacaggaugucuggagacucucaucucccaacuuacuuuucuguuugggcggauauucuuggugaacuuguugaaguaaggcaguuauguuuccucuuguugcacccuuauuuucaggagauuuuacaauguuucagguuuaaaaacaaacuuguauuacugagugguguguuaacauucuuuuuuuuuuuuuuuuuuuaauagggaacuccugaauuuguaacugccacagacugugugcauuacuuugaauggaggacuacugcagccugcaagaaagacauauuuaaagcugauaaggagguaaugggguuugagacuauuuggucaugaaaucuacucuggagagcuugaaagucaggguguggauucugcuggggaggaggugagagagggaaaccauaaucagaauguguccugaaaauaaaaaucuauuuuucaauaaaagaaaaaaagauagaaaauuaaaacaaccucuuacaaagaagguugugacuuugcgauggaaagauuuaaaugacuuauuacagucucuugaggugagaguuuguuucuguggaugugagguuccauuugcacagagguaccacgagauuuaauuguuaaaaacgucuaggccagcuucuggugcacacagcacagcacagcgcagucuguuuuggcuuuaggguuugcccugcaccccuugggcccucaggaaccugacugcuucaucuuccucuguaccugcucccuacccaugaaacaucucacuuggaugauucguucucugccaguuucuuuucuuuucuuuuuuauaaaauuuauuuauuauauguaaguacacuguagcuuucuucagacaccccagaagagggcgucagaucuuguuacagaugguugugagccaucauaugguugcugggauuugaaaucaggaccuuaggaagagcagucagugcucuuaaccacugagccaucucuccagccccuuucuuccaguuuucauugucagagucucauguaaccuagguagccccagacuugguauguggcuaagaaugaccucagaauuguaaucuuucugccuucaugguaugauuaaaucaugaugguuuacuugauagaucuagaauuaccauggaaauaaaccuuauggguaugugucaggguuucuagaguagauuaauugauguaguguggguggcagcacgcuaugggccgggguccuggagugcguggaaaacagaagugagcugagacuagcauccuucugccuugcacuuccuuguagauuaaaugugacagugacuuccc

SEQ ID NO: 45 - RNA, 40697 nt, Mus musculus
uccaccaaaccaauagcucugacgcuuuugcucuggauucugggaacugcacucccucuccacuggccaaccacccugcagcuagcuccgccaaugucugcccuggcugugucuuuucuccugcccaccugaguugccacagauugaaaacaccagacaguccuaacacuuaaaaagccagccagauaacacaagugauggccacagaaucuacugcaauaaacucgucagcuaucuugugucagaauuccaccaguggcagaggucgccaccgguucuagucaacccgaggccucacacaguauacugcuccuuucccaaagccugcugaaaaccagucucucucucucucucucucucucucucucucucucucucucucucucucucucucucucucucucccuuccccuccucuuccuccugggaccuggaaauuccaccuuuuuuccucugcccaguuucugugucuguauugacacaaucaagaaccaauuagggaaaugacaccuccaccuacauauagaaggaauggcuuggauggcaauggcaacuggagauggauucguagaauugcaauagucaauaagcuggagcuaguucuugaaaggauguuacaagggagagucucauaugagguugcuggaaggaaacccaugauaaagaguaacaucuucccuuccaguugucuccugaaaugcaggacacuguuuucccaaaccucuucuuuuggagaaccucagggagcauuacagcagccaacucaacuaagacauacaugcugccaagaauggucuagaaccccaaaacagacaagcagacgggagcucuggcuggagugagauaggccaacacucacaaagcucuguucacauuucacugaagcuguuguugaagaccugaguugggagucaagcccuggauacacauguccaccuccagcugagaacacagauaaacaggaagccuaaaggauguuagaugccauuaacuguaaggaaagauuaaggaaggaauuggguaaaauggcaaaaguccauccucugcguguccuaugugucaaacccugacuguaaaaauaguucuucuucuguucacguggguaaaaagccacaaggagauagauaauuggaacacuuagauaacuuaaaaaaacaaaacaaaacaaaacuuuggguucacauucaugauagugaaaagucagaaauccuauguggguggcugugggaaaugugacacucuaaacaaauaccguggcauuccaguuuauuccuuagucacaaaaaagaaagaccauaauuaaugcauucccaagccuucugcacucugagggcucaaacugcaucugagauauaaaccaugcuuguaugaaggagagagccuugugugacucggcagaacucaaugcuuacuuaccucaugacagggcagguccaaggagcaccaauuagagacagcaacucacaugaccccacccacaucucacaggauagauaugccucucuacagaaugauggacaucgcaaaaugcauuuguucauuugccucacucaguuuucacuuuuacacacacacacacacacacacacacacacacacacacacacacacacacgcauucuuuccccuagcuucuccuucucuucuaugaaucucaauauaguuaacucucugcuuucaccguccaucucauguucuguaucaugucauaaaagcccuguauguguacaucugccauccgcucaaacucuguccuauaagcaagaaaaacuguuuaguuuguuuccaugaucuguccauugaugagagugggguguugaagucuuccgcuauaauugugugagaugcaauguguguuuugugcuuuaguuucuuuuauaaaugugaaugcccuugcauuuggaacuuauauguucauaauugagaguucaucuuuguaguguuuuccagccuuuuacucugagguagugucugucucugucacugaggcuuguuuccugugugcagcaaaaugcuggguccuguuuauguauccagucuguuaguuuauauauuuuggggggaauugaguccauugauauuaagagauauuaaggaaaagugauuguuauuucccacuacuuuugccauuagagguggaauuauguuuguguggcuguuauuuuguguuuguugaaagaagauuacuuucuugcuuuuucuaggguguaguuucccucuuuguguuguucuccaucuauuauccuuuguagggcugcauuuguggaaagauauuguguaaauuugguuuugucaugaaauaucuuguuuuuucauauuguuuuuucuguauauuguaauugagaguuuugcuagguauaguagccugggcuggcauuuguguucucuuagugucuguaugucaucugcccaggaucuucuagcuuucauagucucuggugagaagucugguguaauucugauaggucugccuucauauguuacuugaccuuguucccuuccugcuuuuaauauucuauauuuguuuagugcauuugguguuuugauuauuaugugauggaaggaauaucuucucugguccaaucuauuuggaguucugcaggcuuauuguauguuaugggcaucuuuuucuuuagauuagggaaguuuucuucuauaauuuuauugaagauauuuacuggcccuuugaguugggaaucugcuuucuuacauaccuauuauccuuggaucuugucgucucauuguguccugcauuuccuggaucauuuggguuaggagcuuuuugcauuuucuuugacuguugugucaauguuuucuaugguaucuucuguaccugagauucucucuucuaucucauguauucuguuggugaugcuugcaucuaugacuccugaucucuucccuagguuuucuaucuccaucuuugucucccuuugugauuucuuuauuguuucuaucuccauuuuuagaucuuggaugguuuuguuaauuuccuuugccuauuugguuguguuuuccuguaauucuuuaagggauuuuuuuguguuuucucuuuaaggguuucuagcuguuuaccuguacucuccuguauuuccuuaagggaguuauuuaugacuuucuuaauguccucuaucaccaucaugagaaaugacuuuagaucuuaaucaugcuuuucuggugugaugguguauuuuaucuaaaugacaaauaugauggacuggauguuaauuguauaucauacuuuguaauuuacauaauuguuauccuaaugcucaauuuauaucugagagaagagccuuuuuuuaucgaacagaaagggugagauguuggaaauugguucuaaugcuuuuucugaauucagcucccaaaagccauguuuccagacgcuaaggaucccugcccccagcuggcuuugauugguaauaaggaaugcucuacagccaauggcugggcagggagauggagccaggacuuuuagauugugcagguaagggaccaaagggaaaaaagaacagauagaaucaccaugaugugagagcagagagaucagacuuaaggucccaccaacauguaagaaucaggguaaguggccacaggggucacuauccugacugggucuugggcagcaaagauaaaauacagauuuagagaauguuaacuaaggauuccuagagggggauguguucuaggugcagggagguucaggaagugcccaacuauugagcuaguaaggcauauuaaaaauaucacuguggggcugggcgugguggcacacgccuuuaaucccagcacuugggaggaaaggcaggcagauuucugaguucaagggcagccuggucuacaaagugaguuccaggacagccggggcuacacagagaaacccugucucgaaaaaaaaaaaaacaaccaaacaaacaaacaaaauauauauauauauaucacugugagugagugugugugugugugugugucuuucauuugugaauccagagcucuugggaagguagcuagaagcucaaucgccuucugggagccagaguguauuaacuauucaccauuacacagucggaucgggguaccuucuuaacagacacagcguaccuaaagguagggaugggauaggcuguuuguuaacccagcuggguugaugacugagugauaaccuuuucuuauuguguguaacauaugaauauugggcagacagagagagaaagagauagggugagagagagagagagagagagagagagagagagagagagagagagagagagagaggcagauaagcacgcacuguucacagagcaaacaccugaucaccugauggccacuucggguggggaggaucucacaguggcccuguagaccuuaucuguggagagugcaggcuugugaaucuuaucucacaggacaggcaaagucacaaaguauuuuaucagccuccuuuuccuucccccuucacacugaacacuuucuuuggaggcuggaauuaagaaguuauaugaacuaucuucuauaugucucuuaacuagcaaggccucgaaaguugacaauaagcagccgguuuuugagagggacuuugaggcuguggaagaugugagugcauccugguaccuccuguuaggaaugaaagcugaacaaggaaaggcagaggcugagcagaucagcacauggaucccacccacagcacucaugauaaaaaacaugguuagcugaagaugauuagcucgguggugagggaggaaaugcuugcuuacccagcauguacgaggcccuggguuuaguccuuaggacaguugugggagaaucauuagcaaugauuugcaugcucugaguggaaaaaucaacucaacuuucaaguuauauguauaguuaucauacacacugagucuugaacaucacuuauuguuguuauccaucaaagaaacagggucucaccauguagcucuggcuggccugaacuccauauauacucuacguuggaaucaaacuccacccuccucugccucucaguugcugagauucaucuccuguaccccuggcucaucaaucccgggaacgcuguucauguucuuuugagacagggacucucguuggcuucugacugacuccucaagugccaaauauuuuuaaaacuucuuuuaaaauuaaacuauaauugaguuauuuuccccuuccuuuccucccucuaauccuucccauguauccuucucccucucaacaguguggucuauuuuuguuccuguguguaucccuaaauuauaaacacagccugcucaguccuuuaaugucaccuguguguauaggcuaucagggcugaccauucggugcuggauaaccaacugggggacucaucccaggggaaacugcuucacccauucccaggauucccuaguugccuauagcccauugucuauggguggggcuccaugagaguuucauuguuaacaugucuauugaugucauacuccuuaaagucuuacuuaggcagccauuuuguugagguaucaugguugaagcaucuauugcaaagagaaguuucuuugaugaguggugagagcuacacuucucuguggguguagggacauuuagaguauaguuaggaaugaugauguuuuaguaaagugacacuagcagguucucucuaagacccuuggccucacuaucccuagguaguugucuagguuuccaguaccaagcauaauuucccuuucuggagcaugacugaaguccaguuagagaucuguugacuaccaacaauauaugaaugccacuauugcacccaugguuccaaugccaugcuacccaucuuugugguucauaggcgucaccguugagugggacgauugguugcuucccugucuucgaaauguacauggcaccuugguacuaucuaagcuaccugucaggaaggaagucugcaagucagauccagcucaaguccaccaggucauguaugugaaauucagaagugaggacuuaccuucaacuucugggagacaaccaaaagcaaugccaaucaccuacauugguuucuauuugugcccacuuuuuucauguggauuguguguucacccccaucuuauucagcuggaauauuacuaucucaacuauuuccugaccccgugcauauagauauaugcacuucuagauauauagcaccuaagcauccaucaggauuucgaaacaaguuuuggaacucuaaagagaccaaguuaguggaaguugucuguugccaaauacaaauauauauuauuaaauuuaaauguucuaguuguauccauaaacagcuuccucaaaaaugucaaaacugugaucuaccuacaguauuaguugauuuauuacauuuuucccaaugauuuuugcagauuggauuauguuuguuaauguccagacaacacaguauuaucaaucucacuggcaaacaugaaaaggauuagauaaccugaccuuggacagaacaucacuuuuguaaacuggugucugcuuacuguauuucaaacacacauauuugucuuugguuuccaaaaacaaucaaaaugacuucuaaauaguuuuuuuuuuaauuaucacuggauuauaaaacugaucauguuugguuauauaugaaaucauagaacuggauauuuauucaagaugaauuuuuagaguuugggguuguauauguauguuugugugugugugcacacaugugaaugcacauguauguauguauacagaggccagagguugacguagagugucuuucucaaucacucuucacuguauuuuuugaggcagguucucucacugaaccucggggucccauguagacuagacugguuaccuugcaaacccaggaauccuccugccucugccuccuuagcccugggggugcaggcaugacagguuuaacuuuuuuuuuaacccaggugcuaagaauugaccuuuguucaugcuuuacauggcaagcauuugacugacugagcuauuggcccgucccugagccacccaggcuagcucacagcagaacaguguugggcccagcucucauccacaccccugccaccagggccagcacuacugugcugcucaggggagguauccagccggcucuccugagaacuacagcuggugaugagcagggacagcucuccagagcucaugaccccgugggcagcuuuccagacugcuagggucugugugucaucaccucagugccuaugcuaccuauggaaggcaaguggcagggucagcucuuccauacucaugcccucagaccagcuccacugcccugccugggugagugacccgcucuuuggagugcuguugcgagugagaggugggaccagcucuccaggggccacagccagugagggguggggccagucugcacagcccuccaggguccacuucuuguucacuaugccagaaugccuucccagggagcagaagaacaugguaacuuaaugucuaauuaggacucuagguacucugggaauccucaaaaaauaagccuacaccaaauacaagguaaaacuuaaagaaauucuuuucacauucuaggcaucacuaaacagcucauuuaaucuucauaacaauuuagaugaagaauaauauucaugaaacucaacaaucaaguuagguacuuggaauuucacauauuuaauacccuugccaaugaggcaauuguggcauguggagaucuguagauuaacuccccagagaugcaaagcuguaaacugauuuuuccauaucugauugaaccuugguaacaagccccaucuuccacuucuaauuacuaauuucaggacugacuccaccucuucaagacaaaaugugguuacccaaaguauuuaaccugauuugucaguauggaaauacaaaccaagacaagugaugcuacccacaccaugaaaaugaaguuacaccacagagaacccauguaccacuggcaggagcagauuccacucuaacuguuuagacaacugcucacuuccuaaaucagcaugcuagagccgucuuggauuuuuaaggaucuagggaaugaguugacaccucacuaauagcuuaaauuggacagaaugagagcaacuugcaagcaucuccaaucugcacugaccucagagccagcacacgccugggcaccgcguguccacacucuacaugugcuuguguauaugcuaugagcuagcauaugcccaagagaaacgccuacagacgaggcuagggaaacggcuagugggccaaggcaccagcugcuaacccugaugaccugaauuuaauccccagagcucacauggucaaagaaaaguaacagcuccugaaaguuguccucugaacguguacacacacacacacacacacacacacacacacacacacacauacacacacacacauacacacacacacacacacacacacacacacacacacacauacacacacacacacacacacacacacacacauacacacacacacacauacacacacacacacacacacacacacacacauacacauacacacacacacacacacacacacacacagguacaaaaauaaguaaaauaaaaauguauagaaauguguacauacauucacuagugugcaaaaaguaacacugcuacacauuaccaccuagaugagucucccaauccaacucuggaauaaauugucaaagcaagacucugcaccauuccaggcacaucuaggucaaaccagacaaaacucaucaccuguauaagaaauaagggaagugauuacccacaggaggggccagagcacaggaaccacaagucacuucaguuccauccaagggcuggcuacauaacaguguucgcuucgugaaaauucaccccaaaaauugcaucaugaaaggaagagcuuugauuucauaauuuaaaccaacugggaaugggaagaaaguccaaaugaaaaucauuggacuauaauuugaaaaagaauguaagaaaacuuuuaggggcuagagauauggcuuggucaguaaaguacuaaccacacaagcaugaagacccaacaugaguuugagucccccgcacccauuggagaagccuguguggcagggcacacgugcuuuccgugguggaaguaggaggucagacacaggauggcaacuggcacucacuggucagcaggcaagcccagcugaugaucugguucagugagacaaggucucaaacaugacuucugguacauacacaaauaaaaacccuuuuaaacaaaguuaugugugaccuugaagguugggcaguguuuagacaugacaccaaacgauggugugcagaggaggaagcgucugagaugugauaccacguugcaguacuugccugcauacacagcccugggcccuguccucaggguccagagaguagugggggaggacucaggucucaaaacauuaaaaaauuuacucugccaacaggcacugcuaggaagauggaaagguggcuacauauucaaggggaaauuggaaaucgaguaucuaacaagggcacugugucuagaauacauuuccuuacugaguuauggguacacaggcuccugucucuacaccuuuuauggacccugggaaugcuaucaaccacacugcuuauuuuuacuagaauaaucuggcugauaggugaagaacuauaagaaaauauaaacccuggauggauuccaguccuauguuuuccuuacagucagagagacauaugaaaaccuuuaugcaaugaaacaacacuuuacauuugcuucuaagaguuaaaacucuggcuuacucgcagcacucaguuaguagaggcaggaagaucucuaaguucaaggcccaccugguuuacagagcaaguuccaggacagcccaggguacauagagaaaccuugucucaaaaaaacaaaacaaacaacaaacaaaaacuuaaaaaccugaaaaagccuugcugaaaaauacuggaggaauggguuuguuacaauguacccagaagacagaaugcaauguagccauaagaaguuaagccauagaagaauauuuauugauaugggaaaauguuaacaauauacuucuauaugaaauauguaggauacaaaacaguauauacgguuuaauaccauuuuuacggaaagaaaaauagccauauauacaaaaucaugcauaauaaaaaauaaaaacuguauacaccauuuauggucaucucuuuaguggacuggaugugauuacaauucacugaagugauuacaguaucacucaccugcccuguaaacaguaucugcuuuaucuguccuguaucagugcuuccuuccaacagccugucucugacagacaccucacuagcagcuucugcucugcccgucuacguggaugccauuugcucauagauacuggcauguggagaacaugucaacuaauaaaauauagagaaggccacagcagacgccuggcuuuacaaaguuauaauugggagaacuagaaaauucucuacauaugauuuucucuacuucaauagagaaaacuaugcuaucauuacuuugcacuaauggcaugugaaauacgcaauuucaggaguuagaagugaggaacuggggucuccccucccaccugcagcgaagguuaaggagcucaacccacaaaaugagguuagcaaucuuguaaaauggggaaacguaauuuuuaagugaaggaaaaugagaucagagauauaaaaaauugucuuuucuucuguaaacacuaauacauuuuagacaaaacuccaggaaagaaauucuaauccagugugcuaggaaaauauuuuaugcuccuuuuuucugcagcauaaaauucuuaguguuuuaaucucuuuucacaggucugaaaugucaagauuauaucauuaucuuuagcaaauacugucuaagcucuguaacaauuaauacauaggauauacuuagcauuucauggaaacagagguaaguguuccaaacacacauauaggucauccuauaacucuugauaauuuacaacauuaaauaauguugaaaauaagacuucugucucagaacccacucuaguguaaagcuggcuacuggauuccuauuuaaaauaccaagugaggauguggaucuuucaagcuuacaaacuaagagaaaaaaccugcacaaccucagacgcugucuaugugugcuccagcacucucccaaggcugccucuuccucgggaggggaaucaaacuagucugcgauccguugaucaauuuagucauuguuggcauuauuucugaaagauaacagguacagcuuaccuacacaaagggaauuuuugucuuauuucuuacaaguaauaugcauguaaaaaauaaauuaaacacguguuuaaaaaaggagauuagacaaaaacuuccgcagggaaagagguuuuuuuuuuaaucuaaucaaaagauuugucccucuaucucuccucaaaaaaaaaaaaaaaaaaaaaaucacagaacuaaaaaaaaaaaaaaucuggccagaguucaaauggcaaauguauaucaaacuggugcagugggcagccugcuccucugguguccugcugccucuaucucguucugcaagugaguugaccagagcacagggaagagcacagggaagugcuuccaggucguucagagacaccggaauguuaccucaacacacguaagggaugggacggaaggacuacugggaaggacuacugagacugaauggucacugugugucacuacaggaaucaaacaacaaaaggcaacaacuaagaaauaguaacuuuuugaaauuccacaaucaccaauuugaaacaacugaggaguaacacuuggacuagcaaauguguaaacuaucacuuuggcacaugaucacagaugaauacucggguuuucacguaaacuaucacuccaugaugaauacuauggaaggaagcgugacucacuugugaaaucacaagagaaagacuccccaagaccuccgucuuccaugcgcccccacucugaaagcaacugggagcugaaaaagcaaugcucacuuaacagcauggcaauuucuaucgcaagacauguggccuuucuauuccucuggagacacgucuucccugccuaacaaaggcacgcgacaauacugaaauugacauuuagcucaggaaaacacugugcaugugucacuuccuaguauuauaugaaaugguaaguaagcucacagcuguucuuccaaauaaaugugaaacacaugugaauauguucuagauucucuaguucuggcaaaugguggaaccagaggaggaaacacaaugcugguggaaccaugaugaacuggcugacuugagcugucagugugcuaucuuaauguacucaugaccacugggaacguguccacaguggcugggaaguuaaccucucacacagguucacgucuuaaugaucauucuucuucuugucuuucuucaccuucuuuuuccccaaauucuuaguugacucguccuggaagagaaagcauucaaugaagcaccacagccauguacaagaccccagagcaguuccacagauggucuacacugggaagucugugugcuuuccaauaucagugccacucggacauaguguacuauaauacuucaugacagucaaggcuagucaagagaaacauuucacccaguauauuuaugcuugaaaaaaaucucaguuacuauuucauuucuccccauucucccaaguaaugcaauaaagccuaaauaaauaguuaugcacauauguaaggcauaagcaaaaaacccucaaaauauaaaaaccacaucuacagaugugcaaggaaaacacagauaguccagugcugauggaaggccaggccucugccggagccuccagaccauauacccagugugacagcucaugucucucugggccucagcuggcuuuucuaauagaaacccuacagaccuguaaacucacacugucccauugugugacugaggccuauguccauggcuuccuaguccacaccucaguaccacauccucccacugccgcccucucgcucgcccuucucucugcagucucggcgagugcacccggucacugcagcaucaagacucacaggaguguucgugaaguucuucuccaccagaauguuccuggcacaguuguugauguguuugaaacggucaggucccagcaggaucccuccauaccagcgggacaccaccaccaugacauucuucacauucaaaaucuauuauuuuuagaagcauaauuagacauacaaagaggcaguuuuaagaaggcugaagcauuaggacaaggagaacuugcuaagucaaugccgaguucuagugcccucaaacucucaacuuuaaagccaccugucaaaaggggaaacgacaaagggaggguucuuccgcucuuacugacucuugccagaaagcuaaguuuaagcaguguuuuaccaguaagcaagaaaacaaaaccagccacacaaaauacccugcuucugaacaaguaacugaggagaaagaagagggcuucacaaguagcagcugugaccugucuaaugcugcuguaaccuguccacgccaccucuaauguaugccugccaaguucaggcuugucgccuaugcuaaacaaguuccugugagaacaaggccugcuuagaaagcaaacucuacacccagaaggagaagaaagcauaguaacuuucuaaggaaaaaacagcccgcucuuaaaauuaauagacaaucaaugaucggacccagcaggguaaacaaaacaaacaagauaaaccaacuaaaaugggccuagagaaacuuaggguugggaacaguugaauaaaggaacucaaguuaauauaugcagacaaaauuuagaagccacuauaucugaggaaaaaacugaaaauuaagcacaggagcuggagagauggcucauucauuagagcacuuacagccuuguagagagaggcccagcaaccacagagaggcucaaccaccuggaaccccagggccagggaagccacuguccucucuggccucuguggcacugcgugcacaugguacacagacauagugcacacaaacacccauacacauaaaaauaagugacuuucugaaagaaggaaaauuauuucuaaaaaggaagagaauaaugcuuaagaaaauuaaauggaaggcuguuaaagguacauaaacuccagaagaaguuaagaaagcagcucagacagucaauuuaauucuuaacaaugaauuauuacgaguauaacccauauuucaccauccaacugacagagaguuucacgaagauggaaagaagaaagacagggaagccacugccaggaaaacaaaaagcaguuuuccagagcuguauaguuacagcaauacaaccacgcuguguuauuucccggaaagcacaccauuggggauggacuguuuguacucuuaccuggggccagggacgaagacgacaccuccucaaccaauguccaugaccgggucuuacaucauucaaauucuuacuucuuccuaaguggugcucugguuuguugagauauauucagguauguuacguacaaacgucaagaguuuaacucuacacucaccuccaugaggugaagaaggcggcccccagcagcuguuucuccaucaucuucacaguccugcaagaaggucuguuuauccucacagaauauccuggaaacacauagaaaggguuacacuuugaaacaucaaaauauaacaacauacauauuacauaaugaauguuaguccuugcuggguggugguggcacacgcuuuuaaucccagagcuugggcagcagaggcaggugaaucucugaguucaagcccaggcuucucuacagagcaugccagccagggcuacagagaaacccuaucuggaaaaacaaaauaaguaaauguuaguccucaauuacugaaugucaucaauaugaucacuuccaaaguuggcauauuugucuuaaaaauucuucuugaacucugucuugaggcauuccugugcacagggacccuaggacccagaggaauuugcaugugcaauuccccucuguuagccugaaaguucugagauaauagagaguagacagugacagucgucaacgggggggggggggggggguggggggugggggggggggguguagacugugccaggcacuauacaggagaaaccugaaagugcuaccugagagguagcacacuauagucuucuaagagccuacggcuaaggguacugagggagaugagggacacgugugaauggcucacacucuuccucucauuuaauccagcuaccaagacuuggauaugcggcaggaaauagugguaugugacugugauccuaacacguggaggguagagggacgaugagugcaauguccaagaaagcaaguuugaggccagcccagguuauaugagacccuaucuaaaauaaauaaauggauguacgaauaaaaaaauaaaaaggauuacauuaaaucucuauccagauaauguucaggagggcacacacucauacacacaaauaacuucuuuuuuaagaugugaaccuacuaauagagaaaacuuccuuaugcaaacugagucuuuugaauuugauguuugacuaaucuagauuuuauaaacauuccauugaauuuuaaauuuauaccaagugccuauaucuauauucuguuucacuuugggucuaaacuacauuucuaaaucuuacuauuuuguguauuuuaaaauguucuuuaugucuucauuugcaaaugaagcaaacaguuguacucccacucccaaggcaugcugucacagcacucuuaacucacuacucacaggagcaggaauugcuggacacaauacaaaaagguuuaaaaacaaccuuugaaaaauucugaaauauggaucaaguuaauauuuuugaugcuucuucuauaccauuuuccuuccuuuuaauucucucuguaucuccuuuuguaaaaacgggaggagcugagggcacagcccaggaggaagugguuucugcaugagcagaaggacuaagucugaguccccagcacccauguacgaagcugggcacgucgaugcauugcccauaacgcagcacugacagcaaaggccaggagauggagcacacuagucagugcugccuaaacaguggccccagggucaguaagugaccuugucucaagaaauaacagagccacagaggacaacauccaacccugaccucugggcaccacacaggaaagcucacguucgugaaugugcacacacccacacaugcaugugcacacacaaagaaggagcaacugaaucuacuaugcagaaguaaucuaauucauauccaaaagaugcagugaaaauuugcaaagcuacaaugaaaaaagagcuaaauaaaccaguguggaacugugacguaucuaguagagaacgcagugcuccuccggcuacuugacucucugcaguuuucaaauacuucacaggucuacuguuguaauaaaaaagcagcuauaucucaaaauccugcauagcuucccagcaacuguuuguaaauugccuauuguaaaaccuggcagucacucaccuguaggcauagauguuguggguggcgcuggcaaucuucuuauucucguacagcuuggcaagaaccaguuucaccuucaaaaacagcaguaauagaaauaaacaaauaugccuuuuauuuucucuguaaaugcuagaaagguagaauuaaagcaauuugauauaaauuuauagcagaacaguuacuuagugaauuuauuaagcucugaagugccguaguagggcaaaccuuaguauaaacaggacagacgcgguacugcugagcaccuguuacccacagacguuuagucucuaugucuaaggcacaguauaugaaaauguguuccccagauagagaacuuuucagguaacugcauuuccagaaacuuagcucucacauuuccugaauguacacacucuaggacagggguacagcaauggcauaguccaaauguuguaaaaucacagcugccuuuaggcugccuuguggcuucacagaugaggccugagccagcucuuguuaaggggcaguuuuucugcaucgagacagguaaaggaagagacaugaagaagacacucacucggggccaaugcagggaaggagguuuggaugacuaacauaacuaaauaacaauaaaaaccuuccagucaaaacaaaaaaaaaaauguaaucaacaauaauuaaauaaauguaagaaugucccaugaacguuuauuugggacucagcuuuaacugguaucuguauguacucugucaacccgacacggaacaggaaacugagugaggaaaugcuacacacugcuguauuaagaagauaugggaaguacagcaugaacgguaaauuaggaaucaaauauaaaggcuguguggaaggaguuuggauucucccuuguacacaauggaaaucagcaaagacugcaugaggaggagaguagguggaagggagagagagagggucagauugccacaaacucucuccugcugacaggaaucuaggagucuggaaaccaaucaaugacgugaaacuuuaacgugagagggaaggugccuacuaggacugcacuagugcucuggguccaagguggggaagacggucacgcaccugcucaggacagacgacaggggccacaugagccugaaaagugcuccuucggucaguaauaggaacgccaugagcaacuggaggcaauucuucaguuucuauaaagucaaagaauuuuuuuuaaagaaaauuagcaauaaaggaaaagaacugcgauauaaauaaaauuauauggcaaaucuaagcaaacagcacaaauaacucccuaccaaaauuaaacuuuuaguaagauguucauguagguauuauauguaagagaaaaaugaaugaucuucaccugccauugcaggugaccugcuacagucagaacucaaacccugaacuccggagcaguuuaaguuggcacaguaucuacuuuuugagggaguaaaagagcuacgcaaaccaaugacugacagaugccgauaccacaacuuacuuguuucuccacauaggccaaccucuggagugggaaaucggauuugauauuguguagcuauaauacauaaugucuuccaauaaaauuauucccacuuuacauaauggaauuagacacauuaauacuauagccagucauuagcccauaaaaagugcaaugauccugucuguuauucucccuuuucaacaaguuuaaaaucacuagguagcuguuugugguggcagcagcugugcauguaccccuguagucccagcagccuuuccucugagcaccugagaggcagaggcagguauuucucugaauuugagggcaggcugcucuaccgagugaguuccaggauagccagggccacacaaagaaacccuggcuucgaaaaccaaaaaacaaacaaacgccuccaaacuuguguguguguguguguguguguguguguguguguguguguguguguguguguguuuacugagucucuaggccucccaagaacaucagcacccucuucuccucaagagaaauuaguuaggaacacaauaccugguugaguuucuucacugauuuugagguccaauguuuuaacuggauuuuccggcgggugcucuagaauagggucuucuucggacucaaccucaaccucuucaguuuucuucuugacaucugggucuauguaaaaaugagacuuuaggauugauccucaaagcaaguaugaaauuacacuuacaaaaaucacuggaauccuagcacuagggagacagaaagaggcaggcagauugugcugagucccaggccagccuaguccacauagcuaguucuaggccauacagugagaugaguuuucugucucuaaaaacaaaacaaaaaaaacaaaaacaaaaaaaaaaagaaaagaaaaaagaaaaaacccaaaagaauugggucuugaucucuacacaccauucuucaacagaaggaaucaugauuuuucuuacaaaagauuucuaagaaaugaaugaaagaaggacauaggaucccugugaguugaggaucagaugcccuggagaagaaaagucucauucuaucccugaucacuaauucuugcccuagguauuucuucaacaagguuuuggguuguuuuuuucuuuaaaauauuagaauacaacaugaugggcacaggauuuucauauguauguauacacacauauauaguacauauacauguauguguauacauauauaaauuauguauauauccuuuguguggacagauuguuuguauuggugguucuggggaucaaacccaaugcuuuguaaugcuagguacaucuccugcuacuaaccuacaucccuaguccaaaaacaauuuuaaagaaaaagauccauacaaaauuucuaagccaaagcuuuaaaguaaucuucaacacaacuucaaagucuaacgagcagaaguuaggagggagguggcgcaucccggcugaagcgaguccaguuuuucuucagagcugaaugacucuacugguccacugucaauuucuacagcuacucaacucuacaagacaagcuaucaaaauuaacuuuguuuuuggagaauuucuagagccuuucucaugcacgcucugcaugcuguaaaauuacaacauggauccaaaagucagagaaaacacuuugaaaaugcugcagaucuuagugacuuuaugucaccgcugcuuugauuguaacuaaagcaguaagaauacuugcugcuauagaaaaccugguaaaagucaucuggacacacagguaccgccaucaacgcucaauauccaaaacagucacuucucugcaaacaauccuuaucuaaaaaugcuauaaccuacaggcuccuuuauaguucuuucccauaaaacugaaaauaauuugaccaguggugacaauaaaaagcaauuuagaaacaaccccaggcuaaaugguaacagggcucuuucucucucaaaggccuuguggugaguggcaagcccagcaagggaagugaggggacuggaaggcccugcacuguccuaucucagcagcucaggaagagccugauaacgcugucauuuuuaaacuucuaaguaaaggucuauuccuucacuuagcaggguaacuaugguguaugaauuacaucucaauuuaaaagucuauuuuuaaguuauccuaauauaaaccaaaauacuuaucaagaguucuuuucugaugaauacuagauuuguuuaagacuaauaucuaauuuauauauccaauucauggggaauucuauaaaguucauaauaccuuaauaacauucaagcagaauauguuuuagaucccaauucuuuccacacaaaauucuaaauucuaagaauauaaucuauagaaaaaccuuagagaaagaaaucacuauagcuacaugaguaagugaacuuucaagagaaacuuacuuuuaugauauagaaucuauaaaucuugcugggcaugguggcacaugcccagcacucaagaggcagaagcaggcagaucucugaguucaagaccagccugaucuacagagugaguucuagggcagggcuauacagagcaaccaugucucagaaacaaccaaccaaccaacccaccuaaaaaagaaaaaaagaaagaacaaaaagaaaccacaaaccagaucacagguguucacgugucauuucaacgauauuaucuacaugaaaauguaagugcucccaauuaaaagagcacaaagagguaccacucacucucaccuggcucgguuaucugagauuucuguaucagagcaucucuuauuuucuccacccacugguaaagaauagauucacccauguuguggcuaaacaaaaucaggggcaaaagucauuauuuaagaaauguaacaacacaaauucaagacguuuacuuacauuuaaauccuaagccacuauuuuauaauaagacacaaucaugacuuuuccaaauaagagauaaaauuuaccaacacuuaugugugacuaauauauauuuuguauaccaacauuaauuaaagacuccaaaauggcucaaaaauuaauacaccuuacuuaaaacuuuagcgaacaauugcauccaaagaagagaaagaaaaugucuaaauaugaacuacaacugagacagguguagacaugacuuguuucuauccauaggugcuucagaugugugcaaucaccaccagcucuucuccacucuuuaaacaauacaaucuacuuguuuugccacaaauccuucaacaagguauauacagacuuuaucaggacauuuggaagaauuuauuuaaagagaucuaaaggauacauagcucaacaguuuuauauccguaaagaaauuuuuuuaacaaauuuagucuguugcauaauugauucauuuugguuucaaauaauguuuggcugccucugguaauuaaacucaucucaaaucacuaagcuaaggaauauguuaaaaguuaaaugauagcauaccaauaaaauaaaagaccaaguaucucacuuuuagaguggcguuguuuuagauuugauguguauuuaaagaaaugcccaaacaguacuggagagauggcucagcaauuaagagcucugacugcucuucuagggguccugaguucaauucccagcaaccacagauagcacauuacagaggcgcacaaccaucuguaauugaauccaaugaaccgguugcugucucugaagagaguggcaguguacuuacauacauaagauaaauaaaucuuuaaaaaagaaaagggggaaaaguguccaaacuaugucacagcagugccuugcugcuugccuuuaacccucaaacccacccaccgcauugguuauaacuguguuccuuuuagcacagaaguuaaugggaaagguuuuuaaagacagaauuucuuuuaaacaauauccacucuucuuugcucuggacagugcaagauccaaauguauuaaauauauacugagucccaaagacauuauauagaccagcacagcugauccucacauuucaaaacugucauuaugaagagaugagaaaacaaauuuacagagaguaguuagcuugucuaacagcuuugcuagcgauuaagaaggcucgagcugcaauaaaaucuaagaacugaaguucaaaguucaaagcacuugcguuuugcuccccuaacagugaaugauaagggcacuuaauggucuaugaaauagguuuguauggacucccaaugcauauacugcuaaagguuugucuguccuaggugaaucuucaaacuuggaggcuuaggaaaaaagcaagacucaaugaccugaaugcaugggagcccauccuuucuagcuggcaguauacaugacugccugagauccuggggcuaugguagaguaaagcacggccccuuucacaguuuuaguaaucaucuucuaaacaaaaucagagcuuuauagaguucuauguccuacucucuucaugccacaaucacauuagugacacuaacucuuccugaacaaccacuguaucaagaaguaccaaaaugcuaacuagccagucagcacucacucgcucccuuugaaauacaaagauuaucccuuuuuuuaauuagguauuuauuucauuuacauuuccaaugcuaucccaaaggucccccacacccucccugacccacucccccacccacucccacuucuugaccuuaguguuccccuguacugaggcauauaaaguuugcaagaccaaggggccucuucccugugacagccgacuaggccaucuucugcuacauaugcagcuagagacaggagcucugggguacugguuaguucauauuguuguuccaccuauaggguugcagaucccuuuagcuccuuggguacuuucucuagcuccuccauugggggcccugcguuccauccaauagcugacugugagcaucagauuuuguucucuaagacagggucuuacuguauggagcacaagcugguuuguaacucacuaucuaguccaagcuaccuugaauccauguucucuaccucaguuucagaacugggcuuacaagagaggaucacaccugacucccacacucagcauuugaaaaauaagaccuuagaagaguuucuacaauuaguaauuucccaccgcaaucaaggaaacuuaaucuuugcuucaaaugucuucucagcauggcuucccaugacgcagccaagagcacgccuacugaacuccgggcaccgcugcuucugucugcacuagcauugaaaagacagcuccuugggaauccaccacaaagaggcacagugcgcagaagcuuucuggguaaaguggagaucacucuguaucucagaccccaagucuaccacuaaaaaacauuucuuguuaacauauuauauauauauauauuugcuuucucuugcaauaagaaucuauuucuguauuuuaauuaucaacuacgauuuaguaugacucauugaaaaacaaaaaccuggucuucaaacuuuugccauucauugcucuaaugaaaggcuuuauugaaucagaagcuaauuaauugacaagagcggcaucuuccuucuuguuuaugcucucuggaucccaggaguuuguuuuucaaacuucaugacaaggugacucagcacagguucgaagcaacagggcugaucggugauacguggggggucuccaaaacuauaaccugaaauaaaccucuuuucugcaagccacaccucaaggguuuuguuugaaugggucaaagcuaaccaacuacuacugugugcuaaauaaaguauauuauaugauguuauuuaauccucacaaagauacuauccuuauucuacugugaugaaaauaaacacaagaaagucauacuauucaaaagcugauuucagaagccugaccaaaacagccuuaaugcagccuaacuaagcuucggacaggcuacuaauauuuuauaaguacacaguuaagguugugugugugcacacguguauauguguguguuccugugugugucgugcuauaugugugcauauguauguguugcuggugaccacacuuaguaccucauucaucuugauuuguaugucuguguauacagcuggagauuaaacccaguacccacccgcuugaggcaagagugcucacacugaacuagauccugcaacgcuccaucuucauuugcuuugaggcagucuuacuaugcaguccuugauauguagacuggacuaaccuugaacacacaaagcuuuauacaccucugccuuccaaguggugggucaaagguguauaacaucacaccuagcucuucaucuuuauuuuuaaaucucagauuccuagcaaaaaaaaguauauagaauauaaaaaauguuuuccaaaagauucaugcuuucuuaccuaagugcccacuaaccauaguuuaucuucuuauauaauaaacaaauauucaauuuaccauuuaaaauuauacuaaauauauacaacaguacuauauuaugaaaauauaaauauuaaaaacuauauugacagauuuguauuugauauuuuaagguuaguaauauuuugcacuuaaugcccaugacuaggauauaaaaucauuaaaaguugucacauaaaacucuaaaaaaaauccauucacauugauguuuaucaauaugaaaacacugucauuagacuguaauuucuauucaagcauuuucaauaagcaugauggacucucucuuaucuuuagagcaaucuguuuaaaacaaaaccuccgugugagguagaagaggcaagcuuuguccugugagaagcucccuuggugcacagggcucuggacucauguacaggaacgugagagccacugcagucauggcacugccuugggcaagcgcaaagugugcuagcaugauggaaacaagcaugggaagauuuuuuuaaaaagaugagcugcaagugaccaccagcuguguaauuguaugcauuauacaauuauacauauaugauuguagauauucauacauguauauacauacaacugcauacaucuauacacauauaauguauauaugcauaauuguaagcaaguggugaagacaagcugguaagcagaaguaauuggauuacaagaagcaugucagaaauacaaacgucggaauggccaguaauguuaaaacagguaucaaaaacauuuaagugauuaaagaaauaauuguguauugaggguaacagaaucacuaaguagggacccaggaaaggucuuuuaggaaggacaagugauaaggauuccaggaugacuuaccauuuucuaauuaaauauuuugggaguaaaagaaaccuggccuugaucccuggggcauaaagggggcacucucauaguaccaaacaggguggacaccuagaacauauaauagaaugcugacuaauuccuggguucagaaaaaacaaacugaugguccagaauacuacuugguuuaauaaaucauauauuucguaaauccaaaucaaucauauuuucucuugacauaucagcgucccaacaaauuucugucaucaguucuuguuacuuucuagucagucuccacagagaagcaggcucacuuuuuaucccacuacucaaacuugagccuccaacagcucucauggcuaagccagugccuacagaacucagauccuccuguccaacuuuccaggucuuuucccugccauguuggucugucucuuaccaucccauuucaugucaccauuacuaugcucuggccucucacugaaaucagugugagcuaauuaacucagcucuuagcaagcaagacagauuagaauaaacuuuuuaaaguuaauuaccaucacauugucuagcuuuguucugacaaaaguuauuacagcugcagagcuguguucacuuuuacagcgcugugauaucuuccgcuuucacacuggaaaauucuaaaggcuacagaaagggauaaucucuaguuuuucuaaaccauguguaucuaggaucuacugcacugccuaccauguaguguuugagggagggagggagggagggagggagggaaaacagugccucuguaggaucuuggucuuuuagauuaguacaagaggaccaucaaaguauugaugguuuaacaaagaaucaugguugaaauucuuccauugucauuuuacccuugauauucuaugagaauacacaagaacagcauuuguaaauuugucuucagaagccaaauaaauagugucuaacuuuaaauauuaccauauuuuucuaucaacugcacacauaaaguuaugcaacuauccuuuuaaguuugcuuaaagugaacguuuuuguuaaugaaagagccuaaaaggccagguaaaggacaagcaucagucaagaaaagcucagagcaaagccacuaggaaaacauuugugaaaagugcccugucacuuacacauauaucuccucaaggcuguucgauaagucugcgcguucuugcccuuucagccagggagcgcuaagauugaauaaaacacaguaaagaacauuagucaagaauuagguauauauuucaaauauucauuagugugguuuuucaucauucuguaaaaugcucuacaccaauguaaaagaugcuuuuaauuucuauauucauuuuaaacaaaguauuuucuauaaacacaaggacuaaauagaagauuaucuuugacagcaaaauauuuuuaaaaaaauauaaacgaaggcgcuagagaaauggaucagcaguuaagagcacuaacugcuccuccaaauauccugaguguaauucucagcagccacaugguggcucacaaccaucuguaaugggaucugaugcccucuucuggugugucugaagacagcaacaguguacucacauacauaaaguaaauacacacacacaccaauauauauaaaggagaagacaaagcuuacuucagcugauaagaaggcggugcuguacccggguacucacuuggcaacaucaccuacaaagaaguuuucaaauaaaucugaugacagcugaaaacaacuacauuuauaaagccaggcaaugaacaggguucuaacucaucuagacaaaagacaaacuauuauuuuauuuauuaucagguaaaaaauccccuccuucauauuuauaguucuacaaaaaauaugcuguuaaagaagcugucauguuucuggaaguuaauucuaugcaaagaagcuauaaaaauaugcaaguucagaugaagaaaaccgaagaugaaaaagaacugcguacaggagcucuaccuccugccaccagucaauguugaucuaucuuucguuuuacaaauauuuuucugaaaacuuaaaaugcccuaugaaauaccauuaaacauacucugcaaaacacacaucucuuuuaaaaaucaguauuaugaagccagagucagggcgcugguugguacacaucuuuaaucccagcccuugagaggaaagggcagguagauugcuaaauucaaggacagccaagacuagaucagagaaacucuaucuugaaaaaacaaagguaaaccaaaacaaauaaaaugaauaaaacuuugaaaaaaaucuauauuaugaaauauucuauaauuuucacaacuuagcauccuuuauuugaaaauauaccagucauggaauaugccacaacuaauaagacagaaagccauaacuaaucuuuucauguaucuuauuuauucuaaacacaacugaaucucuaaagaaacaaguaucugcucuaugaauuuucagucauaauuuccucaucuuaauuuccccaccuuuccaggucuaaaccuucuuuuauuguuuagaguaacaaaaagaggugacucaagacuguaaacaaaacacauguuuaauaauuagaagaauuauggcaagaaggauugcaaccaucaacaaaagcaugauuugagggugaucuguaacuaaucaaauacccacguuugcauaaucacgacaauaaucaacaaaggcaauccaaaaaccaauucauacuggaaucauaaauagacaaugaaaucaauuuuaauauauuaaguucuaaugucuggaaaauagcugcauauauauauauauauucuaauauauuuauucuauauauauauauaaguuaccuguaaacaaaguguccauuuggggucauccaugaagucagugacucuaauacaaaauauuuuggcauuuucaucaaugacacaccacuccucgccauaaauggcugccauugcuucgauuucuucacucugaaaguugauuuuaaaagucaacaaauaaacauucaaccuguucaugcuaccuuuuauagaauuaacaauuaacacagucaauccgaaaaaaacaaaaaugcaucuuaggagugucuacucuagaagcaccagugcaagcagcucgaacacacacucgagguacgcuaacccuacccaucugugccacgcccauaaccaugcugcugugucugcgaaaucucggucucaucggaccugugcaagucacaaugccgagcugagcccagggcuagcucaugugacaacucagcggagccgagcagagccgagccugcucgugugacgcagcagccgagcagggcuugcccaugugacaacucaggcgagcagagcagagccgagccgagcccagccgagccugcucauaugaugcaguagaugaacagggcuugcucaugugacaacucagccgagccgagccgagccgagccgagccgagccgagccgagccgagccgagccgagccgagccgagccgagccaagacugcucgugugacguagcagccgagcagggcuugcccaugugacaacucaggcgagcagagccgagccuagccgagccuagccgagccuagccgagcccagccgagccgagccugcucauaugaugcaguaggugaacagggcuugcucaugugacaacucagccgagccgagccgagccgagccgagccgagacugcucguaugacgcagcagccgagcagggcuugcccaugugacaacucagccgagcugagccgagccugcucgaaugagcagggcuugcccaugugacaacucagccaagccgagccaagccgagccgagccgagccgagccgacucggucgagccgagcucuugugacgcagcagcugagcagggauugcacacgugacaacucggcagagccgagugacucagcagccaagccgagcagaguuggccgcgccuguuuaugugacaaugcggcaaagcuagugcgagccugcgccuguaaagagcagccgagcggggcuugcucaguaauaacgcggccgaaugggccaggccugcucguguaacaaugcggcaaagcuagugcgggccugcucauguuaagagaugcggggcaugcucggugacaaggagaucgaacccagugacgcaacagccgagcugugccgagccaagccgagugggccgggccugcucaugugacaaugcagcaaagccugcucgugugacgcagcagccuagucggccuugcuaacaugugacaacgcagccgagcagccgaguccagugacgcagcagcugagccaagccgagugggccgggccugcucaugugacaaugcggcaaagcuagugcgagccugcucgugugacgcagcagccuaguccgccuugcuaacaugugacaacgcagccgagcagccgaguccagugacgcagcagccgagccaugccgagcccagccaagugggccgggccugcucaugugacaaugcggcaaagcuagugcugcgacaggacagaacugggccugcuacguagugugaugcuacggccuagccgggcuugcucaugcgacaucacagccaagcugagauuagccaagcagccuggccugcucaugaggcaaaaaagcuagugcugcggcaaagcuagugcugcgacagaacugggccugcuugugugaugcugcgaauagacccagcuugcuugugugacaacgcugagugacagccuugcaggaugggaaaacgcccugaggcagccugcuugaugcaaaaaaaggccacacccacgugaagcaaacacacacacuugugcgagcgaaauuaugcaccucauccacgaacacacacccuuucgcaugcccaaacacaaacacgcacuuaugagagcaaaacuaugcagcgcauucacaaugcgugugcccaaacacacacaagacagaacgcaucuuacacaccagucagccccacacccuaucaucauauucugauaaauucuuagcggaucuuuguuuuagauucuuuuguaauuuuuaauuugggaacaguagcuuuuuuuuuuuuuugguaaccauuucaaaccacuuaagaauuuauuuuaguuuauaauuaauauuaaauggagauuaauuugaaagcccaugccuuuaauacugcacaucugagcagcaggcagagcucugaguccaaaaccagcccgaaacugugaccccaggauaaccacugauaaguagaggcacuaucucaaaaucaacaacaacaaaaaaagaaucaaaaggaaaggcggggaaaggaugaccccugcugggaccuuaccugccucuggcuguucccuacuuccucuucagccauggugcucaggaucugcgacaccagcuccaaaugcccaaauccgaaagagacgacuggcaagcagcaaaugaaugcaacugcgaugcacugaugcaccggaacugacagccaacaccacccacuuccugaauugcuuccgggucaacaacccugcgugcaggcagcggcugccagcuacaggcuuucugaaaguguugggagugacguagggggagcuugcccuggguucuguuucuugcaaagucauggggcuagggccuuuugcaggccgcacugaggcuccaaugccauuagaagccaugggagaguuuggauuaccaaauugggacucucauacucauccuucaaggcagaguuuucauuuguauaguuuguucauuuuguuuuuuaaauguuuuugagggcaucucgauagauuuggguguauaaaaugaacgagagcuggagaggauugaaaaaugugagaugacuuauguuuuucacuacaguccagugauacaauguuguguuugggcacaauuuucucacacugauuauuacaauuaguguagacugggcucauugauccguuaugcaaaaaauuugaauuagauaggaucauuccaaauuuaaugcugcuuuuuacaguauugguuaugaauucuguucuaaaguagcauucaguccagacaauuccuuuguucacaaaaauguguuugccuccuuccaugucuuauaaacauucaaagcuccauaauaccuguaucuuuucucucuuucgacaucgguaaugacgguaguuguugguucccuuuaaacuuuccuuggguaaggaagugugcacugcaaagaugccuggagcuauuaauugaacguuaucuacagaacucuuacuguaccccacacugacauguaaaacaaaaaguccagcacauccuuuaagagguggaacuguugaucuuagagcauaagcacuugguguccuguucaggaaauuuuccccuaugcccauguguucaaggcucuuccccacuuucucuucuauaaguuucagugucucugguuuuauguggagguccuugauccuauuggacuugagcuuuguacaaggagauaagagaggaucaauuugcauucuucaacuuucugaccgacaguugaaccagcaccauuuguugaaaaugcuguuuuuuuuuucuacuggaugacuuuagcuucuuugucaaacaucaagugaccauagguguguggauucauuucuggauauucaauucuauauuggucuaccugccugucucuguaccaauaccaugaaguuuuucacacuauugcucuguaguacagcuugaggucaggaauggugauaaccccagaaguucuuuuauugaugaaaauaguuuggcuauccugaguuuuugguuauuccaaauuaauuugcaaauugcucuuucuaacucuaugaagaauugaguuggaauuuugauggggauuacauugaaucugcagacugcuuugaggaagauggccauuuuuacuaauuaauccugccaauccaugagcaugggagaucuuuccaucuucugaggucuucuucgauuucuuucuuaaaagacuugaaguucuuaucauacagaucuuucacuagcuugguuagagucacacaaagauauuuuauuauuucugacuauugugaaggguguccuuucccuuauuucuuucucagucuguuuaucucuugaguagaggaagaccauugauuuguuugaguuaauuuuacauccggccacuuuucugaagcuguuuaucagcugcaggccuucucugguggaauuuuuggggucacuuaaguauacuaucauaucaucugcaaauagugauauuuugacuucuuccuuuccgauuuguaucccuuugaccuucuuuuguugucuaauugcucuggcuagaacuuccaguacuauauugaauagauagggagagaguggacagccuugucuacucccugauuuuagcgggauugcuucaaguuucucuccauuuuguuugauguuggcuacugguuugcuguauauugcuuuuacuggccuugaauuccugaucuguccaagacguuuuaacaugaauggguguugaauuuuaucaaaugcuuuuucagcaucuaaugagaugauguguuuuuuuucuuugagauuguuuauauaauggauuacguugaugguuuuccauauauugaaccaucccugcaucccugggaugaagcccacuugaucguggugaaugaucauuuugauguguucuuggauucaguuggcgagaaucuuauugcauauuuuugcauggauauucauaauggaaauuggucugaagaguauggguauuaaaucuucuuugaaggucugauagaauuuugcacuaaacccaucuggcucugggcuuuuuuguuugggagccuuuuaaugacugcuuguauuucuuuaggauuaugagacuguuuagaugguuuguaugggaguacuuagaaggaggaacaaaauaaucaugggagggagagggaaggaagaacuugggaagaagagaaaggggggaggggcaaaagggggcaggaucagguaugggaggagacaggggugauguacagagagucauaaaauuguacagaguguguaacaaugggggauagggaacuggaggguagccaccagaaagucccagaugccaagaaagcaagaggcucccaggacccaacagggaugacauuagcugaaauucccaacaaaggggagggagaaccugaagagaucauauccagauguuaggcacggccuccguuugagggauagagccacccacucaucuccaaacuuuuaacccagaauugcuccuguaaggaaauacagggacaaagaguggagcagagacugaaggaaaggguauccagagagugcccuaccuggggauccaucccauaugcagacaccaaacccagacacuauugcugaagugcuugcugacagaagccugauauagcugauuccugagaggcucugccagugccugaccaauacaggggcaaaggcuuacagccaaccaucaaacugaucauggggaccccaauggaggaguuaggggaaggacugaaggagcugaagggguuugcagccccauagaaagaacauaggaagaacaacaauaucaaccaaccagaccccccagagcucccagggacuaaaccaccaacuaaaaaguacauauggggggaccaauggcuccagcugcauauguagcagaggauggccuugucaggcauccgugggaggggaggcccuugguccugugaaggcucaaugccccaguauaugcagggcagugagaugggaguggcuggguggugaggaugcacccucauagaagcagggggagggaggauaggauggguuugcggaggggaaaucagaaaaaaggauaacauuugaaauguaaguaaggaaaauauucaauaaaaaaauaauaaagaaguugaauuguaaaugguagggacaauacauagcuuuuaucccagcucucaggaggcagagacaggaggaucucugaguaugaggccacccuggucuauacagugaauuccaggcucaacgaggcuauuauauagugaggcaaaauugagucaacuguaaaaauggaccaaaaaaaaaaaaauagaacuguuaguguacaagcauuccccuggccuccucccagggaccuagcugaggauaaaagggcccccagcuacacagacauuucucucugucucucccuccccccauucucuguuguuuccuaugugucucucugaucccucugcauucucuccugugucucucucucccuuuucugcucuaugucucccugccagucaaccucucucucucccuacucccaauaaaccucuuauaccagaucuguuauauagcauaauuucucaaagguagaccuuggcacagcccaacaaaagcaccuacccuuguuccaaauuuuuauccuaucaagagugacaggcuugacuaaaguccugucuauccagggacucuaccucacugaaauggaucuucaagugcuggaaaaccaacacacagagaacugggguguucauucaaugguagagcacuugccuugcaugcaaagggcacuugaguuaaauccucagugccauccauucacaaaaaacagucuugccggguguggugguguaugccuuuaaucccagcacucuggggcaggggcagguggauuucugaguucgaggccagccuggucuacaaagugaguuccaggacagccagggcuacacagagaaacucugucucgaaaaaagauuuaaaaaaaaaaaaaaaaacaacaaaaaaaacagucuugaccuucuaaauaaaauauagcaagucauagucucucagcagcaacccaguaucacacuccauaucaauucccacuuccuaauaguugcagucuuuaagucuuuucuugaacuuugauuguaaacagaaaugaccuuuugugcugagaacaggugaauacaaaaacauucaaacaaacccuuccucguuuuuuuagaccuguuuaacagugugaccacagaaaacccuaaauaacguaccagacugaaggacauaauacuuugggaaaaguaacuagauaauuacuaacgaguaauaaauguagcagacaaccuauacuuuggaaaguguacuagaaaaaauucaguaaauaauuaguuaaaaaaauacuucaagcaaaggccugagcagaggcuuuugagguucugaagacaauccuagacacaggcagaaucuguaggccuggggcugcucauuucuacaccugcuuacucaagggacuguagggucuccccuuaaugcauauaaagccaaucugaauagcuuuuuucaaucuuaguauucccccuaaccuuuccaacucaauaccuggccacuuugaaaaccuuaaacauugcuguaagcuugaaccuugaggaauaccuucuuccucuuucuucucaccuccauauaacaaggugacaaguccugaugacucuuauucacuagcaugacucauguugacuuauuauccaccuuucuaguguaugaugccaucuggacucauccacuguagucauucugcuuuucuuuucuuuucuuuuuaagauuuauucacuguagaauuuauucacauucugaucucaucuuucucuccuugaagcccuuuacuagccccagcuuucacauucaugcuucaacaccuuaacucaccaggaauauucauagccaccucucuaauuucaucucccaaaguuucagcuacaacaguuucauuuaguuuauuucaagaacucuauaacuucagaaaaacauaaaugcuuuuauuuuacacaauagacaccugaaggaaauugaaccaagauauggcuagagucaaggacaggugaucuauuuaaauauaaauagacagccaagugauuaaagugguagcacagaaguccuaagaugcacacugccaacuccaucaaagacaauggcugacuguaccugaaugucucaggacaaaggacuuuggagccuggcauuguuaggaguggcuuaaaucuuuuugcuuaagauugagaaacaaacaucauauacuguguuaaacaaaacaaaaaagaccagcugcaccaaaaauguuucagaaguugagccuauuauccucguggagaagaaucuacgaguucuauauccagaucugcaggacucaggaagagagagccacugggccuggcuucagauuuuaaacccucaaugugacauuuccuccaacaaggucacaacuccuaauccuugucaagagugccacuuccugauaacuaaacauucaaauauauugagccuauaaggggccauuuuuauucaaaccaccacauuccacucccuacuccccaugggcuuguugccauugcauaaugcaaaaauggauacagucuaaccucaaaaguccucagagccuauugcagucucaacacuguuuuaaaguucaaacucuuuucugagacucaaggcaaucuccuaacuguaacccccugagaaaucaaaaagcagaucacauacuucccccacacagugacacaauauauacauuaccauuccaaaaaggaggguaggaucauagugaggggauacuggaacacagcaagagcaaaaacuagcugggcaaacuccacacugaaucucccugccuaaugacaaagcaugcauuagauauccaacuccuuucagcuuuguugaccucaauaagggacaugcaaguauuggaacaaggaguucauaguugugguuauuaaaggcaaggggcugaaaaaggauuggcaugaaauagagagccugaaauugugcuaaugccacugcagcacaguuggguaacacauggauagggcauuaaagccaugaaguaugccccauggaccuauuuugaggguuuguguagauagagcgagcucuuccaacccuaugcccuuuugaaaauguuccuuuuuuauacauguguauauguauaaauguguguuaaugcauguguaccacaugccuacaggagcacaaagaguugcuguggaacuggaguuauaacuggcugugagcuaccauaaaggugcuagagacugagccuguguucucugaaagaacagcaaauguucuuaacugcugagccaucucuccagucccuccauaccccuuuuaaacaaaguaaugucuacaaaccaagaacaucaucucaucugagaaagcuuauuagaaauacugaaacuuggcccuguugauuuguauuuaagacuuucagagauguuuaugcacauuacaaucuuagaacccuguaugcugaccaaggucuuagacaaggaggguaauaggccauauacacugggcucuaagaucucacuguguuugcaccaugccuucucaagggcugcucucacacaagacauggaucuaugcagauaaguuuguuuuggggagauguaaaaccucucugauuggggacuggggauucaggccuugcugcacuucccagagacuuuacacaaacgucaucuuucuuguuuucaaauuauucacugugauauauguauccauuuguguaucugaauccuuuuaauccccacaccccuuuuuugucucugggcuacuucagagcuguuuaccauuuuaucagauacuucuuccucuaauaaaaugcucacacguucaaauuuauuuugcagucuucaucuagagcaguaauuugcagucuuccuaacccugugacccuuuaauacaguuucucauguuguggugaccuccaaccauaaaauuauuuucauugcugcuucauaaauguaacuuugcuaauguuacaaauuuacuguuguaaauaccuguguuuuccaguggucuugggggaguccuaugggagggucguucaacccccucccauaugguccugacccacagguugagaaccagucaucuagaguccacuguauaauacacacuaacaggucaauucuauuccuguaauaaagcuauuucacugggagaccacuaggcucuugucuuacccuuacuguugcugugaugcacaaugaccacagcagccuaggaaggaagccuuauuuggcucacacuccacaucacugugcuucacugaauccaaucaagacaggaacucaaacaggacaggaaccuggaggcaugagcugacccagagauaagagccacugccuguaagcaagcugcugcuuacuggcuugcuccccauggcuuacuaagcaugcuuucuaauagaacccaggaccaccagccccaaguggacacaauucacauugagcuggucccucucccuuccaucacuaagaauaugacuuauuggaaucuucauaaauucauaaaacuucagcacaacuggcccauugucaauuugacaaacacaucacuguuaacaaaccuuuccuuucucauucacccccaagaucucacauucaaaauguaaauaacuuuuuaaaaucccaacaguuuuuucuaauucaaacacauuaaaaguugaguccccuggucuacagagugaguuccaggacagccagggcuauacagagaaacccugucccgaaaaaccacaaaaacaaaaacaacaacaaaaaacaacaacaaaaacccaaacaaacaaaaaacagcaacaacaacaacaaaguugaguccgucagggcuggagaaaugacucagagguuaagagcacagacugcucuuccagagguccugaguucaauucccaacaaccacaugauggcucacaaccaucuguaauggaauccaauacccucuuccggugugucugaaggaagcuacaguguacucacauacauaaaauaaaucuuuaaaaaaaaaaguugaaccccucuaaaauggccaaaaaauucaaaaucuuucaacuguggacucuuacaaaauacaaaauaaacaauuuacuucaacacuauaaacaacucaugucaaauuaucugggauccacucacaaucuacugggauacuccaaggggcuugggucauuucuccagcucuacacucugcagcacacacaacuuguauucugggcuccggcugccuccacuccacugcucugcuguucuugguggucaucccaugguacuggcaucuccaaacugcaggggucucuugcuacaucagggcugcgcuuucaccaauggccucuccugggcucuccucaggaacuccagcccuacaauguaacguacaagccucagcugcucuucaggaucccuucaugccucaaaaccaguuccaccugggugacucuuaacuauccagcucacaugccagcacaugguacaaccuuagccaccucuggaacacagcguaugugugccgacucucaggaaacagaaaacacuucccaggagaaucugacacaaugaucugcuugcuucuuaaucacugcuaacuuuucagccccaucgaaccagcaucaaccgucccaguaacucaaaaggucucacuucaguggugccaggcucuucuuaauuauggcugacucuucagccccagcugacccgauaccacaggcuuuucacauaaauggccugguagagucuuugcuucccucggaaccuucgcaagccaggccuccaucgucuacagugaucccaacauucuugucuuccaagauccuuccuauagcucuccgagcucucaacacucaauggcucuucuagcccaaagucccaaaguccuuccauaguccucccagaaacaugaccaggucugucagagccacgucccacagccacgucccaccuugucuuaguuaggguuacuauggcuaauaugaaacuccaugaccaaagcagcuugggaaggaaaggaugcauuuggcuuacacuuccauaucacuguucaucaucggaggaagucaggacagaaacuuaaacagggcaggaucccucaagggaggagcugaugcagaggccauggaggggugcugcuuacuggcuugcuuuauguggcuuguucaaccugcuuucuuauagaacgcaggaccaucagcccagagaaggcaagaaccacaacagucugaggccuuucccuucagucacuaauuaacaaaaugucccacaggccugccuacaacccgaucuuggagggauuuuuuuuuuuaacauugaggcucccuccucucagaugacucuagguugugucacguugacauaauacuauagagcacaauucuaucgucucaugcuccuuuagaagcaacugagcccaauucaauguaaacuuaaccaaucagaaacuaccagcugagagacuaugcuaggugcugcuaacuacccaaugagggacuucccacuauaaccaaugaaguauccccucuuagcagcacacaaaccuauccgaggucaggugcuguccagugcacggagagcagaauguuuaugaaaugacuaugucauuuguguuugauuagacaguucucagcccucuaccacucuccucccaccaacaguuaagucugcuuugucaauacauuuugagauuuccauggccuuggcca

SEQ ID NO: 46 - RNA, 73441 nt, Mus musculus
ucuguauuugucaggcucuggcagggggaggcucacauuugaugucuuuuuuccuuuaaaauggaaaaauagucagguaagauagugcacaccuuucauucuagcacuugggaggcagaagcaggaguucuaggccaacuugcuccacauaguagcuuccauuugccucugccucccagacugcuggugggauaaaggcuggccuugagcucuccaucaccgucucuaccucaccacauugccacuuccagauuucuuuuugagagcuacguagagcaugauuuacauaguggcuucuaggcugguuaggacuauauaguaagagccugucucaaagaagguggggguagauagccugucuuaguucaaauauaaaugggucauauuuucaugugugugcaugaaugauuuucaugucucucuaaguuguuggauuuagccuauugacaauugauuacacuauauauucuagggagauguucacugaucagaacccacaagcugaccaagaccuggaagaaacugaaucagguaucuuucuugcccuuuggauuguuauugaagucacacauuucauccuugcagccugacauacauacagggaauuuaaaggcacuggaagccaggucuaggguacacaccuuuaagccuagcacuccagcacucagagaggcaacugacaaguaucugugacuucaaggccaacauggucuacauaacaaguucuaggcaagcuagggcuaaauagugagacccuaccaaauaaauaacuaaccaaauaauaaauaagacaauggagggauaaucaggauguagcucacuaguuauaguacuugccuugcaugaaugagguccuugguuagaguccuuaguacuacaaaagccgaguaugaugcaaucccaguauccaggagacagaaggcacccuaucccauuccgaggauggucuaggcaaucaaagaacaucaaggguaaggaagagacacaaauggucacuguucccacagauuacacuguacuuuggccacaagggaggacucuagcucaaggacugucccugguguccuuucccacucagacauccccagauaagcagccccuccucuccccuuuguuaacaaaccaaguccaaggcucuugaaucuggccaaggaggagccccagcaggcugguucagcugagaucccuggggaguagauaagguuuucaccuguaggaaccagauugugaguaauaguuaucaagaaaaaaaagaaaugagaccuugaaggaacugggaggaucugaagcaguacaaguuuauaggguccuaauguucagaucgcacuaaacuguacugcugccccuggagccagaaucccugaagcuacaaucacagugaaggaguagaagcuagggaagagcugagcagccaauccacagccaguccuacuucugagauccuaccucuuaggcucugacuuuccagaacaauugagcucugagaauauagaauagacccacggucucgaacacucuccaggacuuggcagaacggagggggaaaaacaagaacaacaacaacaacaaaaaacagugucuccuauaaagaacuaaaaccauguggcucaguaguuaaaagcucauauugcucuuacagaggaggacccaagcuugauccccagcaccugugucaagcugcucacaaucaccuauaauuucaucuccaggagacccaauuccuaucaccccuguaggcacuagcacuuguauaaauuaaauaaaagacacacaacuguuuuuaaaaagauuuauuuauuauuauaucuaaguauacuauagcugucuucagaugcaccagaaaagggcgucagaucucauuacgggugguugcaagccaccaugugguugcugggauuugaacucaggaccuuuggaagagcagucagugcucuuaacuacugagccaucucucuagcccaacauacaacuuuuaucauuuacaguaaaccuuaaacagcucaagagcugggcagauauagcacucaugugacacagagacauauaauuuuuaaaauaauaauaaaauaccaugaacauuuuccuggaaagaagugagguaaauaguuauuggcuaagcuuggcauuaaguagaacugacguuuaguaaucaaaucagugcaauuucuuuauaaguuuucuuaaaacuuucacauuucacacaaaggaaaaggauuuuguaguuucuguagugccuucugucuuucacagcgucaaaacuauaguuuacaaagcaaaccaaugacaacauccauagguaaagaaggaaacagacauuuaacuguuuagcauugcuuguauuggcaaguacucuuacacguaugcacccucacagguuugacagcaugcaacuuaaccagcugcaucuccagccccauacugccuuuucacguaggcaucuaauauagcugaaacacugauguuugcccuuuaauauaagcaaucagcuggauggcgguagcacacaccuuuaaugccagugcucaggagauagaggcaggcagaucucucugaguucaaagucugccuggucuacaaaggagguuccaggacggccagggccauuacacagaaaaaccucccaaacaacaaaacacagagagagaaucgauaagacuugguagaccuuggaaggccccuuuucuaaagauguucacgagggaggcauuacugaaaaauagagaauaauugaaaaccuuucuuccacagauggugccaugaacccaacugauuaagcaggcaggcagaaacgugucaccaucagcuaccauugugcccucaugcauaaaugaaguccugauggaaaacagacaaacaaacaaacaaacaaacaucucuacacacuaagccgaaaacaaaucuauaccaaacugcuaaaauaaauggaaaauacuuaauuugagccuggcuguuuugaaaauuggaaauccuucuucaaaaugaaaaucaccgcaaaacaaucuaaagucaucuacaggccaacuaggguguuuguugcuugccaaacuuccaauaaauucugcuugaaaccuuugcguuucugugucacuguuucucacuaccccuuccuugucaugcuaauuaugcuaauuaccucguuuuuuccuuuccuuuccuuuuugguuugguuugguuuugguuugguugguuaguugguuuuuagagacaaggcuucucuguguagcccuggcuguccuggaacucacuuuguagaccaggcuggccucgaacucagaaauucaccugccucugccucccgagugcugggauuaaagacaugcaccaucaugacuagcuuuuuuccuuuuuuuuuuucuuuucuucuucuuccccccccccgagacaggguuucucuauauaguccuggcuguccuggaacucacucuguagaccaggcuggccucgaacucagaaauccaccugccucugccuuccaagugcugggauuaaaggcgugcgccaccaugcccggcgaccagcuuuuuucccuuucuuaaaauguagucugggaugcugcuggcucaugccuuuaaucccagcacuccagaggcaaaagaggcaaaaaccugugggucuuuaaauuaaaagccagcugcucauagugaguuccaguucaggacuacauagugagauccugucucaaaauaaacuuuaauuaguuuaguugaguagauuaauuucuuauauuuucuguugcuuuuguuaagugugcugagaacacaaacacuauaacaauauaaaaaacaaaacuauuaaagaucuggucauuagcuccgguggguaauuuuuuauuugcaaguuuuuuuauaguaaagguuuuuuuuuauuuucaaugcuaucccaaaaguccgccauacccaccccccccaauccacuacccacccacucccccguuuuggcccugggguuccccuguacuggggcauauacaguuugcaaguccaaugggccucucuuugcagugauggccgacuaggccaucuuuugauacauaugcagcuagagucaagagcuccgggguagugguuaguucauaauguuguuccaucuauaggguugcaguucccuuuagcuccuuggguaauuucucuagcuccuccauugggggccgugugacccauccaauagcuaacugugaucauccacuucuguguuugcuaggccccguuuuuuuuuuuaauuagguauuuuccucauuuacauuuccaaugcuauccaaaaagucccccauacccuuccccccacucccacuuuuuggcccuggcguuccccuguacuggggcauauaaaguuugcauguccaaugggccucucuuuccagugauggccgacuaggccaucuuuugauacauaugcagcuagagucacgagcucugggggguacugguuaguucauauuguuguuccaccuauaggguugcagaucccuuuagcuccuuggguacuuucuuuagcuccuccauuggaggcccugugauccauccaauagcugacugugagcauccacuuauauguuugcuaggcccaggcgaagucucacuagagacagcuauaucaggguccuucuagcaaaaucuugcuaguguaugcaauggugucagcguuuggaggcugauuaugggauggaucccuggauauggcagucucuagauguuccauccuuuuguaucagcuccaaacuuugucucuguaacuccuuccaguaaagguuuuuuuuaaagauuuauuuauuauaucuaaguacacuguagcugucuucagacacaccagaagagggcaucagaucucauuacagaugguugugagccacuaugagguuccugggaauugaacucaggaccucuggaagagcagucagugcucuuaaccacugagccaucucuccagccccuauaauaaaguuuuaauuuuaaaaaagaagauacuuuaagaaguuagaaaaaaaugaagagugcauugcaaucacucuugccuuaccaauuagaaguauuuuuccagaucacgucaccaauuauaaaaauagaaaucauugugcuugcuguuuuacaauaaauauucaaacaucuaaacuuuaaaaaugaauaagucuggugaggggaaauugcuggagugagguaccucggugaguggcugaaccagugagggaucuucauuauuuguaaauuccaaauuuuaaaaauuuuauuuauuuuuauuccaugugcauugaugcuuuuuugccugcauccauaucugugugaugguauaggaucccuuagagcugaaguuacagacagcugugaucuguaugugguuguugguaauugaaacuggguucucuggaccucuggaagagcagccagugcucuuaaccucuaagccaucucucuagcccccaaauucugaauuuuuaaauauccauauaguaaaucucugauuucguugcaaacaaacaaacagugguuuauaggaaagggcuuuuauuccuuaucagcaauuaaacagucaaggguugguuugggguggggugggggcugggggcuuaagcuguucuaaaccaagugaugguucagcacauuuacuuuuugaacucugacaugaggagcucuugccuuacaugguacaguuaaaucuccuuacuacaagccgggcgugguggcaugguggcgcaugccuuuaaucccagcacucgggaggcagaggcaggcagauuucugaguucgaggccagccuggucuacaaagugaguuccaggacagccagggauacacagagaaacccugucucgaaaaacccaccaaaacaaaaaaaucuucuuacuauaaauggguagaguaugcccggccccuuucuuccugaaucagaaaacagcuggaaccaaguaaacaccaguuuuucuacuuccuuccuuuucucacuuuguaaucuucuauuguuccaucuaucugggggacuguuacucagccgaugccgugaugcggaagaaacuugaaguacuacaauugauauuauaaaggauuuucuacuagacuugcuuaggagacauuaaugcacacaaaguagaauuuagcaaggaacugcugccuccaaacguaugagcuguggagucaugacuagcuucaccuagauuucaaaggauuccuccaugaguuuugagagccaagcagagaaccagaggaaggcugauauaaagucucuaccagcacagugcuuagcgacuuuugcccagagaauagacccccaaugagagcaaugcccaaaagagcuaugaaaacacugcucucaguuaugacgccagagcuauagagccaccaguaugcaaaaacagcuugggagaggugccagcaacugguuccgacugacaagaagugcugugucagcgugccuagcgaggcaagcuuagagcccugugaacccaaauggcgcuccgugugucuagaggcagaacuuggagccaaaguuugcucuugagccuuaagaugaaguauuaccauguuggggugcugcuccucaggggacuuauauucaguccccagaugucucaaaauucccuguaacucuagcuccaagcgauccaauacucucuucuggcauacuccagcaacccacccccuguacugauaaauacaaguaaaaaucuuaaaacuauauuuauaaagagagaggggagagagagcaauggcaucuagacccugggauccauccccucuuaggggaauauguugguguacauaccuuuaaucccagcagucaaaauacagaggcaggugaaucucugauuuagaugccagccuggucuaccugaugaauuccaggccaaucaggcuacauagugauagacugucucaaacaacacaacacaacacaacacaacacaacaccaacaaaaccuuccccuauugggaggagcugauguuaccccaccccucccuggggggucuauaguuggugagaaagggagagaagaucugaguguguaacuacuuguagggaguccauucuccuacaaauaauccccucacccaggacucugaaagcaacuguaaugaaacacuuuggagcacgugcgcacacagaacgaacucuugcccugccaugucuggggcuuauuuggcguaauuuaucccuuucuucuuuccuauuucugacuuuuggaauaaguaugucuaccuaaugucugucucaaaguugugguuuuagacuuuuuaaagauauuuuuugcuuguuauuauuagugugugugcaugcacacaucaugaguagggugaucagauggugcacggcuuuuguccuaccacucaggagguagagucaggaggaucuuugugaguucgaggucagccugacuccagaauuccaggauagccagaacuacaccgaaaaaccuugccucaaaaccaaaaccaaccgaacaaaaacaacaagaaagauaaggccuuuuuggauguauuugguaaugccuccaugacucgauuacugucccuguccuuguaagaacagcuaaaaguacacuccugguugugucuuuugcucuuccauuucuucugucuugugagagaagcaccucuguggaaacagggaucaucugcauggcaugaaaucugcuaucacuuucuaccuucuagcacgugaaaagucagugggcuauuuuugaauuaucguucuggacauuuuguccuggcaguaauaaagaguacaauacagcagauaucugaauuucuuucuuaaaaaaaaaaaaacuauuuuuuuccugaguacacuguagcugucuucagacacaccagaagaaggcauuagaucccauuacagaugguugugugguugcugggaauugaauucagguccucuggaagagcagucaaugcucuuaaccgcugagccaucuguccacccccaucccccuuuuuaaaaauauuuauuuaucuuuauuuuaugugcuuggguguuuuggcugccauaccuagguaccauaucugugcaguguccacagaagccagaagaaggugucaauguccccuaagaacuggaauuauagaugguuguaagccaccauguaggugcugggaauuggacucaggaccucuagaagagcagucaguacucuuuguuuuguuuuguuuuuucgagacaggguuucucuguguagcccuggcuguccuggaacucacuuuguagaccaggcuggccucgaacucagaaaucugccugccucugccucccaagugcugggauuaaaggcgugugccaccacgcucagcaaaacuagaguuuucuuuaaaaaggaucuaacacaguaucauuaacuguagugccugugcuauguauacauuagaucuguaaaacuuauuuaucuugcauaucagcuauuuguaucuuuuuaauuaguguauacuauuuguacaaaguaaagauuucauuaacuauuuccauaaugcauauaacauaauugcauauucaccccucuauuacucuuuuuuaucccuccuacuuuuccucauaguuugguaaaaaccaguccagcaacuaauaaauaaguuggugacuaucuggaucuguuugguuguacacucaaucagccuaucacucagcauuuuguauaauggcagacacuaucuucaaacacuuaccuaccucgcauuuccugacacuuaacacauggaaaaacagcaaauucuagacuuuagcuaaacauugcaacacuucagaaguuucuagcuaaccaacaauagucagaugauaaacagcucaauugauuuuagcauuauuugaguugagaaguaaugucuuuaaaaggaaccugccaggugugguggggggaggaagauggcucuuucugaguuccaggcuaguugaggcuguaucgugagacucuaccucaaaaauaaauagcuagcagauaaaaacaugccuuuaaaaauacuaaagauaaaaaagaaagagacagaaaggaaggaagagauacagacagagacagagacagagacagagacagagacagagacagagacagaaagaaaaagugccaggcagugauggcacaggccuucaaucccagcacuugggaggcagaggcaggcaaaucucugugaguucgaggccagccuggucuacagggagaguuccagaauagugagggcuguuacauagaaaaaaaugugucuccaauaaguagguaaguaaguaaguaaguaaguaaauaaauaaauaaauaaaaauaagcaaacagauaaagauauauguucuuuguucccgaauuuuauauugucugcuuagcacagauacgauacuucuuaauuauauuuuugacugucuaaaaaauaaaauuucuuuuaaaaucuuucuuuccaaguaaagcuacuacuugaauauuguaagagguuauuacuucaugacuuuuacaucauauacauagaagaugaggucacgaauuuaucaccaugcuugguuguuauucuccuuuucuuuauuucuuuacuuauuauuuagaaaaacagucauaaucuggccaucuuuuccaggcuggcuucaaacuccuaauucuucugucucaaaguccucaguucugggauuacagauauucaucacaauauucauauauaacacaaacacacacucagcugaagguagaauucuuauuucuauuuuauuugguuuucauuuuguuuuguuucauuuugccauuuugugauuuguguuuuugagacagggucuuuuugucgugguccuggaugaacuggaacucauauuuuagaccagauuggauuuaaauucagaguucugccugcuucugccuccaaaugcugggaucaaaggcauguucuaccaugcgccuaccauauuuuaauuuuauucgcuugcaugugugcgugugccuguaugugugugcgcacgcacauaucuguacgcaugcgcaaaaugugugugugugugugugugugugugugugugugugugugucugugcgcacgcgugugugcauguguguguguucaugcgugcgcacguguacccgugcguccacacuccgccagcacgugugcuagcuugcaaguuuucaguuugaguacagacaccaggccauagcccaauggcagcagugacagggaggaccguggcagcauguaacaaucagaagacaacuuccggauuuucacucuguccuaaaaagguaaaacgcuuaagcucacuuuuguagaaaagaugcggugauuuaugccuacaccugacuuuauuacuuaugucuauacauguuugcuuuuuacugugaauuuaauagaaaggagaaaguugaggcucugucugggcaauagucuuuuguuucacacaugcuacaggguuaccuagacaccaaguguuuucuugcucaguaaagauaauuuacuuuguuuucaaaaagccuccaaguagggauguuuaagcgucuguuuuucuccuaaggccuacuaugguguuccaguguaguauaauuugugguauaaauuguaaaugauugccauuucucuggagguuauuucuuaucaagaauuccagcaggaggaagugugcagacucuucuuucccacugucaugggagucucugggaccuauuagucuuuuuucuuucucuucauuucuuucuuucuuuccuuccuuccuuuuuuccuugcuuuuuuucccccccagagacaggguuucucuguauagcccugguuguccuugaacucucucucucuguagaucaggacgguuuugaacucagugauccuccugccucugccucuugggugcuaggauuauagguguacaucacuaugguccauuugucuucuuaaagguaguguugugggccagucacuguccacuagcccuccacucaaccuuccuuucacuuccguuacacuucaggaucaguccaggaacaauagagacagauacuccuccucccaccccacccaccagccggggcaccugaccacugaaggacacaaaaaacgaguucaaccagacccacaccuuuaaauuccagcacuugggagacggaaacauuucccucccaccuacaguggaaagaccuauuccaagagacagagacucgagaaauuuuacuugucuuguucguaaacaagcauggaaugaccuaucuaacuugucaucugacaaaacaccgaagcaaauugcauuaagccagacuuucaaaaauacuuuagacauuuagucuugcauuuaguuacaauuaauuuauuuagucuugcaugacccaggugagccuugacacgucgaauacauggugaaaauuugugucaacuuuguguguguguguguguuuugguuuaguuugguuuuugaaacagggucuuauguagcccaggcuagccucaaacuccugauccucuuaucuggaucaaaauucuacaauuuguaauuuucacacuuacaaagaaagaagaaaacuuuuaaauguauuuauugugugugcuuguguuugugauguacgcgcacucaugugugugagcuagugcaugcaugaagaggcuguuaccgugucugccuguuugccuuguuaauccuccagucucugcuagccucagugcuggacuuauagggaugcaugggcccacacuuagcuuauuauauaaaaguguuaggacucaaacugugguguucaggcuuccuccggaaagcacuuugaaucauugagccaucuuuccaguccucagaauuuucuuaagugaaguugugugauauuuagguuuaauauccauuauuuaagucacuuaugauaguugauguuuuguuuuguuuuuuguuuuuuuguuuuuguuuugagacagguucucacucuguaucccagacuggccucuaacugaugauguaagcgcaugcugauguugaagucauaguaaucacccugcccucccucucucucucuccugaacaugggcauuacaggcacgagacaacacaccuagguucaacuuuuuuaauuuaaaaaaaaaaaugcagccgggcagugguggcgcaugccuuuaaucccagcacuugggaggcagaggcagguggauuucugaguucgaggccagccuggucuacagagugaguuccaggacagccagggcuauacagagaaacccugucucgaaaaaccaaaaaaaaaaaaaaaaaaaaaaaaaaaagaaaagaaaagaaagaaaagaaaaaagaaaggaagaaaaagaaacuguggcaugaaaguuagaaagauguuuuaguuuuuaguuugcuuucuauuacugugauaaaacauucuaaccaaaaauacauuggguaggaaaggauuuaucuggcuuguacuuccacaucacaguagaaauuagggcaggaaccacaaaggacagcuuccuggcuugcuccccauggcuugcucacuuugcuuuuucauaccucccaggaccaccuguccauggguggcuccacccacaugguuuaaguggacugcccccccccccagucgaucguuaaccgagaaaaugucccacagauuuacucacaggccaagcugagcacaggguaccauuuuuuuuauuuggcuaauuaacuuucugauuggaguugaggcucacuugcuaggagaaaguucaugccuugucaaaagccucuagcuggggagaccauaggcucuaauggagaagcuuuaccacuauugccucccuagcuggccaccuuaugacuaucaaauugucuucuaaccauguauguuuauaccuguagauuugugcuacugucagcuuugguaagacuaguuucuguucgugcagacuuuuagcucugagucauaagaauaugugauuggcugggcgugccuuuaaucccagcacucgggaggcagaggcaggcagauuucugaguucgaggccagccuggucuacagagugaguuccaggacagccagagcuacacagagaaacccuaucucaaaaaaacaaacaaacaaacaaacaaacaaaaaagaauaugugauugugugauuguugaagaucagcccuaaugggaucugcaucuccucccuugcaagguucaagaaacaccacagcaaagagggcagaaagguaaagcuggaagaagggaugggguauuguggaacauacagcagcagucauacucauaaacucacagcaccuaugauuacccuacccaaggccuguguauacaaggggacccccacauuccuuaggauguguaggaaguuaacaguugcuacaagaggcucacaaggccucaucccuccccgaggaggcaguuaacagugucuagacguaagggaccaagaugccucauuccucccugcagaagggguauuaguaguuauuguuugcugagggaguugggagggggggauacuuucuucgguaagaaucugccauguuccuguaaauaacccuucauccaugcuauagaagaaaccagaaaucagaagugugugagcagaguaaggggaucaguaaaagugagagggagaaaaaaagagaguaaugggagugaauaggaacaaaaucuuacguguaugugauguuauaauggcacucauauuguauagaauauacccuaauaaaauguaaaggguuuuagcugcuacuguggcucauucauguaauccuagcacuugagaggaugguuaugaguuugaggccaggcugagcuacauagugaguuucaagcagcccuuaaaggauuuuugcuggaaauugcaccuuaugccuauaaucccagaacuauagcaacugagggaggcagacuccaaauucaagguaagcccaggcuaaagaugaggcccuauuaaaacagaugaacaaacaaacaaaaaaaucuagguuuuguguucuggagaggcaaaaugaaaaccaauaccuuauccugcucuguguaaaaugugacguuugguuucccccaagguccauuggacaagagcuguucuuuuucaggauuauuuuggcuguucaugggucuucacgcaucuauauguauuuuauaguuauuuuugcuacuuccaaaauacaaaaagaaaacaaacaaaaacccauugggagugcgauagauauugauugacucuacagaucacuuugaacagaaguaguauuuuaacaauauuaaauguucuagucagagcaauuaucucagauuauuuuuuguuauagcaacauuccucaaccuagauuaagucaugaauaguaaagauaaauuuaggucacaauucuggaaacagagacauucaagacugugcuggccaggauuuucucaguuucugguuggaagcaguguuaacucauaggagaguugugguagggaaacaucuauuuuguccaguauaauauaugcacaagagcuaucagguagaugcuaggaucauuuuauagcaaccucuucuuaaaauccaagaacucagcuaggcucuugagaaauuaauuaaacccucuuaaagaugccaccacauuucagcaccaagacaacauacaaguugcuaggaguaaaccauauauuuaaacuauaacaccaaguuugcuguaguggcuugcaccuuuaaucccaggacucaaaggcagaggcagacagaucuuaaauaaauugguagccagccuggucuacauaguaauuuccaagccagccagggcuguaucaaacaaaaacucaggucuucaaacuugggggcaaguguuuguaauugcucagccaucucaguggcccucaauucacuuuuauauacucauuuuguauccuauaacuuuacagcugaauuaccugaguuguaugguguguguguauguguguguguguguguguguauguguguguagacuuucguaagucccccacauaaauaaucauggcauuugugagcagaguacuccagucaguuacaauucagauauuaaaaaaaaaaaaaguaauaaaguaaaacagggucuuuagcccaggguaacguugaauugugauccucuagcuucuacguccugaguaucagggucauaggcuuguaccacuauugggauugcacauagggcuuuaugcauucuagagaaaagcauucuacagacugugguacagucccagcccuggauuccuuuucuuccccaacuguucugcacaggaccaucaauucuauuaggauuggaaucuaagagagcaaacauucuugguuccuucaucuuauuaaagggaaagcacucaauuuuucaccauugaccauguuagcugugggcuuuuucaauguggcccuuauguacucagacaauuuccuccuauuccugguuuaccgagaguuuuuaaucaugaguacacugaguuuuuccaaguguuuuuuuuuuaauuuauuuauuuguuauauguaaguacacuguagcugucuucagaugcaccagaagaaggcaucagaucucauuauggaugguugugagccaccaugugguugcugggauuugaacucacgaccuucagaagagcaguuggugcucuuaaccgcugagccaucuccccagccccguggguuuuuuuguuuguuuguuuguuuguuuguuuguuuuuguuuuaaugcuaucaagaugaucgucauuguauuguggugauaucguguucauugauuuuuguauguugaaucauucuugcauuccaugaguaaaucccaccuggauauuuuaauuccaucaaacucggguuauggauauuguaaugaugaugaucaucagggaugugggcuauaaauuuuuaacuuucuuuugugucucuuucuggcuuugauaucaggaucacucuggcaucaugaauugaguuagauagcaucccuucugcuucggcucuugagagauuuuaagcauugacugauuguaaggucuccuuuugcaaacgugauuugaguuuguuauugguguagcuuaguuucaucagcuucuuaaaaaaaauuuuuuuucaagaaaaacagcauuuuaaaauuuuguauuuacgcucgagccuuugucauuucuguuuucugccaagguuuuccugcaggugguggugacucagagauuccuuccuuaggaaugcgcaucuguaacuccccccaccccccaauacacacaccuuugugcggcuuuagcuucauucauuccauuagguuuuagguauuaucuuguaucuuuaucccauuuccaguugucuccugauacauucugcuugucuggcauuguuugucucuuuauugguagagggagauucuccccacgcauuccaggcagccuuugagcuucugauccuccucagccuuccagauuugggggauugcagagaugcaccgccaaugacaagcaaaaucccuaacuaaaucccuuccccucacaccccauuuguucuucuggagugugcucugaaguguuagcuuccaaaucuuuaugaaugcucacuucuuaaugcuauugauuuugagcaucgguuguguugaugguguuggucuccuauucaugcauguugucuccgaucaaugacuucucugcccgugaaacgagacuauucaaguccgauugcauuaaagguaggcuuauuggggaacugcucucggggaguucacuggcuucaaggauugaggaguugccauggggagaggggagaggagaaaagggaagaaggggugcgcucgugcagagaggagaaggguggggcgcaaaaugucuagauaacauuggaaagaacgucuuguggaagggcagcuaagccccugaacuggaaaguucaagguugggaacaagguauaucaggcagggacugaacgcugcuaguagaaccuggaagccaggucugcauugauauguaaaauaagcacuucugucccuuguccgggggucaaaaccagucuaccguuuuguuuuguuuuagcacuuuuaccauguuaaucauaauuagauguaccaucuaauccuugcagaugucuaccacgccugaauuugguucugaucuguauuuucuagcugagauuuuuuuguuuuaguaagcuuuacauacaguguuugaugugguugaaaaugagggcuauaccauguguccacuguuugauacagccagagggaucccagguuggagaauguuccaagugucuuuauuuuuccuaauuuguugcuuugguugcucuagagacuucuugaauuaguucugaguuguaugacacguuauuguauuucucugauauuacaggaggccuugaugguggcaggguguucauuagcuguaucuaugccacucaacuguggucaucacagcgauucuucuugggucuuguacaguuuuccuucccgucgguuaagcagaagcguggugggcuagaauugggcuuuuuuuucccucccuucaggucgguuugagucuuaugaaagcuaagguggggcaauguucgagcucaggaguugcaugucagccuggggauuaagggacucaguuacuugaauuucuaaugagucacguuugucugaggcugaagcuaggagagcagacugcuauggggguguuucagaaugcuuccuuuucucuuucuguuccaaucccuauggagaucauuuucacuaaaaaacaugcucuagggcuccuaugaagaaaagucacaaaaguguauugcucgcuggauauagccuggauuaucuuauuauuaaauuuauucaaacaaaccuuccaagaaagcgucaguuuguuuuccuguguucacacugucuguggacaggagcuguuuucucacucaucagcaagucgcugcucucucuaagagacuuuguaauuuggggaauguuauuucccugauagagucgaagaaauuguucauuuuauucaauuuuuuuugugaugcuaaaaaugauggcuuuggccugguguggugguuuuuuuaaugguguuuuuguuuuuuaauaacacacugggucccguuugugccaaccaaccauauaugcauggagauggggucauccauugcagguugauggaucuaucagagggccacaccauuaacucccaauggcuccucagcgguagaucgaguaccuccccuaguauuggaaucacagcugcugugagcuccugagcaccgguccugucacugcugcuuaacccccagcccagauggccccugucuuaagugauuuucucugagguuugcauguaacugugugauauagaugcuccauuuagaacugagcacccuucacacucuacagauacuauucucuccauuuugaccacaucaaagcccuggucacuacacaaagaagugucucuggggaggucugagagcuacccuaauccaugggucuagaaguauucauuuaaaagaucauuuauuuguucguuucuuuauuuacuuaauguauauguguucucugucuucauggacaaugaaagaggaaauuagaucccauuguagaugguugugggccaccaugugcuuugagccaccaugugguugcuaggaauugcauucaggugcucuggaagagcaagcagccagugcucucaaccacugagccagccucucccguuggaggucuguauuuagagaggaguuagacgaugugucugauaagcaaaauaauaauggaugguccaccacuaucaccccaagggucuuugaguguccaaguuguggguucuuggucagauuuacagcacccauuuuuuuuaacugucuuuuuaauguuucuuuuaugucaguauuuacaaguauaaauuuccuauuacaacuauuacuccaugcuacaacuucuggucugcugcuacuuugagaugcuuuuauccaucuucauauuuuauaauuucccuucuuucauucuuuggauguuuaggcaaauuguauuucgaugcauuugugaauuuucccuauaucuuuuugcuuuuauuucuaguauaauucuaugugguuaaguucuuuuuuuauuuuuaaauuuguuuuugagaauuuaugagagcuauauucauauuguuuucccuagagguauguguauaaagaucauuuauuuacuuguuuauuuacucaaucuauauguguucucugucuucauggacaaugaaagagagaaucagaugccauuauagaggguugcgggcuaccaugugcuaugagcuagcauaugguugcuguauacauguauauauguauacaugugugugauguguuacaacuugcuguguuucaauucaaccuuuuaauauuuaucgaggaccucugacaagaagcugugggacuguuggaaugaguuucccuaagagugaaaaaagaaacauauguaaacaaaauagaacggagcuaacagcccaaaaauguauccaugcuaauccagucugauuugaaaugccuuuaauuggaguuacauauaaacuauaguauagaucacugcagaggacugcauccaucuaaagucauccaagguacuacaaauauuuguauuuguaaaaauaugaccaaccaagcuccuuuuuauggcuuuaagucuguagcacaaaccugggcuuauacugccaccuagugaccaaauagcaaaacaccaaacacugaacuuguuuuucuggagucuagcugaauagaggcuggcugaaaaauggagcagucuagguagaauucuaucauugcagaggauacugggccagcaccagguuuagcacaucccgaggaaacacuugguuuuugcccuaggauacagucuucccugaagaccgagccuacaaugagaagcuugcuuuccuacuguuaugccuuuguauuguucuguguuauacagucagauuacaguaucacucaagucuuuucuuugguugacuaucuucugucuggucuucuggauuuccaggagacaauuuuguuuuguuuuauuuuuuuguuuuucgagacaggguuucucuguuuagcccuggcuguccuggaacucacucuguagaccaggcuggccucgaacucagaaaucugccugccucugccucccaagugcugggauuaaaggcgugcgccaccacgccuggcuccaggagacaauuuuuuuuuuuuuuuuuugcuuauucacuuuacauccugcucacugcccccaacuccaggucccccccucccaugauccuucuuccuucucccucccauucuucucugagcuggugagggccccuggguauccucccacccugacacaucaaguuucugugaggauaugugcauccucuccuacugaggcccaccaggcaacucagcuaggagaacaaaucccauggacaggcaacagcuuuugugauagcccccguuccaguguuccaguaguucaggauccacaugaaggccaagcugcacaucuacauuaugagcaggaaggcucuauuuuucuuauguacaaaucuuaaauuccuauuuguuuaccaggucauuuuugguugucacugugacagguugaauuuuauaaucuugccacuugggaaauagauuguccuuucuuucucagaguuuugaccccacugcuccccuccuccaagaaugaacaaguuuauuugugucacuugcuacagcaccuucagccaguuucugccuguuacauaauuaucaccaggucuguucccaagcaaacucucacucaacggagcuagauaaagauggcuuccagcagcauaacgaaggcucaguucugagaccuauagaauguccuugcaaggacacccugugugggcuugucccauaccaaagauuucucacacgcccauugcucauuuacuugaaguguguuugcauauuggaauuugagguguaaauuuuuauaaaauccgcauucuuuguuguguguggccaugggggucuguuuucuagacuugacagaauuuccuuaaagaugugauacaaaggggcugaagagauggcucaguggcuaagagcacuggcugaucuuaugaaggacuuagguucuguuuccagcacccacauggcagcucacagcugucuguaacuccagccccaggggaucugacucaagcaucuggccuccacauuacuagccaugcaggugguacacaugcugguaauuaccaaaacacauaaaaaagaaacuucaaaaagaagggagacaaagcuaucucuccagaugggcucuauguucguugaaacacacuuuuaauacccagaaggcaguuuucuguuuguuuguuuguuuguuuguuuuuguuuuguuuuuuuuuguuuuguuuuuuuuuuuuugagaugagacuucucuguauagcccugacuguccuggaacucacucuguagaccaggcuggccucgaacucagaaauccacuugucucugccucccaagugcugggauuaaaguccaccacugcccggcaagcaggcaguuuucaauguuguccuguccuucaccuuacugccuuugugaaccuagaagcugguuacaaucagauuaaggacuucaaccuuuuccacccccccuuucuccugaauaugacuugaguaaugggcacauagaugacuuuguaguucccccagaaugcguagaaacaaaauuucaaagcuaucuuccccuaucgucaccucaaagcaucccuuuugcuggcuuugacuauguugucauaaccuagauaacaacacuauaauuaauuuuuaaaugucugccugaggaaguucauguaaguggaucaaucauuaaugcccugaguugaucuucugggaggcaacaaucagaacacagacucacaguuauguccacauuuuccacucuacuccaaguaaacuccaucagcaauaugagcugcugaccuucaaauccaccuccauguacuucuguuuuuaaagauuuauuuauuuauuauaucuaaguacacuguagcugucuucagaucacaccagaagagggcauccgaucucauuacaagugguugugagucaccauguuguuguugggauuugaacucaggaccuucagaagagcagucagugcuuugaacugcugagccaucucuccaaccccuccauguacuuuugauucgugcagcuuuguaggaaguuccaaaaucagcacauguguacacagugccuuuuaaaccucuuaaauucucugcagaucucucuauuucuuuucaagucguuggcuacuuuaguuuauucagcagggacuaccuacaccuacuuagcagcccgcuguuccccugcaguauacuuucucuuuccagaguuuugaucacugcuauccaaaugcgcucagcuauuugauuucugacuccagauagcguucagauaaguguagaaaguaaugagcgugauaucccuagaucuuucuccuucccgaaaaaagaaacugcuuccuccaacauuguuacauuccaccagacagagcuagagcaaggaccaggaaaaauuucacaaacuuucccugcggaaaagagggccuugaacuuccucuucuacuuaaccuagcaccuugucucuaucgccaucuuguggacuuuuugcuacauuacagagcuuugaauauggggauucuggggccgaacauguuuguuauugaaggcuuauacuaaacuuuauaugccccaguagaggggaaugccagggccaagaagcaggaguggguggguagggguggagggcggagggaggguauagggaacuuucgggauagcauuugaaauguauauaaagaaaauaucuaauaaaaauaaauaaauaaauaaauaaauaaauaaauaaaaaagaaggcuuauacugcuagcacuugaaugguggaggcaggagcaugaguugaacaagauaucccaagcuuccugagauuccccucccucaaacaaacaccugauucuggcaaauuuuuacuuuuguuggacauuugaguacuccccacaugcacacugccuuuccccuacucuauugacuuguguuuuaacauuaacuuguagguauuuuauacagggcaugauguuguuaucuauuguugacugguuagucguuuuguuuuguuuuguuuugagacaggguuuccgaaugcaacagcccuggcuguccuggaacuugcauuguagaccaggcuggccuugaauucucagagaugcaucugccucucucugccucucugcuucugccuuugccucucaagugcugggauuaaaggugugcaucaucaccacuuggcuuuacuuuauauaguuuuaauguaaugauuucucagguauauuugaauguacucauuucuaaagugaguauuucccuuugguugcuguuuuauauuuuucaacuucaaacucuucauuuuauuacuuuuuuuccugccaaaaauuacuccaaaaaacaaaauaggaaaagcauacaauaaaacauuuaauaaccacaucccccauaugcuaaguaaggagagagcuacagucaacaguuuacagacuguggauuuaucucugacaccaaugauucucagcaucaagaaaacuuucucugcaaagcauauacagggcaaauauugagcacaacguuucacaaguucaaugggccuccugaagucgauucaugaccuucauuuucaaaagcaguccccucuccccaaggaccagugaccauggcagaagaagaaacagacuuugugauguauaggcaaagccggaccagagcaaaacaaaaccuucaggacaggacauuaacugcuguacuugugaacuguagcugccugaauaagcuuguguuaaucgccauuccaagcauaaggaagcacuauuuagaguugagagcuuuugggagagggacagucacgguuuuuugacuccuugguaggcacaccaccccaguggaugguucacauccaggcauucacgugcagcacaaauuggacacuguggguaauuuuuuuuuaaugaggagauuaaguugagagaggguggcaggugguggaucugcaagggguuagagaaaggaaugggggugauauaguacacaugccaaauucucaaagaauuaauaaaaauauuauuuuuaaaauuuggugauaguuucuagaaaucaguauguuuucuccuguacauccuagaaaugcuaucuucucacagucaacuuuuguuagguaaucaauguuaucaguuaacaacuacuuauaauacuaaucacuaguagcauccaucuuuaaaauauuuuauuaaauauuuuggaguauuacuuucuaucuucuaaagguaaaaaaagaaugcauuccaguaacaacauaugcauacuggucauuuucguucauuugaagaaauaugaaugaauugggcauugauauuuaaaagcaaaguaucucacuguuaaagcuuuaaauuccuagaaagcucaauaauuuaauaauuuuacacacacaauuguuuuaugguuguuuucgagacagauuguugucucuauguagcccugacuguccuagaacuuguucuguacaucagacuggucucaaagucagagauccuccugccucugccucccaagugcaggaauuaaagggucucaugcauccuagccuggccucaaacucacuauaucgccaaagaggauaacccugaacaccugaaacgucucucucuaccacauacacccaagugcugcaauuacagaccugugccaagcacacggaacaguagacauacuaagaacauggagcuauuucaguauacuuggcaaagguaggugauuagcuugggugcagcuuccuguggccuuccaugaauuuucaugaaugggcuucuugaauuucuacugagaauugauggcuucuggggagaagccauuuuccaucauuuguuucaguucaaagaacucaaggaagaacaugaaagagcuccauuccagcuuuuccucgguacuuucuuuuguaugugaaagaugcuagaauucuuuuuuguuuguuuguuuuguuuuguugguuuuuuugguuuguuuuuguuuuuguuuuucgagacaggguuucucuauauagcccuggcuguccuggaacucgcuuuguagaccaggccggccucgaacucagaaaucugccugccucugccuccugagugcugggauuaaaggcgugcgccgccaccaccuggugaaaggcucuaauucuuuuaauauuucagaccuggaugguauagagggcuuuugccaaaauaucacauucuuggggauuuuuguauucauuuuacuugaagaaucugccuuuuucacucagaggguuuuuuguuuccucccuugggcuacauccuauuucuuugcaaagaaguucuccucauuuucuacuuuuauaaaauuuguaucacauaccagcaaagcuuuggggacugaaaauugacauugggguuaaaaugaugguacaguggcuaagagcaguggcugcauuugcagaggacccagguucgauucccaaacacucgaguaccagcucacagacgccuguaccuccagcugcagggagaucugaugcucucauccggccucuaugggcucugcacacacccacacacauaaaauaaaaauauuuuuaaaaaauucuuugaaaagaaaauuggguuauuauguggcaggaggauuuucuuuucuguuccagucuaauuggugcucuauaagcuucuugugugcuuauagguaucuagguguguuuauagguaucuuguguguuuauagguaucuuguguguuuauagguaucuuguguguuuauagguaccuaggcagauugcucaguuugcauugauacugacuguuauacauuuuuugaaauuuggauauguacaguuuaaggaaaauuuuucucuaggacauuaagucucuugucaauugaaggagaaguauaucaauccauuacaguagguuucccucaaacccagucuuugagaccguaagaguuuaagagagggggcaggaggaggcaagacuggggaggaaaggguuggggugcaggcagucugccacaaaccaaacaaaugagacuguguuggagcugagccuggcagcuuuggucucuggguuuccagcauuccaacacucaccaagggccauucgaccaggcaagcugcuaccugcuggccuagcuuucccagcucucaaaggcaaaugggcucagguugcagccauucuuuucugugacucccacaagguccaugcucuguuccccuaagcucugcccccucuucucugcgcagguggucaagugugcuaaccacacccucucagcaggaucccgcgccucaagagccuuaggucccgccccacacucccucaaacccucagugcagcgcuugugucaggcgcaaucucgcaagauccggugaggcgcuacgucgugcuccacucggucccaaaaguaccugcaagcgcuacacacuugcgcucggcgcccuugcucuguucucacuuuccgagauauccacgcaucuugaguccugcauccacucccgggaggcggcugcggcaagcgcgugauggaagaagagcgugauagccagcuagacagguggccagagcggagcggugggugagaugcgggcuaaggagagggcagaugccuaaagugccugcgggacgguggagaggugcccgaaguccuuguuggggugguggagagguggcugaaauucuugcgggauaguggggcgauggcuaagugcuugcaggacaguggggcgauggcuaagugcuugcgggacaggggagagguggcuaagugcuugcgggacagugggacaguggcaaagugcuuucaggacaguggagcgauggcuacgugcuugcgggacagcggaagagaugguuaaagugauugccaagcagcagaaagauuccuaaaaugcuugccagcuaugcggagaugaagguaaaaugccugcguagucccgaaccgauaguuaaaaugccugccgcauaacggaggaauaacuaaaaugucugcuggguccuggagccaaaauuuaaaaugucugucccuuacaggugguuagacuaccggucagggaccuggaaagauagcuaacauacaugccacguucccggacuaauggcucaaauggaugccugggacugggagacuuuacuaaaaugccuaccaccggggaccugggcuaucacuaaaaugccugccaccggguacugggaggucacuaaaaugucugccacgggguacuugggcuaucacuaaaaugccugccaccggguaucugggcuaucacuaaaaugccugccaccggggaccugggaggucacuaaaaugccugccaccggggaccugguaggucacuaaaaugccugccaccggggaucugggaggucacuaaaaugccugccgucgaggaucugggcuaucacuaaaaugccugccaccggggaucugggaggucgcuaaaaugccugccaccgcuuacugggaggucacuaaaaugucugccacgggggacuugggcuaucacuaaaaugccugccaccggggaccugguaggucacuaaaaugccugccaccggggaucugggaggucacuaaaaugccugccgucgaggaucugggcuaucacuaaaaugccugccaccggggaucugggaggucgcuaaaaugccugccaccgcuuacugggaggucacuaaaaugucugccacgggggacuugggcuaucacuaaaaugccugccaccagggaucugggaggucacuaaaaugccugccaccggggaucugggcuaucacuaaaaugucugccacuggggaucuggaagaucgcuaaaaugccugccaccggggaccugggcuaucacuaaaaugccugccaccggggaccugggcuaucacuaaaaugucugccacuggggaucuggaagaucgcuaaaaugccugccaccggggaccugggcuaucacuaaaaugccugccaccggggaccugggcuaucacuaaaaugucugccacuggggaucuggaagaucgcuaaaaugccugccaccggggaccugggcuaucgcuaaaaugccugccaccggggaccugggcuaucacuaaaaugccugccgccgccagggaccuggggagaucgcuaaaaucccugccuuauaaccaaccccuagaggucgacuaaaaugucugcugggcagagcagaggugaugaaaaugucugggauagcguagagaugguuggcuaaaauguuacagguagauaugcaaagcguucaauaagccuggcguggguaauaaacugcagucuagagcggaaaagaaaguuaagggcgugacuuguagcagggucuagaauccacacacucacaucagggaaagccucguguccgaaaaacucuuuggaauagucuuaauauuuuaauauugcucaagccaaauucagcaauacuaccucaccgcacgugucuuuuucagguaagauuuuugcucuuuuuuuuuuuuuuugguaacaauuuucccgccaugugauuaugcuaaaaaccaaugggauucuaccuccgcuuuagugggguuuucugauuguacgcguuuggauuaaaguugaugaaagaauguggggggggggcacagauucagaaaaguggaaaaauuacugguagcgugugaaguaaccaagaacgaguaacuaagucugcgauaacuuucuuugagaagccuuggaaguugagaccuaaaauuuugguacugcguuccguuuauuuccgagguacauaaugacccgaucucugguaucguugaaauucgaaaauaaucugagugcuuugaaaacccauuaaguuucuacuaucugggacaaggaguauuuucgggguggggguggcgggcaaggcaaaacaauucucagugguucguaucugaaaaaucauauucuuauuuacuauaggcacggaaaaucccucccgguaguguuuauucaguguguucagacgagcaaacaauggcacuaaggaaugaauccaguuuagaaaggagggaaauuaacaaucagcuuugguuuugaugcggauuuggggugaauuuuguuuuuuguuuuuuuuuuaaugccuuauuucugagacaaggucucaguaaauaaccucaaacucgcaaagcucugccugccacugccuucagugggacagugccgauuuuaaaggcuucugccgccauguuuggauuaauguucaguuuucaauucggaagagaagaaagauuugcaaaguacugauuuuguaauaccuaugcaaauucuuaccuguguuaguaggcagacaaacacugacuccccagaauauacuaauauacuauauuacauuggaggaagaaacugagguuucuaaucaaucgaccuugagauaaaaagauuccccuagaagguaagguguuguuucauugaaauggcagggauaaaagauugacaaagacucuacauccggcuauagacauagaggaaggcaauuacuagcuaagaaauuugaagcuaaaaagggcagggaaaugaauucucuaaaacuuacagaaggaauaauuucaauuuaauuucaaauaauaauuucaauuucaacuaggugucucacacugaacuucugacuucuaaaauuauaagguuauagaucuguguugcuuuaagccaccaaguuuguugggggcuuaaacaaauacagcacuguagugcuaccugugucucuguaucuucguagagguuaaggugguuaugaagacauccagaaaaggaaucaugagauaggcuaaggcacagaguaugucuuuuauuuacaguuucuuuguagaacaccuuuaccuaaugucuuaaucagcuaauuagcauaguaaaauacaacuuuggguaguuagagaacaaauagugugucauagcucaagaggcuagaccucucuaaaauggagguuggguucugguguuaucccuuccugucuuccuggauugugaauggcugccuucuggcugcccugcgucugguaaagagacagacagguuuaggcuccauucuuaagaccucauuugauuugaaauuacgucuuuuauuuaaagguuuuauguacauaugcagucaaauucgaaugguuucuuucuugcgcuuguguguguguguguguguguguguguguguguguguguucauuuuugagacagcauuucucuauguaacagcccuggugucuuggaacuagcucuguagaccaggcuggccucaaacucacagagauccuccugcuucucccuucuuuucuugugcuguugaauagaaauagccucagaucuggugaauaaugaguugauuacucaaaaacaaaguuggaagcuuguuuacaugugcugauauuggcaugccugaagcagccagacagcuuuuucugugcaauguaaguagggucuucuacugaaauccauuuggaauuauauauacucuauaggucuacuuuauuauuauuuuagauuuuacguguaugaguguucugcuuguuugcauguuugugaaucauguguaugccuguugggcaccaaugucagaagaggguuugcuaggaucccuggaacuggaguuauagaugguuaugagccacaauguggguguuggaaaucaaaccagguccucugugagaacagaaagugcucacauuaaaaaauaguaguuauagcugggcagguggcucacacuuguuagcacuuuaaaggcagaggcagaaagggauugcagcuaguucaagacuagcuugggcuacacagucaguuccugaccaacuuggcuagaaaacacauguuuuuguuuuguuuuguuuuguuuuguuuuuaaguaaacaucugagcuuacuauuuaaacacacacacacaugagggcauagccgcauucaauucauagcaaauaauaaaacuuuuaucaauaaaaacuuaucagguccuuguauaaugaaaaugaaaguugacgaauaaacaugaaagcccaagaaauuagaauaaggcuggaagugaaaguccaagguaaauggaauuauaggggaaagugaugguuugaauguugaugguaauugaggagacuacacauagaaaacauuuaaggcaggcauuggcauaagugaggauuugauugggaagacuaacucacuuuagacaaauggguggauggugucuuuaucagagugcuauguucaaacauacccuuaaauugacuuuucauccucaagauuucuuaugccaggaauuccuuuuaguguuggauuuuacuaccagugguaaaaauaugaaaguaggguuguuuuguuuuguuuuguuucguuuuguuucacacacacacacauacacacacacacacacacacacacacacacacacacaauuguuuuuuuguuuuguuuuguuuuuuugguuuuucaagacaggguuucucuguguaguccuggcuguccuggaacucacucuguagaucaggcuggacuugaacucagaaauccgccugccucugccuccugagugcugggauuaaaggcaugcgcaugcggcaccacacccugcucacaauuguuuuuaaauaugugugucugaggcauuggcccccuggagauggagugacagaggcuugugagcuaccugacuuaggugcuugcuagcaaacucagguccucucagcaagagcaacaugugcugcuaacugcugagcucuucuuccaccuuuguucuuuugagacgcagucucaugcaguacagcuggcuuugaguuugcuccguagccaacgcugaccuugcccuuccugccuccaccuuccaaguguuggguuuucccuauauuuaauauuuauuuauuccuuggcaauuucauacaugcauucacucguacuucucccccacucccuacacaucccgaagcugucuuccuauaaccuuaaugaggucuccuuuuaaaauaauaauaauaauauaauaauaauaacaacccugugaguccaguuagcagugcuugcuggaauguuggcuaaucuugucggaaucguaugcagguagccacagccgcaguacgcuugugagggcggcagccagcauuuucacagcuugccuccccaucuuuagcucucauguucuuuccagcccugcuuccacgauguuccaugggccuugggcaguguguggguugcuauagacaccuuguuuggagcuaagcaugcaauuguugcucagucucaggccagcucugagucugcauuagcugcuccuccuugcagaagaaacuucucuggccaaggucgaggagaguacaguauugauuuguucuugagauagaguuuuccaggguagcccuggcuggcucacuauauaguauagcccaggcuggucucaaacucacagugaucgaccugccucugcuugccaagugcugggauuaaaagcacgucccucucugccuggcucgacuuauuuuuugacauggggacucacugccuggugucccccuccuccuauagccucaaaauggcugagcaagagucagguaacuugcuucucugccauuccugaagcccuguguuccauccggaaccugcauaaaccaggugaggggugugcuuguagucacagcacugaggucaaggcagaagugucagaaauucaaggucauccuaucuacaaagagaauuugagaccagccugggcuacaagacccugucucaaaacguacaaacaagcaaacaaacaaaaaacaaauucaggagcuggagagacggcucaguaguuaagagcacugacuguacuucuaaagguccugaguucaauucccagcaaccacaugguggcuuacaaccgucuguaaugggaucuggugcccucuucugguauaucugaagacagcaacaguguacuaauauaaauaaaauaaauaaaccuuuaaaaaaacaaaaaacaaauucaggggcuccagaagaguagcaaauguucuugguaaccacugagccaucuuuccagcucuccuguccuucuuucuuuccuuccuuccuuucuuuuucuucuccucuccccuccucuccucuccccuccccuccuccccuccccccuccuccuccuccuccuccucuucuucuuccucucucucucucucucucucucucucucucucucucucuccucuuucuuucuuuuuuuuuuugagacagagucucaugacauugcccaggauagacccaauucuucaucuucuugcucuaaaucucccaagugccgcgguuacaggcccuugccuccaacaccagcugguuccuagguucuagauagcuauuccaaguagguagaugcgagggauauccaauuauaguuugcuucauuucccuagugggaauagagaauaaggccuuguuuauuuacuuacuuuuaaaggcucucauguagcccagcccagccuugaauucugauccaugguccaccaccuccaggcuugcaaugccuacuggcuuuuuucagaccuguagucuuuuguuguucgguguguauguauguauuuauuuagugcauugguguuuugccugaauguaagucuguaugagggugucagauacccuggaacuggacuuacagacaguugugagcugccaugugggugcugggaauugaaccacaaccacgguccgguccggaagagcagccagcauucuuaaccaaugagccauuucuccagccccuuuguuuguuuguuuuuuagggaccaguaaauuaauuuuaaaccuagaaagcccucccuugucuacagaauucuuuuaguuauucuuucuauuggaacugagcuuagggugagugcuugguuaggguagugcuugguuagggugaguguuugguuagagugagugcuugguuagggugcaugcuugguuagggugagugcuugguuaggguagugcuugguuagggugaguguuugguuagagugagugcuugguuagggugcaugcuugguuagggugagugcuugguuagggugcaugcuugguuagggugagugcuugguuagggugcaugcuuaguuagggugagugcuugguuagggugagugcuugguuagggugagugcuugguuagggugagugcuugguuagggugagugcuugguuagggugagugcuugguuacagugugugcuugguuagggugagugcuugguuagggugcaugcuugguuagggugagugcuugguuagggugcaugcuugguuagggugagugcuugguuagggugcaugcuugguuagggugagugcuugguuagggugaguguuugguuagggugagugcuugguuaggguguaugcuugguuagggugagugcuugauuagggugagugcuggguuagggugagugcucgguuagggugagugcucgguuagggugugugcucgguuagggugagugcuugguuagggugagugcuugguuagggugaguacuugguuagggugaguacuugguuagggugagcgcuugguuagggugugugcuugguuagggugagugcuugguuagggugagugcuugguuagggugagugcuugguuagggugagugcuugguuagggugagugcuugguuacagugugugcuugguuagggugagugcuugguuagggugcaugcuugguuagggugagugcuugguuagggugcgugcuugguuagggugagugcuugguuagggugcaugcuugguuagggugaguucuugguuagggugagugcuugguuagggugugugcuugguuagggugagugcuugguuagggugagugcuugguuagggugagugcuugguuagggugagugcuugguuagggugagugcuugguuagggugagugcuugguuagggugagugcuugguuagggugagugcuugguuagggugagugcuugguuagggugagugcuugguuagggugagugcuugguuagggugagugcuugguuagggugagugcuugguuagggugagugcuugguuagggugagugcuugguuagggugagugcuugguuagggugagugcuugguuagggugagugcuugguuagggugagugcuugguuagggugagugcuugguuagggugagugcuugguuagggugagugcuugguuagggugagugcuugguuagggugagugcuugguuagggugagugcuugguuagggugagugcuugguuagggugagugcuugguuagggugagugcuugguuagggugagugcuugguuagggugagugcuugguuagggugagugcuugguuagggugagugcuugguuagggugagugcuugguuagggugagugcuugguuagggugagugcuugguuagggugagugcuugguuagggugagugcuugguuagggugagugcuugguuagggugagugcuugguuagggugagugcuugguuagggugagugcuugguuagggugagugcuugguuagggugagugcuugguuagggugagugcuugguuagggugagugcuugguuagggugagugcuugguuagggugagugcuugguuagggugagugcuugguuagggugagugcuugguuagggugcaugcuugguuagggugagugcuugguuagggugagugcuuggguuuccagcaguaugccagagacuuccaagccagccaggacugcaaugugagacccugacucaaaaaugaaagaaaaacaaaagcaaaaacaauugucucugugugugcuuaguuuaaucuuauccacuccaccuucucucccugauaggagacaaauuuugguucgaguaaagcacagaggaacuaauuaaccugagauuacuugcagaauagcccuuccugacccuugaaggcgccauguuauuacacguugcugucucuucuaucuacagcucuauuucuuccucuucuuuauucuugugccagcuucaccucacugugccauugugccgggagggcaguuuuaauggccacuugccugcccucuccugaccuugcgcaaggaccuggguugaggggagggcuuugggugccgugggcuccucguguucccaggcccugcugggcccaggugcaacaugguggcuucccgccccggaaugggaggaguggacucugccucugucauucuccagucgggggaagugcuggcucaggcucugcaaccacagugcagaugggagaggggccaugggacagaaaggcaaggacccucagugcuagcagcugcuggcuuugugacccauacccagcccagcuccugccucccucuuggauggcagggacagucugggaacuucuaccugauccucacaucuauucucucuuuccagaagccucagaaggagucucccugccccugaguuuccaaagcuccucacccagggggaauaaggaugcccaugcauagcaagaaccugucacuugcagguugccuggaagacccgggcagcucacaacucaugccuuggaccuuaacugccuguuucuaguugaggaacccaggcugaggaaaccaaguuauaucaccaagagcauuuauucuagcaaaccaugaaggggcucaugugugccucuucaauaccuaugaaaaauuuauaauaaaaaauccuauuuaaagccgggcgugguggcgcacgccuuuaauccccagcacuccggaggcagaggcagacggauuucugaguucgaggcccuggcugucccucuaccacugagccacauccuuacuuagcccagaucccgccuuugaagaaucgcaguguuuggcuucuaaaugaccagggugacagucagacgagggaguccagugcugcugacccgugcagcgacccuagccaucagggcaaggaugcuggcagcccuccucuugacucuuuuucguucguuccuuccuuccuucuuuugugugaugcguauuguauaugaauguggaugguguguguacacguuugugggugaggguugcacagagcauaauggagucagaggacaacuucaggugugcaucuggccuuccacguuguuuaugagagcaucucucucucucucucucucucucucuuucuuccuuucuauuuuuuaaaacauuuuguuuuacauaaguacacuguugcugacuucagacgcaccagaagagggcaucagaucccauuacaggugguugugagccaccauaugguugcugggauuugaacucaggaccucuggaagagcauccagugcucuuaaccugagccaucaucucuccagcucagacaggucuuuuguuuuguuuuuguuuuuucgagacaggguuucucuguguagcccuggcuguccuggaacucacucuguagaccaggcuggccucgaacucagaaauccgccugccucugccucuggagugcugggauuaaaggcgugcgccaccacgcccggcuuuaaauaggguuuuuuauuagaaauuuuucauagguauauagaaugcauucugcuuacucuuccacuuucaauuucccucccgcccuggccagcaccccuuauuccuuacaaaaugucucugucauauuugcuaguuuuauuuuguuuaguguuucauaguucaccccagacauaguuuggaacuauuaaauacucaucaguggauacguuugagugccccgugucccaauccuuuaguugccaguaauaaaugguaagguuucaugggcuucuuggaguugggccaaugcuauuuuccaaagauguuaagauuuaccauaauagauucuuguaccugccucacucacacucgcuugcaguaccugucuaucuuucucuucuugccaaucacauuguagaugaggcuuuugugguuuuguuggcuccuuguauuagcauaaggugaacugauuucagguaaaauguuguugcuuuucuggcccauucauuggauggaaacgaaggcccgguuuuguuggagcacuucuacugguuagcaauggcuaggcagagccaugucuaacaguacaaacucucuccugagagaauuuaucuuuucuccuagacgcaauuuugucacuuugaauuuuagaacuaucagaggccccuuucucuauucaaggacuucuugacagccauguucuuucuuuucauuucaucuuaccaguacucccacuuuugagccucaauauuuugcuucucgugaucuuauuagauuuguguucucauaaucuuucuccugaacaacuuaggcucuaaguuaugagaccucaaauuacccaaggaacuggcuaggccugccuggugguguaggccuuuaauccgagcacuccugagucaguagcagacagugcucuauggauuuagggccagccuaaucuacauggacuucaggcuagccagauggccagggcaacauaaccaauuucauuacauagggaauuaaaacugagguaucugguaugauaaaagggccacugaguuagaaacuaucaucugaaaagcaggcuuagugguacaagccuguaauucuaacacaggaggaucaggagcucagagucauuccggcuacuuagggacuuggaggcuagccuaguucuggcuccaugcaaaggaaaaggggaauguggcagugguuaagauaccauaauagauucuuguaccugccucacucacacucgcuugcaguaccugucuaucuuucucuucuugccaaucacauuguagaugaggcuuuugugguuuuguuggcuccuuguauuagcauaaggugaacugauuuaagagcacuaacugcucuuccaggggaucugaauuacauuccggcuacacacaagauggcgucuguaacuugguuuccuugggauccgacacccucugcuggccuacacggguauaacacccaaaccuaaugcauagacaaaacucaugcacauuaaauaaaauuuaaggaaaauaucauauacagcacaugauguuuucaaaacaaagcauuuuauuuaacagcaaacuaccccacccacucaaccacccacccacccacccacccacccauccacccacccacacacggacucauugugacauguugguaagcaacaguuuuuuuuuucaagucuucaaaacacccaagagucaacagaaguucuguauuccgcauccguucacaaaguccagguguuuuccauguguuuuuucacaguuggugggaagaugacuccagucuuucaacaacagauugguacacaguucauuuaugugaucaaagcagaugaugguaggaugugcuuaauugguagcaauauugauggcaguaacugugaaaggaaggcuuucaguuauuuuuuccuuugcaaauuccagaaauguaagcccauuccuacccauacaaagggauauuacugaauccagccaauuuccacuaauuaaaagcuaauauuaguaacacuuuugaugcccaauugaguuuuaaugaaaaugaaaaaaauuuguuugaacucccagaccucuucaaccuggcuccaucuucucuguuccuuuucuuuugccugaauguccugauuggguuacuaaguaaagucuagauacuuugaaaguaugcguaugcuacaaugaauaagcuuccuuacagcaaauugugacuucagcucuaaggcaacuuggauaaagagaucacauugacuuaaucuguuucauucccauuugacucaaggcuuagcugauagccauuuagaugaaaauacauuuucagaaacauuuagcgaauuaauaccaauuuuguggaacugcauuaaagucccaacuuagauuccagauagacaggcuggacccuuuccuucacucggccuccugucccacccucugugagugaaagaaaaauggaaagggucaaagcacaggcauuuuuaaucuuuuucaaguucuuucaauuuggucuuucguuccuccaguuuucugauuguugucaauuuuauuauucuuaaauuuuaugcaagaauguuaaacauuaauguuauuuucauccacuggcauuauuuuaccauagcaagccaccuugaguauauuauaguaaggagaacauuucuaaauuacugugagcauuagcauguaaaaagguaaaagguuuaacgaacacaggcaaaauuggucaauguauuucaaagccugcugcagcucaaaaauggcuuguuugccccaggauaaugcaaaguagccuaagauuguggaacuuagauggcugucaucccuccugaccaguaguggucacagucauagcuaaaauggccuagaaaauugaguuucuuagcguggagggcuucuguaacuuuagggucaggcuugcuacaaagcccagcuucccacucauugcaguggccggagaagacaugaggaugaggacucacauugcauauuacuuggggacuaaggacuaagucgugccacuacccagaaaagagaccccccccccccauccagcacuucccuaugucuauguuuccuuuuuccaugucucaggagccaagugaaggccuaagagacaugcaaauccuuguagaacaggcgaaccaauaaagcaaaugaaugaauaauaaccuuccuguauucaaccucugaggcaaacugugggaaaugaggaaaguguucuucagucuagaaaacguuugagcuaauauuucuguuuaauaaagagcaucccucugcuuuccggggcaucuguaagucacacugagugcccuuuuggaacaaauguguugcacuuagcauccaguagcaucuucugcaauguguggaaccgaggaaauagagaaccucuuuuauuauuuccacucuaccaagcaugcccaugaggaggggagcaacuuuuuauuuaacuugccuccucuacaccuugauguuuuucccagcuaaagugagagcuguagucucaaggugugacugcaguccccucagaaacuacugagguaaaguacacuuuggguugcauccuuuaaaugucuuuguucuuuucaguacuuagaaauuuuaguacuuagaacugcacuuucaucacacuuaaguuaaaaguaugagugugauaguauauucuucuugcucacaugacgcugagccaggcaaugaacaaauacguuuagaauuaucgauucaucuugauucuccuuugaaacacuucaacaguaagaaaaggaaaauggguaaugaauuaaaggacagacuuuaagucuguccuggcuucaagcuaggccaaugagaaaaugacuuuuggagcuuccuuagcuaggaagucuccaguuuauguugaaggaaucuuggccuugguuggguuucgcaaacagccauuauaguuaaaauauuuacucagaaggcuggagagaugacucagugguuaagagucugacugcucuuccgaagguccugaguucaaaucccaacaaccacaugggggcucacaaccaucuguaaugugauguggugcccucuucuggugugucugaagacagcaacagcguacucauauacauaaaauauauaauucuuuaaaaauauuauucacucaguaaucagauauauucuucaggcugggcauggguuaagcacaucuguaaucucagcacuugagaagcugugacagucaccaauuagaaccagccugggcuuuaugagaccaugucuccuaugaucagugaucuacacuagguccaccucacauuuuaguuuuaggaccuagguuagcauauuuuauauacaauguuucauuagguguuguguucugcaugcuuggucccuccagccaguacaucuaguucgagagguucugggccacacugaguacaugccaucagaugcucuggccucuucccguuuuguucccugauacccaugcucugggauuaucucacucuggcccuauaaaacuccuuuacuggcaagguguuuguaauucaucucuggcagcagcauucaacaaacauuuaagaaacuggauggaaaaaguuccugucauuaauaaaaccuuuuccaccuccucagucaagccagcugggaaguauccuagacagcauaguccacucaguguaacauuuagcacacugccuugcacaaauccauuuuuuuuuucuguuuucauuuccucauugaagugaauugaaguuuuggucuagauuucacuccuauaagugcuacauaaugcuagaaagcaaucuauguguucgcucaacacauagcaugguaaaauuauuauuaggugguguuaggugauaagcauuaugauuaaguuucagccauuaugaaacuuagaaaguaaucacuguucacugauaaagccaacaguuaggucccggcuuuauagaacuguagacuucacaaagcuccacacagaucuguugugcaugccugggauaaaagcaaagucauugcacaccaggcaaauauugcauauauacacauauauauggcaguuuacaaauuauaaauuaaucucaugcauaauuucuuuagauacacaggacaaugagaaugcucuuugcaucccagugccuagcaagggcacuguuuuguaauaaaugacugccauucaguauguacucaucaaguauugaaugcuucauauauucagugguucacaguuacuuauuuacuuuauuuucacaguauaauaaauguggcagaauuuuaaaagccuggaaauugauaccaaguaagaaaaugaauuguuacauuuauaugguaccuccgaguucauaaaaugccaacguacauauuauucucaaguguggacacacugaaauguacgucuguguaucucuccaguacccaugaaagagaauauacacaugggagacaauauuuagccuccagguuugagauugaccuuauggucuucccaggcuagccuccaauuucugggcucaagugguccuguugcuucagcucagagcacaugcuaccacacccagcuuguuaacuguacucuucccauuaugggcuaaaaaguacaaugaaaauuuuguagagacuaugccuauuuuauaggcagcuuuauuucuauagaaaauuugucuugucuuauacuacugaacugcuuuauaguuaagaaaguacccacaaccauaaugugaccugggcaaauguucuuguauuaacaugcccuuaucacucaaguuuugacugauuaaauuaagcauuggcucauuccuuaugaauaguauggaaugcaaacauucuuauuucauggcaguuacucaugaauauuucauguacccaaaacaauaucggauacaucagagguaguuaguagucauucauuugcacacauggaacaauugauagcuguauaaugcuuuauuuaaugcauucuuuuguaaauucuaguucugugguaaugucccccuuuguuauucccagugcugaacauggguauucagaaauuagaaggugaucagaauaggguaaucaaucaccugcauuagugaccuaguuuguaguuuaaaaucaguuuccauguguuuucucuucugcuaccugguauaauauaacuuacugagccucaccaaagcagaagaaacacacuggccuuaaguauauggacuguuauucauucaagccccguuauguucauauauuuguuuuuacaaagcauguuauuccuagagcaaucuuugugccuauagcacacagaggcguagacuucagcuacuauguaauacauacucagcacugacuuggaaguuacaguaggcuucaugguuuacguauucauacguuuccugguuaccugguaauaucuuguuaccugggggugaccacagugaagcaucacagccuuaguauucagcacaaaaaauaugcagggaaggaaauuaauguuacucagacauucccuggcauucauaucagggcuugaucaaguacaggcaauagaccagugugccuuuuucuuaccuuuugaaaaggauuugcaacuaaggaauaugcaacuaagaccaugaacccacaaagcuucagguacuuagucugaugccuuauaggaaaagcucuacacuuucagauaauaaccauguauaauugccaaugugcuaugagcauguuacuuuuucauccugugucauuuaacuucccucuuacagaggaagaggaaggcacgaaaaagauuaagcccguuaaguaguccuuagagucucucaucauuaauuuuaaagguagguauuagacccaggaguuccuuuggugaaaugcaccaaauuacucggccacuacuaugagcagggaguucagaccucauuuuguccccaaaccauuauuagaaaaccauacccugcucaccuaagcccaaagaaagaaggugacacuggcuggugcuucucagaggguuggcacaucugcauauugcuugucuaauucuucucauuggucuggaacaacucuuuauauuuucucuagauagccugacauuguuuucccccuaacaaccugaugcuuuccuuuucuugucagccuagggcuucugagguagggaggauggcaguaugcauaucuguaugcaugcuuauuccuagggaaguuucaauagucaggcuauauacacuggcuggauuuaguuccgucucaaguggagcagaugugaagagaaauggaaguuguaaaacaucaacaauuuaacaaauggcuaagacccaguuuaaaacagacccuugcacaauacuauccagcuaaaaacguauuccuuuaugggcaauggcaacaaugaaaaauuacaucucaagugaagacagcuuaaauagaaauauaagaaauggaaagggaugcugggguuggggggcaggucucaucuucgaauuucccuucuuggucuuggggauagaaggauagaaauauccuuccagaguucugggccauaggccuuuaucucuuaaauauucuguccauauaggauuggguccuuaggucuuaugcuuggacuuagcucagguuuugugucuuaugacauacguaguuccccgcucuuggaagucacagguguccuguagaaacaguuccucuucuuuggguugucagcauucuguccagccagcucaagacgggccaucuguguauuuugguccuuuuaaaucucaagucgcaaaacuucugucuucuacuugggcguucacuucagagccacuugaauccugaccggacggaaugauguauuuugucuuagauuauuucucagggcagucuggugugaggaacggcuccacgggugacauucuggaccuauugggaaggggcuaugaagcuccucucacacaugacacacauaacacacaugcacacacgcacauguacauacaaagaaacauccaagaaaggauuacuuuagaauacaagagagacacagacuuguaaagagaugaaaugcucaaagugaacagaaaggaggaaaguagaagauagaaacacaagcaaacacaaagcaacagaaugaugcugagauaagaaauccaccaauagcaaagagacacaaauacaaaagaaaacagagaaaguggcccaagaaaggcagggaagaaauguaaacaagaauucacuaaggauagaagcagcagaaagaaaacugaaauggacugacaaagagaacuugaacaaagaacaaguggggugagcacaagaaaaagagagggaugcaugcaacaugugacccaaaggggagucacgaaaggcaggagugaaagaaaagcuaagagaaauagcaaccagauagauaaaacagagagccauagcuagugaagacaaagcagaccacacaggcaccagagaaagugaaacaaagcucaaagcucugcaagaaagaacaugcaggagaaacaugggaauagguaagacacacugcagacagaaaagacacacaaaggaaagaaggagacaugcaaaggaaggaagaaauagauguaacaaagaauuagacacacaaggaagaaguagauacacaaaacaaggaagacauagacacacaaagcaaggaagacauagacacacaaagcaaggaagaaauagacacacaaagcaaggaagaaauagaugcaacaacgaauuagacaacacaaggagacauagacacacaaagcaaugaagaaauauauauaccaaagaauuagacacaaugcaaggaagaaauagacacacaaaagcaaggaagaaauagauguaacaaagaauuagacacaacugcaaggaagaaauagacacacaaaagcaagaaagaaagacacacaaaagcaaggaagaaauagauguaacaaagaauuagacacaacugcaaggaagaaauagacacaaagcaaggaagacagacacacaaagcaaggaagaaauagauauaacaaagaauuagacacaaugcaaggaagaaauagacacacaaagcaaggaagaaauagauguaacaaagaauuagacacaacugcaaggaagaaauagacacaaagcaaggaagaaauagauauaacaaagaauuagacauaaugcaaggaagaaauagacacacaaagcaaggaagaaauagacacacaaagcaaggaagaaauagauguaacaaagaauuagacacacagaccaaggaaaaaauagauacauaaaacaagaaauagacacacccacaauacacacuaaugauugauaguaagcaaagaccaccagaaagaggguaacaagaaacagggaagggcaaagaaaaaaauugccauuaguacacuguaccaggcuaucaacguuaaacuuaagguuuccuuaacauaggaccauaggacacacccgucaacucuuccaaauggccuagucaugcaacuccagggcauauuugccaggcucuguacucaacacuuuccauucaugauuucauuugaccuucacaaacagacaggucuuagcagaacuaaauugccaaagggcauacaucuaggggauauuacauuuaaacacagaaugaacaucucaacauucuguuacauggauuaaaagcuucuguaagcagcaaacacuauaagcgacugcauauuuaauugucagcuucacucuccucuucuauuaaaaaaaagggggggcuugguuuuuacauccuucacaagucuaauggcugcuucacagauggagauaagaaauaaacuauuuaaagcuuuucaauguuuaagucuguaagaaugguagggcaccaagccaaaacaaacaacaacaacaacaaaaccuagaagcuaaauuccucuugugauauaacugguaagcagauaauaguuugaguugcugcugugaggccauuugauaacgugaaagccuguucaucuuccaucguguacauggcccugccucacauuaucacauuagaugcucuccacccagcaccaucuuccagcaaaugcaaauccucagaagacugcaaugcuagugacuuaccucauucuauugcuuuuaagaugcugcagucaggcauguugauccucgggucauuuauaaagcugccuuccuuuuguguguucacauugcuugaucacgcugaagacccaguuuucugugcugcuuuggggaaggguaauauuugguagauggcacuacaaagaacaaaagaagcuguaugaaugccaggaaagaaguacuagaacauccuggcucuuuaaauucugccuaaugauagauacuucuguaucaauuccagccagguuuccauuuguaguuagaggcauucaucaucaguaauguuagugauggcucagugguuaagagcaccuauugcucuuccagagguccugaguucaauccccagcaaccacaugguggcgcacaaccaucuguaaugagaucuggugcucucuucuggugugucugaggacagcaacaguguacucguaaauagcuagguagguaaauaagcuacucacuuguguauuauauggcaugaguaggguagcagugcaucuugaaguauguaaacagcuggcaaagcuuuccuagcuucuggagagagaaccaaauagagcagaauggcuuccucgaaggucagugccacuauugcagcagcuuuucuccuagaagaaacauuugcacuguuuaguuacauuucccagaugugggaaaaagauaaaauuuauguauauaucucaaguaaaaggcugacuuuaauggaaaacaagaucaaaguuaaaauuauuacacuguugcagaaaacuuaccuacuuugauguaggguggcauucuuugagccuuugucuuccuugcuggguucaggaaagcgucucacugaaaucugggcuaggccuguugcccagugguggugagcuauuccccuggaggauccucaugccccaucuccaccuagggaucgucaaagggaauaggucgccagcacugcaaagcagcaagcccacaauucuggggggagaucuggaaaagaggugaaagaaaagccaauucuugaaaucaagaauacugggaaaguugucucauuauguaguaaccagcaguuguguuaaaucauggggaggggcuuggagagugaacccuucacauuuguagaucuuaguguuaacuuagagacaugagaauugcuccauccaaguucuuucuggcuuuuauucugucaccuaccaaugagagauccuuuagauuauagguuguguuaaaguccuuguacuucaaauacucugggaauaaagggguuaaauuauuuucuucuuuuaauuugugcuuuaaacaauaccaugccagaacacuggcaaggugaauagcauuguuuggcucagugcuuauggugcauaugucccuagaaacugguguagcauuggaccucugaguuugaggauauucagagaccagaauuaugacaggccuacagaaugugacaacagccauaucuacuuacucuaucaaguacaaaagacuagggugucagaaacuggccuucauuccucugauaaccuaccuuuuaggcauuucagagcagaaauguuacagauuggucauaacaugguggggaugauuucaaggccucaucauaaggcaaggaucucauuggcuaacugacuaugccaggggaccaggagauggggagugcuuuauugacuugcccccucauucucugaugaacuggagaucagauagaaacccccaaauagcaaauucuccaaaguaccuuuuuuucuccauguggccuguaagcuuuuuguucagaguagcgaggacuugaagagaaguucugcugagauguaauguagcuguauaggcugcuggcaguccuugagucucacauagggauuguuugucccugugaagaaauacaaggcuaucauuagacuacaaaaauuguugaaaauuccacaugaaaauaaugagguauuuacuuaggagguauaacuugacacauuagaccuuuaagggaagauacuaucucagucaaccaaguaacggaaauaccuuugggcucucuccagcacucuucacuccucuaaauccaggcaauccuucuucuugaggcaggagcacaaaacagacuccaaauucaucccuggaaaacaaaugauaauuauacuaaacucuacaaaugauaauuugauuacuagcaauacaaucuucauaugcacaugucagcguuuucaauuggugguaagaacucagggugaggauauguucucauggaaccccuaguucuuaagagaugugaaaacagccuuuaaaauugaaagcaugucuacauuucaaaggccuuucauuucuuuucccuuuuuguauauuugaguacucuaucugcauguaugccugugugccagaagagggagucagacgucauuacagaugguugugagccaccaugugguugcugggaauuguacucaggaccucuggaagacuaacagaaccaucucuccagcucucgucuuaagugagcuuucucuuuuccuguuuuauuuaaaauuaacaaaacuuucuuaugacuacacaaauagagccaucuuccccugggaugagccagaggacuaaguaaggggcaggcagaagagguucacuggacugggagagagggcacagguuggacaguggcuagguuauauggcaguaugcauacaaagaccuggucugguucugccacagggcuuuguaaaaucagcuggcaaaauccacuacuuccacuucccaccacuuaaugaagguguacauucucaaauucacuuguucuacaggguucuuuguuuacaaacuccuaagucugggucaagccauuggacagcuuggaagaaagcucauucuucuuuuuuuuucaagacaggguuucucuguguagcccuggcuguccuggaacucacucuguagaccaggcuggccucgaacucagagauccgccugccucugccucccaagugcugggauuaaaggcucgagcuaccacugcccggcugaaagcucauucuuaauguauacaguucaggcagccugaagauggugauggcgaguugguggcuuuccauuacaugauuacugacagugagggcugggucaggacacuaauuuggggaacucuuuguauuccaucaauuauggggaccaaagauggccuccagaugguuuugugugauggcaccuccuaauggacauuucaaucacagacaagcucauguuccagauguccuacuacaaauaaguguguauuuuacagugccguggaggucauguaggacuagguugccaugacagaauuggcccugauuaaugaucugccugcucacacaacuugaucauuucaauagggaacugucagugauaguggguuuacugugaauagcagcaguaccagcuuccuccaggccacuaacuggagucugaguccuaaucucuauuuagguccauaggaggcaggcugaaagcucuaggugccuaggcaagccugggggggggggucacuuugcauguacugggguggguagccaauggugcuaaggugagaccgaagcuuuagcuaacugucuuagugcaccaaacacauucuuuagcaucucaaaaagcuuuuuuuccuugcaaauguuuccuuuugaagcaguuacuuguacaacaaugguccuaguuuccuaaaagacucaauaguucuagauguauuaucaccuagagagccagacaaugcuaagccuuuggaguugggggaaaccugcugcgaaggaauuuacaguggacuuaaaaggguuaaaguacuagagggucauuugcacguacaaaaggcaaaugcaaaaaaauguuaaguguuauggacaaggauguuuuuucagcuagaccauuuucuacacaggagucaaguauuuguuguuuuaacugaaaguaucuguugaaaagugcuggcagggguccaguguggcacccacccuuaaucccaacacucuaaacuggaggcagaggcgggcggaucucugcgggcggaucucuugaguuugaguuccaggauagccagacuacacagagaaucccugucacaaaacaaaacagagaacaaaacaaaauuaauugauuaauuaaugaaaaagaaaaaugagcaaggaggguacauaaaguaguccauaguaaaauuuguucauaaaacuuauccuucuuugcacuuuuguaaaaaaaaaaaaaaaaaaaaaaaaaaaaaaaaaaaaaaaaaaaaaaaaagauuguaagcuaugaaguucucugucuaagcuguuagugccguccaguggucuguucugggcagaaaugcaguaaaaaugguugaaagaaccaaauuaucaaauuuauauucccaauuccuacacaagcucaucucuugcuacccuuggcguacagcuaagcauaaugcauggagucuuucacucuuaauauucuuuccaugcuuccaagagguagauagaaacagauggcauucagauaaaccaaccagaugguacuaauagucgucuggaccaacaaggcaaaguaagcacacuucccucuuuaagaagucaaauuucaaccccaguagacuuccuaaaauacuuaaacaauucacacaggcaguacauuuccuaaaaugaucucaagugugcuuauauuacauuaagucuuaaauaacauaaucaucucacggaagaaauuuuguaaaauaucaucgcuucucauuuuaguguaccccagcauaauggcgauuggguacacaauguguuaauucuacaauuucguuggcauacuauguguuguguauggauaagcugagaagagcuagugacuuauuagucacuuugacuuuucaguggguggcacagaaagaaacucgaaugagaaaaagauagcuuaguagcuaacaagguaguacuuacuguagucuaaacagccagagucugauguaacggaggagcaguaguucaagcaggauccugcacuggaugaguuacuugaacauccuccucagaaaaauaguaucauuucucaguaaugcugggagaacugcuguugugaugauuauuuucaucagcaaugucauaucaaacacucagcagcgggauggcaagauggcacgcggaggguaaaggcacuugcugccaagccugaugaucucacuuugaucuccaggacccacaagauagacgaaccagcucccauuguugucugagcaccaugugaaugaaugacugcgcgcagcaacaugcauguacacacacacauacauacacucauacacaauagcucccaaaaaagaccuaaguacucggcggcuacaaagcacccuucacacuagagaaagcucuuuucuuacuaggaaaaucucucuuugaaguguacguuuaaaggaaugauuagauccuggcagacauauuuuaaaauguaaaguggggaaacagguucuaucaucucuaaaauaaauucccacuuuaggaauuuucaagcuacuucaaauuauugccagaguuuaaugguggauagaaugaauuaauuaaaugugauggccuauauaauuuucaaaggcgacuugacauguucucaaauuuaauccauccagucaccuuuuaaaaauaagcaaggacuggugaccaaugucagacaaaauauaaugauuagaaggcuuaggucaucuuccaaaaaguuaaucauacuaaaggccacacaaagauugacuuuuucguuuuguuaaacuuguaguaaagaccaagcaaagauacuugucuuaaacauucugcaauaguugcacugaucuuuccacagacucaucacccucaguacacugagacacugcuuagucuucagaaacaugacacaaauggcuauuuuuacuucacaaaagcuaaugaucucacagucaauccaccuugcaauccaaaugccuuucuuaaggaauaaaauuaucaauaacuuuucuggcaguugguccuguacaguagcaauauacaaaaucgggcuuaaaguuucuuaagcagacaguuggcuccuuccuggaggaagaacggaaagaaaagugcuaagcuuccuucucaggaagacaauuuucaguucauacuguaaaggaaagccccaaguaaaagguggcaauccaacucccugagcuacuugccugcaauauuuugcacaauaaagcauuaauaaagguaggcaagaaugguuccuggcccuagaaugugccagcaguuggaauuggaauaauuuagaagugcaaguuaaagauugaaggcucauccaccuaguuuuggccugcuuuugcuauucaguguauaaauacaccaaaauuuauuaaugacacauaggguguuugggguaauuaacauuacccagaauaauguaagaauucgaggugucucuguucagugggagcaaggagaaggcaacugagacacuguagccauaugaagugaguaaacugguguuguugacuuuaagucaagagaagggcuuugcccagucaauacuguucaaacaaagaggcaaaagggauggcaugauggaauugagaaagggcacaaacucuuccuuaaugauggguuugugagaauuagugauucagaaaaguggucaauggacaaacuagaggccgggcaaaaggaacacuauaaagugugagauugugacuauuuaggauuguauauauuaaagcaaugcaaaaagggucgaaauccgggucauuguuggguguacauacugcuguacuuuauuauaucauugggaaacuagcaggggauuugcucaaguuggaguagaaaauaaaccauccagaacugccauugugccuauuaagagucccaaaaucaguuuaaggaagagagcaggucauucgucagagccccugugcucauugacaguaccggguaguuucgggggcucagcaaccucugcaauaauguaaaggggacaaaauauuccagacauucauaguuauaaauacgcauaacuuagcaauuaauucugggacucaguagccuugaugguaugcaaagagagcacacagguccuugacauuuuugcauaguaaucauccaaaugcugagguuacuaauaguuacuaccacucagcagccccagucaaaagguaggcauuucagaaccuuugcugccgcacaggucauauguguaaggguacagauuaauauugacaagagaagugcucagaaauaauuaauaugccucuggugucaaaagaguacaaggauguaaaauccaacuccaaagguaaugauggacaacuaacugcauuaaugcacuuaaguccaaaugaagagcacuucguacaacccucuuucugcuuuaaagcggagaagaggguacaguaguucuuagagaagugcuuagacaugugaacuuuccaaaugaaagucuugagcuuauuaucacuuccugcugaaggugcuaaggaagugagugggauccuuucaagugcacagagcagguggcagugcauacgcauacauuuaauauaugauaacaguccaaaagaaugcggccuuguugaucagcauauccugauauagugcaaaugaaaggcgaaggaguauggccuuuguuuacuggcaaagacaaaggaagauucacuguauauuaaugguccacuagcagggaccuugggagauaaacgguaucccuugcaggagugcaagagauacaaugguccgaaaaguaauaagguuguggauaaguguaauuuuacacauuaacuggccaaguauuuuuauuaaaaugaauggaucaugucccuguuauauacauuaauguucaagggacauguuaucaauuaaaaaccccauccuuuaugcaaauauuaagucuuuaaaguaauaguccuggaaauuaaagaguggaaaggaggggacagccuuauccaguguccaggaagaugaagaagccaaaagauuagugacccuugcuguacugcaaaaggguuugagaguaggaucguauccaaauggaaugagaugugugcaguaaaugcauacuaauaugcaagguacauguuuauggccauuacaguuuuacgcuguucagguuuccuucuguagugaacagaaaaggccuacuacaaucagucauuauuauuagcaagccacaaaaugggaccuuauaggucaacaccacuucuguacuucaaaguuaagaguaaaauugauccuacuaaaauugccaguauguacauaaauaguuugaggaagggguuucaagugcacagcacauacauaauuccauaaagcaaagaggauaugaaugaucagagacagaagucuuaccuugaaggaccauugaccguauuggaaucguuucaaucuauagucucaugaaagaagcuuuauauuagugagccucuuugcuuugcuaaguacaggaguccugaucuaaaaggcacaacuguggacaugagaauauguacaauagaguuaacacugugcacauuuacuauguuaaggaucuuaaauacugcugcaauacaaauaagucuucaccagaugcagauuacuacagugaaaugacauaugcacauucacaauaugaaagacugcaugcagggcauagugguaggaaccagauaugccaacacuuguuaaacgcaggcuagauccugagcucaaggcuagccuggguuauaugcuaaguuccaggccagccuggaaguuaaaaacaggacagaucaaaggucuucuugauuaccaacaaaaugacuugacuuaguuugguuucuuuauccaaugcuuaggaagagggacaaaugcagcugugcacacaacaggcacaaauauguuuacauuacagguggcaaugccuguaagucccgcccagcccaggcuacauaagaggcuguucucucaaaccaccacacgguggggcuguagcucuaugacagugcuuuacuagcguacacaagacucaagguuugauuccccagcacagcagaaagaccagaacagagaaguggucucauugguuggcacccuugauugucacccauuaggguaugaggguaugggaucuugguuacuaacagaaggggacuugaacaacugcaauuuugcacaauuguguaagaggcauuaaguaaucagcacccucuuuacauaaagcaaggguaguauuaggaccuugagaaaagacucaauuccuagucaggauuauccacauaaaauguuccagugcagagguuuuuggcugaaauaagaaagcaugugagacuaguauacaauaucaugagcaaauaaauguaucuccaucaguuagaaagaugugaccuggggcgauagcacccaugacagcaugccaacaguauauaguauucuacccccuuuaauggccaaugccuugaaaauugggacugagcacuuuaacugucugauaacagaccuguguuugccccuuugcuaaaugcacacagggcuggacuagcuaaagucuaauccaauggacaaaauauuucugacagaauuauucaguacucaagguaauacaugagaaaagacgacugaacacugcuuagaaacuugggacugugacuacuacagcaaugacagaaugguuuucuuuccuuaaaggaaaggagacuugagagaugauaccuccauggcaagucucugauauaaaacucuuguuugauugguguaucuugauuaacaugaaggacaagaguucuuuguuuacuuguccauggacaaguaaaguaggacuguaugcaaagugaaauuccaugacucuggaagucaguauggaggggguaugggguauagaugggcucagucuuauaggcugagugaugggcacugcauuuuagcaauacgauucuaugcauuaagugaaauuccaugacucuggaacucaguauggaggggguauagaugggcuaucucagucuuauaggcugaguuaugggcacugcauuuuagcaauagaaaucuauacauuaugugaaauuccaugacucuggaagucaguauggaggggguagaggguauagauagggauaucucagucuuauaggcugagugaugggcacugcauuuuagcaauaggaccguaugcaaagugaaauucuaugucucuggaagucaguauggaggggguaugggguauacauagggauaucucagucuuauaggcugaguaauggacacugcauuuuagcaauacgauucuaugcauuaagugaaauuccaugacccuagaagucaguauggaggggguaugggguauaaaugggcuaucucagucuuauaggcugaguuaugggcacugcauuuuagcaauaggacugcaugcauuaagugaaacuccaugacucuggaagucaguauggaguggguauagaugggcuaucucagucuuauaggcugagugaugggcacugcauuuuagcaauaggacugcaugcauuaagugaaauuccaugacucuggaagucaguauggaguggguauagaugggcuaucucagucuuauaggcugagugaugggcacugcauuuuagcaauaggacugcaugcauuaagugaaauuccaugacucuggaagucaguauggaggggguaugggguauagaugggcuaucucagucuuauaggcugagugaugggcacugcauuuuagcaauaggacugcaugcauuaagugaaauuccaugacucuggaagucaguauggaggggguauagaugggcuaucucagucuuauaggcugagugaugggcacugcauuuuagcaauaggaccguaugcaaagugaaauucuaugacucuggaagucaguauggagggaguaugggguauacauagggauaucucagucuuauagacugagugauggacacugcauuuuagcaauaggaccguaugcaaagugaaauucuaugacucuggaagucaguauggagggaguaugggguauacauagggauaucucagucuuauagacugagugauggacacugcauuuuagcaauacgauucuauguauuaagugaaauuccaugacccuagaagucaguauggaggggguaugggguauaaaugggcuaucucagucuuauaggcugaguuaugggcacugcauuuuagcaauaggacugcaugcauuaagugaaacuccaugacucuguaagucaguauggaggggguauagaugggcuaucucagucuuauaggcugagugaugggcacugcauuuuagcaauacgauucuaugcauuaagugaaauuccaugacucuagaagucaguauggaggggguauagaugggcugucucagucuuauaggcugagugauggacacugcauuuuagcacugaaucaaugaagauucgaauuucucuaaguagaagugggcuugggauaggucugaaaguaucugggccuggggcuaggacugggcuggggcagggcuggacuggauuggguugguuggguggggcaggggcaggggcagggguaggggcuggggcuggggcuggggcaggggcuggggcaggggcaggggcuggggcuggggcaggggcuggggcuggggcuggggcaggggcuggggcugggccuggggcuggggcagcaauagcagcagcacuauuugcugagucuugaggagaaucuagaugccauaaaggcaagaacacacagaaaguugaaauguaggccuuaauauuacuauuauaacaguaagucugauagaggacacagagcauuacaauucaaggcucuugcugacaaguaaaaccauuagucaauauagcaucaacaauagcaacaaaagcaaagccugaacugguauagaaccucaaauacuccugacauccagucauaauguucacuuuacauuaacaguaucuguguuauaagacuuaaaaauuugaagaguagcucgguggaugaguuugaaagaaaguacauuuaagugccaaguaauuugaguaucaucugccaaaaaaauuauugaaaacuuuaaggacuccaaaguaacaauucacuaaagguaauuaaaaugaauucaacaaguaagcaaaucguaaauacauuuugaaaacaaucacuucgguuuuaaauucaaacacuagcaaagcacacuaucagacgugucguuggcauccaaaauauucauugaaaucaaaaugcaaccccagcaauagucaugggguagauuuuggaagaagguaggauucuaccucuucaccagugauuugugauccacuaugacucuggccaaagucaccacuuauacccaguaggcuuagagaaccgcuugagaucagugcuggcuaaaucagaggccaagguguaaguagacuagccacugaacaauacaaaggaauggaacgggcugaguuuuaguuugcaccgccacguauagagcacuguaagagacuaugaacgcaagcggaugagucaaauguccuugaaauggccuuagauacuuuucuuucuuuuaauaggugagguuucaaugauuuacaucgaccaagaacccgcagccucggucucucgaaucggauccgacaucauccaacacuucaguguuagaauugcaagcaugcgcucucccgaccugggcaggcacuucgaaaaaaugaugacuaaagacacacgugaaguaccaagcgaaacucacguccuuaugggacagugacucaucacagucuaauuccauccuggccaccaagcaauaaugcacauuucuaacuggaagucaagcaaacaccaacacuuucacacuugugcccauuucugacgaguuacgucaaguggcaaccaacacuuccacuuagccuugccucagcuucgaguggcacaagguaggaccaaccacacccuaccauaaugcaccaaguguacccucgggcaaagcccgccaaguagcuaaagcccgccaaaaaaaaaaucacugaaagaaaccacuagagggcaggucacaugacuuccgccaucuuagacacauucaagagcaugugccaccucuccaggcuaacucagacaugaagcugacaugugacacacaaagcccuuugcguuauaccgcaccaagaacuugagccgccaucuuuuccuguacgaccuaaauguccuauaauccauugcuacacaccagaacaaagauugggcugucgagccucggguggagcccccgagccgccauuuuauagacuucugagcagcccuuaaagccacgggggaccgcgccagggguccauaugcacacacacccugcccaauccccacacccacgcugagcccuauccccuaguccucugcggcuuccgcgcaacaccgcacacuaauacgagcacuccuuggcuuucuacuuccggcuagcacaaccccgcaaaugcuaccacaaaucaaggcgaaucccgcaaccccgcacauauaaagaaagccuuuagcuagcgcagcgcaauugguugcuuuuauccaguccgcugugcuccucgguguccuaauucuuggcguaacuggcucgagaauagccguaucacgcagaagccauaauggcggacgcgggcucuccacgcccugaacacccacucaguuuaagagcaaagucguuuuucuaagccauagguucacucacacagcaccaaacgaucagcagcaacaguacacgcaaauaagaggcauagauauuccagguagugcaauaacucacaaaaccauauuuccauccaccaagcgccccguugggccgugaaaaaaaaaauuuaaagcagguauccacagccccgaugggcaaaagaaaaagaaaaaaaaauaauaacagcagguauccgaggccccguugggcaugggaaaaaaagacuaaacgcagguauccgaggucccgauggaccgagaaagguuuuuuuguuuuuuuuuuuuuuuuuacaaaaagcagguauccauggccccgaugggcuaaggagaagaaaaaaagaauaaaagcagguauccacagcccagaugggcaaguuuagaaaaaaaaauaauaagaaaaaaaaagaaugaaaaggcagguaaguauccaaaaccccguugggcauggaauggcggggaggacacacagguauccguggccccgaugggcaagaauauauaaacaaugaaagaaagguaaguccaccauacacacacaaguaucaaccaaaaggcacaacaaagaaauauuccuuaaaaaugaaaaauugacugaaaauauuacaaauaucaaaaaguauggaggacaugucaaaaaaaaaaucuuaccagaacauaucaaaacgucaaaaaucucguggaauuuugauauguuuucuuaaauaagccauaaggcuuggugguaggggaacuaaaaauguucccccaaagcuccuuagauggagagaaaccacggaagaaccgcacauccacgggaaacgagcaaacauggcuggagcaagccguugcacgccuuuaacugauccgcggcgcugaaggcggagagaccagaagaggaguggccacaaagauugcaauucugacaucuuauuggaccuuuaggucuaacuauauuauaaaaaaauuaaaaugaauaaagauggagguacguaagcucagugacaugacgcgugaauuucauuauuuugcgcgauaaugaaggauuauccuauuuuacagcuaaaaacguuuauguagaacuuccacauaaacauuaaauaauguacauuaggucacacaccugucuaugcaaaauuucaauauaucuucuacuuggacaaaccauguaucgcuccgcgucuuggacacuagaaguucuucugcauuaguuggcgaccucagaugaggagaggaaaggguagaaaugccucacaaaauggcuccuugguuccuaaauuaucagaguauuaguugugaccgauuuggugggcuuacgcucauaguuuugggucauuggcaucuuagucuuucucugggaaccuggugacuccauaccuugggacaaaaacgcacugaaguacguuacucgcuagcaguaaugaaaaauaauuccuaaaugccaaagcaaagccugagggaauaauagcucauugguaucuuacucgccccagagacacugcuaacuuaaaagaacugucaaauuuuguuaacugucaaacuaugaauauccacaugaaagagaucagacacccuggguauuagaaaaucaaaggauauuguugucucguugauucacgcugacaaauaauucacagucuguucuaaguucccuuuaggcgucccaugaauaauaaaggacacaaaauugguuugcuuauggacgaucaaagugccagcaauucacuaaucuuacuauugaggugguucagguagggauggaaaaauaucugcuacaaaauaaacuguuucaacaaaagaaaaacaaauuaacaaguaaauaaaugaugcacacagacugaauaaaccagcagguggcagcaugaaucuuuccaaggcaucugaagccaaacuuggagugcaaaaggauuccuaucugaauugagaaguaaagguuacuuugucuaacuuuaguugacagagcgaucaggaucagaguaacaagcacaccaaaagcaucaccagugagaagucacauaggacauauuagggaaaaaagacccaaggaagggcucuucacagcuaagagcaccuggcuccacgauggauauggcuuuguauaaacgagaacuucuaaaugagcuguacaaagagaauuuagaacuugcgagguacuggucacagauuaugcaagccaguguaucauuuuuguggggaugcuagagagaaucaucaaauuaaagaguuaaauuuagucucuguguuuuacuuagucccaauucuugcaaaccucaucauucuuucucacaccguguacaucaagguaugucagguuucggggacacuuuuuagucuuaucacaagaaagcaugaagggauaugugcuaaaacucaguuccugggcuggagagauagcucagugguuaggagugcugacugcucuuccagagggccugaguucaauucucaacaacuucguaguggcucacagucaucuguagugggauccgauaucuaaccucuucugauguaucugaacagugaccgacaguguacucacauuaaauaaauauuuuucuaaaaaacaccuccauuccuguacacuuaacuagguaauuuauugcauauucuuuguuuguuuguuuguuuuguuuuucaaggcagguuuucucuguauagccccagauguccuggaacucacucuguagaccaggcuggccucgaaguuagaaauccaccugccuccaccucccaagugcugggauuaaaggugugugccaccacugccugccucauugcauauucuuaacauuaagauuaaaaaugcaccugggguaaaauaguaaucuugaggaauucuccaugcaaauucaaagaggagaagaaggaagaacaagaugaugaugauaaugggucaagaaacaaggacccacuacaaagcagcaagaaacagaaaugggaguuaagaaauggucuuccaaugugcagagaguaagagacuuuagaacacuugguccuagaugagaugucuucaucaagcccuuucuuucaaugcucaggcaucuaugaagauaaggagucagaaagacugcaguaaaugacuccaagaaaacaccauccagacaaaacagcgcaguuuucguuuuguuuuuaagaaaaugaauauggauuuggaugaguggggaagaguuggaggaaggaaaaaugaucaaaauaaaucaugaaaaaugguuuguuuuuuuaaaggaagggauguucaaugacacuacuggcucugugaacagagagaaaguuggagccacaacuauagguagaucaggcauccagucucuccaggaaaucuauauuuuuuucaauucuaacguauauugggagagggguugaucugguauaaaaugguugaagaaacacucccaaguucaugaaucaacauaauauugucuaaguugcaucaaaaacccaucuauggauuuagcgcuauacucagcaaaauucuaaugacauucacauaaauaguuuuuaaaaauaggugacaugguaaguagcuuaugccugugaaucccagcccuugggaguuacaaggaugaucagaaauagccacauagagaauuggagaccagauugagcuacaugacaaagcuucaaaugaaugaacagguugcaccacagcgucaacaugcuacugcucauagguaggcuuguaaauuagugggauagaauagaggaccuggagacagccauccacuacucaacaaagguacaaacaccacauguaagagacauacagucacuuggccaagugauccuuagcauagugguacuaucucacccuauacagaaaucaaucuaccaaagaucauguaagaacaaugacuccuacagccucagacauuuuaucacuaagccaucaggagcggggaggagguggcacuacuuuagaagaauuaggaaggacauaagucacuagggagugggcuuugagguuucagaagcccaagccagggccggugguuggcuuucuuccuacuaccuguggaaccagaugucaaacuccaguacuaugucuucuugaaugcugacaugcucccuaccaugaagacaauagacuuuaacccuagaaaauauuagaaagccccuuuacaaugcuaucucuuaaaguguggucaaccagguggacguggugcaugucuuuaguccccagaccuaagaagugaucaauuauggugcuuaagacugcucuuagauuacucuugagaugcuuaauauuccagaugaccaaaguucaagauuuacacucacacuagacaaaucuuuacugccuguaauuucagugcuaagggaucuaaagaucaggcuuucaugugcaacuucacagacuuuauauaagauaacaaaaaacaaucuccagcaccucauaaaacaggcauaccaacuuauaaguuauaguaauagaaagugaagaguccccagcuccaagucccggaaaaauaucaacaaaaucagaagaaaauuuucccaaccuaaagagaugccacccuuuccccuggcuggcagcauggaggcugaacgaugccugaagucacuguaaaagauguuaaccaucagguucgucagagcgcuggcagccuuccucaaaaaguccaggaagcugaaaguucgggaauggguggacacagucaaguuagccaaacauaaagagcuugccccauaugaugagaacugguucuacccacgagcugcuuccacaacuccggaccuguaccucuguacacaacuguagugcaggaguugguuccgugaccaagaucuaugaaggauggcagaggaacgguguuaggcccagccacuucagcagaggcucugagaguauggcuugccagguccuccaagcccugaaagggcugaaaaugguggaaaagggccgagaugggggccgcaagcuaacaccucagggacaggaaacacaucuggacaggaucgcugaacagguggcagcugccaacaagaagcauuagaaaaaauaauacuggguuaauaaauugccucauucauaaaaaagaaaagaauaaagaaagagaagccuauaaacauacaagaagcuuauagaguaccaauuauacccaaaaaaaaaaaaaaaaaaaaaaaaaaaaccaaacaaaacaaaaaacaaaacccuccuggcauguaauaaucaaauguaaauacaaauaauaauguuuuggagaagauguaaugauccauuccauuaauacgagcacuugggaagcagagccaugguggaugggucucagaggagugugaacuuaaugugggccucugcuguagcagcaaguguucuuagcugcuaagccaucucuguggcuucuuuuauuccaaggacuguuuaagcugaccuggaauucacuauguagaccaaacuagccuugaacuuauggugaacuuccugccuacaaaguguugugcuuacaagcaugugcuaccggucacagauauaagugauaaguauaaguguuuuauuauauauaaauaaguaaauaaauacauagauucuauaucuguucuuccacuugccacaucaguuuuuccccucucagcucauacuccggauuacauacuccgguguuauagucuuggcacaggagcaggcaaugcaaguugauggucacaauuaugcaaccugaggaauccucagaaccgcagaguucucucuaguuauauauuguugugauucuugauuuauauuacagaaaacuuaagaaugcuuauugaauaagaugaaggaaagauaugaguggguauugggaggggcauggacugaaguccagcaguaguagcuauauaccugauuuguuuuuuuuuaaguuucuguuauuuaaaggaaguauuuuauaaccaagguugagagagcaaagaaaacauuuguucaucuucccacucuacccuugccuuuuccauuuuuguguguauaugcauuuuguccauagauguggauacacauguauauagguucauauguauaugugugugaauauauaggccuaaguuuaaugucuucaaucauuuuucuaccuuguuuacugaggcaagaucuuagccaaaccgagagcucacugauauggcacgucuuguuaggcaacuugcucuggggaucccuguuugagccuuucauagcugcaauuauaggagggcuucacauggguucacgccuuggggacuugaacucugguccucaugcuuuuauggcaaauacuuaaccucugagccaucucuuuagauccccauuacaucauugaaaaguauugaguuuuuaagguuuauuucugacuuuaguuauguauauggucugugugugcccucaaagaccagaagagagcagcaaagccccuggagcggaaguuauaggugguugucaacugccugauagugcugagaaucaaacuuggauuuucugaaagaguagcaaauguuuguaagcaucgagguaugucucuagucccagguuuguuuguuuguuuuauuuaaaugacguuacugaggguacuggugagguugcaauaugaauaaaagagaugugauuaagauaaacccauggaaugugagcaguggaggugcacaccuuuaaucccagcacuugggaguuagaggcagauggaucucugaguuugagaccagcauagucuaccgaggcaguuccaguauagccaaggccacagagaaacccugccuugaaaacaaacacaaacaaacagaaagaguagauaauaauacauuuggggggcuggagagauggcucaacaguuaagaggauucgcugcuuuuccagacgauccagguucaguuuucuuuaaagaauaggccacuggcaguuugaccucacgagcuaauaauguuuuauauaacauggaguaacuuagaguagcauaaccugaugacaaagguggucaagugguaagagccauagaaggguucaacgacccugccccuaucgcuggaguauugagauuuaaacuaaaaauaggagagacauuucaauagagaacaaggaguacccauaauaaguaauuuucgcuuuuuuccccugccgccaccaauuugcgcggaggcagaagcucaggugcguucaagauucggcgucacccauaauccaccgccauggccgaggaaggcauagcugcuggagguguaauggacgucaacacugcucuacaagaggugcucaagaccgcccucauccaggauggccuagcacguggcauacucgaagcugccaaagccuuaguuagacaagcgccaagcccaucucugugugcucgcauccaacugugaugagcccauguaugucaagcugguggaggcacuuugugcugagcaccaaaucaaccugauaaagguugaugacaacaagaaacuaggggaauggguaggccucuguagaaucgaucgagaggggaaaccacggaagguggucgguugcuguugcguagugguuaaggacuauggcaaagaaucuuaggccaaggaugauaucgaggaauacuccaaauucaauaaauaaauaaauuguagcucauuaugaaaaaaaaguaauuuucuucgagguguagccugacuaauuauugugucuugugguacugcaagauagcccagagaaacccucaucuugacuggccaugguagcacaugccuauaaucccagcagaagaauugcuuugagcuugagaccauacuaugucuugagagaguucuuguuuuuuuaaaggguggcucauguuugaagcauaagcugauuacuuuugccuugcaucauggauaacugcccucauauggaagaaggucuguccugggagguuuugcucuuggaguucaacaugacuaaggaugaaugaaauaauuuaggaagacacuccuucuguuauuaauaugccuaugcacagucaagcaggaguuugaaaugaacggaaagacagacucaaaaugaaggcagagacucaagucuuuaauccugugguugguuaccuugugaagccaaguaggccaucaauaccuuuagcaaaagcacuuucugaaaaccuguucuaacaggacauaaauuucuaacaacagugcaacuuaaauuguaagaaaacacaggacuguuucaaagacugauagcauguuguuuccuauguuucauauacagccucaugguuugcuuuggcuuugcucuccaccccucuuucacguggucucauguaauucaggcugaucuggaacuuacuguguugcugaagaugagcugaacuccugaugcuccuuccuaacucucucaaauucuggaauuuuaggcaagcaccacuuugcucagcuuuucuuugauuuucauuuagaauauuaaagaauaguuuuauuuaaucccaccauucaguaggcagagucaggaggauuucugauucccagucuggucuacagagcaagcuucaggacagccagggcuacacagagaaacucuaucuugagauaccaauaaagaaagaaagaaaaacauuuuucuuggggcuggcaauauggcucagugguagagcaauggcuuagcauguaauuagaaaaucauggauucaguccuuaguaacacacacacacacacacacacacacacacacacacacacacacacacgggcugagucuugacugcaagauggcucagcugauaaggagcuuaccucaaagccuggcagacacccugagcuccauccuuggaaacuaugugguggacacauccauauauucucucucucucucucucucucucucucucucucucucucucucucucucucccuucuucuaccccgccuuggucuuucucaaacacaaaaauaaauaaauguaaaauauuguaagaaguuauaggucauuuauauaaagaaaauuaaaggaaauuaaggaaauacuuuuagaugagaauagaguauaagguuuuuauccuaaaacuaaaagauuguucccauauggacaaaaaggggugaugagggaaaaaaccagaaaguuuuagucuauugccaaaggccugaguaugucacaagaaguuuguagaagauaaagugaggcccggggaaggaaggagaauugggaauuuacagucauucucugcuacguaauaagucgaggccagccuggaauaacgggggcccugucucaaaaacagaagagcaacaacgauaugcaugccugaaaagccaaaucuuuaaaaauuagcuagagucacacuuuccuagguacuucuuucaacaguuuugccacagacauuagaaugaaguuggaaaugcagacaguugggcucccagauacccugaaucaacuuuuauauuugacuuuuguuuuuuuuaaguuuauaaaaacuuuuuuuuuuuuagaauuuuuaugugugugaguguuuugccugcauauaggucuguguaccacacucgagcauggugucagaggaggugagaagccucaugcagcugcuaggcauugaaccccaguccuuugugagaauauuaaguacucuuacacaccaagccaacucuccagcccugcuuuugggguguucaacaacaaagauaaguagaaaccaaauacgcacccagagaaaaaucacauauauacaaaaagccagaaauuugagaggcaauguguguguguguguguguguguguguguguguguaguggcgaggaauaacauaggaggaauuggagaagggaaugggggagaauauguaauuauauuuagauuaauuuuauuuuuuaguauagaauagaguuuauucagggcauggggaggggaguuaagaggguagcagaggcagggaaaggcagagagagagaaagagagaguagagaacuagaggcuggccaugagcacauggagagagggggaagggaaucuagauuaaaaauuuaaauggggggggcaauaaagugguuauagucacaggagcauaucaaauugauugucuuggccauggguguguguguguguguguguguguguguguaauaauuuucacaaacuugccaucucagagaaacucuaggaggaagaaaggauuccaaacaggcaaauucuggcuacagcugaggagagcucgcacaggaaagaacugccuguaauggaaugaaaagaagccagggcuuugcugucuugggaaagagggaaaccaguguaagggaaaaugugcuaccuucuggagagaggacagcccucggcuccaugacagcugucccagguugccuuagcaaagccuuccucaagcagauauucacugaggccccuucggcaacuuuccaacaugguuuuacuuaaauacacacacacacaugcauuuacuucguguguguguguguguguguguguguguguguguguguguauacauguuugccuguguagagagaucuguguagagagaaguaugugccggggacugaaccugcauccuuugcuagagcauuaagcacuguuaaccacugagcacucgcuucugccccugugccucguggugcaauagguaaaaugagaacuuuuuucuuucuuuuuuaaauggaaguguaguucucugccuuuauugauaacccaagauccuuuucuaauuugugugguaaccaguauuggugugaacauccaaaagccaaaggaguuauugucagcuucggcccugugagguguccaauaggaauaggacaagguauaauucugucuuuaucaaaaacuaggggacauacccaggccugugguuuacuuugccaccuagccucugugacauguagauugcaguuauagcagcuacagcaaugcuggcagcuaaaaacacagaaggggcuccgaaagagaucucgggagcaaaacacaagcuggucuucuauagaaacaaaaaagaaaaaggaauuucgguggggguaggggggggguggggggugggggguggggggugaggggguggcaagagaacaaauuaaagacgggcaagaaacgcgggagcacgugaaagaugcuaacagaggcagccgggagaggaaccgcaagcgcucagucaucugcggaagcgaccgcggacagucccggucacguugcuggagcagccauuuagggacagccugacagcgcggcgccgcgcggcacagggacuguucggcugugacgcaugcucuccgcccgcccgacccccccccccccccacggcaccaccaggcuucuguaacuuauaaaauggcggcguccacauguauacguccuucccgggauuagccaggcagcuagaggaugacuuaauaaggagaguggagaaacuggccaauuaaugaacaugcccuggugagugccgggucucgcgcugucagagagauggccgccguagcggucaccacgccgacccgccgcagcggucaccacuccgaccgcauggucugccgagcgggacgaguagucggcggcuggcacuccggauuucuccccuauuccgcccacaauagaugagugaucagugcccacaucaccggaccuccacggaugaaccugucaggcuggggaggcucauuccuaggagagaucguguuuugagguuuccuuuuguuuuccuuugucuaauugggguuugacggauagugagugucuccaaaauggaguguuuauucuagcuccccagaggccucgaaaaacggccucaguucuuucucaucaacacuuaguaguugauaaaacuagcuuauugguaacauuaauuaugguauaauaacgcuuuuugcccuaugcccuuuuuauguacuccaaaugaggaccagaguauguuacuaaauuuguggucugggagcaucuguuauaauagggccuuauagggugaucuguguucuuuuguuagaugcuuacuuggucaaaaagacauuucaguaccuuagcuaggcauugcugaauaaaguaugaauuguugcaaccauuuggaagcauugauguagcuauauuuagaaaaauaaaaauauauauggaguaccaaguuccaauaucuggaacucaguagucugacuuucacggcucaauccuucagaaagagaagcaucaguauauaaauaaggauaccuaaaagaggaugucuaugcagcucuuuucuuguggcaagugauaagaaacaaccuguguauccauuaauaggaggauguuuuaaaagucuguauauuuuggcucuuugguguaaaagaugauaugauagcuuguuacauuaaaaacaaguuguaggauaauaugaucucauuuuuuucauauauguaugagggugacaaaggaauguuugcuauuuuuaaaacauuucggcagcuuuauauauuaugaccuauuuaacacaaaugcaaacacagagaauaaaaugaaacccuaauauuagaguugacguuuugccauauuucuccacaguugcggcucacucuuuugucaucccguagauuaagcaucauuuuuaguuuaguaauugugcuuauuucccccuuuccccccaguauugguuguggaaccuaggacacuguggugcuagacagucacacuaccacugaacuauaucuagaucuguucccacuuuaaga

SEQ ID NO: 47 - RNA, 73441 nt, Mus musculus
ucuuaaagugggaacagaucuagauauaguucagugguagugugacugucuagcaccacaguguccuagguuccacaaccaauacuggggggaaagggggaaauaagcacaauuacuaaacuaaaaaugaugcuuaaucuacgggaugacaaaagagugagccgcaacuguggagaaauauggcaaaacgucaacucuaauauuaggguuucauuuuauucucuguguuugcauuuguguuaaauaggucauaauauauaaagcugccgaaauguuuuaaaaauagcaaacauuccuuugucacccucauacauauaugaaaaaaaugagaucauauuauccuacaacuuguuuuuaauguaacaagcuaucauaucaucuuuuacaccaaagagccaaaauauacagacuuuuaaaacauccuccuauuaauggauacacagguuguuucuuaucacuugccacaagaaaagagcugcauagacauccucuuuuagguauccuuauuuauauacugaugcuucucuuucugaaggauugagccgugaaagucagacuacugaguuccagauauuggaacuugguacuccauauauauuuuuauuuuucuaaauauagcuacaucaaugcuuccaaaugguugcaacaauucauacuuuauucagcaaugccuagcuaagguacugaaaugucuuuuugaccaaguaagcaucuaacaaaagaacacagaucacccuauaaggcccuauuauaacagaugcucccagaccacaaauuuaguaacauacucugguccucauuuggaguacauaaaaagggcauagggcaaaaagcguuauuauaccauaauuaauguuaccaauaagcuaguuuuaucaacuacuaaguguugaugagaaagaacugaggccguuuuucgaggccucuggggagcuagaauaaacacuccauuuuggagacacucacuauccgucaaaccccaauuagacaaaggaaaacaaaaggaaaccucaaaacacgaucucuccuaggaaugagccuccccagccugacagguucauccguggagguccggugaugugggcacugaucacucaucuauugugggcggaauaggggagaaauccggagugccagccgccgacuacucgucccgcucggcagaccaugcggucggaguggugaccgcugcggcgggucggcguggugaccgcuacggcggccaucucucugacagcgcgagacccggcacucaccagggcauguucauuaauuggccaguuucuccacucuccuuauuaagucauccucuagcugccuggcuaaucccgggaaggacguauacauguggacgccgccauuuuauaaguuacagaagccugguggugccgugggggggggggggggucgggcgggcggagagcaugcgucacagccgaacagucccugugccgcgcggcgccgcgcugucaggcugucccuaaauggcugcuccagcaacgugaccgggacuguccgcggucgcuuccgcagaugacugagcgcuugcgguuccucucccggcugccucuguuagcaucuuucacgugcucccgcguuucuugcccgucuuuaauuuguucucuugccacccccucaccccccaccccccaccccccacccccccccuacccccaccgaaauuccuuuuucuuuuuuguuucuauagaagaccagcuuguguuuugcucccgagaucucuuucggagccccuucuguguuuuuagcugccagcauugcuguagcugcuauaacugcaaucuacaugucacagaggcuagguggcaaaguaaaccacaggccuggguauguccccuaguuuuugauaaagacagaauuauaccuuguccuauuccuauuggacaccucacagggccgaagcugacaauaacuccuuuggcuuuuggauguucacaccaauacugguuaccacacaaauuagaaaaggaucuuggguuaucaauaaaggcagagaacuacacuuccauuuaaaaaagaaagaaaaaaguucucauuuuaccuauugcaccacgaggcacaggggcagaagcgagugcucagugguuaacagugcuuaaugcucuagcaaaggaugcagguucaguccccggcacauacuucucucuacacagaucucucuacacaggcaaacauguauacacacacacacacacacacacacacacacacacacacacgaaguaaaugcauguguguguguguauuuaaguaaaaccauguuggaaaguugccgaaggggccucagugaauaucugcuugaggaaggcuuugcuaaggcaaccugggacagcugucauggagccgagggcuguccucucuccagaagguagcacauuuucccuuacacugguuucccucuuucccaagacagcaaagcccuggcuucuuuucauuccauuacaggcaguucuuuccugugcgagcucuccucagcuguagccagaauuugccuguuuggaauccuuucuuccuccuagaguuucucugagauggcaaguuugugaaaauuauuacacacacacacacacacacacacacacacccauggccaagacaaucaauuugauaugcuccugugacuauaaccacuuuauugccccccccauuuaaauuuuuaaucuagauucccuucccccucucuccaugugcucauggccagccucuaguucucuacucucucuuucucucucucugccuuucccugccucugcuacccucuuaacuccccuccccaugcccugaauaaacucuauucuauacuaaaaaauaaaauuaaucuaaauauaauuacauauucucccccauucccuucuccaauuccuccuauguuauuccucgccacuacacacacacacacacacacacacacacacacacauugccucucaaauuucuggcuuuuuguauauaugugauuuuucucugggugcguauuugguuucuacuuaucuuuguuguugaacaccccaaaagcagggcuggagaguuggcuugguguguaagaguacuuaauauucucacaaaggacugggguucaaugccuagcagcugcaugaggcuucucaccuccucugacaccaugcucgagugugguacacagaccuauaugcaggcaaaacacucacacacauaaaaauucuaaaaaaaaaaaaguuuuuauaaacuuaaaaaaaacaaaagucaaauauaaaaguugauucaggguaucugggagcccaacugucugcauuuccaacuucauucuaaugucuguggcaaaacuguugaaagaaguaccuaggaaagugugacucuagcuaauuuuuaaagauuuggcuuuucaggcaugcauaucguuguugcucuucuguuuuugagacagggcccccguuauuccaggcuggccucgacuuauuacguagcagagaaugacuguaaauucccaauucuccuuccuuccccgggccucacuuuaucuucuacaaacuucuugugacauacucaggccuuuggcaauagacuaaaacuuucugguuuuuucccucaucaccccuuuuuguccauaugggaacaaucuuuuaguuuuaggauaaaaaccuuauacucuauucucaucuaaaaguauuuccuuaauuuccuuuaauuuucuuuauauaaaugaccuauaacuucuuacaauauuuuacauuuauuuauuuuuguguuugagaaagaccaaggcgggguagaagaagggagagagagagagagagagagagagagagagagagagagagagagagagagaauauauggauguguccaccacauaguuuccaaggauggagcucagggugucugccaggcuuugagguaagcuccuuaucagcugagccaucuugcagucaagacucagcccguguguguguguguguguguguguguguguguguguguguguguguguuacuaaggacugaauccaugauuuucuaauuacaugcuaagccauugcucuaccacugagccauauugccagccccaagaaaaauguuuuucuuucuuucuuuauugguaucucaagauagaguuucucuguguagcccuggcuguccugaagcuugcucuguagaccagacugggaaucagaaauccuccugacucugccuacugaauggugggauuaaauaaaacuauucuuuaauauucuaaaugaaaaucaaagaaaagcugagcaaaguggugcuugccuaaaauuccagaauuugagagaguuaggaaggagcaucaggaguucagcucaucuucagcaacacaguaaguuccagaucagccugaauuacaugagaccacgugaaagagggguggagagcaaagccaaagcaaaccaugaggcuguauaugaaacauaggaaacaacaugcuaucagucuuugaaacaguccuguguuuucuuacaauuuaaguugcacuguuguuagaaauuuauguccuguuagaacagguuuucagaaagugcuuuugcuaaagguauugauggccuacuuggcuucacaagguaaccaaccacaggauuaaagacuugagucucugccuucauuuugagucugucuuuccguucauuucaaacuccugcuugacugugcauaggcauauuaauaacagaaggagugucuuccuaaauuauuucauucauccuuagucauguugaacuccaagagcaaaaccucccaggacagaccuucuuccauaugagggcaguuauccaugaugcaaggcaaaaguaaucagcuuaugcuucaaacaugagccacccuuuaaaaaaacaagaacucucucaagacauaguauggucucaagcucaaagcaauucuucugcugggauuauaggcaugugcuaccauggccagucaagaugaggguuucucugggcuaucuugcaguaccacaagacacaauaauuagucaggcuacaccucgaagaaaauuacuuuuuuuucauaaugagcuacaauuuauuuauuuauugaauuuggaguauuccucgauaucauccuuggccuaagauucuuugccauaguccuuaaccacuacgcaacagcaaccgaccaccuuccgugguuuccccucucgaucgauucuacagaggccuacccauuccccuaguuucuuguugucaucaaccuuuaucagguugauuuggugcucagcacaaagugccuccaccagcuugacauacaugggcucaucacaguuggaugcgagcacacagagaugggcuuggcgcuugucuaacuaaggcuuuggcagcuucgaguaugccacgugcuaggccauccuggaugagggcggucuugagcaccucuuguagagcaguguugacguccauuacaccuccagcagcuaugccuuccucggccauggcgguggauuaugggugacgccgaaucuugaacgcaccugagcuucugccuccgcgcaaauugguggcggcaggggaaaaaagcgaaaauuacuuauuauggguacuccuuguucucuauugaaaugucucuccuauuuuuaguuuaaaucucaauacuccagcgauaggggcagggucguugaacccuucuauggcucuuaccacuugaccaccuuugucaucagguuaugcuacucuaaguuacuccauguuauauaaaacauuauuagcucgugaggucaaacugccaguggccuauucuuuaaagaaaacugaaccuggaucgucuggaaaagcagcgaauccucuuaacuguugagccaucucuccagccccccaaauguauuauuaucuacucuuucuguuuguuuguguuuguuuucaaggcaggguuucucuguggccuuggcuauacuggaacugccucgguagacuaugcuggucucaaacucagagauccaucugccucuaacucccaagugcugggauuaaaggugugcaccuccacugcucacauuccauggguuuaucuuaaucacaucucuuuuauucauauugcaaccucaccaguacccucaguaacgucauuuaaauaaaacaaacaaacaaaccugggacuagagacauaccucgaugcuuacaaacauuugcuacucuuucagaaaauccaaguuugauucucagcacuaucaggcaguugacaaccaccuauaacuuccgcuccaggggcuuugcugcucucuucuggucuuugagggcacacacagaccauauacauaacuaaagucagaaauaaaccuuaaaaacucaauacuuuucaaugauguaauggggaucuaaagagauggcucagagguuaaguauuugccauaaaagcaugaggaccagaguucaaguccccaaggcgugaacccaugugaagcccuccuauaauugcagcuaugaaaggcucaaacagggauccccagagcaaguugccuaacaagacgugccauaucagugagcucucgguuuggcuaagaucuugccucaguaaacaagguagaaaaaugauugaagacauuaaacuuaggccuauauauucacacacauauacauaugaaccuauauacauguguauccacaucuauggacaaaaugcauauacacacaaaaauggaaaaggcaaggguagagugggaagaugaacaaauguuuucuuugcucucucaaccuugguuauaaaauacuuccuuuaaauaacagaaacuuaaaaaaaaacaaaucagguauauagcuacuacugcuggacuucaguccaugccccucccaauacccacucauaucuuuccuucaucuuauucaauaagcauucuuaaguuuucuguaauauaaaucaagaaucacaacaauauauaacuagagagaacucugcgguucugaggauuccucagguugcauaauugugaccaucaacuugcauugccugcuccugugccaagacuauaacaccggaguauguaauccggaguaugagcugagaggggaaaaacugauguggcaaguggaagaacagauauagaaucuauguauuuauuuacuuauuuauauauaauaaaacacuuauacuuaucacuuauaucugugaccgguagcacaugcuuguaagcacaacacuuuguaggcaggaaguucaccauaaguucaaggcuaguuuggucuacauagugaauuccaggucagcuuaaacaguccuuggaauaaaagaagccacagagauggcuuagcagcuaagaacacuugcugcuacagcagaggcccacauuaaguucacacuccucugagacccauccaccauggcucugcuucccaagugcucguauuaauggaauggaucauuacaucuucuccaaaacauuauuauuuguauuuacauuugauuauuacaugccaggaggguuuuguuuuuuguuuuguuugguuuuuuuuuuuuuuuuuuuuuuuuuuuuggguauaauugguacucuauaagcuucuuguauguuuauaggcuucucuuucuuuauucuuuucuuuuuuaugaaugaggcaauuuauuaacccaguauuauuuuuucuaaugcuucuuguuggcagcugccaccuguucagcgauccuguccagauguguuuccugucccugagguguuagcuugcggcccccaucucggcccuuuuccaccauuuucagcccuuucagggcuuggaggaccuggcaagccauacucucagagccucugcugaaguggcugggccuaacaccguuccucugccauccuucauagaucuuggucacggaaccaacuccugcacuacaguuguguacagagguacagguccggaguuguggaagcagcucguggguagaaccaguucucaucauauggggcaagcucuuuauguuuggcuaacuugacuguguccacccauucccgaacuuucagcuuccuggacuuuuugaggaaggcugccagcgcucugacgaaccugaugguuaacaucuuuuacagugacuucaggcaucguucagccuccaugcugccagccaggggaaaggguggcaucucuuuagguugggaaaauuuucuucugauuuuguugauauuuuuccgggacuuggagcuggggacucuucacuuucuauuacuauaacuuauaaguugguaugccuguuuuaugaggugcuggagauuguuuuuuguuaucuuauauaaagucugugaaguugcacaugaaagccugaucuuuagaucccuuagcacugaaauuacaggcaguaaagauuugucuagugugaguguaaaucuugaacuuuggucaucuggaauauuaagcaucucaagaguaaucuaagagcagucuuaagcaccauaauugaucacuucuuaggucuggggacuaaagacaugcaccacguccaccugguugaccacacuuuaagagauagcauuguaaaggggcuuucuaauauuuucuaggguuaaagucuauugucuucaugguagggagcaugucagcauucaagaagacauaguacuggaguuugacaucugguuccacagguaguaggaagaaagccaaccaccggcccuggcuugggcuucugaaaccucaaagcccacucccuagugacuuauguccuuccuaauucuucuaaaguagugccaccuccuccccgcuccugauggcuuagugauaaaaugucugaggcuguaggagucauuguucuuacaugaucuuugguagauugauuucuguauagggugagauaguaccacuaugcuaaggaucacuuggccaagugacuguaugucucuuacaugugguguuuguaccuuuguugaguaguggauggcugucuccagguccucuauucuaucccacuaauuuacaagccuaccuaugagcaguagcauguugacgcuguggugcaaccuguucauucauuugaagcuuugucauguagcucaaucuggucuccaauucucuauguggcuauuucugaucauccuuguaacucccaagggcugggauucacaggcauaagcuacuuaccaugucaccuauuuuuaaaaacuauuuaugugaaugucauuagaauuuugcugaguauagcgcuaaauccauagauggguuuuugaugcaacuuagacaauauuauguugauucaugaacuugggaguguuucuucaaccauuuuauaccagaucaaccccucucccaauauacguuagaauugaaaaaaauauagauuuccuggagagacuggaugccugaucuaccuauaguuguggcuccaacuuucucucuguucacagagccaguagugucauugaacaucccuuccuuuaaaaaaacaaaccauuuuucaugauuuauuuugaucauuuuuccuuccuccaacucuuccccacucauccaaauccauauucauuuucuuaaaaacaaaacgaaaacugcgcuguuuugucuggaugguguuuucuuggagucauuuacugcagucuuucugacuccuuaucuucauagaugccugagcauugaaagaaagggcuugaugaagacaucucaucuaggaccaaguguucuaaagucucuuacucucugcacauuggaagaccauuucuuaacucccauuucuguuucuugcugcuuuguaguggguccuuguuucuugacccauuaucaucaucaucuuguucuuccuucuucuccucuuugaauuugcauggagaauuccucaagauuacuauuuuaccccaggugcauuuuuaaucuuaauguuaagaauaugcaaugaggcaggcagugguggcacacaccuuuaaucccagcacuugggagguggaggcagguggauuucuaacuucgaggccagccuggucuacagagugaguuccaggacaucuggggcuauacagagaaaaccugccuugaaaaacaaaacaaacaaacaaacaaagaauaugcaauaaauuaccuaguuaaguguacaggaauggagguguuuuuuagaaaaauauuuauuuaaugugaguacacugucggucacuguucagauacaucagaagagguuagauaucggaucccacuacagaugacugugagccacuacgaaguuguugagaauugaacucaggcccucuggaagagcagucagcacuccuaaccacugagcuaucucuccagcccaggaacugaguuuuagcacauaucccuucaugcuuucuugugauaagacuaaaaaguguccccgaaaccugacauaccuugauguacacggugugagaaagaaugaugagguuugcaagaauugggacuaaguaaaacacagagacuaaauuuaacucuuuaauuugaugauucucucuagcauccccacaaaaaugauacacuggcuugcauaaucugugaccaguaccucgcaaguucuaaauucucuuuguacagcucauuuagaaguucucguuuauacaaagccauauccaucguggagccaggugcucuuagcugugaagagcccuuccuugggucuuuuuucccuaauauguccuaugugacuucucacuggugaugcuuuuggugugcuuguuacucugauccugaucgcucugucaacuaaaguuagacaaaguaaccuuuacuucucaauucagauaggaauccuuuugcacuccaaguuuggcuucagaugccuuggaaagauucaugcugccaccugcugguuuauucagucugugugcaucauuuauuuacuuguuaauuuguuuuucuuuuguugaaacaguuuauuuuguagcagauauuuuuccaucccuaccugaaccaccucaauaguaagauuagugaauugcuggcacuuugaucguccauaagcaaaccaauuuuguguccuuuauuauucaugggacgccuaaagggaacuuagaacagacugugaauuauuugucagcgugaaucaacgagacaacaauauccuuugauuuucuaauacccagggugucugaucucuuucauguggauauucauaguuugacaguuaacaaaauuugacaguucuuuuaaguuagcagugucucuggggcgaguaagauaccaaugagcuauuauucccucaggcuuugcuuuggcauuuaggaauuauuuuucauuacugcuagcgaguaacguacuucagugcguuuuugucccaagguauggagucaccagguucccagagaaagacuaagaugccaaugacccaaaacuaugagcguaagcccaccaaaucggucacaacuaauacucugauaauuuaggaaccaaggagccauuuugugaggcauuucuacccuuuccucuccucaucugaggucgccaacuaaugcagaagaacuucuaguguccaagacgcggagcgauacaugguuuguccaaguagaagauauauugaaauuuugcauagacaggugugugaccuaauguacauuauuuaauguuuauguggaaguucuacauaaacguuuuuagcuguaaaauaggauaauccuucauuaucgcgcaaaauaaugaaauucacgcgucaugucacugagcuuacguaccuccaucuuuauucauuuuaauuuuuuuauaauauaguuagaccuaaagguccaauaagaugucagaauugcaaucuuuguggccacuccucuucuggucucuccgccuucagcgccgcggaucaguuaaaggcgugcaacggcuugcuccagccauguuugcucguuucccguggaugugcgguucuuccgugguuucucuccaucuaaggagcuuugggggaacauuuuuaguuccccuaccaccaagccuuauggcuuauuuaagaaaacauaucaaaauuccacgagauuuuugacguuuugauauguucugguaagauuuuuuuuuugacauguccuccauacuuuuugauauuuguaauauuuucagucaauuuuucauuuuuaaggaauauuucuuuguugugccuuuugguugauacuuguguguguaugguggacuuaccuuucuuucauuguuuauauauucuugcccaucggggccacggauaccuguguguccuccccgccauuccaugcccaacgggguuuuggauacuuaccugccuuuucauucuuuuuuuuucuuauuauuuuuuuuucuaaacuugcccaucugggcuguggauaccugcuuuuauucuuuuuuucuucuccuuagcccaucggggccauggauaccugcuuuuuguaaaaaaaaaaaaaaaaacaaaaaaaccuuucucgguccaucgggaccucggauaccugcguuuagucuuuuuuucccaugcccaacggggccucggauaccugcuguuauuauuuuuuuuucuuuuucuuuugcccaucggggcuguggauaccugcuuuaaauuuuuuuuuucacggcccaacggggcgcuugguggauggaaauaugguuuugugaguuauugcacuaccuggaauaucuaugccucuuauuugcguguacuguugcugcugaucguuuggugcugugugagugaaccuauggcuuagaaaaacgacuuugcucuuaaacugaguggguguucagggcguggagagcccgcguccgccauuauggcuucugcgugauacggcuauucucgagccaguuacgccaagaauuaggacaccgaggagcacagcggacuggauaaaagcaaccaauugcgcugcgcuagcuaaaggcuuucuuuauaugugcgggguugcgggauucgccuugauuugugguagcauuugcgggguugugcuagccggaaguagaaagccaaggagugcucguauuagugugcgguguugcgcggaagccgcagaggacuaggggauagggcucagcguggguguggggauugggcagggugugugugcauauggaccccuggcgcggucccccguggcuuuaagggcugcucagaagucuauaaaauggcggcucgggggcuccacccgaggcucgacagcccaaucuuuguucugguguguagcaauggauuauaggacauuuaggucguacaggaaaagauggcggcucaaguucuuggugcgguauaacgcaaagggcuuugugugucacaugucagcuucaugucugaguuagccuggagagguggcacaugcucuugaaugugucuaagauggcggaagucaugugaccugcccucuagugguuucuuucagugauuuuuuuuuuggcgggcuuuagcuacuuggcgggcuuugcccgaggguacacuuggugcauuaugguagggugugguugguccuaccuugugccacucgaagcugaggcaaggcuaaguggaaguguugguugccacuugacguaacucgucagaaaugggcacaagugugaaaguguugguguuugcuugacuuccaguuagaaaugugcauuauugcuugguggccaggauggaauuagacugugaugagucacugucccauaaggacgugaguuucgcuugguacuucacgugugucuuuagucaucauuuuuucgaagugccugcccaggucgggagagcgcaugcuugcaauucuaacacugaaguguuggaugaugucggauccgauucgagagaccgaggcugcggguucuuggucgauguaaaucauugaaaccucaccuauuaaaagaaagaaaaguaucuaaggccauuucaaggacauuugacucauccgcuugcguucauagucucuuacagugcucuauacguggcggugcaaacuaaaacucagcccguuccauuccuuuguauuguucaguggcuagucuacuuacaccuuggccucugauuuagccagcacugaucucaagcgguucucuaagccuacuggguauaaguggugacuuuggccagagucauaguggaucacaaaucacuggugaagagguagaauccuaccuucuuccaaaaucuaccccaugacuauugcugggguugcauuuugauuucaaugaauauuuuggaugccaacgacacgucugauagugugcuuugcuaguguuugaauuuaaaaccgaagugauuguuuucaaaauguauuuacgauuugcuuacuuguugaauucauuuuaauuaccuuuagugaauuguuacuuuggaguccuuaaaguuuucaauaauuuuuuuggcagaugauacucaaauuacuuggcacuuaaauguacuuucuuucaaacucauccaccgagcuacucuucaaauuuuuaagucuuauaacacagauacuguuaauguaaagugaacauuaugacuggaugucaggaguauuugagguucuauaccaguucaggcuuugcuuuuguugcuauuguugaugcuauauugacuaaugguuuuacuugucagcaagagccuugaauuguaaugcucuguguccucuaucagacuuacuguuauaauaguaauauuaaggccuacauuucaacuuucuguguguucuugccuuuauggcaucuagauucuccucaagacucagcaaauagugcugcugcuauugcugccccagccccaggcccagccccagccccugccccagccccagccccagccccugccccagccccagccccugccccugccccagccccugccccagccccagccccagccccuaccccugccccugccccugccccacccaaccaacccaauccaguccagcccugccccagcccaguccuagccccaggcccagauacuuucagaccuaucccaagcccacuucuacuuagagaaauucgaaucuucauugauucagugcuaaaaugcaguguccaucacucagccuauaagacugagacagcccaucuauacccccuccauacugacuucuagagucauggaauuucacuuaaugcauagaaucguauugcuaaaaugcagugcccaucacucagccuauaagacugagauagcccaucuauacccccuccauacugacuuacagagucauggaguuucacuuaaugcaugcaguccuauugcuaaaaugcagugcccauaacucagccuauaagacugagauagcccauuuauaccccauacccccuccauacugacuucuagggucauggaauuucacuuaauacauagaaucguauugcuaaaaugcaguguccaucacucagucuauaagacugagauaucccuauguauaccccauacucccuccauacugacuuccagagucauagaauuucacuuugcauacgguccuauugcuaaaaugcaguguccaucacucagucuauaagacugagauaucccuauguauaccccauacucccuccauacugacuuccagagucauagaauuucacuuugcauacgguccuauugcuaaaaugcagugcccaucacucagccuauaagacugagauagcccaucuauacccccuccauacugacuuccagagucauggaauuucacuuaaugcaugcaguccuauugcuaaaaugcagugcccaucacucagccuauaagacugagauagcccaucuauaccccauacccccuccauacugacuuccagagucauggaauuucacuuaaugcaugcaguccuauugcuaaaaugcagugcccaucacucagccuauaagacugagauagcccaucuauacccacuccauacugacuuccagagucauggaauuucacuuaaugcaugcaguccuauugcuaaaaugcagugcccaucacucagccuauaagacugagauagcccaucuauacccacuccauacugacuuccagagucauggaguuucacuuaaugcaugcaguccuauugcuaaaaugcagugcccauaacucagccuauaagacugagauagcccauuuauaccccauacccccuccauacugacuucuagggucauggaauuucacuuaaugcauagaaucguauugcuaaaaugcaguguccauuacucagccuauaagacugagauaucccuauguauaccccauacccccuccauacugacuuccagagacauagaauuucacuuugcauacgguccuauugcuaaaaugcagugcccaucacucagccuauaagacugagauaucccuaucuauacccucuacccccuccauacugacuuccagagucauggaauuucacauaauguauagauuucuauugcuaaaaugcagugcccauaacucagccuauaagacugagauagcccaucuauacccccuccauacugaguuccagagucauggaauuucacuuaaugcauagaaucguauugcuaaaaugcagugcccaucacucagccuauaagacugagcccaucuauaccccauacccccuccauacugacuuccagagucauggaauuucacuuugcauacaguccuacuuuacuuguccauggacaaguaaacaaagaacucuuguccuucauguuaaucaagauacaccaaucaaacaagaguuuuauaucagagacuugccauggagguaucaucucucaagucuccuuuccuuuaaggaaagaaaaccauucugucauugcuguaguagucacagucccaaguuucuaagcaguguucagucgucuuuucucauguauuaccuugaguacugaauaauucugucagaaauauuuuguccauuggauuagacuuuagcuaguccagcccugugugcauuuagcaaaggggcaaacacaggucuguuaucagacaguuaaagugcucagucccaauuuucaaggcauuggccauuaaaggggguagaauacuauauacuguuggcaugcugucaugggugcuaucgccccaggucacaucuuucuaacugauggagauacauuuauuugcucaugauauuguauacuagucucacaugcuuucuuauuucagccaaaaaccucugcacuggaacauuuuauguggauaauccugacuaggaauugagucuuuucucaagguccuaauacuacccuugcuuuauguaaagagggugcugauuacuuaaugccucuuacacaauugugcaaaauugcaguuguucaaguccccuucuguuaguaaccaagaucccauacccucauacccuaaugggugacaaucaagggugccaaccaaugagaccacuucucuguucuggucuuucugcugugcuggggaaucaaaccuugagucuuguguacgcuaguaaagcacugucauagagcuacagccccaccguguggugguuugagagaacagccucuuauguagccugggcugggcgggacuuacaggcauugccaccuguaauguaaacauauuugugccuguugugugcacagcugcauuugucccucuuccuaagcauuggauaaagaaaccaaacuaagucaagucauuuuguugguaaucaagaagaccuuugaucuguccuguuuuuaacuuccaggcuggccuggaacuuagcauauaacccaggcuagccuugagcucaggaucuagccugcguuuaacaaguguuggcauaucugguuccuaccacuaugcccugcaugcagucuuucauauugugaaugugcauaugucauuucacuguaguaaucugcaucuggugaagacuuauuuguauugcagcaguauuuaagauccuuaacauaguaaaugugcacaguguuaacucuauuguacauauucucauguccacaguugugccuuuuagaucaggacuccuguacuuagcaaagcaaagaggcucacuaauauaaagcuucuuucaugagacuauagauugaaacgauuccaauacggucaaugguccuucaagguaagacuucugucucugaucauucauauccucuuugcuuuauggaauuauguaugugcugugcacuugaaaccccuuccucaaacuauuuauguacauacuggcaauuuuaguaggaucaauuuuacucuuaacuuugaaguacagaagugguguugaccuauaaggucccauuuuguggcuugcuaauaauaaugacugauuguaguaggccuuuucuguucacuacagaaggaaaccugaacagcguaaaacuguaauggccauaaacauguaccuugcauauuaguaugcauuuacugcacacaucucauuccauuuggauacgauccuacucucaaacccuuuugcaguacagcaagggucacuaaucuuuuggcuucuucaucuuccuggacacuggauaaggcuguccccuccuuuccacucuuuaauuuccaggacuauuacuuuaaagacuuaauauuugcauaaaggaugggguuuuuaauugauaacaugucccuugaacauuaauguauauaacagggacaugauccauucauuuuaauaaaaauacuuggccaguuaauguguaaaauuacacuuauccacaaccuuauuacuuuucggaccauuguaucucuugcacuccugcaagggauaccguuuaucucccaaggucccugcuaguggaccauuaauauacagugaaucuuccuuugucuuugccaguaaacaaaggccauacuccuucgccuuucauuugcacuauaucaggauaugcugaucaacaaggccgcauucuuuuggacuguuaucauauauuaaauguaugcguaugcacugccaccugcucugugcacuugaaaggaucccacucacuuccuuagcaccuucagcaggaagugauaauaagcucaagacuuucauuuggaaaguucacaugucuaagcacuucucuaagaacuacuguacccucuucuccgcuuuaaagcagaaagaggguuguacgaagugcucuucauuuggacuuaagugcauuaaugcaguuaguuguccaucauuaccuuuggaguuggauuuuacauccuuguacucuuuugacaccagaggcauauuaauuauuucugagcacuucucuugucaauauuaaucuguacccuuacacauaugaccugugcggcagcaaagguucugaaaugccuaccuuuugacuggggcugcugagugguaguaacuauuaguaaccucagcauuuggaugauuacuaugcaaaaaugucaaggaccugugugcucucuuugcauaccaucaaggcuacugagucccagaauuaauugcuaaguuaugcguauuuauaacuaugaaugucuggaauauuuuguccccuuuacauuauugcagagguugcugagcccccgaaacuacccgguacugucaaugagcacaggggcucugacgaaugaccugcucucuuccuuaaacugauuuugggacucuuaauaggcacaauggcaguucuggaugguuuauuuucuacuccaacuugagcaaauccccugcuaguuucccaaugauauaauaaaguacagcaguauguacacccaacaaugacccggauuucgacccuuuuugcauugcuuuaauauauacaauccuaaauagucacaaucucacacuuuauaguguuccuuuugcccggccucuaguuuguccauugaccacuuuucugaaucacuaauucucacaaacccaucauuaaggaagaguuugugcccuuucucaauuccaucaugccaucccuuuugccucuuuguuugaacaguauugacugggcaaagcccuucucuugacuuaaagucaacaacaccaguuuacucacuucauauggcuacagugucucaguugccuucuccuugcucccacugaacagagacaccucgaauucuuacauuauucuggguaauguuaauuaccccaaacacccuaugugucauuaauaaauuuugguguauuuauacacugaauagcaaaagcaggccaaaacuagguggaugagccuucaaucuuuaacuugcacuucuaaauuauuccaauuccaacugcuggcacauucuagggccaggaaccauucuugccuaccuuuauuaaugcuuuauugugcaaaauauugcaggcaaguagcucagggaguuggauugccaccuuuuacuuggggcuuuccuuuacaguaugaacugaaaauugucuuccugagaaggaagcuuagcacuuuucuuuccguucuuccuccaggaaggagccaacugucugcuuaagaaacuuuaagcccgauuuuguauauugcuacuguacaggaccaacugccagaaaaguuauugauaauuuuauuccuuaagaaaggcauuuggauugcaagguggauugacugugagaucauuagcuuuugugaaguaaaaauagccauuugugucauguuucugaagacuaagcagugucucaguguacugagggugaugagucuguggaaagaucagugcaacuauugcagaauguuuaagacaaguaucuuugcuuggucuuuacuacaaguuuaacaaaacgaaaaagucaaucuuuguguggccuuuaguaugauuaacuuuuuggaagaugaccuaagccuucuaaucauuauauuuugucugacauuggucaccaguccuugcuuauuuuuaaaaggugacuggauggauuaaauuugagaacaugucaagucgccuuugaaaauuauauaggccaucacauuuaauuaauucauucuauccaccauuaaacucuggcaauaauuugaaguagcuugaaaauuccuaaagugggaauuuauuuuagagaugauagaaccuguuuccccacuuuacauuuuaaaauaugucugccaggaucuaaucauuccuuuaaacguacacuucaaagagagauuuuccuaguaagaaaagagcuuucucuagugugaagggugcuuuguagccgccgaguacuuaggucuuuuuugggagcuauuguguaugaguguauguauguguguguguacaugcauguugcugcgcgcagucauucauucacauggugcucagacaacaaugggagcugguucgucuaucuuguggguccuggagaucaaagugagaucaucaggcuuggcagcaagugccuuuacccuccgcgugccaucuugccaucccgcugcugaguguuugauaugacauugcugaugaaaauaaucaucacaacagcaguucucccagcauuacugagaaaugauacuauuuuucugaggaggauguucaaguaacucauccagugcaggauccugcuugaacuacugcuccuccguuacaucagacucuggcuguuuagacuacaguaaguacuaccuuguuagcuacuaagcuaucuuuuucucauucgaguuucuuucugugccacccacugaaaagucaaagugacuaauaagucacuagcucuucucagcuuauccauacacaacacauaguaugccaacgaaauuguagaauuaacacauuguguacccaaucgccauuaugcugggguacacuaaaaugagaagcgaugauauuuuacaaaauuucuuccgugagaugauuauguuauuuaagacuuaauguaauauaagcacacuugagaucauuuuaggaaauguacugccugugugaauuguuuaaguauuuuaggaagucuacugggguugaaauuugacuucuuaaagagggaagugugcuuacuuugccuuguugguccagacgacuauuaguaccaucugguugguuuaucugaaugccaucuguuucuaucuaccucuuggaagcauggaaagaauauuaagagugaaagacuccaugcauuaugcuuagcuguacgccaaggguagcaagagaugagcuuguguaggaauugggaauauaaauuugauaauuugguucuuucaaccauuuuuacugcauuucugcccagaacagaccacuggacggcacuaacagcuuagacagagaacuucauagcuuacaaucuuuuuuuuuuuuuuuuuuuuuuuuuuuuuuuuuuuuuuuuuuuuuuuuuacaaaagugcaaagaaggauaaguuuuaugaacaaauuuuacuauggacuacuuuauguacccuccuugcucauuuuucuuuuucauuaauuaaucaauuaauuuuguuuuguucucuguuuuguuuugugacagggauucucuguguagucuggcuauccuggaacucaaacucaagagauccgcccgcagagauccgcccgccucugccuccaguuuagaguguugggauuaagggugggugccacacuggaccccugccagcacuuuucaacagauacuuucaguuaaaacaacaaauacuugacuccuguguagaaaauggucuagcugaaaaaacauccuuguccauaacacuuaacauuuuuuugcauuugccuuuuguacgugcaaaugacccucuaguacuuuaacccuuuuaaguccacuguaaauuccuucgcagcagguuucccccaacuccaaaggcuuagcauugucuggcucucuaggugauaauacaucuagaacuauugagucuuuuaggaaacuaggaccauuguuguacaaguaacugcuucaaaaggaaacauuugcaaggaaaaaaagcuuuuugagaugcuaaagaauguguuuggugcacuaagacaguuagcuaaagcuucggucucaccuuagcaccauuggcuacccaccccaguacaugcaaagugacccccccccccaggcuugccuaggcaccuagagcuuucagccugccuccuauggaccuaaauagagauuaggacucagacuccaguuaguggccuggaggaagcugguacugcugcuauucacaguaaacccacuaucacugacaguucccuauugaaaugaucaaguugugugagcaggcagaucauuaaucagggccaauucugucauggcaaccuaguccuacaugaccuccacggcacuguaaaauacacacuuauuuguaguaggacaucuggaacaugagcuugucugugauugaaauguccauuaggaggugccaucacacaaaaccaucuggaggccaucuuugguccccauaauugauggaauacaaagaguuccccaaauuaguguccugacccagcccucacugucaguaaucauguaauggaaagccaccaacucgccaucaccaucuucaggcugccugaacuguauacauuaagaaugagcuuucagccgggcagugguagcucgagccuuuaaucccagcacuugggaggcagaggcaggcggaucucugaguucgaggccagccuggucuacagagugaguuccaggacagccagggcuacacagagaaacccugucuugaaaaaaaaagaagaaugagcuuucuuccaagcuguccaauggcuugacccagacuuaggaguuuguaaacaaagaacccuguagaacaagugaauuugagaauguacaccuucauuaaguggugggaaguggaaguaguggauuuugccagcugauuuuacaaagcccuguggcagaaccagaccaggucuuuguaugcauacugccauauaaccuagccacuguccaaccugugcccucucucccaguccagugaaccucuucugccugccccuuacuuaguccucuggcucaucccaggggaagauggcucuauuuguguagucauaagaaaguuuuguuaauuuuaaauaaaacaggaaaagagaaagcucacuuaagacgagagcuggagagaugguucuguuagucuuccagagguccugaguacaauucccagcaaccacaugguggcucacaaccaucuguaaugacgucugacucccucuucuggcacacaggcauacaugcagauagaguacucaaauauacaaaaagggaaaagaaaugaaaggccuuugaaauguagacaugcuuucaauuuuaaaggcuguuuucacaucucuuaagaacuagggguuccaugagaacauauccucacccugaguucuuaccaccaauugaaaacgcugacaugugcauaugaagauuguauugcuaguaaucaaauuaucauuuguagaguuuaguauaauuaucauuuguuuuccagggaugaauuuggagucuguuuugugcuccugccucaagaagaaggauugccuggauuuagaggagugaagagugcuggagagagcccaaagguauuuccguuacuugguugacugagauaguaucuucccuuaaaggucuaaugugucaaguuauaccuccuaaguaaauaccucauuauuuucauguggaauuuucaacaauuuuuguagucuaaugauagccuuguauuucuucacagggacaaacaaucccuaugugagacucaaggacugccagcagccuauacagcuacauuacaucucagcagaacuucucuucaaguccucgcuacucugaacaaaaagcuuacaggccacauggagaaaaaaagguacuuuggagaauuugcuauuuggggguuucuaucugaucuccaguucaucagagaaugagggggcaagucaauaaagcacuccccaucuccugguccccuggcauagucaguuagccaaugagauccuugccuuaugaugaggccuugaaaucauccccaccauguuaugaccaaucuguaacauuucugcucugaaaugccuaaaagguagguuaucagaggaaugaaggccaguuucugacacccuagucuuuuguacuugauagaguaaguagauauggcuguugucacauucuguaggccugucauaauucuggucucugaauauccucaaacucagagguccaaugcuacaccaguuucuagggacauaugcaccauaagcacugagccaaacaaugcuauucaccuugccaguguucuggcaugguauuguuuaaagcacaaauuaaaagaagaaaauaauuuaaccccuuuauucccagaguauuugaaguacaaggacuuuaacacaaccuauaaucuaaaggaucucucauugguaggugacagaauaaaagccagaaagaacuuggauggagcaauucucaugucucuaaguuaacacuaagaucuacaaaugugaaggguucacucuccaagccccuccccaugauuuaacacaacugcugguuacuacauaaugagacaacuuucccaguauucuugauuucaagaauuggcuuuucuuucaccucuuuuccagaucuccccccagaauugugggcuugcugcuuugcagugcuggcgaccuauucccuuugacgaucccuagguggagauggggcaugaggauccuccaggggaauagcucaccaccacugggcaacaggccuagcccagauuucagugagacgcuuuccugaacccagcaaggaagacaaaggcucaaagaaugccacccuacaucaaaguagguaaguuuucugcaacaguguaauaauuuuaacuuugaucuuguuuuccauuaaagucagccuuuuacuugagauauauacauaaauuuuaucuuuuucccacaucugggaaauguaacuaaacagugcaaauguuucuucuaggagaaaagcugcugcaauaguggcacugaccuucgaggaagccauucugcucuauuugguucucucuccagaagcuaggaaagcuuugccagcuguuuacauacuucaagaugcacugcuacccuacucaugccauauaauacacaagugaguagcuuauuuaccuaccuagcuauuuacgaguacacuguugcuguccucagacacaccagaagagagcaccagaucucauuacagaugguugugcgccaccaugugguugcuggggauugaacucaggaccucuggaagagcaauaggugcucuuaaccacugagccaucacuaacauuacugaugaugaaugccucuaacuacaaauggaaaccuggcuggaauugauacagaaguaucuaucauuaggcagaauuuaaagagccaggauguucuaguacuucuuuccuggcauucauacagcuucuuuuguucuuuguagugccaucuaccaaauauuacccuuccccaaagcagcacagaaaacugggucuucagcgugaucaagcaaugugaacacacaaaaggaaggcagcuuuauaaaugacccgaggaucaacaugccugacugcagcaucuuaaaagcaauagaaugagguaagucacuagcauugcagucuucugaggauuugcauuugcuggaagauggugcuggguggagagcaucuaaugugauaaugugaggcagggccauguacacgauggaagaugaacaggcuuucacguuaucaaauggccucacagcagcaacucaaacuauuaucugcuuaccaguuauaucacaagaggaauuuagcuucuagguuuuguuguuguuguuguuuguuuuggcuuggugcccuaccauucuuacagacuuaaacauugaaaagcuuuaaauaguuuauuucuuaucuccaucugugaagcagccauuagacuugugaaggauguaaaaaccaagcccccccuuuuuuuuaauagaagaggagagugaagcugacaauuaaauaugcagucgcuuauaguguuugcugcuuacagaagcuuuuaauccauguaacagaauguugagauguucauucuguguuuaaauguaauauccccuagauguaugcccuuuggcaauuuaguucugcuaagaccugucuguuugugaaggucaaaugaaaucaugaauggaaaguguugaguacagagccuggcaaauaugcccuggaguugcaugacuaggccauuuggaagaguugacggguguguccuaugguccuauguuaaggaaaccuuaaguuuaacguugauagccugguacaguguacuaauggcaauuuuuuucuuugcccuucccuguuucuuguuacccucuuucugguggucuuugcuuacuaucaaucauuaguguguauugugggugugucuauuucuuguuuuauguaucuauuuuuuccuuggucugugugucuaauucuuuguuacaucuauuucuuccuugcuuugugugucuauuucuuccuugcuuugugugucuauuucuuccuugcauuaugucuaauucuuuguuauaucuauuucuuccuugcuuugugucuauuucuuccuugcaguugugucuaauucuuuguuacaucuauuucuuccuugcuuugugugucuauuucuuccuugcauugugucuaauucuuuguuauaucuauuucuuccuugcuuugugugucugucuuccuugcuuugugucuauuucuuccuugcaguugugucuaauucuuuguuacaucuauuucuuccuugcuuuugugugucuuucuuucuugcuuuugugugucuauuucuuccuugcaguugugucuaauucuuuguuacaucuauuucuuccuugcuuuugugugucuauuucuuccuugcauugugucuaauucuuugguauauauauuucuucauugcuuugugugucuaugucuccuuguguugucuaauucguuguugcaucuauuucuuccuugcuuugugugucuauuucuuccuugcuuugugugucuaugucuuccuugcuuugugugucuaugucuuccuuguuuuguguaucuacuucuuccuugugugucuaauucuuuguuacaucuauuucuuccuuccuuugcaugucuccuucuuuccuuugugugucuuuucugucugcagugugucuuaccuauucccauguuucuccugcauguucuuucuugcagagcuuugagcuuuguuucacuuucucuggugccuguguggucugcuuugucuucacuagcuauggcucucuguuuuaucuaucugguugcuauuucucuuagcuuuucuuucacuccugccuuucgugacuccccuuugggucacauguugcaugcaucccucucuuuuucuugugcucaccccacuuguucuuuguucaaguucucuuugucaguccauuucaguuuucuuucugcugcuucuauccuuagugaauucuuguuuacauuucuucccugccuuucuugggccacuuucucuguuuucuuuuguauuugugucucuuugcuauugguggauuucuuaucucagcaucauucuguugcuuuguguuugcuuguguuucuaucuucuacuuuccuccuuucuguucacuuugagcauuucaucucuuuacaagucugugucucucuuguauucuaaaguaauccuuucuuggauguuucuuuguauguacaugugcgugugugcauguguguuaugugugucaugugugagaggagcuucauagccccuucccaauagguccagaaugucacccguggagccguuccucacaccagacugcccugagaaauaaucuaagacaaaauacaucauuccguccggucaggauucaaguggcucugaagugaacgcccaaguagaagacagaaguuuugcgacuugagauuuaaaaggaccaaaauacacagauggcccgucuugagcuggcuggacagaaugcugacaacccaaagaagaggaacuguuucuacaggacaccugugacuuccaagagcggggaacuacguaugucauaagacacaaaaccugagcuaaguccaagcauaagaccuaaggacccaauccuauauggacagaauauuuaagagauaaaggccuauggcccagaacucuggaaggauauuucuauccuucuauccccaagaccaagaagggaaauucgaagaugagaccugccccccaaccccagcaucccuuuccauuucuuauauuucuauuuaagcugucuucacuugagauguaauuuuucauuguugccauugcccauaaaggaauacguuuuuagcuggauaguauugugcaagggucuguuuuaaacugggucuuagccauuuguuaaauuguugauguuuuacaacuuccauuucucuucacaucugcuccacuugagacggaacuaaauccagccaguguauauagccugacuauugaaacuucccuaggaauaagcaugcauacagauaugcauacugccauccucccuaccucagaagcccuaggcugacaagaaaaggaaagcaucagguuguuagggggaaaacaaugucaggcuaucuagagaaaauauaaagaguuguuccagaccaaugagaagaauuagacaagcaauaugcagaugugccaacccucugagaagcaccagccagugucaccuucuuucuuugggcuuaggugagcaggguaugguuuucuaauaaugguuuggggacaaaaugaggucugaacucccugcucauaguaguggccgaguaauuuggugcauuucaccaaaggaacuccugggucuaauaccuaccuuuaaaauuaaugaugagagacucuaaggacuacuuaacgggcuuaaucuuuuucgugccuuccucuuccucuguaagagggaaguuaaaugacacaggaugaaaaaguaacaugcucauagcacauuggcaauuauacaugguuauuaucugaaaguguagagcuuuuccuauaaggcaucagacuaaguaccugaagcuuuguggguucauggucuuaguugcauauuccuuaguugcaaauccuuuucaaaagguaagaaaaaggcacacuggucuauugccuguacuugaucaagcccugauaugaaugccagggaaugucugaguaacauuaauuuccuucccugcauauuuuuugugcugaauacuaaggcugugaugcuucacuguggucacccccagguaacaagauauuaccagguaaccaggaaacguaugaauacguaaaccaugaagccuacuguaacuuccaagucagugcugaguauguauuacauaguagcugaagucuacgccucugugugcuauaggcacaaagauugcucuaggaauaacaugcuuuguaaaaacaaauauaugaacauaacggggcuugaaugaauaacaguccauauacuuaaggccaguguguuucuucugcuuuggugaggcucaguaaguuauauuauaccagguagcagaagagaaaacacauggaaacugauuuuaaacuacaaacuaggucacuaaugcaggugauugauuacccuauucugaucaccuucuaauuucugaauacccauguucagcacugggaauaacaaagggggacauuaccacagaacuagaauuuacaaaagaaugcauuaaauaaagcauuauacagcuaucaauuguuccaugugugcaaaugaaugacuacuaacuaccucugauguauccgauauuguuuuggguacaugaaauauucaugaguaacugccaugaaauaagaauguuugcauuccauacuauucauaaggaaugagccaaugcuuaauuuaaucagucaaaacuugagugauaagggcauguuaauacaagaacauuugcccaggucacauuaugguuguggguacuuucuuaacuauaaagcaguucaguaguauaagacaagacaaauuuucuauagaaauaaagcugccuauaaaauaggcauagucucuacaaaauuuucauuguacuuuuuagcccauaaugggaagaguacaguuaacaagcugggugugguagcaugugcucugagcugaagcaacaggaccacuugagcccagaaauuggaggcuagccugggaagaccauaaggucaaucucaaaccuggaggcuaaauauugucucccauguguauauucucuuucauggguacuggagagauacacagacguacauuucaguguguccacacuugagaauaauauguacguuggcauuuuaugaacucggagguaccauauaaauguaacaauucauuuucuuacuugguaucaauuuccaggcuuuuaaaauucugccacauuuauuauacugugaaaauaaaguaaauaaguaacugugaaccacugaauauaugaagcauucaauacuugaugaguacauacugaauggcagucauuuauuacaaaacagugcccuugcuaggcacugggaugcaaagagcauucucauuguccuguguaucuaaagaaauuaugcaugagauuaauuuauaauuuguaaacugccauauauauguguauauaugcaauauuugccuggugugcaaugacuuugcuuuuaucccaggcaugcacaacagaucuguguggagcuuugugaagucuacaguucuauaaagccgggaccuaacuguuggcuuuaucagugaacagugauuacuuucuaaguuucauaauggcugaaacuuaaucauaaugcuuaucaccuaacaccaccuaauaauaauuuuaccaugcuauguguugagcgaacacauagauugcuuucuagcauuauguagcacuuauaggagugaaaucuagaccaaaacuucaauucacuucaaugaggaaaugaaaacagaaaaaaaaaauggauuugugcaaggcagugugcuaaauguuacacugaguggacuaugcugucuaggauacuucccagcuggcuugacugaggagguggaaaagguuuuauuaaugacaggaacuuuuuccauccaguuucuuaaauguuuguugaaugcugcugccagagaugaauuacaaacaccuugccaguaaaggaguuuuauagggccagagugagauaaucccagagcauggguaucagggaacaaaacgggaagaggccagagcaucugauggcauguacucaguguggcccagaaccucucgaacuagauguacuggcuggagggaccaagcaugcagaacacaacaccuaaugaaacauuguauauaaaauaugcuaaccuagguccuaaaacuaaaaugugagguggaccuaguguagaucacugaucauaggagacauggucucauaaagcccaggcugguucuaauuggugacugucacagcuucucaagugcugagauuacagaugugcuuaacccaugcccagccugaagaauauaucugauuacugagugaauaauauuuuuaaagaauuauauauuuuauguauaugaguacgcuguugcugucuucagacacaccagaagagggcaccacaucacauuacagaugguugugagcccccaugugguuguugggauuugaacucaggaccuucggaagagcagucagacucuuaaccacugagucaucucuccagccuucugaguaaauauuuuaacuauaauggcuguuugcgaaacccaaccaaggccaagauuccuucaacauaaacuggagacuuccuagcuaaggaagcuccaaaagucauuuucucauuggccuagcuugaagccaggacagacuuaaagucuguccuuuaauucauuacccauuuuccuuuucuuacuguugaaguguuucaaaggagaaucaagaugaaucgauaauucuaaacguauuuguucauugccuggcucagcgucaugugagcaagaagaauauacuaucacacucauacuuuuaacuuaagugugaugaaagugcaguucuaaguacuaaaauuucuaaguacugaaaagaacaaagacauuuaaaggaugcaacccaaaguguacuuuaccucaguaguuucugaggggacugcagucacaccuugagacuacagcucucacuuuagcugggaaaaacaucaagguguagaggaggcaaguuaaauaaaaaguugcuccccuccucaugggcaugcuugguagaguggaaauaauaaaagagguucucuauuuccucgguuccacacauugcagaagaugcuacuggaugcuaagugcaacacauuuguuccaaaagggcacucagugugacuuacagaugccccggaaagcagagggaugcucuuuauuaaacagaaauauuagcucaaacguuuucuagacugaagaacacuuuccucauuucccacaguuugccucagagguugaauacaggaagguuauuauucauucauuugcuuuauugguucgccuguucuacaaggauuugcaugucucuuaggccuucacuuggcuccugagacauggaaaaaggaaacauagacauagggaagugcuggauggggggggggggucucuuuucuggguaguggcacgacuuaguccuuaguccccaaguaauaugcaaugugaguccucauccucaugucuucuccggccacugcaaugagugggaagcugggcuuuguagcaagccugacccuaaaguuacagaagcccuccacgcuaagaaacucaauuuucuaggccauuuuagcuaugacugugaccacuacuggucaggagggaugacagccaucuaaguuccacaaucuuaggcuacuuugcauuauccuggggcaaacaagccauuuuugagcugcagcaggcuuugaaauacauugaccaauuuugccuguguucguuaaaccuuuuaccuuuuuacaugcuaaugcucacaguaauuuagaaauguucuccuuacuauaauauacucaagguggcuugcuaugguaaaauaaugccaguggaugaaaauaacauuaauguuuaacauucuugcauaaaauuuaagaauaauaaaauugacaacaaucagaaaacuggaggaacgaaagaccaaauugaaagaacuugaaaaagauuaaaaaugccugugcuuugacccuuuccauuuuucuuucacucacagagggugggacaggaggccgagugaaggaaaggguccagccugucuaucuggaaucuaaguugggacuuuaaugcaguuccacaaaauugguauuaauucgcuaaauguuucugaaaauguauuuucaucuaaauggcuaucagcuaagccuugagucaaaugggaaugaaacagauuaagucaaugugaucucuuuauccaaguugccuuagagcugaagucacaauuugcuguaaggaagcuuauucauuguagcauacgcauacuuucaaaguaucuagacuuuacuuaguaacccaaucaggacauucaggcaaaagaaaaggaacagagaagauggagccagguugaagaggucugggaguucaaacaaauuuuuuucauuuucauuaaaacucaauugggcaucaaaaguguuacuaauauuagcuuuuaauuaguggaaauuggcuggauucaguaauaucccuuuguauggguaggaaugggcuuacauuucuggaauuugcaaaggaaaaaauaacugaaagccuuccuuucacaguuacugccaucaauauugcuaccaauuaagcacauccuaccaucaucugcuuugaucacauaaaugaacuguguaccaaucuguuguugaaagacuggagucaucuucccaccaacugugaaaaaacacauggaaaacaccuggacuuugugaacggaugcggaauacagaacuucuguugacucuuggguguuuugaagacuugaaaaaaaaaacuguugcuuaccaacaugucacaaugaguccguguguggguggguggaugggugggugggugggugggugggugguugagugggugggguaguuugcuguuaaauaaaaugcuuuguuuugaaaacaucaugugcuguauaugauauuuuccuuaaauuuuauuuaaugugcaugaguuuugucuaugcauuagguuuggguguuauacccguguaggccagcagagggugucggaucccaaggaaaccaaguuacagacgccaucuuguguguagccggaauguaauucagauccccuggaagagcaguuagugcucuuaaaucaguucaccuuaugcuaauacaaggagccaacaaaaccacaaaagccucaucuacaaugugauuggcaagaagagaaagauagacagguacugcaagcgagugugagugaggcagguacaagaaucuauuaugguaucuuaaccacugccacauuccccuuuuccuuugcauggagccagaacuaggcuagccuccaagucccuaaguagccggaaugacucugagcuccugauccuccuguguuagaauuacaggcuuguaccacuaagccugcuuuucagaugauaguuucuaacucaguggcccuuuuaucauaccagauaccucaguuuuaauucccuauguaaugaaauugguuauguugcccuggccaucuggcuagccugaaguccauguagauuaggcuggcccuaaauccauagagcacugucugcuacugacucaggagugcucggauuaaaggccuacaccaccaggcaggccuagccaguuccuuggguaauuugaggucucauaacuuagagccuaaguuguucaggagaaagauuaugagaacacaaaucuaauaagaucacgagaagcaaaauauugaggcucaaaagugggaguacugguaagaugaaaugaaaagaaagaacauggcugucaagaaguccuugaauagagaaaggggccucugauaguucuaaaauucaaagugacaaaauugcgucuaggagaaaagauaaauucucucaggagagaguuuguacuguuagacauggcucugccuagccauugcuaaccaguagaagugcuccaacaaaaccgggccuucguuuccauccaaugaaugggccagaaaagcaacaacauuuuaccugaaaucaguucaccuuaugcuaauacaaggagccaacaaaaccacaaaagccucaucuacaaugugauuggcaagaagagaaagauagacagguacugcaagcgagugugagugaggcagguacaagaaucuauuaugguaaaucuuaacaucuuuggaaaauagcauuggcccaacuccaagaagcccaugaaaccuuaccauuuauuacuggcaacuaaaggauugggacacggggcacucaaacguauccacugaugaguauuuaauaguuccaaacuaugucuggggugaacuaugaaacacuaaacaaaauaaaacuagcaaauaugacagagacauuuuguaaggaauaaggggugcuggccagggcgggagggaaauugaaaguggaagaguaagcagaaugcauucuauauaccuaugaaaaauuucuaauaaaaaacccuauuuaaagccgggcgugguggcgcacgccuuuaaucccagcacuccagaggcagaggcaggcggauuucugaguucgaggccagccuggucuacagagugaguuccaggacagccagggcuacacagagaaacccugucucgaaaaaacaaaaacaaaacaaaagaccugucugagcuggagagaugauggcucagguuaagagcacuggaugcucuuccagagguccugaguucaaaucccagcaaccauaugguggcucacaaccaccuguaaugggaucugaugcccucuucuggugcgucugaagucagcaacaguguacuuauguaaaacaaaauguuuuaaaaaauagaaaggaagaaagagagagagagagagagagagagagaugcucucauaaacaacguggaaggccagaugcacaccugaaguuguccucugacuccauuaugcucugugcaacccucacccacaaacguguacacacaccauccacauucauauacaauacgcaucacacaaaagaaggaaggaaggaacgaacgaaaaagagucaagaggagggcugccagcauccuugcccugauggcuagggucgcugcacgggucagcagcacuggacucccucgucugacugucacccuggucauuuagaagccaaacacugcgauucuucaaaggcgggaucugggcuaaguaaggauguggcucagugguagagggacagccagggccucgaacucagaaauccgucugccucugccuccggagugcuggggauuaaaggcgugcgccaccacgcccggcuuuaaauaggauuuuuuauuauaaauuuuucauagguauugaagaggcacacaugagccccuucaugguuugcuagaauaaaugcucuuggugauauaacuugguuuccucagccuggguuccucaacuagaaacaggcaguuaagguccaaggcaugaguugugagcugcccgggucuuccaggcaaccugcaagugacagguucuugcuaugcaugggcauccuuauucccccugggugaggagcuuuggaaacucaggggcagggagacuccuucugaggcuucuggaaagagagaauagaugugaggaucagguagaaguucccagacugucccugccauccaagagggaggcaggagcugggcuggguaugggucacaaagccagcagcugcuagcacugaggguccuugccuuucugucccauggccccucucccaucugcacugugguugcagagccugagccagcacuucccccgacuggagaaugacagaggcagaguccacuccucccauuccggggcgggaagccaccauguugcaccugggcccagcagggccugggaacacgaggagcccacggcacccaaagcccuccccucaacccagguccuugcgcaaggucaggagagggcaggcaaguggccauuaaaacugcccucccggcacaauggcacagugaggugaagcuggcacaagaauaaagaagaggaagaaauagagcuguagauagaagagacagcaacguguaauaacauggcgccuucaagggucaggaagggcuauucugcaaguaaucucagguuaauuaguuccucugugcuuuacucgaaccaaaauuugucuccuaucagggagagaagguggaguggauaagauuaaacuaagcacacacagagacaauuguuuuugcuuuuguuuuucuuucauuuuugagucagggucucacauugcaguccuggcuggcuuggaagucucuggcauacugcuggaaacccaagcacucacccuaaccaagcacucacccuaaccaagcaugcacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacacacccuaaccaagcacucacccuaaccaagaacucacccuaaccaagcaugcacccuaaccaagcacucacccuaaccaagcacgcacccuaaccaagcacucacccuaaccaagcaugcacccuaaccaagcacucacccuaaccaagcacacacuguaaccaagcacucacccuaaccaagcacucacccuaaccaagcacucacccuaaccaagcacucacccuaaccaagcacucacccuaaccaagcacacacccuaaccaagcgcucacccuaaccaaguacucacccuaaccaaguacucacccuaaccaagcacucacccuaaccaagcacucacccuaaccgagcacacacccuaaccgagcacucacccuaaccgagcacucacccuaacccagcacucacccuaaucaagcacucacccuaaccaagcauacacccuaaccaagcacucacccuaaccaaacacucacccuaaccaagcacucacccuaaccaagcaugcacccuaaccaagcacucacccuaaccaagcaugcacccuaaccaagcacucacccuaaccaagcaugcacccuaaccaagcacucacccuaaccaagcacacacuguaaccaagcacucacccuaaccaagcacucacccuaaccaagcacucacccuaaccaagcacucacccuaaccaagcacucacccuaaccaagcacucacccuaacuaagcaugcacccuaaccaagcacucacccuaaccaagcaugcacccuaaccaagcacucacccuaaccaagcaugcacccuaaccaagcacucacucuaaccaaacacucacccuaaccaagcacuacccuaaccaagcacucacccuaaccaagcaugcacccuaaccaagcacucacucuaaccaaacacucacccuaaccaagcacuacccuaaccaagcacucacccuaagcucaguuccaauagaaagaauaacuaaaagaauucuguagacaagggagggcuuucuagguuuaaaauuaauuuacuggucccuaaaaaacaaacaaacaaaggggcuggagaaauggcucauugguuaagaaugcuggcugcucuuccggaccggaccgugguugugguucaauucccagcacccacauggcagcucacaacugucuguaaguccaguuccaggguaucugacacccucauacagacuuacauucaggcaaaacaccaaugcacuaaauaaauacauacauacacaccgaacaacaaaagacuacaggucugaaaaaagccaguaggcauugcaagccuggaggugguggaccauggaucagaauucaaggcugggcugggcuacaugagagccuuuaaaaguaaguaaauaaacaaggccuuauucucuauucccacuagggaaaugaagcaaacuauaauuggauaucccucgcaucuaccuacuuggaauagcuaucuagaaccuaggaaccagcugguguuggaggcaagggccuguaaccgcggcacuugggagauuuagagcaagaagaugaagaauugggucuauccugggcaaugucaugagacucugucucaaaaaaaaaaagaaagaaagaggagagagagagagagagagagagagagagagagagagagaggaagaagaagaggaggaggaggaggaggaggggggaggggaggaggggaggggagaggagaggaggggagaggagaagaaaaagaaaggaaggaaggaaagaaagaaggacaggagagcuggaaagauggcucagugguuaccaagaacauuugcuacucuucuggagccccugaauuuguuuuuuguuuuuuuaaagguuuauuuauuuuauuuauauuaguacacuguugcugucuucagauauaccagaagagggcaccagaucccauuacagacgguuguaagccaccaugugguugcugggaauugaacucaggaccuuuagaaguacagucagugcucuuaacuacugagccgucucuccagcuccugaauuuguuuuuuguuuguuugcuuguuuguacguuuugagacagggucuuguagcccaggcuggucucaaauucucuuuguagauaggaugaccuugaauuucugacacuucugccuugaccucagugcugugacuacaagcacaccccucaccugguuuaugcagguuccggauggaacacagggcuucaggaauggcagagaagcaaguuaccugacucuugcucagccauuuugaggcuauaggaggagggggacaccaggcagugaguccccaugucaaaaaauaagucgagccaggcagagagggacgugcuuuuaaucccagcacuuggcaagcagaggcaggucgaucacugugaguuugagaccagccugggcuauacuauauagugagccagccagggcuacccuggaaaacucuaucucaagaacaaaucaauacuguacucuccucgaccuuggccagagaaguuucuucugcaaggaggagcagcuaaugcagacucagagcuggccugagacugagcaacaauugcaugcuuagcuccaaacaaggugucuauagcaacccacacacugcccaaggcccauggaacaucguggaagcagggcuggaaagaacaugagagcuaaagauggggaggcaagcugugaaaaugcuggcugccgcccucacaagcguacugcggcuguggcuaccugcauacgauuccgacaagauuagccaacauuccagcaagcacugcuaacuggacucacaggguuguuauuauuauuauauuauuauuauuauuuuaaaaggagaccucauuaagguuauaggaagacagcuucgggauguguagggagugggggagaaguacgagugaaugcauguaugaaauugccaaggaauaaauaaauauuaaauauagggaaaacccaacacuuggaagguggaggcaggaagggcaaggucagcguuggcuacggagcaaacucaaagccagcuguacugcaugagacugcgucucaaaagaacaaagguggaagaagagcucagcaguuagcagcacauguugcucuugcugagaggaccugaguuugcuagcaagcaccuaagucagguagcucacaagccucugucacuccaucuccagggggccaaugccucagacacacauauuuaaaaacaauugugagcaggguguggugccgcaugcgcaugccuuuaaucccagcacucaggaggcagaggcaggcggauuucugaguucaaguccagccugaucuacagagugaguuccaggacagccaggacuacacagagaaacccugucuugaaaaaccaaaaaaacaaaacaaaacaaaaaaacaauuguguguguguguguguguguguguguguguguguguaugugugugugugugaaacaaaacgaaacaaaacaaaacaaaacaacccuacuuucauauuuuuaccacugguaguaaaauccaacacuaaaaggaauuccuggcauaagaaaucuugaggaugaaaagucaauuuaaggguauguuugaacauagcacucugauaaagacaccauccacccauuugucuaaagugaguuagucuucccaaucaaauccucacuuaugccaaugccugccuuaaauguuuucuauguguagucuccucaauuaccaucaacauucaaaccaucacuuuccccuauaauuccauuuaccuuggacuuucacuuccagccuuauucuaauuucuugggcuuucauguuuauucgucaacuuucauuuucauuauacaaggaccugauaaguuuuuauugauaaaaguuuuauuauuugcuaugaauugaaugcggcuaugcccucauguguguguguguuuaaauaguaagcucagauguuuacuuaaaaacaaaacaaaacaaaacaaaacaaaaacauguguuuucuagccaaguuggucaggaacugacuguguagcccaagcuagucuugaacuagcugcaaucccuuucugccucugccuuuaaagugcuaacaagugugagccaccugcccagcuauaacuacuauuuuuuaaugugagcacuuucuguucucacagaggaccugguuugauuuccaacacccacauuguggcucauaaccaucuauaacuccaguuccagggauccuagcaaacccucuucugacauuggugcccaacaggcauacacaugauucacaaacaugcaaacaagcagaacacucauacacguaaaaucuaaaauaauaauaaaguagaccuauagaguauauauaauuccaaauggauuucaguagaagacccuacuuacauugcacagaaaaagcugucuggcugcuucaggcaugccaauaucagcacauguaaacaagcuuccaacuuuguuuuugaguaaucaacucauuauucaccagaucugaggcuauuucuauucaacagcacaagaaaagaagggagaagcaggaggaucucugugaguuugaggccagccuggucuacagagcuaguuccaagacaccagggcuguuacauagagaaaugcugucucaaaaaugaacacacacacacacacacacacacacacacacacacacaagcgcaagaaagaaaccauucgaauuugacugcauauguacauaaaaccuuuaaauaaaagacguaauuucaaaucaaaugaggucuuaagaauggagccuaaaccugucugucucuuuaccagacgcagggcagccagaaggcagccauucacaauccaggaagacaggaagggauaacaccagaacccaaccuccauuuuagagaggucuagccucuugagcuaugacacacuauuuguucucuaacuacccaaaguuguauuuuacuaugcuaauuagcugauuaagacauuagguaaagguguucuacaaagaaacuguaaauaaaagacauacucugugccuuagccuaucucaugauuccuuuucuggaugucuucauaaccaccuuaaccucuacgaagauacagagacacagguagcacuacagugcuguauuuguuuaagcccccaacaaacuugguggcuuaaagcaacacagaucuauaaccuuauaauuuuagaagucagaaguucagugugagacaccuaguugaaauugaaauuauuauuugaaauuaaauugaaauuauuccuucuguaaguuuuagagaauucauuucccugcccuuuuuagcuucaaauuucuuagcuaguaauugccuuccucuaugucuauagccggauguagagucuuugucaaucuuuuaucccugccauuucaaugaaacaacaccuuaccuucuaggggaaucuuuuuaucucaaggucgauugauuagaaaccucaguuucuuccuccaauguaauauaguauauuaguauauucuggggagucaguguuugucugccuacuaacacagguaagaauuugcauagguauuacaaaaucaguacuuugcaaaucuuucuucucuuccgaauugaaaacugaacauuaauccaaacauggcggcagaagccuuuaaaaucggcacugucccacugaaggcaguggcaggcagagcuuugcgaguuugagguuauuuacugagaccuugucucagaaauaaggcauuaaaaaaaaaacaaaaaacaaaauucaccccaaauccgcaucaaaaccaaagcugauuguuaauuucccuccuuucuaaacuggauucauuccuuagugccauuguuugcucgucugaacacacugaauaaacacuaccgggagggauuuuccgugccuauaguaaauaagaauaugauuuuucagauacgaaccacugagaauuguuuugccuugcccgccacccccaccccgaaaauacuccuugucccagauaguagaaacuuaauggguuuucaaagcacucagauuauuuucgaauuucaacgauaccagagaucgggucauuauguaccucggaaauaaacggaacgcaguaccaaaauuuuaggucucaacuuccaaggcuucucaaagaaaguuaucgcagacuuaguuacucguucuugguuacuucacacgcuaccaguaauuuuuccacuuuucugaaucugugccccccccccacauucuuucaucaacuuuaauccaaacgcguacaaucagaaaaccccacuaaagcggagguagaaucccauugguuuuuagcauaaucacauggcgggaaaauuguuaccaaaaaaaaaaaaaaagagcaaaaaucuuaccugaaaaagacacgugcggugagguaguauugcugaauuuggcuugagcaauauuaaaauauuaagacuauuccaaagaguuuuucggacacgaggcuuucccugaugugaguguguggauucuagacccugcuacaagucacgcccuuaacuuucuuuuccgcucuagacugcaguuuauuacccacgccaggcuuauugaacgcuuugcauaucuaccuguaacauuuuagccaaccaucucuacgcuaucccagacauuuucaucaccucugcucugcccagcagacauuuuagucgaccucuagggguugguuauaaggcagggauuuuagcgaucuccccaggucccuggcggcggcaggcauuuuagugauagcccagguccccgguggcaggcauuuuagcgauagcccagguccccgguggcaggcauuuuagcgaucuuccagauccccaguggcagacauuuuagugauagcccagguccccgguggcaggcauuuuagugauagcccagguccccgguggcaggcauuuuagcgaucuuccagauccccaguggcagacauuuuagugauagcccagguccccgguggcaggcauuuuagugauagcccagguccccgguggcaggcauuuuagcgaucuuccagauccccaguggcagacauuuuagugauagcccagauccccgguggcaggcauuuuagugaccucccagaucccugguggcaggcauuuuagugauagcccaagucccccguggcagacauuuuagugaccucccaguaagcgguggcaggcauuuuagcgaccucccagauccccgguggcaggcauuuuagugauagcccagauccucgacggcaggcauuuuagugaccucccagauccccgguggcaggcauuuuagugaccuaccagguccccgguggcaggcauuuuagugauagcccaagucccccguggcagacauuuuagugaccucccaguaagcgguggcaggcauuuuagcgaccucccagauccccgguggcaggcauuuuagugauagcccagauccucgacggcaggcauuuuagugaccucccagauccccgguggcaggcauuuuagugaccuaccagguccccgguggcaggcauuuuagugaccucccagguccccgguggcaggcauuuuagugauagcccagauacccgguggcaggcauuuuagugauagcccaaguaccccguggcagacauuuuagugaccucccaguacccgguggcaggcauuuuagugauagcccagguccccggugguaggcauuuuaguaaagucucccagucccaggcauccauuugagccauuaguccgggaacguggcauguauguuagcuaucuuuccaggucccugaccgguagucuaaccaccuguaagggacagacauuuuaaauuuuggcuccaggacccagcagacauuuuaguuauuccuccguuaugcggcaggcauuuuaacuaucgguucgggacuacgcaggcauuuuaccuucaucuccgcauagcuggcaagcauuuuaggaaucuuucugcugcuuggcaaucacuuuaaccaucucuuccgcugucccgcaagcacguagccaucgcuccacuguccugaaagcacuuugccacugucccacugucccgcaagcacuuagccaccucuccccugucccgcaagcacuuagccaucgccccacuguccugcaagcacuuagccaucgccccacuaucccgcaagaauuucagccaccucuccaccaccccaacaaggacuucgggcaccucuccaccgucccgcaggcacuuuaggcaucugcccucuccuuagcccgcaucucacccaccgcuccgcucuggccaccugucuagcuggcuaucacgcucuucuuccaucacgcgcuugccgcagccgccucccgggaguggaugcaggacucaagaugcguggauaucucggaaagugagaacagagcaagggcgccgagcgcaaguguguagcgcuugcagguacuuuugggaccgaguggagcacgacguagcgccucaccggaucuugcgagauugcgccugacacaagcgcugcacugaggguuugagggaguguggggcgggaccuaaggcucuugaggcgcgggauccugcugagagggugugguuagcacacuugaccaccugcgcagagaagagggggcagagcuuaggggaacagagcauggaccuugugggagucacagaaaagaauggcugcaaccugagcccauuugccuuugagagcugggaaagcuaggccagcagguagcagcuugccuggucgaauggcccuuggugaguguuggaaugcuggaaacccagagaccaaagcugccaggcucagcuccaacacagucucauuuguuugguuuguggcagacugccugcaccccaacccuuuccuccccagucuugccuccuccugcccccucucuuaaacucuuacggucucaaagacuggguuugagggaaaccuacuguaauggauugauauacuucuccuucaauugacaagagacuuaauguccuagagaaaaauuuuccuuaaacuguacauauccaaauuucaaaaaauguauaacagucaguaucaaugcaaacugagcaaucugccuagguaccuauaaacacacaagauaccuauaaacacacaagauaccuauaaacacacaagauaccuauaaacacaccuagauaccuauaagcacacaagaagcuuauagagcaccaauuagacuggaacagaaaagaaaauccuccugccacauaauaacccaauuuucuuuucaaagaauuuuuuaaaaauauuuuuauuuuaugugugugggugugugcagagcccauagaggccggaugagagcaucagaucucccugcagcuggagguacaggcgucugugagcugguacucgaguguuugggaaucgaaccuggguccucugcaaaugcagccacugcucuuagccacuguaccaucauuuuaaccccaaugucaauuuucaguccccaaagcuuugcugguaugugauacaaauuuuauaaaaguagaaaaugaggagaacuucuuugcaaagaaauaggauguagcccaagggaggaaacaaaaaacccucugagugaaaaaggcagauucuucaaguaaaaugaauacaaaaauccccaagaaugugauauuuuggcaaaagcccucuauaccauccaggucugaaauauuaaaagaauuagagccuuucaccaggugguggcggcgcacgccuuuaaucccagcacucaggaggcagaggcaggcagauuucugaguucgaggccggccuggucuacaaagcgaguuccaggacagccagggcuauauagagaaacccugucucgaaaaacaaaaacaaaaacaaaccaaaaaaaccaacaaaacaaaacaaacaaacaaaaaagaauucuagcaucuuucacauacaaaagaaaguaccgaggaaaagcuggaauggagcucuuucauguucuuccuugaguucuuugaacugaaacaaaugauggaaaauggcuucuccccagaagccaucaauucucaguagaaauucaagaagcccauucaugaaaauucauggaaggccacaggaagcugcacccaagcuaaucaccuaccuuugccaaguauacugaaauagcuccauguucuuaguaugucuacuguuccgugugcuuggcacaggucuguaauugcagcacuuggguguaugugguagagagagacguuucagguguucaggguuauccucuuuggcgauauagugaguuugaggccaggcuaggaugcaugagacccuuuaauuccugcacuugggaggcagaggcaggaggaucucugacuuugagaccagucugauguacagaacaaguucuaggacagucagggcuacauagagacaacaaucugucucgaaaacaaccauaaaacaauuguguguguaaaauuauuaaauuauugagcuuucuaggaauuuaaagcuuuaacagugagauacuuugcuuuuaaauaucaaugcccaauucauucauauuucuucaaaugaacgaaaaugaccaguaugcauauguuguuacuggaaugcauucuuuuuuuaccuuuagaagauagaaaguaauacuccaaaauauuuaauaaaauauuuuaaagauggaugcuacuagugauuaguauuauaaguaguuguuaacugauaacauugauuaccuaacaaaaguugacugugagaagauagcauuucuaggauguacaggagaaaacauacugauuucuagaaacuaucaccaaauuuuaaaaauaauauuuuuauuaauucuuugagaauuuggcauguguacuauaucacccccauuccuuucucuaaccccuugcagauccaccaccugccacccucucucaacuuaaucuccucauuaaaaaaaaauuacccacaguguccaauuugugcugcacgugaaugccuggaugugaaccauccacugggguggugugccuaccaaggagucaaaaaaccgugacugucccucucccaaaagcucucaacucuaaauagugcuuccuuaugcuuggaauggcgauuaacacaagcuuauucaggcagcuacaguucacaaguacagcaguuaauguccuguccugaagguuuuguuuugcucugguccggcuuugccuauacaucacaaagucuguuucuucuucugccauggucacugguccuuggggagaggggacugcuuuugaaaaugaaggucaugaaucgacuucaggaggcccauugaacuugugaaacguugugcucaauauuugcccuguauaugcuuugcagagaaaguuuucuugaugcugagaaucauuggugucagagauaaauccacagucuguaaacuguugacuguagcucucuccuuacuuagcauaugggggaugugguuauuaaauguuuuauuguaugcuuuuccuauuuuguuuuuuggaguaauuuuuggcaggaaaaaaaguaauaaaaugaagaguuugaaguugaaaaauauaaaacagcaaccaaagggaaauacucacuuuagaaaugaguacauucaaauauaccugagaaaucauuacauuaaaacuauauaaaguaaagccaaguggugaugaugcacaccuuuaaucccagcacuugagaggcaaaggcagaagcagagaggcagagagaggcagaugcaucucugagaauucaaggccagccuggucuacaaugcaaguuccaggacagccagggcuguugcauucggaaacccugucucaaaacaaaacaaaacaaaacgacuaaccagucaacaauagauaacaacaucaugcccuguauaaaauaccuacaaguuaauguuaaaacacaagucaauagaguaggggaaaggcagugugcauguggggaguacucaaauguccaacaaaaguaaaaauuugccagaaucagguguuuguuugagggaggggaaucucaggaagcuugggauaucuuguucaacucaugcuccugccuccaccauucaagugcuagcaguauaagccuucuuuuuuauuuauuuauuuauuuauuuauuuauuuauuuuuauuagauauuuucuuuauauacauuucaaaugcuaucccgaaaguucccuauacccucccuccgcccuccaccccuacccacccacuccugcuucuuggcccuggcauuccccucuacuggggcauauaaaguuuaguauaagccuucaauaacaaacauguucggccccagaauccccauauucaaagcucuguaauguagcaaaaaguccacaagauggcgauagagacaaggugcuagguuaaguagaagaggaaguucaaggcccucuuuuccgcagggaaaguuugugaaauuuuuccugguccuugcucuagcucugucugguggaauguaacaauguuggaggaagcaguuucuuuuuucgggaaggagaaagaucuagggauaucacgcucauuacuuucuacacuuaucugaacgcuaucuggagucagaaaucaaauagcugagcgcauuuggauagcagugaucaaaacucuggaaagagaaaguauacugcaggggaacagcgggcugcuaaguagguguagguagucccugcugaauaaacuaaaguagccaacgacuugaaaagaaauagagagaucugcagagaauuuaagagguuuaaaaggcacuguguacacaugugcugauuuuggaacuuccuacaaagcugcacgaaucaaaaguacauggagggguuggagagauggcucagcaguucaaagcacugacugcucuucugaagguccugaguucaaaucccaacaacaacauggugacucacaaccacuuguaaugagaucggaugcccucuucuggugugaucugaagacagcuacaguguacuuagauauaauaaauaaauaaaucuuuaaaaacagaaguacauggagguggauuugaaggucagcagcucauauugcugauggaguuuacuuggaguagaguggaaaauguggacauaacugugagucuguguucugauuguugccucccagaagaucaacucagggcauuaaugauugauccacuuacaugaacuuccucaggcagacauuuaaaaauuaauuauaguguuguuaucuagguuaugacaacauagucaaagccagcaaaagggaugcuuugaggugacgauaggggaagauagcuuugaaauuuuguuucuacgcauucugggggaacuacaaagucaucuaugugcccauuacucaagucauauucaggagaaaggggggguggaaaagguugaaguccuuaaucugauuguaaccagcuucuagguucacaaaggcaguaaggugaaggacaggacaacauugaaaacugccugcuugccgggcagugguggacuuuaaucccagcacuugggaggcagagacaaguggauuucugaguucgaggccagccuggucuacagagugaguuccaggacagucagggcuauacagagaagucucaucucaaaaaaaaaaaaacaaaacaaaaaaaaacaaaacaaaaacaaacaaacaaacaaacaaacagaaaacugccuucuggguauuaaaaguguguuucaacgaacauagagcccaucuggagagauagcuuugucucccuucuuuuugaaguuucuuuuuuauguguuuugguaauuaccagcauguguaccaccugcauggcuaguaauguggaggccagaugcuugagucagauccccuggggcuggaguuacagacagcugugagcugccaugugggugcuggaaacagaaccuaaguccuucauaagaucagccagugcucuuagccacugagccaucucuucagccccuuuguaucacaucuuuaaggaaauucugucaagucuagaaaacagacccccauggccacacacaacaaagaaugcggauuuuauaaaaauuuacaccucaaauuccaauaugcaaacacacuucaaguaaaugagcaaugggcgugugagaaaucuuugguaugggacaagcccacacaggguguccuugcaaggacauucuauaggucucagaacugagccuucguuaugcugcuggaagccaucuuuaucuagcuccguugagugagaguuugcuugggaacagaccuggugauaauuauguaacaggcagaaacuggcugaaggugcuguagcaagugacacaaauaaacuuguucauucuuggaggaggggagcaguggggucaaaacucugagaaagaaaggacaaucuauuucccaaguggcaagauuauaaaauucaaccugucacagugacaaccaaaaaugaccugguaaacaaauaggaauuuaagauuuguacauaagaaaaauagagccuuccugcucauaauguagaugugcagcuuggccuucauguggauccugaacuacuggaacacuggaacgggggcuaucacaaaagcuguugccuguccaugggauuuguucuccuagcugaguugccuggugggccucaguaggagaggaugcacauauccucacagaaacuugaugugucagggugggaggauacccaggggcccucaccagcucagagaagaaugggagggagaaggaagaaggaucaugggagggggggaccuggaguugggggcagugagcaggauguaaagugaauaagcaaaaaaaaaaaaaaaaaauugucuccuggagccaggcgugguggcgcacgccuuuaaucccagcacuugggaggcagaggcaggcagauuucugaguucgaggccagccuggucuacagagugaguuccaggacagccagggcuaaacagagaaacccugucucgaaaaacaaaaaaauaaaacaaaacaaaauugucuccuggaaauccagaagaccagacagaagauagucaaccaaagaaaagacuugagugauacuguaaucugacuguauaacacagaacaauacaaaggcauaacaguaggaaagcaagcuucucauuguaggcucggucuucagggaagacuguauccuagggcaaaaaccaaguguuuccucgggaugugcuaaaccuggugcuggcccaguauccucugcaaugauagaauucuaccuagacugcuccauuuuucagccagccucuauucagcuagacuccagaaaaacaaguucaguguuugguguuuugcuauuuggucacuagguggcaguauaagcccagguuugugcuacagacuuaaagccauaaaaaggagcuugguuggucauauuuuuacaaauacaaauauuuguaguaccuuggaugacuuuagauggaugcaguccucugcagugaucuauacuauaguuuauauguaacuccaauuaaaggcauuucaaaucagacuggauuagcauggauacauuuuugggcuguuagcuccguucuauuuuguuuacauauguuucuuuuuucacucuuagggaaacucauuccaacagucccacagcuucuugucagagguccucgauaaauauuaaaagguugaauugaaacacagcaaguuguaacacaucacacacauguauacauauauacauguauacagcaaccauaugcuagcucauagcacaugguagcccgcaacccucuauaauggcaucugauucucucuuucauuguccaugaagacagagaacacauauagauugaguaaauaaacaaguaaauaaaugaucuuuauacacauaccucuagggaaaacaauaugaauauagcucucauaaauucucaaaaacaaauuuaaaaauaaaaaaagaacuuaaccacauagaauuauacuagaaauaaaagcaaaaagauauagggaaaauucacaaaugcaucgaaauacaauuugccuaaacauccaaagaaugaaagaagggaaauuauaaaauaugaagauggauaaaagcaucucaaaguagcagcagaccagaaguuguagcauggaguaauaguuguaauaggaaauuuauacuuguaaauacugacauaaaagaaacauuaaaaagacaguuaaaaaaaaugggugcuguaaaucugaccaagaacccacaacuuggacacucaaagacccuuggggugauagugguggaccauccauuauuauuuugcuuaucagacacaucgucuaacuccucucuaaauacagaccuccaacgggagaggcuggcucagugguugagagcacuggcugcuugcucuuccagagcaccugaaugcaauuccuagcaaccacaugguggcucaaagcacaugguggcccacaaccaucuacaaugggaucuaauuuccucuuucauuguccaugaagacagagaacacauauacauuaaguaaauaaagaaacgaacaaauaaaugaucuuuuaaaugaauacuucuagacccauggauuaggguagcucucagaccuccccagagacacuucuuuguguagugaccagggcuuugauguggucaaaauggagagaauaguaucuguagagugugaagggugcucaguucuaaauggagcaucuauaucacacaguuacaugcaaaccucagagaaaaucacuuaagacaggggccaucugggcuggggguuaagcagcagugacaggaccggugcucaggagcucacagcagcugugauuccaauacuaggggagguacucgaucuaccgcugaggagccauugggaguuaaugguguggcccucugauagauccaucaaccugcaauggaugaccccaucuccaugcauauaugguugguuggcacaaacgggacccaguguguuauuaaaaaacaaaaacaccauuaaaaaaaccaccacaccaggccaaagccaucauuuuuagcaucacaaaaaaaauugaauaaaaugaacaauuucuucgacucuaucagggaaauaacauuccccaaauuacaaagucucuuagagagagcagcgacuugcugaugagugagaaaacagcuccuguccacagacagugugaacacaggaaaacaaacugacgcuuucuuggaagguuuguuugaauaaauuuaauaauaagauaauccaggcuauauccagcgagcaauacacuuuugugacuuuucuucauaggagcccuagagcauguuuuuuagugaaaaugaucuccauagggauuggaacagaaagagaaaaggaagcauucugaaacacccccauagcagucugcucuccuagcuucagccucagacaaacgugacucauuagaaauucaaguaacugagucccuuaauccccaggcugacaugcaacuccugagcucgaacauugccccaccuuagcuuucauaagacucaaaccgaccugaagggagggaaaaaaaagcccaauucuagcccaccacgcuucugcuuaaccgacgggaaggaaaacuguacaagacccaagaagaaucgcugugaugaccacaguugaguggcauagauacagcuaaugaacacccugccaccaucaaggccuccuguaauaucagagaaauacaauaacgugucauacaacucagaacuaauucaagaagucucuagagcaaccaaagcaacaaauuaggaaaaauaaagacacuuggaacauucuccaaccugggaucccucuggcuguaucaaacaguggacacaugguauagcccucauuuucaaccacaucaaacacuguauguaaagcuuacuaaaacaaaaaaaucucagcuagaaaauacagaucagaaccaaauucaggcgugguagacaucugcaaggauuagaugguacaucuaauuaugauuaacaugguaaaagugcuaaaacaaaacaaaacgguagacugguuuugacccccggacaagggacagaagugcuuauuuuacauaucaaugcagaccuggcuuccagguucuacuagcagcguucagucccugccugauauaccuuguucccaaccuugaacuuuccaguucaggggcuuagcugcccuuccacaagacguucuuuccaauguuaucuagacauuuugcgccccacccuucuccucucugcacgagcgcaccccuucuucccuuuucuccucuccccucuccccauggcaacuccucaauccuugaagccagugaacuccccgagagcaguuccccaauaagccuaccuuuaaugcaaucggacuugaauagucucguuucacgggcagagaagucauugaucggagacaacaugcaugaauaggagaccaacaccaucaacacaaccgaugcucaaaaucaauagcauuaagaagugagcauucauaaagauuuggaagcuaacacuucagagcacacuccagaagaacaaauggggugugaggggaagggauuuaguuagggauuuugcuugucauuggcggugcaucucugcaaucccccaaaucuggaaggcugaggaggaucagaagcucaaaggcugccuggaaugcguggggagaaucucccucuaccaauaaagagacaaacaaugccagacaagcagaauguaucaggagacaacuggaaaugggauaaagauacaagauaauaccuaaaaccuaauggaaugaaugaagcuaaagccgcacaaagguguguguauugggggguggggggaguuacagaugcgcauuccuaaggaaggaaucucugagucaccaccaccugcaggaaaaccuuggcagaaaacagaaaugacaaaggcucgagcguaaauacaaaauuuuaaaaugcuguuuuucuugaaaaaaaauuuuuuuuaagaagcugaugaaacuaagcuacaccaauaacaaacucaaaucacguuugcaaaaggagaccuuacaaucagucaaugcuuaaaaucucucaagagccgaagcagaagggaugcuaucuaacucaauucaugaugccagagugauccugauaucaaagccagaaagagacacaaaagaaaguuaaaaauuuauagcccacaucccugaugaucaucaucauuacaauauccauaacccgaguuugauggaauuaaaauauccaggugggauuuacucauggaaugcaagaaugauucaacauacaaaaaucaaugaacacgauaucaccacaauacaaugacgaucaucuugauagcauuaaaacaaaaacaaacaaacaaacaaacaaacaaacaaaaaaacccacggggcuggggagauggcucagcgguuaagagcaccaacugcucuucugaaggucgugaguucaaaucccagcaaccacaugguggcucacaaccauccauaaugagaucugaugccuucuucuggugcaucugaagacagcuacaguguacuuacauauaacaaauaaauaaauuaaaaaaaaaacacuuggaaaaacucaguguacucaugauuaaaaacucucgguaaaccaggaauaggaggaaauugucugaguacauaagggccacauugaaaaagcccacagcuaacauggucaauggugaaaaauugagugcuuucccuuuaauaagaugaaggaaccaagaauguuugcucucuuagauuccaauccuaauagaauugaugguccugugcagaacaguuggggaagaaaaggaauccagggcugggacuguaccacagucuguagaaugcuuuucucuagaaugcauaaagcccuaugugcaaucccaauagugguacaagccuaugacccugauacucaggacguagaagcuagaggaucacaauucaacguuacccugggcuaaagacccuguuuuacuuuauuacuuuuuuuuuuuuuaauaucugaauuguaacugacuggaguacucugcucacaaaugccaugauuauuuaugugggggacuuacgaaagucuacacacacauacacacacacacacacacacauacacacacaccauacaacucagguaauucagcuguaaaguuauaggauacaaaaugaguauauaaaagugaauugagggccacugagauggcugagcaauuacaaacacuugcccccaaguuugaagaccugaguuuuuguuugauacagcccuggcuggcuuggaaauuacuauguagaccaggcuggcuaccaauuuauuuaagaucugucugccucugccuuugaguccugggauuaaaggugcaagccacuacagcaaacuugguguuauaguuuaaauauaugguuuacuccuagcaacuuguauguugucuuggugcugaaaugugguggcaucuuuaagaggguuuaauuaauuucucaagagccuagcugaguucuuggauuuuaagaagagguugcuauaaaaugauccuagcaucuaccugauagcucuugugcauauauuauacuggacaaaauagauguuucccuaccacaacucuccuaugaguuaacacugcuuccaaccagaaacugagaaaauccuggccagcacagucuugaaugucucuguuuccagaauugugaccuaaauuuaucuuuacuauucaugacuuaaucuagguugaggaauguugcuauaacaaaaaauaaucugagauaauugcucugacuagaacauuuaauauuguuaaaauacuacuucuguucaaagugaucuguagagucaaucaauaucuaucgcacucccaauggguuuuuguuuguuuucuuuuuguauuuuggaaguagcaaaaauaacuauaaaauacauauagaugcgugaagacccaugaacagccaaaauaauccugaaaaagaacagcucuuguccaauggaccuugggggaaaccaaacgucacauuuuacacagagcaggauaagguauugguuuucauuuugccucuccagaacacaaaaccuagauuuuuuuguuuguuuguucaucuguuuuaauagggccucaucuuuagccugggcuuaccuugaauuuggagucugccucccucaguugcuauaguucugggauuauaggcauaaggugcaauuuccagcaaaaauccuuuaagggcugcuugaaacucacuauguagcucagccuggccucaaacucauaaccauccucucaagugcuaggauuacaugaaugagccacaguagcagcuaaaacccuuuacauuuuauuaggguauauucuauacaauaugagugccauuauaacaucacauacacguaagauuuuguuccuauucacucccauuacucucuuuuuuucucccucucacuuuuacugauccccuuacucugcucacacacuucugauuucugguuucuucuauagcauggaugaaggguuauuuacaggaacauggcagauucuuaccgaagaaaguaucccccccucccaacucccucagcaaacaauaacuacuaauaccccuucugcagggaggaaugaggcaucuuggucccuuacgucuagacacuguuaacugccuccucggggagggaugaggccuugugagccucuuguagcaacuguuaacuuccuacacauccuaaggaauguggggguccccuuguauacacaggccuuggguaggguaaucauaggugcugugaguuuaugaguaugacugcugcuguauguuccacaauaccccaucccuucuuccagcuuuaccuuucugcccucuuugcugugguguuucuugaaccuugcaagggaggagaugcagaucccauuagggcugaucuucaacaaucacacaaucacauauucuuuuuuguuuguuuguuuguuuguuuguuuuuuugagauaggguuucucuguguagcucuggcuguccuggaacucacucuguagaccaggcuggccucgaacucagaaaucugccugccucugccucccgagugcugggauuaaaggcacgcccagccaaucacauauucuuaugacucagagcuaaaagucugcacgaacagaaacuagucuuaccaaagcugacaguagcacaaaucuacagguauaaacauacaugguuagaagacaauuugauagucauaagguggccagcuagggaggcaauagugguaaagcuucuccauuagagccuauggucuccccagcuagaggcuuuugacaaggcaugaacuuucuccuagcaagugagccucaacuccaaucagaaaguuaauuagccaaauaaaaaaaaugguacccugugcucagcuuggccugugaguaaaucugugggacauuuucucgguuaacgaucgacugggggggggggcaguccacuuaaaccauguggguggagccacccauggacaggugguccugggagguaugaaaaagcaaagugagcaagccauggggagcaagccaggaagcuguccuuugugguuccugcccuaauuucuacugugauguggaaguacaagccagauaaauccuuuccuacccaauguauuuuugguuagaauguuuuaucacaguaauagaaagcaaacuaaaaacuaaaacaucuuucuaacuuucaugccacaguuucuuuuucuuccuuucuuuuuucuuuucuuucuuuucuuuucuuuuuuuuuuuuuuuuuuuuuuuuuuuugguuuuucgagacaggguuucucuguauagcccuggcuguccuggaacucacucuguagaccaggcuggccucgaacucagaaauccaccugccucugccucccaagugcugggauuaaaggcaugcgccaccacugcccggcugcauuuuuuuuuuuaaauuaaaaaaguugaaccuagguguguugucucgugccuguaaugcccauguucaggagagagagagagggagggcagggugauuacuaugacuucaacaucagcaugcgcuuacaucaucaguuagaggccagucugggauacagagugagaaccugucucaaaacaaaaacaaaaaaacaaaaaacaaaacaaaacaucaacuaucauaagugacuuaaauaauggauauuaaaccuaaauaucacacaacuucacuuaagaaaauucugaggacuggaaagauggcucaaugauucaaagugcuuuccggaggaagccugaacaccacaguuugaguccuaacacuuuuauauaauaagcuaagugugggcccaugcaucccuauaaguccagcacugaggcuagcagagacuggaggauuaacaaggcaaacaggcagacacgguaacagccucuucaugcaugcacuagcucacacacaugagugcgcguacaucacaaacacaagcacacacaauaaauacauuuaaaaguuuucuucuuucuuuguaagugugaaaauuacaaauuguagaauuuugauccagauaagaggaucaggaguuugaggcuagccugggcuacauaagacccuguuucaaaaaccaaacuaaaccaaaacacacacacacacacaaaguugacacaaauuuucaccauguauucgacgugucaaggcucaccugggucaugcaagacuaaauaaauuaauuguaacuaaaugcaagacuaaaugucuaaaguauuuuugaaagucuggcuuaaugcaauuugcuucgguguuuugucagaugacaaguuagauaggucauuccaugcuuguuuacgaacaagacaaguaaaauuucucgagucucugucucuuggaauaggucuuuccacuguaggugggagggaaauguuuccgucucccaagugcuggaauuuaaaggugugggucugguugaacucguuuuuuguguccuucaguggucaggugccccggcugguggguggggugggaggaggaguaucugucucuauuguuccuggacugauccugaaguguaacggaagugaaaggaagguugaguggagggcuaguggacagugacuggcccacaacacuaccuuuaagaagacaaauggaccauagugauguacaccuauaauccuagcacccaagaggcagaggcaggaggaucacugaguucaaaaccguccugaucuacagagagagagaguucaaggacaaccagggcuauacagagaaacccugucucugggggggaaaaaaagcaaggaaaaaaggaaggaaggaaagaaagaaagaaaugaagagaaagaaaaaagacuaauaggucccagagacucccaugacagugggaaagaagagucugcacacuuccuccugcuggaauucuugauaagaaauaaccuccagagaaauggcaaucauuuacaauuuauaccacaaauuauacuacacuggaacaccauaguaggccuuaggagaaaaacagacgcuuaaacaucccuacuuggaggcuuuuugaaaacaaaguaaauuaucuuuacugagcaagaaaacacuuggugucuagguaacccuguagcaugugugaaacaaaagacuauugcccagacagagccucaacuuucuccuuucuauuaaauucacaguaaaaagcaaacauguauagacauaaguaauaaagucagguguaggcauaaaucaccgcaucuuuucuacaaaagugagcuuaagcguuuuaccuuuuuaggacagagugaaaauccggaaguugucuucugauuguuacaugcugccacgguccucccugucacugcugccauugggcuauggccuggugucuguacucaaacugaaaacuugcaagcuagcacacgugcuggcggaguguggacgcacggguacacgugcgcacgcaugaacacacacacaugcacacacgcgugcgcacagacacacacacacacacacacacacacacacacacacacacauuuugcgcaugcguacagauaugugcgugcgcacacacauacaggcacacgcacacaugcaagcgaauaaaauuaaaauaugguaggcgcaugguagaacaugccuuugaucccagcauuuggaggcagaagcaggcagaacucugaauuuaaauccaaucuggucuaaaauaugaguuccaguucauccaggaccacgacaaaaagacccugucucaaaaacacaaaucacaaaauggcaaaaugaaacaaaacaaaaugaaaaccaaauaaaauagaaauaagaauucuaccuucagcugaguguguguuuguguuauauaugaauauugugaugaauaucuguaaucccagaacugaggacuuugagacagaagaauuaggaguuugaagccagccuggaaaagauggccagauuaugacuguuuuucuaaauaauaaguaaagaaauaaagaaaaggagaauaacaaccaagcauggugauaaauucgugaccucaucuucuauguauaugauguaaaagucaugaaguaauaaccucuuacaauauucaaguaguagcuuuacuuggaaagaaagauuuuaaaagaaauuuuauuuuuuagacagucaaaaauauaauuaagaaguaucguaucugugcuaagcagacaauauaaaauucgggaacaaagaacauauaucuuuaucuguuugcuuauuuuuauuuauuuauuuauuuacuuacuuacuuacuuacuuaccuacuuauuggagacacauuuuuuucuauguaacagcccucacuauucuggaacucucccuguagaccaggcuggccucgaacucacagagauuugccugccucugccucccaagugcugggauugaaggccugugccaucacugccuggcacuuuuucuuucugucucugucucugucucugucucugucucugucucugucucugucuguaucucuuccuuccuuucugucucuuucuuuuuuaucuuuaguauuuuuaaaggcauguuuuuaucugcuagcuauuuauuuuugagguagagucucacgauacagccucaacuagccuggaacucagaaagagccaucuuccuccccccaccacaccuggcagguuccuuuuaaagacauuacuucucaacucaaauaaugcuaaaaucaauugagcuguuuaucaucugacuauuguugguuagcuagaaacuucugaaguguugcaauguuuagcuaaagucuagaauuugcuguuuuuccauguguuaagugucaggaaaugcgagguagguaaguguuugaagauagugucugccauuauacaaaaugcugagugauaggcugauugaguguacaaccaaacagauccagauagucaccaacuuauuuauuaguugcuggacugguuuuuaccaaacuaugaggaaaaguaggagggauaaaaaagaguaauagaggggugaauaugcaauuauguuauaugcauuauggaaauaguuaaugaaaucuuuacuuuguacaaauaguauacacuaauuaaaaagauacaaauagcugauaugcaagauaaauaaguuuuacagaucuaauguauacauagcacaggcacuacaguuaaugauacuguguuagauccuuuuuaaagaaaacucuaguuuugcugagcgugguggcacacgccuuuaaucccagcacuugggaggcagaggcaggcagauuucugaguucgaggccagccuggucuacaaagugaguuccaggacagccagggcuacacagagaaacccugucucgaaaaaacaaaacaaaacaaagaguacugacugcucuucuagagguccugaguccaauucccagcaccuacaugguggcuuacaaccaucuauaauuccaguucuuaggggacauugacaccuucuucuggcuucuguggacacugcacagauaugguaccuagguauggcagccaaaacacccaagcacauaaaauaaagauaaauaaauauuuuuaaaaagggggauggggguggacagauggcucagcgguuaagagcauugacugcucuuccagaggaccugaauucaauucccagcaaccacacaaccaucuguaaugggaucuaaugccuucuucuggugugucugaagacagcuacaguguacucaggaaaaaaauaguuuuuuuuuuuuuaagaaagaaauucagauaucugcuguauuguacucuuuauuacugccaggacaaaauguccagaacgauaauucaaaaauagcccacugacuuuucacgugcuagaagguagaaagugauagcagauuucaugccaugcagaugaucccuguuuccacagaggugcuucucucacaagacagaagaaauggaagagcaaaagacacaaccaggaguguacuuuuagcuguucuuacaaggacagggacaguaaucgagucauggaggcauuaccaaauacauccaaaaaggccuuaucuuucuuguuguuuuuguucgguugguuuugguuuugaggcaagguuuuucgguguaguucuggcuauccuggaauucuggagucaggcugaccucgaacucacaaagauccuccugacucuaccuccugagugguaggacaaaagccgugcaccaucugaucacccuacucaugaugugugcaugcacacacacuaauaauaacaagcaaaaaauaucuuuaaaaagucuaaaaccacaacuuugagacagacauuagguagacauacuuauuccaaaagucagaaauaggaaagaagaaagggauaaauuacgccaaauaagccccagacauggcagggcaagaguucguucugugugcgcacgugcuccaaaguguuucauuacaguugcuuucagaguccugggugaggggauuauuuguaggagaauggacucccuacaaguaguuacacacucagaucuucucucccuuucucaccaacuauagaccccccagggaggggugggguaacaucagcuccucccaauaggggaagguuuuguugguguuguguuguguuguguuguguuguguuguuugagacagucuaucacuauguagccugauuggccuggaauucaucagguagaccaggcuggcaucuaaaucagagauucaccugccucuguauuuugacugcugggauuaaagguauguacaccaacauauuccccuaagaggggauggaucccagggucuagaugccauugcucucucuccccucucucuuuauaaauauaguuuuaagauuuuuacuuguauuuaucaguacaggggguggguugcuggaguaugccagaagagaguauuggaucgcuuggagcuagaguuacagggaauuuugagacaucuggggacugaauauaaguccccugaggagcagcaccccaacaugguaauacuucaucuuaaggcucaagagcaaacuuuggcuccaaguucugccucuagacacacggagcgccauuuggguucacagggcucuaagcuugccucgcuaggcacgcugacacagcacuucuugucagucggaaccaguugcuggcaccucucccaagcuguuuuugcauacugguggcucuauagcucuggcgucauaacugagagcaguguuuucauagcucuuuugggcauugcucucauugggggucuauucucugggcaaaagucgcuaagcacugugcugguagagacuuuauaucagccuuccucugguucucugcuuggcucucaaaacucauggaggaauccuuugaaaucuaggugaagcuagucaugacuccacagcucauacguuuggaggcagcaguuccuugcuaaauucuacuuugugugcauuaaugucuccuaagcaagucuaguagaaaauccuuuauaauaucaauuguaguacuucaaguuucuuccgcaucacggcaucggcugaguaacagucccccagauagauggaacaauagaagauuacaaagugagaaaaggaaggaaguagaaaaacugguguuuacuugguuccagcuguuuucugauucaggaagaaaggggccgggcauacucuacccauuuauaguaagaagauuuuuuuguuuugguggguuuuucgagacaggguuucucuguguaucccuggcuguccuggaacucacuuuguagaccaggcuggccucgaacucagaaaucugccugccucugccucccgagugcugggauuaaaggcaugcgccaccaugccaccacgcccggcuuguaguaaggagauuuaacuguaccauguaaggcaagagcuccucaugucagaguucaaaaaguaaaugugcugaaccaucacuugguuuagaacagcuuaagcccccagcccccaccccaccccaaaccaacccuugacuguuuaauugcugauaaggaauaaaagcccuuuccuauaaaccacuguuuguuuguuugcaacgaaaucagagauuuacuauauggauauuuaaaaauucagaauuugggggcuagagagauggcuuagagguuaagagcacuggcugcucuuccagagguccagagaacccaguuucaauuaccaacaaccacauacagaucacagcugucuguaacuucagcucuaagggauccuauaccaucacacagauauggaugcaggcaaaaaagcaucaaugcacauggaauaaaaauaaauaaaauuuuuaaaauuuggaauuuacaaauaaugaagaucccucacugguucagccacucaccgagguaccucacuccagcaauuuccccucaccagacuuauucauuuuuaaaguuuagauguuugaauauuuauuguaaaacagcaagcacaaugauuucuauuuuuauaauuggugacgugaucuggaaaaauacuucuaauugguaaggcaagagugauugcaaugcacucuucauuuuuuucuaacuucuuaaaguaucuucuuuuuuaaaauuaaaacuuuauuauaggggcuggagagauggcucagugguuaagagcacugacugcucuuccagagguccugaguucaauucccaggaaccucauaguggcucacaaccaucuguaaugagaucugaugcccucuucuggugugucugaagacagcuacaguguacuuagauauaauaaauaaaucuuuaaaaaaaaccuuuacuggaaggaguuacagagacaaaguuuggagcugauacaaaaggauggaacaucuagagacugccauauccagggauccaucccauaaucagccuccaaacgcugacaccauugcauacacuagcaagauuuugcuagaaggacccugauauagcugucucuagugagacuucgccugggccuagcaaacauauaaguggaugcucacagucagcuauuggauggaucacagggccuccaauggaggagcuaaagaaaguacccaaggagcuaaagggaucugcaacccuauagguggaacaacaauaugaacuaaccaguaccccccagagcucgugacucuagcugcauauguaucaaaagauggccuagucggccaucacuggaaagagaggcccauuggacaugcaaacuuuauaugccccaguacaggggaacgccagggccaaaaagugggaguggggggaaggguaugggggacuuuuuggauagcauuggaaauguaaaugaggaaaauaccuaauuaaaaaaaaaaacggggccuagcaaacacagaaguggaugaucacaguuagcuauuggaugggucacacggcccccaauggaggagcuagagaaauuacccaaggagcuaaagggaacugcaacccuauagauggaacaacauuaugaacuaaccacuaccccggagcucuugacucuagcugcauauguaucaaaagauggccuagucggccaucacugcaaagagaggcccauuggacuugcaaacuguauaugccccaguacaggggaaccccagggccaaaacgggggaguggguggguaguggauugggggggguggguauggcggacuuuugggauagcauugaaaauaaaaaaaaaccuuuacuauaaaaaaacuugcaaauaaaaaauuacccaccggagcuaaugaccagaucuuuaauaguuuuguuuuuuauauuguuauaguguuuguguucucagcacacuuaacaaaagcaacagaaaauauaagaaauuaaucuacucaacuaaacuaauuaaaguuuauuuugagacaggaucucacuauguaguccugaacuggaacucacuaugagcagcuggcuuuuaauuuaaagacccacagguuuuugccucuuuugccucuggagugcugggauuaaaggcaugagccagcagcaucccagacuacauuuuaagaaagggaaaaaagcuggucgccgggcaugguggcgcacgccuuuaaucccagcacuuggaaggcagaggcagguggauuucugaguucgaggccagccuggucuacagagugaguuccaggacagccaggacuauauagagaaacccugucucggggggggggaagaagaagaaaagaaaaaaaaaaaggaaaaaagcuagucaugauggugcaugucuuuaaucccagcacucgggaggcagaggcaggugaauuucugaguucgaggccagccuggucuacaaagugaguuccaggacagccagggcuacacagagaagccuugucucuaaaaaccaacuaaccaaccaaaccaaaaccaaaccaaaccaaaaaggaaaggaaaggaaaaaacgagguaauuagcauaauuagcaugacaaggaagggguagugagaaacagugacacagaaacgcaaagguuucaagcagaauuuauuggaaguuuggcaagcaacaaacacccuaguuggccuguagaugacuuuagauuguuuugcggugauuuucauuuugaagaaggauuuccaauuuucaaaacagccaggcucaaauuaaguauuuuccauuuauuuuagcaguuugguauagauuuguuuucggcuuaguguguagagauguuuguuuguuuguuuguuugucuguuuuccaucaggacuucauuuaugcaugagggcacaaugguagcugauggugacacguuucugccugccugcuuaaucaguuggguucauggcaccaucuguggaagaaagguuuucaauuauucucuauuuuucaguaaugccucccucgugaacaucuuuagaaaaggggccuuccaaggucuaccaagucuuaucgauucucucucuguguuuuguuguuugggagguuuuucuguguaauggcccuggccguccuggaaccuccuuuguagaccaggcagacuuugaacucagagagaucugccugccucuaucuccugagcacuggcauuaaaggugugugcuaccgccauccagcugauugcuuauauuaaagggcaaacaucaguguuucagcuauauuagaugccuacgugaaaaggcaguauggggcuggagaugcagcugguuaaguugcaugcugucaaaccugugagggugcauacguguaagaguacuugccaauacaagcaaugcuaaacaguuaaaugucuguuuccuucuuuaccuauggauguugucauugguuugcuuuguaaacuauaguuuugacgcugugaaagacagaaggcacuacagaaacuacaaaauccuuuuccuuugugugaaaugugaaaguuuuaagaaaacuuauaaagaaauugcacugauuugauuacuaaacgucaguucuacuuaaugccaagcuuagccaauaacuauuuaccucacuucuuuccaggaaaauguucaugguauuuuauuauuauuuuaaaaauuauaugucucugugucacaugagugcuauaucugcccagcucuugagcuguuuaagguuuacuguaaaugauaaaaguuguauguugggcuagagagauggcucaguaguuaagagcacugacugcucuuccaaagguccugaguucaaaucccagcaaccacaugguggcuugcaaccacccguaaugagaucugacgcccuuuucuggugcaucugaagacagcuauaguauacuuagauauaauaauaaauaaaucuuuuuaaaaacaguugugugucuuuuauuuaauuuauacaagugcuagugccuacaggggugauaggaauugggucuccuggagaugaaauuauaggugauugugagcagcuugacacaggugcuggggaucaagcuuggguccuccucuguaagagcaauaugagcuuuuaacuacugagccacaugguuuuaguucuuuauaggagacacuguuuuuuguuguuguuguuguucuuguuuuucccccuccguucugccaaguccuggagaguguucgagaccgugggucuauucuauauucucagagcucaauuguucuggaaagucagagccuaagagguaggaucucagaaguaggacuggcuguggauuggcugcucagcucuucccuagcuucuacuccuucacugugauuguagcuucagggauucuggcuccaggggcagcaguacaguuuagugcgaucugaacauuaggacccuauaaacuuguacugcuucagauccucccaguuccuucaaggucucauuucuuuuuuuucuugauaacuauuacucacaaucugguuccuacaggugaaaaccuuaucuacuccccagggaucucagcugaaccagccugcuggggcuccuccuuggccagauucaagagccuuggacuugguuuguuaacaaaggggagaggaggggcugcuuaucuggggaugucugagugggaaaggacaccagggacaguccuugagcuagaguccucccuuguggccaaaguacaguguaaucugugggaacagugaccauuugugucucuuccuuacccuugauguucuuugauugccuagaccauccucggaaugggauagggugccuucugucuccuggauacugggauugcaucauacucggcuuuuguaguacuaaggacucuaaccaaggaccucauucaugcaaggcaaguacuauaacuagugagcuacauccugauuaucccuccauugucuuauuuauuauuugguuaguuauuuauuugguagggucucacuauuuagcccuagcuugccuagaacuuguuauguagaccauguuggccuugaagucacagauacuugucaguugccucucugagugcuggagugcuaggcuuaaagguguguacccuagaccuggcuuccagugccuuuaaauucccuguauguaugucaggcugcaaggaugaaaugugugacuucaauaacaauccaaagggcaagaaagauaccugauucaguuucuuccaggucuuggucagcuuguggguucugaucagugaacaucucccuagaauauauaguguaaucaauugucaauaggcuaaauccaacaacuuagagagacaugaaaaucauucaugcacacacaugaaaauaugacccauuuauauuugaacuaagacaggcuaucuacccccaccuucuuugagacaggcucuuacuauauaguccuaaccagccuagaagccacuauguaaaucaugcucuacguagcucucaaaaagaaaucuggaaguggcaauguggugagguagagacggugauggagagcucaaggccagccuuuaucccaccagcagucugggaggcagaggcaaauggaagcuacuauguggagcaaguuggccuagaacuccugcuucugccucccaagugcuagaaugaaaggugugcacuaucuuaccugacuauuuuuccauuuuaaaggaaaaaagacaucaaaugugagccucccccugccagagccugacaaauacaga

SEQ ID NO: 48 - RNA, 42861 nt, Mus musculus
aacaauggcacuaaggaaugaauccaguuuagaaaggagggaaauuaacaaucagcuuugguuuugaugcggauuuggggugaauuuuguuuuuuguuuuuuuuuuaaugccuuauuucugagacaaggucucaguaaauaaccucaaacucgcaaagcucugccugccacugccuucagugggacagugccgauuuuaaaggcuucugccgccauguuuggauuaauguucaguuuucaauucggaagagaagaaagauuugcaaaguacugauuuuguaauaccuaugcaaauucuuaccuguguuaguaggcagacaaacacugacuccccagaauauacuaauauacuauauuacauuggaggaagaaacugagguuucuaaucaaucgaccuugagauaaaaagauuccccuagaagguaagguguuguuucauugaaauggcagggauaaaagauugacaaagacucuacauccggcuauagacauagaggaaggcaauuacuagcuaagaaauuugaagcuaaaaagggcagggaaaugaauucucuaaaacuuacagaaggaauaauuucaauuuaauuucaaauaauaauuucaauuucaacuaggugucucacacugaacuucugacuucuaaaauuauaagguuauagaucuguguugcuuuaagccaccaaguuuguugggggcuuaaacaaauacagcacuguagugcuaccugugucucuguaucuucguagagguuaaggugguuaugaagacauccagaaaaggaaucaugagauaggcuaaggcacagaguaugucuuuuauuuacaguuucuuuguagaacaccuuuaccuaaugucuuaaucagcuaauuagcauaguaaaauacaacuuuggguaguuagagaacaaauagugugucauagcucaagaggcuagaccucucuaaaauggagguuggguucugguguuaucccuuccugucuuccuggauugugaauggcugccuucuggcugcccugcgucugguaaagagacagacagguuuaggcuccauucuuaagaccucauuugauuugaaauuacgucuuuuauuuaaagguuuuauguacauaugcagucaaauucgaaugguuucuuucuugcgcuuguguguguguguguguguguguguguguguguguguguucauuuuugagacagcauuucucuauguaacagcccuggugucuuggaacuagcucuguagaccaggcuggccucaaacucacagagauccuccugcuucucccuucuuuucuugugcuguugaauagaaauagccucagaucuggugaauaaugaguugauuacucaaaaacaaaguuggaagcuuguuuacaugugcugauauuggcaugccugaagcagccagacagcuuuuucugugcaauguaaguagggucuucuacugaaauccauuuggaauuauauauacucuauaggucuacuuuauuauuauuuuagauuuuacguguaugaguguucugcuuguuugcauguuugugaaucauguguaugccuguugggcaccaaugucagaagaggguuugcuaggaucccuggaacuggaguuauagaugguuaugagccacaauguggguguuggaaaucaaaccagguccucugugagaacagaaagugcucacauuaaaaaauaguaguuauagcugggcagguggcucacacuuguuagcacuuuaaaggcagaggcagaaagggauugcagcuaguucaagacuagcuugggcuacacagucaguuccugaccaacuuggcuagaaaacacauguuuuuguuuuguuuuguuuuguuuuguuuuuaaguaaacaucugagcuuacuauuuaaacacacacacacaugagggcauagccgcauucaauucauagcaaauaauaaaacuuuuaucaauaaaaacuuaucagguccuuguauaaugaaaaugaaaguugacgaauaaacaugaaagcccaagaaauuagaauaaggcuggaagugaaaguccaagguaaauggaauuauaggggaaagugaugguuugaauguugaugguaauugaggagacuacacauagaaaacauuuaaggcaggcauuggcauaagugaggauuugauugggaagacuaacucacuuuagacaaauggguggauggugucuuuaucagagugcuauguucaaacauacccuuaaauugacuuuucauccucaagauuucuuaugccaggaauuccuuuuaguguuggauuuuacuaccagugguaaaaauaugaaaguaggguuguuuuguuuuguuuuguuucguuuuguuucacacacacacacauacacacacacacacacacacacacacacacacacacaauuguuuuuuuguuuuguuuuguuuuuuugguuuuucaagacaggguuucucuguguaguccuggcuguccuggaacucacucuguagaucaggcuggacuugaacucagaaauccgccugccucugccuccugagugcugggauuaaaggcaugcgcaugcggcaccacacccugcucacaauuguuuuuaaauaugugugucugaggcauuggcccccuggagauggagugacagaggcuugugagcuaccugacuuaggugcuugcuagcaaacucagguccucucagcaagagcaacaugugcugcuaacugcugagcucuucuuccaccuuuguucuuuugagacgcagucucaugcaguacagcuggcuuugaguuugcuccguagccaacgcugaccuugcccuuccugccuccaccuuccaaguguuggguuuucccuauauuuaauauuuauuuauuccuuggcaauuucauacaugcauucacucguacuucucccccacucccuacacaucccgaagcugucuuccuauaaccuuaaugaggucuccuuuuaaaauaauaauaauaauauaauaauaauaacaacccugugaguccaguuagcagugcuugcuggaauguuggcuaaucuugucggaaucguaugcagguagccacagccgcaguacgcuugugagggcggcagccagcauuuucacagcuugccuccccaucuuuagcucucauguucuuuccagcccugcuuccacgauguuccaugggccuugggcaguguguggguugcuauagacaccuuguuuggagcuaagcaugcaauuguugcucagucucaggccagcucugagucugcauuagcugcuccuccuugcagaagaaacuucucuggccaaggucgaggagaguacaguauugauuuguucuugagauagaguuuuccaggguagcccuggcuggcucacuauauaguauagcccaggcuggucucaaacucacagugaucgaccugccucugcuugccaagugcugggauuaaaagcacgucccucucugccuggcucgacuuauuuuuugacauggggacucacugccuggugucccccuccuccuauagccucaaaauggcugagcaagagucagguaacuugcuucucugccauuccugaagcccuguguuccauccggaaccugcauaaaccaggugaggggugugcuuguagucacagcacugaggucaaggcagaagugucagaaauucaaggucauccuaucuacaaagagaauuugagaccagccugggcuacaagacccugucucaaaacguacaaacaagcaaacaaacaaaaaacaaauucaggagcuggagagacggcucaguaguuaagagcacugacuguacuucuaaagguccugaguucaauucccagcaaccacaugguggcuuacaaccgucuguaaugggaucuggugcccucuucugguauaucugaagacagcaacaguguacuaauauaaauaaaauaaauaaaccuuuaaaaaaacaaaaaacaaauucaggggcuccagaagaguagcaaauguucuugguaaccacugagccaucuuuccagcucuccuguccuucuuucuuuccuuccuuccuuucuuuuucuucuccucuccccuccucuccucuccccuccccuccuccccuccccccuccuccuccuccuccuccucuucuucuuccucucucucucucucucucucucucucucucucucucucuccucuuucuuucuuuuuuuuuuugagacagagucucaugacauugcccaggauagacccaauucuucaucuucuugcucuaaaucucccaagugccgcgguuacaggcccuugccuccaacaccagcugguuccuagguucuagauagcuauuccaaguagguagaugcgagggauauccaauuauaguuugcuucauuucccuagugggaauagagaauaaggccuuguuuauuuacuuacuuuuaaaggcucucauguagcccagcccagccuugaauucugauccaugguccaccaccuccaggcuugcaaugccuacuggcuuuuuucagaccuguagucuuuuguuguucgguguguauguauguauuuauuuagugcauugguguuuugccugaauguaagucuguaugagggugucagauacccuggaacuggacuuacagacaguugugagcugccaugugggugcugggaauugaaccacaaccacgguccgguccggaagagcagccagcauucuuaaccaaugagccauuucuccagccccuuuguuuguuuguuuuuuagggaccaguaaauuaauuuuaaaccuagaaagcccucccuugucuacagaauucuuuuaguuauucuuucuauuggaacugagcuuagggugagugcuugguuaggguagugcuugguuagggugaguguuugguuagagugagugcuugguuagggugcaugcuugguuagggugagugcuugguuaggguagugcuugguuagggugaguguuugguuagagugagugcuugguuagggugcaugcuugguuagggugagugcuugguuagggugcaugcuugguuagggugagugcuugguuagggugcaugcuuaguuagggugagugcuugguuagggugagugcuugguuagggugagugcuugguuagggugagugcuugguuagggugagugcuugguuagggugagugcuugguuacagugugugcuugguuagggugagugcuugguuagggugcaugcuugguuagggugagugcuugguuagggugcaugcuugguuagggugagugcuugguuagggugcaugcuugguuagggugagugcuugguuagggugaguguuugguuagggugagugcuugguuaggguguaugcuugguuagggugagugcuugauuagggugagugcuggguuagggugagugcucgguuagggugagugcucgguuagggugugugcucgguuagggugagugcuugguuagggugagugcuugguuagggugaguacuugguuagggugaguacuugguuagggugagcgcuugguuagggugugugcuugguuagggugagugcuugguuagggugagugcuugguuagggugagugcuugguuagggugagugcuugguuagggugagugcuugguuacagugugugcuugguuagggugagugcuugguuagggugcaugcuugguuagggugagugcuugguuagggugcgugcuugguuagggugagugcuugguuagggugcaugcuugguuagggugaguucuugguuagggugagugcuugguuagggugugugcuugguuagggugagugcuugguuagggugagugcuugguuagggugagugcuugguuagggugagugcuugguuagggugagugcuugguuagggugagugcuugguuagggugagugcuugguuagggugagugcuugguuagggugagugcuugguuagggugagugcuugguuagggugagugcuugguuagggugagugcuugguuagggugagugcuugguuagggugagugcuugguuagggugagugcuugguuagggugagugcuugguuagggugagugcuugguuagggugagugcuugguuagggugagugcuugguuagggugagugcuugguuagggugagugcuugguuagggugagugcuugguuagggugagugcuugguuagggugagugcuugguuagggugagugcuugguuagggugagugcuugguuagggugagugcuugguuagggugagugcuugguuagggugagugcuugguuagggugagugcuugguuagggugagugcuugguuagggugagugcuugguuagggugagugcuugguuagggugagugcuugguuagggugagugcuugguuagggugagugcuugguuagggugagugcuugguuagggugagugcuugguuagggugagugcuugguuagggugagugcuugguuagggugagugcuugguuagggugagugcuugguuagggugagugcuugguuagggugagugcuugguuagggugagugcuugguuagggugagugcuugguuagggugagugcuugguuagggugagugcuugguuagggugagugcuugguuagggugcaugcuugguuagggugagugcuugguuagggugagugcuuggguuuccagcaguaugccagagacuuccaagccagccaggacugcaaugugagacccugacucaaaaaugaaagaaaaacaaaagcaaaaacaauugucucugugugugcuuaguuuaaucuuauccacuccaccuucucucccugauaggagacaaauuuugguucgaguaaagcacagaggaacuaauuaaccugagauuacuugcagaauagcccuuccugacccuugaaggcgccauguuauuacacguugcugucucuucuaucuacagcucuauuucuuccucuucuuuauucuugugccagcuucaccucacugugccauugugccgggagggcaguuuuaauggccacuugccugcccucuccugaccuugcgcaaggaccuggguugaggggagggcuuugggugccgugggcuccucguguucccaggcccugcugggcccaggugcaacaugguggcuucccgccccggaaugggaggaguggacucugccucugucauucuccagucgggggaagugcuggcucaggcucugcaaccacagugcagaugggagaggggccaugggacagaaaggcaaggacccucagugcuagcagcugcuggcuuugugacccauacccagcccagcuccugccucccucuuggauggcagggacagucugggaacuucuaccugauccucacaucuauucucucuuuccagaagccucagaaggagucucccugccccugaguuuccaaagcuccucacccagggggaauaaggaugcccaugcauagcaagaaccugucacuugcagguugccuggaagacccgggcagcucacaacucaugccuuggaccuuaacugccuguuucuaguugaggaacccaggcugaggaaaccaaguuauaucaccaagagcauuuauucuagcaaaccaugaaggggcucaugugugccucuucaauaccuaugaaaaauuuauaauaaaaaauccuauuuaaagccgggcgugguggcgcacgccuuuaauccccagcacuccggaggcagaggcagacggauuucugaguucgaggcccuggcugucccucuaccacugagccacauccuuacuuagcccagaucccgccuuugaagaaucgcaguguuuggcuucuaaaugaccagggugacagucagacgagggaguccagugcugcugacccgugcagcgacccuagccaucagggcaaggaugcuggcagcccuccucuugacucuuuuucguucguuccuuccuuccuucuuuugugugaugcguauuguauaugaauguggaugguguguguacacguuugugggugaggguugcacagagcauaauggagucagaggacaacuucaggugugcaucuggccuuccacguuguuuaugagagcaucucucucucucucucucucucucucuuucuuccuuucuauuuuuuaaaacauuuuguuuuacauaaguacacuguugcugacuucagacgcaccagaagagggcaucagaucccauuacaggugguugugagccaccauaugguugcugggauuugaacucaggaccucuggaagagcauccagugcucuuaaccugagccaucaucucuccagcucagacaggucuuuuguuuuguuuuuguuuuuucgagacaggguuucucuguguagcccuggcuguccuggaacucacucuguagaccaggcuggccucgaacucagaaauccgccugccucugccucuggagugcugggauuaaaggcgugcgccaccacgcccggcuuuaaauaggguuuuuuauuagaaauuuuucauagguauauagaaugcauucugcuuacucuuccacuuucaauuucccucccgcccuggccagcaccccuuauuccuuacaaaaugucucugucauauuugcuaguuuuauuuuguuuaguguuucauaguucaccccagacauaguuuggaacuauuaaauacucaucaguggauacguuugagugccccgugucccaauccuuuaguugccaguaauaaaugguaagguuucaugggcuucuuggaguugggccaaugcuauuuuccaaagauguuaagauuuaccauaauagauucuuguaccugccucacucacacucgcuugcaguaccugucuaucuuucucuucuugccaaucacauuguagaugaggcuuuugugguuuuguuggcuccuuguauuagcauaaggugaacugauuucagguaaaauguuguugcuuuucuggcccauucauuggauggaaacgaaggcccgguuuuguuggagcacuucuacugguuagcaauggcuaggcagagccaugucuaacaguacaaacucucuccugagagaauuuaucuuuucuccuagacgcaauuuugucacuuugaauuuuagaacuaucagaggccccuuucucuauucaaggacuucuugacagccauguucuuucuuuucauuucaucuuaccaguacucccacuuuugagccucaauauuuugcuucucgugaucuuauuagauuuguguucucauaaucuuucuccugaacaacuuaggcucuaaguuaugagaccucaaauuacccaaggaacuggcuaggccugccuggugguguaggccuuuaauccgagcacuccugagucaguagcagacagugcucuauggauuuagggccagccuaaucuacauggacuucaggcuagccagauggccagggcaacauaaccaauuucauuacauagggaauuaaaacugagguaucugguaugauaaaagggccacugaguuagaaacuaucaucugaaaagcaggcuuagugguacaagccuguaauucuaacacaggaggaucaggagcucagagucauuccggcuacuuagggacuuggaggcuagccuaguucuggcuccaugcaaaggaaaaggggaauguggcagugguuaagauaccauaauagauucuuguaccugccucacucacacucgcuugcaguaccugucuaucuuucucuucuugccaaucacauuguagaugaggcuuuugugguuuuguuggcuccuuguauuagcauaaggugaacugauuuaagagcacuaacugcucuuccaggggaucugaauuacauuccggcuacacacaagauggcgucuguaacuugguuuccuugggauccgacacccucugcuggccuacacggguauaacacccaaaccuaaugcauagacaaaacucaugcacauuaaauaaaauuuaaggaaaauaucauauacagcacaugauguuuucaaaacaaagcauuuuauuuaacagcaaacuaccccacccacucaaccacccacccacccacccacccacccauccacccacccacacacggacucauugugacauguugguaagcaacaguuuuuuuuuucaagucuucaaaacacccaagagucaacagaaguucuguauuccgcauccguucacaaaguccagguguuuuccauguguuuuuucacaguuggugggaagaugacuccagucuuucaacaacagauugguacacaguucauuuaugugaucaaagcagaugaugguaggaugugcuuaauugguagcaauauugauggcaguaacugugaaaggaaggcuuucaguuauuuuuuccuuugcaaauuccagaaauguaagcccauuccuacccauacaaagggauauuacugaauccagccaauuuccacuaauuaaaagcuaauauuaguaacacuuuugaugcccaauugaguuuuaaugaaaaugaaaaaaauuuguuugaacucccagaccucuucaaccuggcuccaucuucucuguuccuuuucuuuugccugaauguccugauuggguuacuaaguaaagucuagauacuuugaaaguaugcguaugcuacaaugaauaagcuuccuuacagcaaauugugacuucagcucuaaggcaacuuggauaaagagaucacauugacuuaaucuguuucauucccauuugacucaaggcuuagcugauagccauuuagaugaaaauacauuuucagaaacauuuagcgaauuaauaccaauuuuguggaacugcauuaaagucccaacuuagauuccagauagacaggcuggacccuuuccuucacucggccuccugucccacccucugugagugaaagaaaaauggaaagggucaaagcacaggcauuuuuaaucuuuuucaaguucuuucaauuuggucuuucguuccuccaguuuucugauuguugucaauuuuauuauucuuaaauuuuaugcaagaauguuaaacauuaauguuauuuucauccacuggcauuauuuuaccauagcaagccaccuugaguauauuauaguaaggagaacauuucuaaauuacugugagcauuagcauguaaaaagguaaaagguuuaacgaacacaggcaaaauuggucaauguauuucaaagccugcugcagcucaaaaauggcuuguuugccccaggauaaugcaaaguagccuaagauuguggaacuuagauggcugucaucccuccugaccaguaguggucacagucauagcuaaaauggccuagaaaauugaguuucuuagcguggagggcuucuguaacuuuagggucaggcuugcuacaaagcccagcuucccacucauugcaguggccggagaagacaugaggaugaggacucacauugcauauuacuuggggacuaaggacuaagucgugccacuacccagaaaagagaccccccccccccauccagcacuucccuaugucuauguuuccuuuuuccaugucucaggagccaagugaaggccuaagagacaugcaaauccuuguagaacaggcgaaccaauaaagcaaaugaaugaauaauaaccuuccuguauucaaccucugaggcaaacugugggaaaugaggaaaguguucuucagucuagaaaacguuugagcuaauauuucuguuuaauaaagagcaucccucugcuuuccggggcaucuguaagucacacugagugcccuuuuggaacaaauguguugcacuuagcauccaguagcaucuucugcaauguguggaaccgaggaaauagagaaccucuuuuauuauuuccacucuaccaagcaugcccaugaggaggggagcaacuuuuuauuuaacuugccuccucuacaccuugauguuuuucccagcuaaagugagagcuguagucucaaggugugacugcaguccccucagaaacuacugagguaaaguacacuuuggguugcauccuuuaaaugucuuuguucuuuucaguacuuagaaauuuuaguacuuagaacugcacuuucaucacacuuaaguuaaaaguaugagugugauaguauauucuucuugcucacaugacgcugagccaggcaaugaacaaauacguuuagaauuaucgauucaucuugauucuccuuugaaacacuucaacaguaagaaaaggaaaauggguaaugaauuaaaggacagacuuuaagucuguccuggcuucaagcuaggccaaugagaaaaugacuuuuggagcuuccuuagcuaggaagucuccaguuuauguugaaggaaucuuggccuugguuggguuucgcaaacagccauuauaguuaaaauauuuacucagaaggcuggagagaugacucagugguuaagagucugacugcucuuccgaagguccugaguucaaaucccaacaaccacaugggggcucacaaccaucuguaaugugauguggugcccucuucuggugugucugaagacagcaacagcguacucauauacauaaaauauauaauucuuuaaaaauauuauucacucaguaaucagauauauucuucaggcugggcauggguuaagcacaucuguaaucucagcacuugagaagcugugacagucaccaauuagaaccagccugggcuuuaugagaccaugucuccuaugaucagugaucuacacuagguccaccucacauuuuaguuuuaggaccuagguuagcauauuuuauauacaauguuucauuagguguuguguucugcaugcuuggucccuccagccaguacaucuaguucgagagguucugggccacacugaguacaugccaucagaugcucuggccucuucccguuuuguucccugauacccaugcucugggauuaucucacucuggcccuauaaaacuccuuuacuggcaagguguuuguaauucaucucuggcagcagcauucaacaaacauuuaagaaacuggauggaaaaaguuccugucauuaauaaaaccuuuuccaccuccucagucaagccagcugggaaguauccuagacagcauaguccacucaguguaacauuuagcacacugccuugcacaaauccauuuuuuuuuucuguuuucauuuccucauugaagugaauugaaguuuuggucuagauuucacuccuauaagugcuacauaaugcuagaaagcaaucuauguguucgcucaacacauagcaugguaaaauuauuauuaggugguguuaggugauaagcauuaugauuaaguuucagccauuaugaaacuuagaaaguaaucacuguucacugauaaagccaacaguuaggucccggcuuuauagaacuguagacuucacaaagcuccacacagaucuguugugcaugccugggauaaaagcaaagucauugcacaccaggcaaauauugcauauauacacauauauauggcaguuuacaaauuauaaauuaaucucaugcauaauuucuuuagauacacaggacaaugagaaugcucuuugcaucccagugccuagcaagggcacuguuuuguaauaaaugacugccauucaguauguacucaucaaguauugaaugcuucauauauucagugguucacaguuacuuauuuacuuuauuuucacaguauaauaaauguggcagaauuuuaaaagccuggaaauugauaccaaguaagaaaaugaauuguuacauuuauaugguaccuccgaguucauaaaaugccaacguacauauuauucucaaguguggacacacugaaauguacgucuguguaucucuccaguacccaugaaagagaauauacacaugggagacaauauuuagccuccagguuugagauugaccuuauggucuucccaggcuagccuccaauuucugggcucaagugguccuguugcuucagcucagagcacaugcuaccacacccagcuuguuaacuguacucuucccauuaugggcuaaaaaguacaaugaaaauuuuguagagacuaugccuauuuuauaggcagcuuuauuucuauagaaaauuugucuugucuuauacuacugaacugcuuuauaguuaagaaaguacccacaaccauaaugugaccugggcaaauguucuuguauuaacaugcccuuaucacucaaguuuugacugauuaaauuaagcauuggcucauuccuuaugaauaguauggaaugcaaacauucuuauuucauggcaguuacucaugaauauuucauguacccaaaacaauaucggauacaucagagguaguuaguagucauucauuugcacacauggaacaauugauagcuguauaaugcuuuauuuaaugcauucuuuuguaaauucuaguucugugguaaugucccccuuuguuauucccagugcugaacauggguauucagaaauuagaaggugaucagaauaggguaaucaaucaccugcauuagugaccuaguuuguaguuuaaaaucaguuuccauguguuuucucuucugcuaccugguauaauauaacuuacugagccucaccaaagcagaagaaacacacuggccuuaaguauauggacuguuauucauucaagccccguuauguucauauauuuguuuuuacaaagcauguuauuccuagagcaaucuuugugccuauagcacacagaggcguagacuucagcuacuauguaauacauacucagcacugacuuggaaguuacaguaggcuucaugguuuacguauucauacguuuccugguuaccugguaauaucuuguuaccugggggugaccacagugaagcaucacagccuuaguauucagcacaaaaaauaugcagggaaggaaauuaauguuacucagacauucccuggcauucauaucagggcuugaucaaguacaggcaauagaccagugugccuuuuucuuaccuuuugaaaaggauuugcaacuaaggaauaugcaacuaagaccaugaacccacaaagcuucagguacuuagucugaugccuuauaggaaaagcucuacacuuucagauaauaaccauguauaauugccaaugugcuaugagcauguuacuuuuucauccugugucauuuaacuucccucuuacagaggaagaggaaggcacgaaaaagauuaagcccguuaaguaguccuuagagucucucaucauuaauuuuaaagguagguauuagacccaggaguuccuuuggugaaaugcaccaaauuacucggccacuacuaugagcagggaguucagaccucauuuuguccccaaaccauuauuagaaaaccauacccugcucaccuaagcccaaagaaagaaggugacacuggcuggugcuucucagaggguuggcacaucugcauauugcuugucuaauucuucucauuggucuggaacaacucuuuauauuuucucuagauagccugacauuguuuucccccuaacaaccugaugcuuuccuuuucuugucagccuagggcuucugagguagggaggauggcaguaugcauaucuguaugcaugcuuauuccuagggaaguuucaauagucaggcuauauacacuggcuggauuuaguuccgucucaaguggagcagaugugaagagaaauggaaguuguaaaacaucaacaauuuaacaaauggcuaagacccaguuuaaaacagacccuugcacaauacuauccagcuaaaaacguauuccuuuaugggcaauggcaacaaugaaaaauuacaucucaagugaagacagcuuaaauagaaauauaagaaauggaaagggaugcugggguuggggggcaggucucaucuucgaauuucccuucuuggucuuggggauagaaggauagaaauauccuuccagaguucugggccauaggccuuuaucucuuaaauauucuguccauauaggauuggguccuuaggucuuaugcuuggacuuagcucagguuuugugucuuaugacauacguaguuccccgcucuuggaagucacagguguccuguagaaacaguuccucuucuuuggguugucagcauucuguccagccagcucaagacgggccaucuguguauuuugguccuuuuaaaucucaagucgcaaaacuucugucuucuacuugggcguucacuucagagccacuugaauccugaccggacggaaugauguauuuugucuuagauuauuucucagggcagucuggugugaggaacggcuccacgggugacauucuggaccuauugggaaggggcuaugaagcuccucucacacaugacacacauaacacacaugcacacacgcacauguacauacaaagaaacauccaagaaaggauuacuuuagaauacaagagagacacagacuuguaaagagaugaaaugcucaaagugaacagaaaggaggaaaguagaagauagaaacacaagcaaacacaaagcaacagaaugaugcugagauaagaaauccaccaauagcaaagagacacaaauacaaaagaaaacagagaaaguggcccaagaaaggcagggaagaaauguaaacaagaauucacuaaggauagaagcagcagaaagaaaacugaaauggacugacaaagagaacuugaacaaagaacaaguggggugagcacaagaaaaagagagggaugcaugcaacaugugacccaaaggggagucacgaaaggcaggagugaaagaaaagcuaagagaaauagcaaccagauagauaaaacagagagccauagcuagugaagacaaagcagaccacacaggcaccagagaaagugaaacaaagcucaaagcucugcaagaaagaacaugcaggagaaacaugggaauagguaagacacacugcagacagaaaagacacacaaaggaaagaaggagacaugcaaaggaaggaagaaauagauguaacaaagaauuagacacacaaggaagaaguagauacacaaaacaaggaagacauagacacacaaagcaaggaagacauagacacacaaagcaaggaagaaauagacacacaaagcaaggaagaaauagaugcaacaacgaauuagacaacacaaggagacauagacacacaaagcaaugaagaaauauauauaccaaagaauuagacacaaugcaaggaagaaauagacacacaaaagcaaggaagaaauagauguaacaaagaauuagacacaacugcaaggaagaaauagacacacaaaagcaagaaagaaagacacacaaaagcaaggaagaaauagauguaacaaagaauuagacacaacugcaaggaagaaauagacacaaagcaaggaagacagacacacaaagcaaggaagaaauagauauaacaaagaauuagacacaaugcaaggaagaaauagacacacaaagcaaggaagaaauagauguaacaaagaauuagacacaacugcaaggaagaaauagacacaaagcaaggaagaaauagauauaacaaagaauuagacauaaugcaaggaagaaauagacacacaaagcaaggaagaaauagacacacaaagcaaggaagaaauagauguaacaaagaauuagacacacagaccaaggaaaaaauagauacauaaaacaagaaauagacacacccacaauacacacuaaugauugauaguaagcaaagaccaccagaaagaggguaacaagaaacagggaagggcaaagaaaaaaauugccauuaguacacuguaccaggcuaucaacguuaaacuuaagguuuccuuaacauaggaccauaggacacacccgucaacucuuccaaauggccuagucaugcaacuccagggcauauuugccaggcucuguacucaacacuuuccauucaugauuucauuugaccuucacaaacagacaggucuuagcagaacuaaauugccaaagggcauacaucuaggggauauuacauuuaaacacagaaugaacaucucaacauucuguuacauggauuaaaagcuucuguaagcagcaaacacuauaagcgacugcauauuuaauugucagcuucacucuccucuucuauuaaaaaaaagggggggcuugguuuuuacauccuucacaagucuaauggcugcuucacagauggagauaagaaauaaacuauuuaaagcuuuucaauguuuaagucuguaagaaugguagggcaccaagccaaaacaaacaacaacaacaacaaaaccuagaagcuaaauuccucuugugauauaacugguaagcagauaauaguuugaguugcugcugugaggccauuugauaacgugaaagccuguucaucuuccaucguguacauggcccugccucacauuaucacauuagaugcucuccacccagcaccaucuuccagcaaaugcaaauccucagaagacugcaaugcuagugacuuaccucauucuauugcuuuuaagaugcugcagucaggcauguugauccucgggucauuuauaaagcugccuuccuuuuguguguucacauugcuugaucacgcugaagacccaguuuucugugcugcuuuggggaaggguaauauuugguagauggcacuacaaagaacaaaagaagcuguaugaaugccaggaaagaaguacuagaacauccuggcucuuuaaauucugccuaaugauagauacuucuguaucaauuccagccagguuuccauuuguaguuagaggcauucaucaucaguaauguuagugauggcucagugguuaagagcaccuauugcucuuccagagguccugaguucaauccccagcaaccacaugguggcgcacaaccaucuguaaugagaucuggugcucucuucuggugugucugaggacagcaacaguguacucguaaauagcuagguagguaaauaagcuacucacuuguguauuauauggcaugaguaggguagcagugcaucuugaaguauguaaacagcuggcaaagcuuuccuagcuucuggagagagaaccaaauagagcagaauggcuuccucgaaggucagugccacuauugcagcagcuuuucuccuagaagaaacauuugcacuguuuaguuacauuucccagaugugggaaaaagauaaaauuuauguauauaucucaaguaaaaggcugacuuuaauggaaaacaagaucaaaguuaaaauuauuacacuguugcagaaaacuuaccuacuuugauguaggguggcauucuuugagccuuugucuuccuugcuggguucaggaaagcgucucacugaaaucugggcuaggccuguugcccagugguggugagcuauuccccuggaggauccucaugccccaucuccaccuagggaucgucaaagggaauaggucgccagcacugcaaagcagcaagcccacaauucuggggggagaucuggaaaagaggugaaagaaaagccaauucuugaaaucaagaauacugggaaaguugucucauuauguaguaaccagcaguuguguuaaaucauggggaggggcuuggagagugaacccuucacauuuguagaucuuaguguuaacuuagagacaugagaauugcuccauccaaguucuuucuggcuuuuauucugucaccuaccaaugagagauccuuuagauuauagguuguguuaaaguccuuguacuucaaauacucugggaauaaagggguuaaauuauuuucuucuuuuaauuugugcuuuaaacaauaccaugccagaacacuggcaaggugaauagcauuguuuggcucagugcuuauggugcauaugucccuagaaacugguguagcauuggaccucugaguuugaggauauucagagaccagaauuaugacaggccuacagaaugugacaacagccauaucuacuuacucuaucaaguacaaaagacuagggugucagaaacuggccuucauuccucugauaaccuaccuuuuaggcauuucagagcagaaauguuacagauuggucauaacaugguggggaugauuucaaggccucaucauaaggcaaggaucucauuggcuaacugacuaugccaggggaccaggagauggggagugcuuuauugacuugcccccucauucucugaugaacuggagaucagauagaaacccccaaauagcaaauucuccaaaguaccuuuuuuucuccauguggccuguaagcuuuuuguucagaguagcgaggacuugaagagaaguucugcugagauguaauguagcuguauaggcugcuggcaguccuugagucucacauagggauuguuugucccugugaagaaauacaaggcuaucauuagacuacaaaaauuguugaaaauuccacaugaaaauaaugagguauuuacuuaggagguauaacuugacacauuagaccuuuaagggaagauacuaucucagucaaccaaguaacggaaauaccuuugggcucucuccagcacucuucacuccucuaaauccaggcaauccuucuucuugaggcaggagcacaaaacagacuccaaauucaucccuggaaaacaaaugauaauuauacuaaacucuacaaaugauaauuugauuacuagcaauacaaucuucauaugcacaugucagcguuuucaauuggugguaagaacucagggugaggauauguucucauggaaccccuaguucuuaagagaugugaaaacagccuuuaaaauugaaagcaugucuacauuucaaaggccuuucauuucuuuucccuuuuuguauauuugaguacucuaucugcauguaugccugugugccagaagagggagucagacgucauuacagaugguugugagccaccaugugguugcugggaauuguacucaggaccucuggaagacuaacagaaccaucucuccagcucucgucuuaagugagcuuucucuuuuccuguuuuauuuaaaauuaacaaaacuuucuuaugacuacacaaauagagccaucuuccccugggaugagccagaggacuaaguaaggggcaggcagaagagguucacuggacugggagagagggcacagguuggacaguggcuagguuauauggcaguaugcauacaaagaccuggucugguucugccacagggcuuuguaaaaucagcuggcaaaauccacuacuuccacuucccaccacuuaaugaagguguacauucucaaauucacuuguucuacaggguucuuuguuuacaaacuccuaagucugggucaagccauuggacagcuuggaagaaagcucauucuucuuuuuuuuucaagacaggguuucucuguguagcccuggcuguccuggaacucacucuguagaccaggcuggccucgaacucagagauccgccugccucugccucccaagugcugggauuaaaggcucgagcuaccacugcccggcugaaagcucauucuuaauguauacaguucaggcagccugaagauggugauggcgaguugguggcuuuccauuacaugauuacugacagugagggcugggucaggacacuaauuuggggaacucuuuguauuccaucaauuauggggaccaaagauggccuccagaugguuuugugugauggcaccuccuaauggacauuucaaucacagacaagcucauguuccagauguccuacuacaaauaaguguguauuuuacagugccguggaggucauguaggacuagguugccaugacagaauuggcccugauuaaugaucugccugcucacacaacuugaucauuucaauagggaacugucagugauaguggguuuacugugaauagcagcaguaccagcuuccuccaggccacuaacuggagucugaguccuaaucucuauuuagguccauaggaggcaggcugaaagcucuaggugccuaggcaagccugggggggggggucacuuugcauguacugggguggguagccaauggugcuaaggugagaccgaagcuuuagcuaacugucuuagugcaccaaacacauucuuuagcaucucaaaaagcuuuuuuuccuugcaaauguuuccuuuugaagcaguuacuuguacaacaaugguccuaguuuccuaaaagacucaauaguucuagauguauuaucaccuagagagccagacaaugcuaagccuuuggaguugggggaaaccugcugcgaaggaauuuacaguggacuuaaaaggguuaaaguacuagagggucauuugcacguacaaaaggcaaaugcaaaaaaauguuaaguguuauggacaaggauguuuuuucagcuagaccauuuucuacacaggagucaaguauuuguuguuuuaacugaaaguaucuguugaaaagugcuggcagggguccaguguggcacccacccuuaaucccaacacucuaaacuggaggcagaggcgggcggaucucugcgggcggaucucuugaguuugaguuccaggauagccagacuacacagagaaucccugucacaaaacaaaacagagaacaaaacaaaauuaauugauuaauuaaugaaaaagaaaaaugagcaaggaggguacauaaaguaguccauaguaaaauuuguucauaaaacuuauccuucuuugcacuuuuguaaaaaaaaaaaaaaaaaaaaaaaaaaaaaaaaaaaaaaaaaaaaaaaaagauuguaagcuaugaaguucucugucuaagcuguuagugccguccaguggucuguucugggcagaaaugcaguaaaaaugguugaaagaaccaaauuaucaaauuuauauucccaauuccuacacaagcucaucucuugcuacccuuggcguacagcuaagcauaaugcauggagucuuucacucuuaauauucuuuccaugcuuccaagagguagauagaaacagauggcauucagauaaaccaaccagaugguacuaauagucgucuggaccaacaaggcaaaguaagcacacuucccucuuuaagaagucaaauuucaaccccaguagacuuccuaaaauacuuaaacaauucacacaggcaguacauuuccuaaaaugaucucaagugugcuuauauuacauuaagucuuaaauaacauaaucaucucacggaagaaauuuuguaaaauaucaucgcuucucauuuuaguguaccccagcauaauggcgauuggguacacaauguguuaauucuacaauuucguuggcauacuauguguuguguauggauaagcugagaagagcuagugacuuauuagucacuuugacuuuucaguggguggcacagaaagaaacucgaaugagaaaaagauagcuuaguagcuaacaagguaguacuuacuguagucuaaacagccagagucugauguaacggaggagcaguaguucaagcaggauccugcacuggaugaguuacuugaacauccuccucagaaaaauaguaucauuucucaguaaugcugggagaacugcuguugugaugauuauuuucaucagcaaugucauaucaaacacucagcagcgggauggcaagauggcacgcggaggguaaaggcacuugcugccaagccugaugaucucacuuugaucuccaggacccacaagauagacgaaccagcucccauuguugucugagcaccaugugaaugaaugacugcgcgcagcaacaugcauguacacacacacauacauacacucauacacaauagcucccaaaaaagaccuaaguacucggcggcuacaaagcacccuucacacuagagaaagcucuuuucuuacuaggaaaaucucucuuugaaguguacguuuaaaggaaugauuagauccuggcagacauauuuuaaaauguaaaguggggaaacagguucuaucaucucuaaaauaaauucccacuuuaggaauuuucaagcuacuucaaauuauugccagaguuuaaugguggauagaaugaauuaauuaaaugugauggccuauauaauuuucaaaggcgacuugacauguucucaaauuuaauccauccagucaccuuuuaaaaauaagcaaggacuggugaccaaugucagacaaaauauaaugauuagaaggcuuaggucaucuuccaaaaaguuaaucauacuaaaggccacacaaagauugacuuuuucguuuuguuaaacuuguaguaaagaccaagcaaagauacuugucuuaaacauucugcaauaguugcacugaucuuuccacagacucaucacccucaguacacugagacacugcuuagucuucagaaacaugacacaaauggcuauuuuuacuucacaaaagcuaaugaucucacagucaauccaccuugcaauccaaaugccuuucuuaaggaauaaaauuaucaauaacuuuucuggcaguugguccuguacaguagcaauauacaaaaucgggcuuaaaguuucuuaagcagacaguuggcuccuuccuggaggaagaacggaaagaaaagugcuaagcuuccuucucaggaagacaauuuucaguucauacuguaaaggaaagccccaaguaaaagguggcaauccaacucccugagcuacuugccugcaauauuuugcacaauaaagcauuaauaaagguaggcaagaaugguuccuggcccuagaaugugccagcaguuggaauuggaauaauuuagaagugcaaguuaaagauugaaggcucauccaccuaguuuuggccugcuuuugcuauucaguguauaaauacaccaaaauuuauuaaugacacauaggguguuugggguaauuaacauuacccagaauaauguaagaauucgaggugucucuguucagugggagcaaggagaaggcaacugagacacuguagccauaugaagugaguaaacugguguuguugacuuuaagucaagagaagggcuuugcccagucaauacuguucaaacaaagaggcaaaagggauggcaugauggaauugagaaagggcacaaacucuuccuuaaugauggguuugugagaauuagugauucagaaaaguggucaauggacaaacuagaggccgggcaaaaggaacacuauaaagugugagauugugacuauuuaggauuguauauauuaaagcaaugcaaaaagggucgaaauccgggucauuguuggguguacauacugcuguacuuuauuauaucauugggaaacuagcaggggauuugcucaaguuggaguagaaaauaaaccauccagaacugccauugugccuauuaagagucccaaaaucaguuuaaggaagagagcaggucauucgucagagccccugugcucauugacaguaccggguaguuucgggggcucagcaaccucugcaauaauguaaaggggacaaaauauuccagacauucauaguuauaaauacgcauaacuuagcaauuaauucugggacucaguagccuugaugguaugcaaagagagcacacagguccuugacauuuuugcauaguaaucauccaaaugcugagguuacuaauaguuacuaccacucagcagccccagucaaaagguaggcauuucagaaccuuugcugccgcacaggucauauguguaaggguacagauuaauauugacaagagaagugcucagaaauaauuaauaugccucuggugucaaaagaguacaaggauguaaaauccaacuccaaagguaaugauggacaacuaacugcauuaaugcacuuaaguccaaaugaagagcacuucguacaacccucuuucugcuuuaaagcggagaagaggguacaguaguucuuagagaagugcuuagacaugugaacuuuccaaaugaaagucuugagcuuauuaucacuuccugcugaaggugcuaaggaagugagugggauccuuucaagugcacagagcagguggcagugcauacgcauacauuuaauauaugauaacaguccaaaagaaugcggccuuguugaucagcauauccugauauagugcaaaugaaaggcgaaggaguauggccuuuguuuacuggcaaagacaaaggaagauucacuguauauuaaugguccacuagcagggaccuugggagauaaacgguaucccuugcaggagugcaagagauacaaugguccgaaaaguaauaagguuguggauaaguguaauuuuacacauuaacuggccaaguauuuuuauuaaaaugaauggaucaugucccuguuauauacauuaauguucaagggacauguuaucaauuaaaaaccccauccuuuaugcaaauauuaagucuuuaaaguaauaguccuggaaauuaaagaguggaaaggaggggacagccuuauccaguguccaggaagaugaagaagccaaaagauuagugacccuugcuguacugcaaaaggguuugagaguaggaucguauccaaauggaaugagaugugugcaguaaaugcauacuaauaugcaagguacauguuuauggccauuacaguuuuacgcuguucagguuuccuucuguagugaacagaaaaggccuacuacaaucagucauuauuauuagcaagccacaaaaugggaccuuauaggucaacaccacuucuguacuucaaaguuaagaguaaaauugauccuacuaaaauugccaguauguacauaaauaguuugaggaagggguuucaagugcacagcacauacauaauuccauaaagcaaagaggauaugaaugaucagagacagaagucuuaccuugaaggaccauugaccguauuggaaucguuucaaucuauagucucaugaaagaagcuuuauauuagugagccucuuugcuuugcuaaguacaggaguccugaucuaaaaggcacaacuguggacaugagaauauguacaauagaguuaacacugugcacauuuacuauguuaaggaucuuaaauacugcugcaauacaaauaagucuucaccagaugcagauuacuacagugaaaugacauaugcacauucacaauaugaaagacugcaugcagggcauagugguaggaaccagauaugccaacacuuguuaaacgcaggcuagauccugagcucaaggcuagccuggguuauaugcuaaguuccaggccagccuggaaguuaaaaacaggacagaucaaaggucuucuugauuaccaacaaaaugacuugacuuaguuugguuucuuuauccaaugcuuaggaagagggacaaaugcagcugugcacacaacaggcacaaauauguuuacauuacagguggcaaugccuguaagucccgcccagcccaggcuacauaagaggcuguucucucaaaccaccacacgguggggcuguagcucuaugacagugcuuuacuagcguacacaagacucaagguuugauuccccagcacagcagaaagaccagaacagagaaguggucucauugguuggcacccuugauugucacccauuaggguaugaggguaugggaucuugguuacuaacagaaggggacuugaacaacugcaauuuugcacaauuguguaagaggcauuaaguaaucagcacccucuuuacauaaagcaaggguaguauuaggaccuugagaaaagacucaauuccuagucaggauuauccacauaaaauguuccagugcagagguuuuuggcugaaauaagaaagcaugugagacuaguauacaauaucaugagcaaauaaauguaucuccaucaguuagaaagaugugaccuggggcgauagcacccaugacagcaugccaacaguauauaguauucuacccccuuuaauggccaaugccuugaaaauugggacugagcacuuuaacugucugauaacagaccuguguuugccccuuugcuaaaugcacacagggcuggacuagcuaaagucuaauccaauggacaaaauauuucugacagaauuauucaguacucaagguaauacaugagaaaagacgacugaacacugcuuagaaacuugggacugugacuacuacagcaaugacagaaugguuuucuuuccuuaaaggaaaggagacuugagagaugauaccuccauggcaagucucugauauaaaacucuuguuugauugguguaucuugauuaacaugaaggacaagaguucuuuguuuacuuguccauggacaaguaaaguaggacuguaugcaaagugaaauuccaugacucuggaagucaguauggaggggguaugggguauagaugggcucagucuuauaggcugagugaugggcacugcauuuuagcaauacgauucuaugcauuaagugaaauuccaugacucuggaacucaguauggaggggguauagaugggcuaucucagucuuauaggcugaguuaugggcacugcauuuuagcaauagaaaucuauacauuaugugaaauuccaugacucuggaagucaguauggaggggguagaggguauagauagggauaucucagucuuauaggcugagugaugggcacugcauuuuagcaauaggaccguaugcaaagugaaauucuaugucucuggaagucaguauggaggggguaugggguauacauagggauaucucagucuuauaggcugaguaauggacacugcauuuuagcaauacgauucuaugcauuaagugaaauuccaugacccuagaagucaguauggaggggguaugggguauaaaugggcuaucucagucuuauaggcugaguuaugggcacugcauuuuagcaauaggacugcaugcauuaagugaaacuccaugacucuggaagucaguauggaguggguauagaugggcuaucucagucuuauaggcugagugaugggcacugcauuuuagcaauaggacugcaugcauuaagugaaauuccaugacucuggaagucaguauggaguggguauagaugggcuaucucagucuuauaggcugagugaugggcacugcauuuuagcaauaggacugcaugcauuaagugaaauuccaugacucuggaagucaguauggaggggguaugggguauagaugggcuaucucagucuuauaggcugagugaugggcacugcauuuuagcaauaggacugcaugcauuaagugaaauuccaugacucuggaagucaguauggaggggguauagaugggcuaucucagucuuauaggcugagugaugggcacugcauuuuagcaauaggaccguaugcaaagugaaauucuaugacucuggaagucaguauggagggaguaugggguauacauagggauaucucagucuuauagacugagugauggacacugcauuuuagcaauaggaccguaugcaaagugaaauucuaugacucuggaagucaguauggagggaguaugggguauacauagggauaucucagucuuauagacugagugauggacacugcauuuuagcaauacgauucuauguauuaagugaaauuccaugacccuagaagucaguauggaggggguaugggguauaaaugggcuaucucagucuuauaggcugaguuaugggcacugcauuuuagcaauaggacugcaugcauuaagugaaacuccaugacucuguaagucaguauggaggggguauagaugggcuaucucagucuuauaggcugagugaugggcacugcauuuuagcaauacgauucuaugcauuaagugaaauuccaugacucuagaagucaguauggaggggguauagaugggcugucucagucuuauaggcugagugauggacacugcauuuuagcacugaaucaaugaagauucgaauuucucuaaguagaagugggcuugggauaggucugaaaguaucugggccuggggcuaggacugggcuggggcagggcuggacuggauuggguugguuggguggggcaggggcaggggcagggguaggggcuggggcuggggcuggggcaggggcuggggcaggggcaggggcuggggcuggggcaggggcuggggcuggggcuggggcaggggcuggggcugggccuggggcuggggcagcaauagcagcagcacuauuugcugagucuugaggagaaucuagaugccauaaaggcaagaacacacagaaaguugaaauguaggccuuaauauuacuauuauaacaguaagucugauagaggacacagagcauuacaauucaaggcucuugcugacaaguaaaaccauuagucaauauagcaucaacaauagcaacaaaagcaaagccugaacugguauagaaccucaaauacuccugacauccagucauaauguucacuuuacauuaacaguaucuguguuauaagacuuaaaaauuugaagaguagcucgguggaugaguuugaaagaaaguacauuuaagugccaaguaauuugaguaucaucugccaaaaaaauuauugaaaacuuuaaggacuccaaaguaacaauucacuaaagguaauuaaaaugaauucaacaaguaagcaaaucguaaauacauuuugaaaacaaucacuucgguuuuaaauucaaacacuagcaaagcacacuaucagacgugucguuggcauccaaaauauucauugaaaucaaaaugcaaccccagcaauagucaugggguagauuuuggaagaagguaggauucuaccucuucaccagugauuugugauccacuaugacucuggccaaagucaccacuuauacccaguaggcuuagagaaccgcuugagaucagugcuggcuaaaucagaggccaagguguaaguagacuagccacugaacaauacaaaggaauggaacgggcugaguuuuaguuugcaccgccacguauagagcacuguaagagacuaugaacgcaagcggaugagucaaauguccuugaaauggccuuagauacuuuucuuucuuuuaauaggugagguuucaaugauuuacaucgaccaagaacccgcagccucggucucucgaaucggauccgacaucauccaacacuucaguguuagaauugcaagcaugcgcucucccgaccugggcaggcacuucgaaaaaaugaugacuaaagacacacgugaaguaccaagcgaaacucacguccuuaugggacagugacucaucacagucuaauuccauccuggccaccaagcaauaaugcacauuucuaacuggaagucaagcaaacaccaacacuuucacacuugugcccauuucugacgaguuacgucaaguggcaaccaacacuuccacuuagccuugccucagcuucgaguggcacaagguaggaccaaccacacccuaccauaaugcaccaaguguacccucgggcaaagcccgccaaguagcuaaagcccgccaaaaaaaaaaucacugaaagaaaccacuagagggcaggucacaugacuuccgccaucuuagacacauucaagagcaugugccaccucuccaggcuaacucagacaugaagcugacaugugacacacaaagcccuuugcguuauaccgcaccaagaacuugagccgccaucuuuuccuguacgaccuaaauguccuauaauccauugcuacacaccagaacaaagauugggcugucgagccucggguggagcccccgagccgccauuuuauagacuucugagcagcccuuaaagccacgggggaccgcgccagggguccauaugcacacacacccugcccaauccccacacccacgcugagcccuauccccuaguccucugcggcuuccgcgcaacaccgcacacuaauacgagcacuccuuggcuuucuacuuccggcuagcacaaccccgcaaaugcuaccacaaaucaaggcgaaucccgcaaccccgcacauauaaagaaagccuuuagcuagcgcagcgcaauugguugcuuuuauccaguccgcugugcuccucgguguccuaauucuuggcguaacuggcucgagaauagccguaucacgcagaagccauaauggcggacgcgggcucuccacgcccugaacacccacucaguuuaagagcaaagucguuuuucuaagccauagguucacucacacagcaccaaacgaucagcagcaacaguacacgcaaauaagaggcauagauauuccagguagugcaauaacucacaaaaccauauuuccauccaccaagcgccccguugggccgugaaaaaaaaaauuuaaagcagguauccacagccccgaugggcaaaagaaaaagaaaaaaaaauaauaacagcagguauccgaggccccguugggcaugggaaaaaaagacuaaacgcagguauccgaggucccgauggaccgagaaagguuuuuuuguuuuuuuuuuuuuuuuuacaaaaagcagguauccauggccccgaugggcuaaggagaagaaaaaaagaauaaaagcagguauccacagcccagaugggcaaguuuagaaaaaaaaauaauaagaaaaaaaaagaaugaaaaggcagguaaguauccaaaaccccguugggcauggaauggcggggaggacacacagguauccguggccccgaugggcaagaauauauaaacaaugaaagaaagguaaguccaccauacacacacaaguaucaaccaaaaggcacaacaaagaaauauuccuuaaaaaugaaaaauugacugaaaauauuacaaauaucaaaaaguauggaggacaugucaaaaaaaaaaucuuaccagaacauaucaaaacgucaaaaaucucguggaauuuugauauguuuucuuaaauaagccauaaggcuuggugguaggggaacuaaaaauguucccccaaagcuccuuagauggagagaaaccacggaagaaccgcacauccacgggaaacgagcaaacauggcuggagcaagccguugcacgccuuuaacugauccgcggcgcugaaggcggagagaccagaagaggaguggccacaaagauugcaauucugacaucuuauuggaccuuuaggucuaacuauauuauaaaaaaauuaaaaugaauaaagauggagguacguaagcucagugacaugacgcgugaauuucauuauuuugcgcgauaaugaaggauuauccuauuuuacagcuaaaaacguuuauguagaacuuccacauaaacauuaaauaauguacauuaggucacacaccugucuaugcaaaauuucaauauaucuucuacuuggacaaaccauguaucgcuccgcgucuuggacacuagaaguucuucugcauuaguuggcgaccucagaugaggagaggaaaggguagaaaugccucacaaaauggcuccuugguuccuaaauuaucagaguauuaguugugaccgauuuggugggcuuacgcucauaguuuugggucauuggcaucuuagucuuucucugggaaccuggugacuccauaccuugggacaaaaacgcacugaaguacguuacucgcuagcaguaaugaaaaauaauuccuaaaugccaaagcaaagccugagggaauaauagcucauugguaucuuacucgccccagagacacugcuaacuuaaaagaacugucaaauuuuguuaacugucaaacuaugaauauccacaugaaagagaucagacacccuggguauuagaaaaucaaaggauauuguugucucguugauucacgcugacaaauaauucacagucuguucuaaguucccuuuaggcgucccaugaauaauaaaggacacaaaauugguuugcuuauggacgaucaaagugccagcaauucacuaaucuuacuauugaggugguucagguagggauggaaaaauaucugcuacaaaauaaacuguuucaacaaaagaaaaacaaauuaacaaguaaauaaaugaugcacacagacugaauaaaccagcagguggcagcaugaaucuuuccaaggcaucugaagccaaacuuggagugcaaaaggauuccuaucugaauugagaaguaaagguuacuuugucuaacuuuaguugacagagcgaucaggaucagaguaacaagcacaccaaaagcaucaccagugagaagucacauaggacauauuagggaaaaaagacccaaggaagggcucuucacagcuaagagcaccuggcuccacgauggauauggcuuuguauaaacgagaacuucuaaaugagcuguacaaagagaauuuagaacuugcgagguacuggucacagauuaugcaagccaguguaucauuuuuguggggaugcuagagagaaucaucaaauuaaagaguuaaauuuagucucuguguuuuacuuagucccaauucuugcaaaccucaucauucuuucucacaccguguacaucaagguaugucagguuucggggacacuuuuuagucuuaucacaagaaagcaugaagggauaugugcuaaaacucaguuccugggcuggagagauagcucagugguuaggagugcugacugcucuuccagagggccugaguucaauucucaacaacuucguaguggcucacagucaucuguagugggauccgauaucuaaccucuucugauguaucugaacagugaccgacaguguacucacauuaaauaaauauuuuucuaaaaaacaccuccauuccuguacacuuaacuagguaauuuauugcauauucuuuguuuguuuguuuguuuuguuuuucaaggcagguuuucucuguauagccccagauguccuggaacucacucuguagaccaggcuggccucgaaguuagaaauccaccugccuccaccucccaagugcugggauuaaaggugugugccaccacugccugccucauugcauauucuuaacauuaagauuaaaaaugcaccugggguaaaauaguaaucuugaggaauucuccaugcaaauucaaagaggagaagaaggaagaacaagaugaugaugauaaugggucaagaaacaaggacccacuacaaagcagcaagaaacagaaaugggaguuaagaaauggucuuccaaugugcagagaguaagagacuuuagaacacuugguccuagaugagaugucuucaucaagcccuuucuuucaaugcucaggcaucuaugaagauaaggagucagaaagacugcaguaaaugacuccaagaaaacaccauccagacaaaacagcgcaguuuucguuuuguuuuuaagaaaaugaauauggauuuggaugaguggggaagaguuggaggaaggaaaaaugaucaaaauaaaucaugaaaaaugguuuguuuuuuuaaaggaagggauguucaaugacacuacuggcucugugaacagagagaaaguuggagccacaacuauagguagaucaggcauccagucucuccaggaaaucuauauuuuuuucaauucuaacguauauugggagagggguugaucugguauaaaaugguugaagaaacacucccaaguucaugaaucaacauaauauugucuaaguugcaucaaaaacccaucuauggauuuagcgcuauacucagcaaaauucuaaugacauucacauaaauaguuuuuaaaaauaggugacaugguaaguagcuuaugccugugaaucccagcccuugggaguuacaaggaugaucagaaauagccacauagagaauuggagaccagauugagcuacaugacaaagcuucaaaugaaugaacagguugcaccacagcgucaacaugcuacugcucauagguaggcuuguaaauuagugggauagaauagaggaccuggagacagccauccacuacucaacaaagguacaaacaccacauguaagagacauacagucacuuggccaagugauccuuagcauagugguacuaucucacccuauacagaaaucaaucuaccaaagaucauguaagaacaaugacuccuacagccucagacauuuuaucacuaagccaucaggagcggggaggagguggcacuacuuuagaagaauuaggaaggacauaagucacuagggagugggcuuugagguuucagaagcccaagccagggccggugguuggcuuucuuccuacuaccuguggaaccagaugucaaacuccaguacuaugucuucuugaaugcugacaugcucccuaccaugaagacaauagacuuuaacccuagaaaauauuagaaagccccuuuacaaugcuaucucuuaaaguguggucaaccagguggacguggugcaugucuuuaguccccagaccuaagaagugaucaauuauggugcuuaagacugcucuuagauuacucuugagaugcuuaauauuccagaugaccaaaguucaagauuuacacucacacuagacaaaucuuuacugccuguaauuucagugcuaagggaucuaaagaucaggcuuucaugugcaacuucacagacuuuauauaagauaacaaaaaacaaucuccagcaccucauaaaacaggcauaccaacuuauaaguuauaguaauagaaagugaagaguccccagcuccaagucccggaaaaauaucaacaaaaucagaagaaaauuuucccaaccuaaagagaugccacccuuuccccuggcuggcagcauggaggcugaacgaugccugaagucacuguaaaagauguuaaccaucagguucgucagagcgcuggcagccuuccucaaaaaguccaggaagcugaaaguucgggaauggguggacacagucaaguuagccaaacauaaagagcuugccccauaugaugagaacugguucuacccacgagcugcuuccacaacuccggaccuguaccucuguacacaacuguagugcaggaguugguuccgugaccaagaucuaugaaggauggcagaggaacgguguuaggcccagccacuucagcagaggcucugagaguauggcuugccagguccuccaagcccugaaagggcugaaaaugguggaaaagggccgagaugggggccgcaagcuaacaccucagggacaggaaacacaucuggacaggaucgcugaacagguggcagcugccaacaagaagcauuagaaaaaauaauacuggguuaauaaauugccucauucauaaaaaagaaaagaauaaagaaagagaagccuauaaacauacaagaagcuuauagaguaccaauuauacccaaaaaaaaaaaaaaaaaaaaaaaaaaaaccaaacaaaacaaaaaacaaaacccuccuggcauguaauaaucaaauguaaauacaaauaauaauguuuuggagaagauguaaugauccauuccauuaauacgagcacuugggaagcagagccaugguggaugggucucagaggagugugaacuuaaugugggccucugcuguagcagcaaguguucuuagcugcuaagccaucucuguggcuucuuuuauuccaaggacuguuuaagcugaccuggaauucacuauguagaccaaacuagccuugaacuuauggugaacuuccugccuacaaaguguugugcuuacaagcaugugcuaccggucacagauauaagugauaaguauaaguguuuuauuauauauaaauaaguaaauaaauacauagauucuauaucuguucuuccacuugccacaucaguuuuuccccucucagcucauacuccggauuacauacuccgguguuauagucuuggcacaggagcaggcaaugcaaguugauggucacaauuaugcaaccugaggaauccucagaaccgcagaguucucucuaguuauauauuguugugauucuugauuuauauuacagaaaacuuaagaaugcuuauugaauaagaugaaggaaagauaugaguggguauugggaggggcauggacugaaguccagcaguaguagcuauauaccugauuuguuuuuuuuuaaguuucuguuauuuaaaggaaguauuuuauaaccaagguugagagagcaaagaaaacauuuguucaucuucccacucuacccuugccuuuuccauuuuuguguguauaugcauuuuguccauagauguggauacacauguauauagguucauauguauaugugugugaauauauaggccuaaguuuaaugucuucaaucauuuuucuaccuuguuuacugaggcaagaucuuagccaaaccgagagcucacugauauggcacgucuuguuaggcaacuugcucuggggaucccuguuugagccuuucauagcugcaauuauaggagggcuucacauggguucacgccuuggggacuugaacucugguccucaugcuuuuauggcaaauacuuaaccucugagccaucucuuuagauccccauuacaucauugaaaaguauugaguuuuuaagguuuauuucugacuuuaguuauguauauggucugugugugcccucaaagaccagaagagagcagcaaagccccuggagcggaaguuauaggugguugucaacugccugauagugcugagaaucaaacuuggauuuucugaaagaguagcaaauguuuguaagcaucgagguaugucucuagucccagguuuguuuguuuguuuuauuuaaaugacguuacugaggguacuggugagguugcaauaugaauaaaagagaugugauuaagauaaacccauggaaugugagcaguggaggugcacaccuuuaaucccagcacuugggaguuagaggcagauggaucucugaguuugagaccagcauagucuaccgaggcaguuccaguauagccaaggccacagagaaacccugccuugaaaacaaacacaaacaaacagaaagaguagauaauaauacauuuggggggcuggagagauggcucaacaguuaagaggauucgcugcuuuuccagacgauccagguucaguuuucuuuaaagaauaggccacuggcaguuugaccucacgagcuaauaauguuuuauauaacauggaguaacuuagaguagcauaaccugaugacaaagguggucaagugguaagagccauagaaggguucaacgacccugccccuaucgcuggaguauugagauuuaaacuaaaaauaggagagacauuucaauagagaacaaggaguacccauaauaaguaauuuucgcuuuuuuccccugccgccaccaauuugcgcggaggcagaagcucaggugcguucaagauucggcgucacccauaauccaccgccauggccgaggaaggcauagcugcuggagguguaauggacgucaacacugcucuacaagaggugcucaagaccgcccucauccaggauggccuagcacguggcauacucgaagcugccaaagccuuaguuagacaagcgccaagcccaucucugugugcucgcauccaacugugaugagcccauguaugucaagcugguggaggcacuuugugcugagcaccaaaucaaccugauaaagguugaugacaacaagaaacuaggggaauggguaggccucuguagaaucgaucgagaggggaaaccacggaagguggucgguugcuguugcguagugguuaaggacuauggcaaagaaucuuaggccaaggaugauaucgaggaauacuccaaauucaauaaauaaauaaauuguagcucauuaugaaaaaaaaguaauuuucuucgagguguagccugacuaauuauugugucuugugguacugcaagauagcccagagaaacccucaucuugacuggccaugguagcacaugccuauaaucccagcagaagaauugcuuugagcuugagaccauacuaugucuugagagaguucuuguuuuuuuaaaggguggcucauguuugaagcauaagcugauuacuuuugccuugcaucauggauaacugcccucauauggaagaaggucuguccugggagguuuugcucuuggaguucaacaugacuaaggaugaaugaaauaauuuaggaagacacuccuucuguuauuaauaugccuaugcacagucaagcaggaguuugaaaugaacggaaagacagacucaaaaugaaggcagagacucaagucuuuaauccugugguugguuaccuugugaagccaaguaggccaucaauaccuuuagcaaaagcacuuucugaaaaccuguucuaacaggacauaaauuucuaacaacagugcaacuuaaauuguaagaaaacacaggacuguuucaaagacugauagcauguuguuuccuauguuucauauacagccucaugguuugcuuuggcuuugcucuccaccccucuuucacguggucucauguaauucaggcugaucuggaacuuacuguguugcugaagaugagcugaacuccugaugcuccuuccuaacucucucaaauucuggaauuuuaggcaagcaccacuuugcucagcuuuucuuugauuuucauuuagaauauuaaagaauaguuuuauuuaaucccaccauucaguaggcagagucaggaggauuucugauucccagucuggucuacagagcaagcuucaggacagccagggcuacacagagaaacucuaucuugagauaccaauaaagaaagaaagaaaaacauuuuucuuggggcuggcaauauggcucagugguagagcaauggcuuagcauguaauuagaaaaucauggauucaguccuuaguaacacacacacacacacacacacacacacacacacacacacacacacacgggcugagucuugacugcaagauggcucagcugauaaggagcuuaccucaaagccuggcagacacccugagcuccauccuuggaaacuaugugguggacacauccauauauucucucucucucucucucucucucucucucucucucucucucucucucucucccuucuucuaccccgccuuggucuuucucaaacacaaaaauaaauaaauguaaaauauuguaagaaguuauaggucauuuauauaaagaaaauuaaaggaaauuaaggaaauacuuuuagaugagaauagaguauaagguuuuuauccuaaaacuaaaagauuguucccauauggacaaaaaggggugaugagggaaaaaaccagaaaguuuuagucuauugccaaaggccugaguaugucacaagaaguuuguagaagauaaagugaggcccggggaaggaaggagaauugggaauuuacagucauucucugcuacguaauaagucgaggccagccuggaauaacgggggcccugucucaaaaacagaagagcaacaacgauaugcaugccugaaaagccaaaucuuuaaaaauuagcuagagucacacuuuccuagguacuucuuucaacaguuuugccacagacauuagaaugaaguuggaaaugcagacaguugggcucccagauacccugaaucaacuuuuauauuugacuuuuguuuuuuuuaaguuuauaaaaacuuuuuuuuuuuuagaauuuuuaugugugugaguguuuugccugcauauaggucuguguaccacacucgagcauggugucagaggaggugagaagccucaugcagcugcuaggcauugaaccccaguccuuugugagaauauuaaguacucuuacacaccaagccaacucuccagcccugcuuuugggguguucaacaacaaagauaaguagaaaccaaauacgcacccagagaaaaaucacauauauacaaaaagccagaaauuugagaggcaauguguguguguguguguguguguguguguguguguaguggcgaggaauaacauaggaggaauuggagaagggaaugggggagaauauguaauuauauuuagauuaauuuuauuuuuuaguauagaauagaguuuauucagggcauggggaggggaguuaagaggguagcagaggcagggaaaggcagagagagagaaagagagaguagagaacuagaggcuggccaugagcacauggagagagggggaagggaaucuagauuaaaaauuuaaauggggggggcaauaaagugguuauagucacaggagcauaucaaauugauugucuuggccauggguguguguguguguguguguguguguguguaauaauuuucacaaacuugccaucucagagaaacucuaggaggaagaaaggauuccaaacaggcaaauucuggcuacagcugaggagagcucgcacaggaaagaacugccuguaauggaaugaaaagaagccagggcuuugcugucuugggaaagagggaaaccaguguaagggaaaaugugcuaccuucuggagagaggacagcccucggcuccaugacagcugucccagguugccuuagcaaagccuuccucaagcagauauucacugaggccccuucggcaacuuuccaacaugguuuuacuuaaauacacacacacacaugcauuuacuucguguguguguguguguguguguguguguguguguguguguauacauguuugccuguguagagagaucuguguagagagaaguaugugccggggacugaaccugcauccuuugcuagagcauuaagcacuguuaaccacugagcacucgcuucugccccugugccucguggugcaauagguaaaaugagaacuuuuuucuuucuuuuuuaaauggaaguguaguucucugccuuuauugauaacccaagauccuuuucuaauuugugugguaaccaguauuggugugaacauccaaaagccaaaggaguuauugucagcuucggcccugugagguguccaauaggaauaggacaagguauaauucugucuuuaucaaaaacuaggggacauacccaggccugugguuuacuuugccaccuagccucugugacauguagauugcaguuauagcagcuacagcaaugcuggcagcuaaaaacacagaaggggcuccgaaagagaucucgggagcaa

SEQ ID NO: 49 - RNA, 42861 nt, Mus musculus
uugcucccgagaucucuuucggagccccuucuguguuuuuagcugccagcauugcuguagcugcuauaacugcaaucuacaugucacagaggcuagguggcaaaguaaaccacaggccuggguauguccccuaguuuuugauaaagacagaauuauaccuuguccuauuccuauuggacaccucacagggccgaagcugacaauaacuccuuuggcuuuuggauguucacaccaauacugguuaccacacaaauuagaaaaggaucuuggguuaucaauaaaggcagagaacuacacuuccauuuaaaaaagaaagaaaaaaguucucauuuuaccuauugcaccacgaggcacaggggcagaagcgagugcucagugguuaacagugcuuaaugcucuagcaaaggaugcagguucaguccccggcacauacuucucucuacacagaucucucuacacaggcaaacauguauacacacacacacacacacacacacacacacacacacacacgaaguaaaugcauguguguguguguauuuaaguaaaaccauguuggaaaguugccgaaggggccucagugaauaucugcuugaggaaggcuuugcuaaggcaaccugggacagcugucauggagccgagggcuguccucucuccagaagguagcacauuuucccuuacacugguuucccucuuucccaagacagcaaagcccuggcuucuuuucauuccauuacaggcaguucuuuccugugcgagcucuccucagcuguagccagaauuugccuguuuggaauccuuucuuccuccuagaguuucucugagauggcaaguuugugaaaauuauuacacacacacacacacacacacacacacacccauggccaagacaaucaauuugauaugcuccugugacuauaaccacuuuauugccccccccauuuaaauuuuuaaucuagauucccuucccccucucuccaugugcucauggccagccucuaguucucuacucucucuuucucucucucugccuuucccugccucugcuacccucuuaacuccccuccccaugcccugaauaaacucuauucuauacuaaaaaauaaaauuaaucuaaauauaauuacauauucucccccauucccuucuccaauuccuccuauguuauuccucgccacuacacacacacacacacacacacacacacacacacauugccucucaaauuucuggcuuuuuguauauaugugauuuuucucugggugcguauuugguuucuacuuaucuuuguuguugaacaccccaaaagcagggcuggagaguuggcuugguguguaagaguacuuaauauucucacaaaggacugggguucaaugccuagcagcugcaugaggcuucucaccuccucugacaccaugcucgagugugguacacagaccuauaugcaggcaaaacacucacacacauaaaaauucuaaaaaaaaaaaaguuuuuauaaacuuaaaaaaaacaaaagucaaauauaaaaguugauucaggguaucugggagcccaacugucugcauuuccaacuucauucuaaugucuguggcaaaacuguugaaagaaguaccuaggaaagugugacucuagcuaauuuuuaaagauuuggcuuuucaggcaugcauaucguuguugcucuucuguuuuugagacagggcccccguuauuccaggcuggccucgacuuauuacguagcagagaaugacuguaaauucccaauucuccuuccuuccccgggccucacuuuaucuucuacaaacuucuugugacauacucaggccuuuggcaauagacuaaaacuuucugguuuuuucccucaucaccccuuuuuguccauaugggaacaaucuuuuaguuuuaggauaaaaaccuuauacucuauucucaucuaaaaguauuuccuuaauuuccuuuaauuuucuuuauauaaaugaccuauaacuucuuacaauauuuuacauuuauuuauuuuuguguuugagaaagaccaaggcgggguagaagaagggagagagagagagagagagagagagagagagagagagagagagagagagagaauauauggauguguccaccacauaguuuccaaggauggagcucagggugucugccaggcuuugagguaagcuccuuaucagcugagccaucuugcagucaagacucagcccguguguguguguguguguguguguguguguguguguguguguguguguuacuaaggacugaauccaugauuuucuaauuacaugcuaagccauugcucuaccacugagccauauugccagccccaagaaaaauguuuuucuuucuuucuuuauugguaucucaagauagaguuucucuguguagcccuggcuguccugaagcuugcucuguagaccagacugggaaucagaaauccuccugacucugccuacugaauggugggauuaaauaaaacuauucuuuaauauucuaaaugaaaaucaaagaaaagcugagcaaaguggugcuugccuaaaauuccagaauuugagagaguuaggaaggagcaucaggaguucagcucaucuucagcaacacaguaaguuccagaucagccugaauuacaugagaccacgugaaagagggguggagagcaaagccaaagcaaaccaugaggcuguauaugaaacauaggaaacaacaugcuaucagucuuugaaacaguccuguguuuucuuacaauuuaaguugcacuguuguuagaaauuuauguccuguuagaacagguuuucagaaagugcuuuugcuaaagguauugauggccuacuuggcuucacaagguaaccaaccacaggauuaaagacuugagucucugccuucauuuugagucugucuuuccguucauuucaaacuccugcuugacugugcauaggcauauuaauaacagaaggagugucuuccuaaauuauuucauucauccuuagucauguugaacuccaagagcaaaaccucccaggacagaccuucuuccauaugagggcaguuauccaugaugcaaggcaaaaguaaucagcuuaugcuucaaacaugagccacccuuuaaaaaaacaagaacucucucaagacauaguauggucucaagcucaaagcaauucuucugcugggauuauaggcaugugcuaccauggccagucaagaugaggguuucucugggcuaucuugcaguaccacaagacacaauaauuagucaggcuacaccucgaagaaaauuacuuuuuuuucauaaugagcuacaauuuauuuauuuauugaauuuggaguauuccucgauaucauccuuggccuaagauucuuugccauaguccuuaaccacuacgcaacagcaaccgaccaccuuccgugguuuccccucucgaucgauucuacagaggccuacccauuccccuaguuucuuguugucaucaaccuuuaucagguugauuuggugcucagcacaaagugccuccaccagcuugacauacaugggcucaucacaguuggaugcgagcacacagagaugggcuuggcgcuugucuaacuaaggcuuuggcagcuucgaguaugccacgugcuaggccauccuggaugagggcggucuugagcaccucuuguagagcaguguugacguccauuacaccuccagcagcuaugccuuccucggccauggcgguggauuaugggugacgccgaaucuugaacgcaccugagcuucugccuccgcgcaaauugguggcggcaggggaaaaaagcgaaaauuacuuauuauggguacuccuuguucucuauugaaaugucucuccuauuuuuaguuuaaaucucaauacuccagcgauaggggcagggucguugaacccuucuauggcucuuaccacuugaccaccuuugucaucagguuaugcuacucuaaguuacuccauguuauauaaaacauuauuagcucgugaggucaaacugccaguggccuauucuuuaaagaaaacugaaccuggaucgucuggaaaagcagcgaauccucuuaacuguugagccaucucuccagccccccaaauguauuauuaucuacucuuucuguuuguuuguguuuguuuucaaggcaggguuucucuguggccuuggcuauacuggaacugccucgguagacuaugcuggucucaaacucagagauccaucugccucuaacucccaagugcugggauuaaaggugugcaccuccacugcucacauuccauggguuuaucuuaaucacaucucuuuuauucauauugcaaccucaccaguacccucaguaacgucauuuaaauaaaacaaacaaacaaaccugggacuagagacauaccucgaugcuuacaaacauuugcuacucuuucagaaaauccaaguuugauucucagcacuaucaggcaguugacaaccaccuauaacuuccgcuccaggggcuuugcugcucucuucuggucuuugagggcacacacagaccauauacauaacuaaagucagaaauaaaccuuaaaaacucaauacuuuucaaugauguaauggggaucuaaagagauggcucagagguuaaguauuugccauaaaagcaugaggaccagaguucaaguccccaaggcgugaacccaugugaagcccuccuauaauugcagcuaugaaaggcucaaacagggauccccagagcaaguugccuaacaagacgugccauaucagugagcucucgguuuggcuaagaucuugccucaguaaacaagguagaaaaaugauugaagacauuaaacuuaggccuauauauucacacacauauacauaugaaccuauauacauguguauccacaucuauggacaaaaugcauauacacacaaaaauggaaaaggcaaggguagagugggaagaugaacaaauguuuucuuugcucucucaaccuugguuauaaaauacuuccuuuaaauaacagaaacuuaaaaaaaaacaaaucagguauauagcuacuacugcuggacuucaguccaugccccucccaauacccacucauaucuuuccuucaucuuauucaauaagcauucuuaaguuuucuguaauauaaaucaagaaucacaacaauauauaacuagagagaacucugcgguucugaggauuccucagguugcauaauugugaccaucaacuugcauugccugcuccugugccaagacuauaacaccggaguauguaauccggaguaugagcugagaggggaaaaacugauguggcaaguggaagaacagauauagaaucuauguauuuauuuacuuauuuauauauaauaaaacacuuauacuuaucacuuauaucugugaccgguagcacaugcuuguaagcacaacacuuuguaggcaggaaguucaccauaaguucaaggcuaguuuggucuacauagugaauuccaggucagcuuaaacaguccuuggaauaaaagaagccacagagauggcuuagcagcuaagaacacuugcugcuacagcagaggcccacauuaaguucacacuccucugagacccauccaccauggcucugcuucccaagugcucguauuaauggaauggaucauuacaucuucuccaaaacauuauuauuuguauuuacauuugauuauuacaugccaggaggguuuuguuuuuuguuuuguuugguuuuuuuuuuuuuuuuuuuuuuuuuuuuggguauaauugguacucuauaagcuucuuguauguuuauaggcuucucuuucuuuauucuuuucuuuuuuaugaaugaggcaauuuauuaacccaguauuauuuuuucuaaugcuucuuguuggcagcugccaccuguucagcgauccuguccagauguguuuccugucccugagguguuagcuugcggcccccaucucggcccuuuuccaccauuuucagcccuuucagggcuuggaggaccuggcaagccauacucucagagccucugcugaaguggcugggccuaacaccguuccucugccauccuucauagaucuuggucacggaaccaacuccugcacuacaguuguguacagagguacagguccggaguuguggaagcagcucguggguagaaccaguucucaucauauggggcaagcucuuuauguuuggcuaacuugacuguguccacccauucccgaacuuucagcuuccuggacuuuuugaggaaggcugccagcgcucugacgaaccugaugguuaacaucuuuuacagugacuucaggcaucguucagccuccaugcugccagccaggggaaaggguggcaucucuuuagguugggaaaauuuucuucugauuuuguugauauuuuuccgggacuuggagcuggggacucuucacuuucuauuacuauaacuuauaaguugguaugccuguuuuaugaggugcuggagauuguuuuuuguuaucuuauauaaagucugugaaguugcacaugaaagccugaucuuuagaucccuuagcacugaaauuacaggcaguaaagauuugucuagugugaguguaaaucuugaacuuuggucaucuggaauauuaagcaucucaagaguaaucuaagagcagucuuaagcaccauaauugaucacuucuuaggucuggggacuaaagacaugcaccacguccaccugguugaccacacuuuaagagauagcauuguaaaggggcuuucuaauauuuucuaggguuaaagucuauugucuucaugguagggagcaugucagcauucaagaagacauaguacuggaguuugacaucugguuccacagguaguaggaagaaagccaaccaccggcccuggcuugggcuucugaaaccucaaagcccacucccuagugacuuauguccuuccuaauucuucuaaaguagugccaccuccuccccgcuccugauggcuuagugauaaaaugucugaggcuguaggagucauuguucuuacaugaucuuugguagauugauuucuguauagggugagauaguaccacuaugcuaaggaucacuuggccaagugacuguaugucucuuacaugugguguuuguaccuuuguugaguaguggauggcugucuccagguccucuauucuaucccacuaauuuacaagccuaccuaugagcaguagcauguugacgcuguggugcaaccuguucauucauuugaagcuuugucauguagcucaaucuggucuccaauucucuauguggcuauuucugaucauccuuguaacucccaagggcugggauucacaggcauaagcuacuuaccaugucaccuauuuuuaaaaacuauuuaugugaaugucauuagaauuuugcugaguauagcgcuaaauccauagauggguuuuugaugcaacuuagacaauauuauguugauucaugaacuugggaguguuucuucaaccauuuuauaccagaucaaccccucucccaauauacguuagaauugaaaaaaauauagauuuccuggagagacuggaugccugaucuaccuauaguuguggcuccaacuuucucucuguucacagagccaguagugucauugaacaucccuuccuuuaaaaaaacaaaccauuuuucaugauuuauuuugaucauuuuuccuuccuccaacucuuccccacucauccaaauccauauucauuuucuuaaaaacaaaacgaaaacugcgcuguuuugucuggaugguguuuucuuggagucauuuacugcagucuuucugacuccuuaucuucauagaugccugagcauugaaagaaagggcuugaugaagacaucucaucuaggaccaaguguucuaaagucucuuacucucugcacauuggaagaccauuucuuaacucccauuucuguuucuugcugcuuuguaguggguccuuguuucuugacccauuaucaucaucaucuuguucuuccuucuucuccucuuugaauuugcauggagaauuccucaagauuacuauuuuaccccaggugcauuuuuaaucuuaauguuaagaauaugcaaugaggcaggcagugguggcacacaccuuuaaucccagcacuugggagguggaggcagguggauuucuaacuucgaggccagccuggucuacagagugaguuccaggacaucuggggcuauacagagaaaaccugccuugaaaaacaaaacaaacaaacaaacaaagaauaugcaauaaauuaccuaguuaaguguacaggaauggagguguuuuuuagaaaaauauuuauuuaaugugaguacacugucggucacuguucagauacaucagaagagguuagauaucggaucccacuacagaugacugugagccacuacgaaguuguugagaauugaacucaggcccucuggaagagcagucagcacuccuaaccacugagcuaucucuccagcccaggaacugaguuuuagcacauaucccuucaugcuuucuugugauaagacuaaaaaguguccccgaaaccugacauaccuugauguacacggugugagaaagaaugaugagguuugcaagaauugggacuaaguaaaacacagagacuaaauuuaacucuuuaauuugaugauucucucuagcauccccacaaaaaugauacacuggcuugcauaaucugugaccaguaccucgcaaguucuaaauucucuuuguacagcucauuuagaaguucucguuuauacaaagccauauccaucguggagccaggugcucuuagcugugaagagcccuuccuugggucuuuuuucccuaauauguccuaugugacuucucacuggugaugcuuuuggugugcuuguuacucugauccugaucgcucugucaacuaaaguuagacaaaguaaccuuuacuucucaauucagauaggaauccuuuugcacuccaaguuuggcuucagaugccuuggaaagauucaugcugccaccugcugguuuauucagucugugugcaucauuuauuuacuuguuaauuuguuuuucuuuuguugaaacaguuuauuuuguagcagauauuuuuccaucccuaccugaaccaccucaauaguaagauuagugaauugcuggcacuuugaucguccauaagcaaaccaauuuuguguccuuuauuauucaugggacgccuaaagggaacuuagaacagacugugaauuauuugucagcgugaaucaacgagacaacaauauccuuugauuuucuaauacccagggugucugaucucuuucauguggauauucauaguuugacaguuaacaaaauuugacaguucuuuuaaguuagcagugucucuggggcgaguaagauaccaaugagcuauuauucccucaggcuuugcuuuggcauuuaggaauuauuuuucauuacugcuagcgaguaacguacuucagugcguuuuugucccaagguauggagucaccagguucccagagaaagacuaagaugccaaugacccaaaacuaugagcguaagcccaccaaaucggucacaacuaauacucugauaauuuaggaaccaaggagccauuuugugaggcauuucuacccuuuccucuccucaucugaggucgccaacuaaugcagaagaacuucuaguguccaagacgcggagcgauacaugguuuguccaaguagaagauauauugaaauuuugcauagacaggugugugaccuaauguacauuauuuaauguuuauguggaaguucuacauaaacguuuuuagcuguaaaauaggauaauccuucauuaucgcgcaaaauaaugaaauucacgcgucaugucacugagcuuacguaccuccaucuuuauucauuuuaauuuuuuuauaauauaguuagaccuaaagguccaauaagaugucagaauugcaaucuuuguggccacuccucuucuggucucuccgccuucagcgccgcggaucaguuaaaggcgugcaacggcuugcuccagccauguuugcucguuucccguggaugugcgguucuuccgugguuucucuccaucuaaggagcuuugggggaacauuuuuaguuccccuaccaccaagccuuauggcuuauuuaagaaaacauaucaaaauuccacgagauuuuugacguuuugauauguucugguaagauuuuuuuuuugacauguccuccauacuuuuugauauuuguaauauuuucagucaauuuuucauuuuuaaggaauauuucuuuguugugccuuuugguugauacuuguguguguaugguggacuuaccuuucuuucauuguuuauauauucuugcccaucggggccacggauaccuguguguccuccccgccauuccaugcccaacgggguuuuggauacuuaccugccuuuucauucuuuuuuuuucuuauuauuuuuuuuucuaaacuugcccaucugggcuguggauaccugcuuuuauucuuuuuuucuucuccuuagcccaucggggccauggauaccugcuuuuuguaaaaaaaaaaaaaaaaacaaaaaaaccuuucucgguccaucgggaccucggauaccugcguuuagucuuuuuuucccaugcccaacggggccucggauaccugcuguuauuauuuuuuuuucuuuuucuuuugcccaucggggcuguggauaccugcuuuaaauuuuuuuuuucacggcccaacggggcgcuugguggauggaaauaugguuuugugaguuauugcacuaccuggaauaucuaugccucuuauuugcguguacuguugcugcugaucguuuggugcugugugagugaaccuauggcuuagaaaaacgacuuugcucuuaaacugaguggguguucagggcguggagagcccgcguccgccauuauggcuucugcgugauacggcuauucucgagccaguuacgccaagaauuaggacaccgaggagcacagcggacuggauaaaagcaaccaauugcgcugcgcuagcuaaaggcuuucuuuauaugugcgggguugcgggauucgccuugauuugugguagcauuugcgggguugugcuagccggaaguagaaagccaaggagugcucguauuagugugcgguguugcgcggaagccgcagaggacuaggggauagggcucagcguggguguggggauugggcagggugugugugcauauggaccccuggcgcggucccccguggcuuuaagggcugcucagaagucuauaaaauggcggcucgggggcuccacccgaggcucgacagcccaaucuuuguucugguguguagcaauggauuauaggacauuuaggucguacaggaaaagauggcggcucaaguucuuggugcgguauaacgcaaagggcuuugugugucacaugucagcuucaugucugaguuagccuggagagguggcacaugcucuugaaugugucuaagauggcggaagucaugugaccugcccucuagugguuucuuucagugauuuuuuuuuuggcgggcuuuagcuacuuggcgggcuuugcccgaggguacacuuggugcauuaugguagggugugguugguccuaccuugugccacucgaagcugaggcaaggcuaaguggaaguguugguugccacuugacguaacucgucagaaaugggcacaagugugaaaguguugguguuugcuugacuuccaguuagaaaugugcauuauugcuugguggccaggauggaauuagacugugaugagucacugucccauaaggacgugaguuucgcuugguacuucacgugugucuuuagucaucauuuuuucgaagugccugcccaggucgggagagcgcaugcuugcaauucuaacacugaaguguuggaugaugucggauccgauucgagagaccgaggcugcggguucuuggucgauguaaaucauugaaaccucaccuauuaaaagaaagaaaaguaucuaaggccauuucaaggacauuugacucauccgcuugcguucauagucucuuacagugcucuauacguggcggugcaaacuaaaacucagcccguuccauuccuuuguauuguucaguggcuagucuacuuacaccuuggccucugauuuagccagcacugaucucaagcgguucucuaagccuacuggguauaaguggugacuuuggccagagucauaguggaucacaaaucacuggugaagagguagaauccuaccuucuuccaaaaucuaccccaugacuauugcugggguugcauuuugauuucaaugaauauuuuggaugccaacgacacgucugauagugugcuuugcuaguguuugaauuuaaaaccgaagugauuguuuucaaaauguauuuacgauuugcuuacuuguugaauucauuuuaauuaccuuuagugaauuguuacuuuggaguccuuaaaguuuucaauaauuuuuuuggcagaugauacucaaauuacuuggcacuuaaauguacuuucuuucaaacucauccaccgagcuacucuucaaauuuuuaagucuuauaacacagauacuguuaauguaaagugaacauuaugacuggaugucaggaguauuugagguucuauaccaguucaggcuuugcuuuuguugcuauuguugaugcuauauugacuaaugguuuuacuugucagcaagagccuugaauuguaaugcucuguguccucuaucagacuuacuguuauaauaguaauauuaaggccuacauuucaacuuucuguguguucuugccuuuauggcaucuagauucuccucaagacucagcaaauagugcugcugcuauugcugccccagccccaggcccagccccagccccugccccagccccagccccagccccugccccagccccagccccugccccugccccagccccugccccagccccagccccagccccuaccccugccccugccccugccccacccaaccaacccaauccaguccagcccugccccagcccaguccuagccccaggcccagauacuuucagaccuaucccaagcccacuucuacuuagagaaauucgaaucuucauugauucagugcuaaaaugcaguguccaucacucagccuauaagacugagacagcccaucuauacccccuccauacugacuucuagagucauggaauuucacuuaaugcauagaaucguauugcuaaaaugcagugcccaucacucagccuauaagacugagauagcccaucuauacccccuccauacugacuuacagagucauggaguuucacuuaaugcaugcaguccuauugcuaaaaugcagugcccauaacucagccuauaagacugagauagcccauuuauaccccauacccccuccauacugacuucuagggucauggaauuucacuuaauacauagaaucguauugcuaaaaugcaguguccaucacucagucuauaagacugagauaucccuauguauaccccauacucccuccauacugacuuccagagucauagaauuucacuuugcauacgguccuauugcuaaaaugcaguguccaucacucagucuauaagacugagauaucccuauguauaccccauacucccuccauacugacuuccagagucauagaauuucacuuugcauacgguccuauugcuaaaaugcagugcccaucacucagccuauaagacugagauagcccaucuauacccccuccauacugacuuccagagucauggaauuucacuuaaugcaugcaguccuauugcuaaaaugcagugcccaucacucagccuauaagacugagauagcccaucuauaccccauacccccuccauacugacuuccagagucauggaauuucacuuaaugcaugcaguccuauugcuaaaaugcagugcccaucacucagccuauaagacugagauagcccaucuauacccacuccauacugacuuccagagucauggaauuucacuuaaugcaugcaguccuauugcuaaaaugcagugcccaucacucagccuauaagacugagauagcccaucuauacccacuccauacugacuuccagagucauggaguuucacuuaaugcaugcaguccuauugcuaaaaugcagugcccauaacucagccuauaagacugagauagcccauuuauaccccauacccccuccauacugacuucuagggucauggaauuucacuuaaugcauagaaucguauugcuaaaaugcaguguccauuacucagccuauaagacugagauaucccuauguauaccccauacccccuccauacugacuuccagagacauagaauuucacuuugcauacgguccuauugcuaaaaugcagugcccaucacucagccuauaagacugagauaucccuaucuauacccucuacccccuccauacugacuuccagagucauggaauuucacauaauguauagauuucuauugcuaaaaugcagugcccauaacucagccuauaagacugagauagcccaucuauacccccuccauacugaguuccagagucauggaauuucacuuaaugcauagaaucguauugcuaaaaugcagugcccaucacucagccuauaagacugagcccaucuauaccccauacccccuccauacugacuuccagagucauggaauuucacuuugcauacaguccuacuuuacuuguccauggacaaguaaacaaagaacucuuguccuucauguuaaucaagauacaccaaucaaacaagaguuuuauaucagagacuugccauggagguaucaucucucaagucuccuuuccuuuaaggaaagaaaaccauucugucauugcuguaguagucacagucccaaguuucuaagcaguguucagucgucuuuucucauguauuaccuugaguacugaauaauucugucagaaauauuuuguccauuggauuagacuuuagcuaguccagcccugugugcauuuagcaaaggggcaaacacaggucuguuaucagacaguuaaagugcucagucccaauuuucaaggcauuggccauuaaaggggguagaauacuauauacuguuggcaugcugucaugggugcuaucgccccaggucacaucuuucuaacugauggagauacauuuauuugcucaugauauuguauacuagucucacaugcuuucuuauuucagccaaaaaccucugcacuggaacauuuuauguggauaauccugacuaggaauugagucuuuucucaagguccuaauacuacccuugcuuuauguaaagagggugcugauuacuuaaugccucuuacacaauugugcaaaauugcaguuguucaaguccccuucuguuaguaaccaagaucccauacccucauacccuaaugggugacaaucaagggugccaaccaaugagaccacuucucuguucuggucuuucugcugugcuggggaaucaaaccuugagucuuguguacgcuaguaaagcacugucauagagcuacagccccaccguguggugguuugagagaacagccucuuauguagccugggcugggcgggacuuacaggcauugccaccuguaauguaaacauauuugugccuguugugugcacagcugcauuugucccucuuccuaagcauuggauaaagaaaccaaacuaagucaagucauuuuguugguaaucaagaagaccuuugaucuguccuguuuuuaacuuccaggcuggccuggaacuuagcauauaacccaggcuagccuugagcucaggaucuagccugcguuuaacaaguguuggcauaucugguuccuaccacuaugcccugcaugcagucuuucauauugugaaugugcauaugucauuucacuguaguaaucugcaucuggugaagacuuauuuguauugcagcaguauuuaagauccuuaacauaguaaaugugcacaguguuaacucuauuguacauauucucauguccacaguugugccuuuuagaucaggacuccuguacuuagcaaagcaaagaggcucacuaauauaaagcuucuuucaugagacuauagauugaaacgauuccaauacggucaaugguccuucaagguaagacuucugucucugaucauucauauccucuuugcuuuauggaauuauguaugugcugugcacuugaaaccccuuccucaaacuauuuauguacauacuggcaauuuuaguaggaucaauuuuacucuuaacuuugaaguacagaagugguguugaccuauaaggucccauuuuguggcuugcuaauaauaaugacugauuguaguaggccuuuucuguucacuacagaaggaaaccugaacagcguaaaacuguaauggccauaaacauguaccuugcauauuaguaugcauuuacugcacacaucucauuccauuuggauacgauccuacucucaaacccuuuugcaguacagcaagggucacuaaucuuuuggcuucuucaucuuccuggacacuggauaaggcuguccccuccuuuccacucuuuaauuuccaggacuauuacuuuaaagacuuaauauuugcauaaaggaugggguuuuuaauugauaacaugucccuugaacauuaauguauauaacagggacaugauccauucauuuuaauaaaaauacuuggccaguuaauguguaaaauuacacuuauccacaaccuuauuacuuuucggaccauuguaucucuugcacuccugcaagggauaccguuuaucucccaaggucccugcuaguggaccauuaauauacagugaaucuuccuuugucuuugccaguaaacaaaggccauacuccuucgccuuucauuugcacuauaucaggauaugcugaucaacaaggccgcauucuuuuggacuguuaucauauauuaaauguaugcguaugcacugccaccugcucugugcacuugaaaggaucccacucacuuccuuagcaccuucagcaggaagugauaauaagcucaagacuuucauuuggaaaguucacaugucuaagcacuucucuaagaacuacuguacccucuucuccgcuuuaaagcagaaagaggguuguacgaagugcucuucauuuggacuuaagugcauuaaugcaguuaguuguccaucauuaccuuuggaguuggauuuuacauccuuguacucuuuugacaccagaggcauauuaauuauuucugagcacuucucuugucaauauuaaucuguacccuuacacauaugaccugugcggcagcaaagguucugaaaugccuaccuuuugacuggggcugcugagugguaguaacuauuaguaaccucagcauuuggaugauuacuaugcaaaaaugucaaggaccugugugcucucuuugcauaccaucaaggcuacugagucccagaauuaauugcuaaguuaugcguauuuauaacuaugaaugucuggaauauuuuguccccuuuacauuauugcagagguugcugagcccccgaaacuacccgguacugucaaugagcacaggggcucugacgaaugaccugcucucuuccuuaaacugauuuugggacucuuaauaggcacaauggcaguucuggaugguuuauuuucuacuccaacuugagcaaauccccugcuaguuucccaaugauauaauaaaguacagcaguauguacacccaacaaugacccggauuucgacccuuuuugcauugcuuuaauauauacaauccuaaauagucacaaucucacacuuuauaguguuccuuuugcccggccucuaguuuguccauugaccacuuuucugaaucacuaauucucacaaacccaucauuaaggaagaguuugugcccuuucucaauuccaucaugccaucccuuuugccucuuuguuugaacaguauugacugggcaaagcccuucucuugacuuaaagucaacaacaccaguuuacucacuucauauggcuacagugucucaguugccuucuccuugcucccacugaacagagacaccucgaauucuuacauuauucuggguaauguuaauuaccccaaacacccuaugugucauuaauaaauuuugguguauuuauacacugaauagcaaaagcaggccaaaacuagguggaugagccuucaaucuuuaacuugcacuucuaaauuauuccaauuccaacugcuggcacauucuagggccaggaaccauucuugccuaccuuuauuaaugcuuuauugugcaaaauauugcaggcaaguagcucagggaguuggauugccaccuuuuacuuggggcuuuccuuuacaguaugaacugaaaauugucuuccugagaaggaagcuuagcacuuuucuuuccguucuuccuccaggaaggagccaacugucugcuuaagaaacuuuaagcccgauuuuguauauugcuacuguacaggaccaacugccagaaaaguuauugauaauuuuauuccuuaagaaaggcauuuggauugcaagguggauugacugugagaucauuagcuuuugugaaguaaaaauagccauuugugucauguuucugaagacuaagcagugucucaguguacugagggugaugagucuguggaaagaucagugcaacuauugcagaauguuuaagacaaguaucuuugcuuggucuuuacuacaaguuuaacaaaacgaaaaagucaaucuuuguguggccuuuaguaugauuaacuuuuuggaagaugaccuaagccuucuaaucauuauauuuugucugacauuggucaccaguccuugcuuauuuuuaaaaggugacuggauggauuaaauuugagaacaugucaagucgccuuugaaaauuauauaggccaucacauuuaauuaauucauucuauccaccauuaaacucuggcaauaauuugaaguagcuugaaaauuccuaaagugggaauuuauuuuagagaugauagaaccuguuuccccacuuuacauuuuaaaauaugucugccaggaucuaaucauuccuuuaaacguacacuucaaagagagauuuuccuaguaagaaaagagcuuucucuagugugaagggugcuuuguagccgccgaguacuuaggucuuuuuugggagcuauuguguaugaguguauguauguguguguguacaugcauguugcugcgcgcagucauucauucacauggugcucagacaacaaugggagcugguucgucuaucuuguggguccuggagaucaaagugagaucaucaggcuuggcagcaagugccuuuacccuccgcgugccaucuugccaucccgcugcugaguguuugauaugacauugcugaugaaaauaaucaucacaacagcaguucucccagcauuacugagaaaugauacuauuuuucugaggaggauguucaaguaacucauccagugcaggauccugcuugaacuacugcuccuccguuacaucagacucuggcuguuuagacuacaguaaguacuaccuuguuagcuacuaagcuaucuuuuucucauucgaguuucuuucugugccacccacugaaaagucaaagugacuaauaagucacuagcucuucucagcuuauccauacacaacacauaguaugccaacgaaauuguagaauuaacacauuguguacccaaucgccauuaugcugggguacacuaaaaugagaagcgaugauauuuuacaaaauuucuuccgugagaugauuauguuauuuaagacuuaauguaauauaagcacacuugagaucauuuuaggaaauguacugccugugugaauuguuuaaguauuuuaggaagucuacugggguugaaauuugacuucuuaaagagggaagugugcuuacuuugccuuguugguccagacgacuauuaguaccaucugguugguuuaucugaaugccaucuguuucuaucuaccucuuggaagcauggaaagaauauuaagagugaaagacuccaugcauuaugcuuagcuguacgccaaggguagcaagagaugagcuuguguaggaauugggaauauaaauuugauaauuugguucuuucaaccauuuuuacugcauuucugcccagaacagaccacuggacggcacuaacagcuuagacagagaacuucauagcuuacaaucuuuuuuuuuuuuuuuuuuuuuuuuuuuuuuuuuuuuuuuuuuuuuuuuuacaaaagugcaaagaaggauaaguuuuaugaacaaauuuuacuauggacuacuuuauguacccuccuugcucauuuuucuuuuucauuaauuaaucaauuaauuuuguuuuguucucuguuuuguuuugugacagggauucucuguguagucuggcuauccuggaacucaaacucaagagauccgcccgcagagauccgcccgccucugccuccaguuuagaguguugggauuaagggugggugccacacuggaccccugccagcacuuuucaacagauacuuucaguuaaaacaacaaauacuugacuccuguguagaaaauggucuagcugaaaaaacauccuuguccauaacacuuaacauuuuuuugcauuugccuuuuguacgugcaaaugacccucuaguacuuuaacccuuuuaaguccacuguaaauuccuucgcagcagguuucccccaacuccaaaggcuuagcauugucuggcucucuaggugauaauacaucuagaacuauugagucuuuuaggaaacuaggaccauuguuguacaaguaacugcuucaaaaggaaacauuugcaaggaaaaaaagcuuuuugagaugcuaaagaauguguuuggugcacuaagacaguuagcuaaagcuucggucucaccuuagcaccauuggcuacccaccccaguacaugcaaagugacccccccccccaggcuugccuaggcaccuagagcuuucagccugccuccuauggaccuaaauagagauuaggacucagacuccaguuaguggccuggaggaagcugguacugcugcuauucacaguaaacccacuaucacugacaguucccuauugaaaugaucaaguugugugagcaggcagaucauuaaucagggccaauucugucauggcaaccuaguccuacaugaccuccacggcacuguaaaauacacacuuauuuguaguaggacaucuggaacaugagcuugucugugauugaaauguccauuaggaggugccaucacacaaaaccaucuggaggccaucuuugguccccauaauugauggaauacaaagaguuccccaaauuaguguccugacccagcccucacugucaguaaucauguaauggaaagccaccaacucgccaucaccaucuucaggcugccugaacuguauacauuaagaaugagcuuucagccgggcagugguagcucgagccuuuaaucccagcacuugggaggcagaggcaggcggaucucugaguucgaggccagccuggucuacagagugaguuccaggacagccagggcuacacagagaaacccugucuugaaaaaaaaagaagaaugagcuuucuuccaagcuguccaauggcuugacccagacuuaggaguuuguaaacaaagaacccuguagaacaagugaauuugagaauguacaccuucauuaaguggugggaaguggaaguaguggauuuugccagcugauuuuacaaagcccuguggcagaaccagaccaggucuuuguaugcauacugccauauaaccuagccacuguccaaccugugcccucucucccaguccagugaaccucuucugccugccccuuacuuaguccucuggcucaucccaggggaagauggcucuauuuguguagucauaagaaaguuuuguuaauuuuaaauaaaacaggaaaagagaaagcucacuuaagacgagagcuggagagaugguucuguuagucuuccagagguccugaguacaauucccagcaaccacaugguggcucacaaccaucuguaaugacgucugacucccucuucuggcacacaggcauacaugcagauagaguacucaaauauacaaaaagggaaaagaaaugaaaggccuuugaaauguagacaugcuuucaauuuuaaaggcuguuuucacaucucuuaagaacuagggguuccaugagaacauauccucacccugaguucuuaccaccaauugaaaacgcugacaugugcauaugaagauuguauugcuaguaaucaaauuaucauuuguagaguuuaguauaauuaucauuuguuuuccagggaugaauuuggagucuguuuugugcuccugccucaagaagaaggauugccuggauuuagaggagugaagagugcuggagagagcccaaagguauuuccguuacuugguugacugagauaguaucuucccuuaaaggucuaaugugucaaguuauaccuccuaaguaaauaccucauuauuuucauguggaauuuucaacaauuuuuguagucuaaugauagccuuguauuucuucacagggacaaacaaucccuaugugagacucaaggacugccagcagccuauacagcuacauuacaucucagcagaacuucucuucaaguccucgcuacucugaacaaaaagcuuacaggccacauggagaaaaaaagguacuuuggagaauuugcuauuuggggguuucuaucugaucuccaguucaucagagaaugagggggcaagucaauaaagcacuccccaucuccugguccccuggcauagucaguuagccaaugagauccuugccuuaugaugaggccuugaaaucauccccaccauguuaugaccaaucuguaacauuucugcucugaaaugccuaaaagguagguuaucagaggaaugaaggccaguuucugacacccuagucuuuuguacuugauagaguaaguagauauggcuguugucacauucuguaggccugucauaauucuggucucugaauauccucaaacucagagguccaaugcuacaccaguuucuagggacauaugcaccauaagcacugagccaaacaaugcuauucaccuugccaguguucuggcaugguauuguuuaaagcacaaauuaaaagaagaaaauaauuuaaccccuuuauucccagaguauuugaaguacaaggacuuuaacacaaccuauaaucuaaaggaucucucauugguaggugacagaauaaaagccagaaagaacuuggauggagcaauucucaugucucuaaguuaacacuaagaucuacaaaugugaaggguucacucuccaagccccuccccaugauuuaacacaacugcugguuacuacauaaugagacaacuuucccaguauucuugauuucaagaauuggcuuuucuuucaccucuuuuccagaucuccccccagaauugugggcuugcugcuuugcagugcuggcgaccuauucccuuugacgaucccuagguggagauggggcaugaggauccuccaggggaauagcucaccaccacugggcaacaggccuagcccagauuucagugagacgcuuuccugaacccagcaaggaagacaaaggcucaaagaaugccacccuacaucaaaguagguaaguuuucugcaacaguguaauaauuuuaacuuugaucuuguuuuccauuaaagucagccuuuuacuugagauauauacauaaauuuuaucuuuuucccacaucugggaaauguaacuaaacagugcaaauguuucuucuaggagaaaagcugcugcaauaguggcacugaccuucgaggaagccauucugcucuauuugguucucucuccagaagcuaggaaagcuuugccagcuguuuacauacuucaagaugcacugcuacccuacucaugccauauaauacacaagugaguagcuuauuuaccuaccuagcuauuuacgaguacacuguugcuguccucagacacaccagaagagagcaccagaucucauuacagaugguugugcgccaccaugugguugcuggggauugaacucaggaccucuggaagagcaauaggugcucuuaaccacugagccaucacuaacauuacugaugaugaaugccucuaacuacaaauggaaaccuggcuggaauugauacagaaguaucuaucauuaggcagaauuuaaagagccaggauguucuaguacuucuuuccuggcauucauacagcuucuuuuguucuuuguagugccaucuaccaaauauuacccuuccccaaagcagcacagaaaacugggucuucagcgugaucaagcaaugugaacacacaaaaggaaggcagcuuuauaaaugacccgaggaucaacaugccugacugcagcaucuuaaaagcaauagaaugagguaagucacuagcauugcagucuucugaggauuugcauuugcuggaagauggugcuggguggagagcaucuaaugugauaaugugaggcagggccauguacacgauggaagaugaacaggcuuucacguuaucaaauggccucacagcagcaacucaaacuauuaucugcuuaccaguuauaucacaagaggaauuuagcuucuagguuuuguuguuguuguuguuuguuuuggcuuggugcccuaccauucuuacagacuuaaacauugaaaagcuuuaaauaguuuauuucuuaucuccaucugugaagcagccauuagacuugugaaggauguaaaaaccaagcccccccuuuuuuuuaauagaagaggagagugaagcugacaauuaaauaugcagucgcuuauaguguuugcugcuuacagaagcuuuuaauccauguaacagaauguugagauguucauucuguguuuaaauguaauauccccuagauguaugcccuuuggcaauuuaguucugcuaagaccugucuguuugugaaggucaaaugaaaucaugaauggaaaguguugaguacagagccuggcaaauaugcccuggaguugcaugacuaggccauuuggaagaguugacggguguguccuaugguccuauguuaaggaaaccuuaaguuuaacguugauagccugguacaguguacuaauggcaauuuuuuucuuugcccuucccuguuucuuguuacccucuuucugguggucuuugcuuacuaucaaucauuaguguguauugugggugugucuauuucuuguuuuauguaucuauuuuuuccuuggucugugugucuaauucuuuguuacaucuauuucuuccuugcuuugugugucuauuucuuccuugcuuugugugucuauuucuuccuugcauuaugucuaauucuuuguuauaucuauuucuuccuugcuuugugucuauuucuuccuugcaguugugucuaauucuuuguuacaucuauuucuuccuugcuuugugugucuauuucuuccuugcauugugucuaauucuuuguuauaucuauuucuuccuugcuuugugugucugucuuccuugcuuugugucuauuucuuccuugcaguugugucuaauucuuuguuacaucuauuucuuccuugcuuuugugugucuuucuuucuugcuuuugugugucuauuucuuccuugcaguugugucuaauucuuuguuacaucuauuucuuccuugcuuuugugugucuauuucuuccuugcauugugucuaauucuuugguauauauauuucuucauugcuuugugugucuaugucuccuuguguugucuaauucguuguugcaucuauuucuuccuugcuuugugugucuauuucuuccuugcuuugugugucuaugucuuccuugcuuugugugucuaugucuuccuuguuuuguguaucuacuucuuccuugugugucuaauucuuuguuacaucuauuucuuccuuccuuugcaugucuccuucuuuccuuugugugucuuuucugucugcagugugucuuaccuauucccauguuucuccugcauguucuuucuugcagagcuuugagcuuuguuucacuuucucuggugccuguguggucugcuuugucuucacuagcuauggcucucuguuuuaucuaucugguugcuauuucucuuagcuuuucuuucacuccugccuuucgugacuccccuuugggucacauguugcaugcaucccucucuuuuucuugugcucaccccacuuguucuuuguucaaguucucuuugucaguccauuucaguuuucuuucugcugcuucuauccuuagugaauucuuguuuacauuucuucccugccuuucuugggccacuuucucuguuuucuuuuguauuugugucucuuugcuauugguggauuucuuaucucagcaucauucuguugcuuuguguuugcuuguguuucuaucuucuacuuuccuccuuucuguucacuuugagcauuucaucucuuuacaagucugugucucucuuguauucuaaaguaauccuuucuuggauguuucuuuguauguacaugugcgugugugcauguguguuaugugugucaugugugagaggagcuucauagccccuucccaauagguccagaaugucacccguggagccguuccucacaccagacugcccugagaaauaaucuaagacaaaauacaucauuccguccggucaggauucaaguggcucugaagugaacgcccaaguagaagacagaaguuuugcgacuugagauuuaaaaggaccaaaauacacagauggcccgucuugagcuggcuggacagaaugcugacaacccaaagaagaggaacuguuucuacaggacaccugugacuuccaagagcggggaacuacguaugucauaagacacaaaaccugagcuaaguccaagcauaagaccuaaggacccaauccuauauggacagaauauuuaagagauaaaggccuauggcccagaacucuggaaggauauuucuauccuucuauccccaagaccaagaagggaaauucgaagaugagaccugccccccaaccccagcaucccuuuccauuucuuauauuucuauuuaagcugucuucacuugagauguaauuuuucauuguugccauugcccauaaaggaauacguuuuuagcuggauaguauugugcaagggucuguuuuaaacugggucuuagccauuuguuaaauuguugauguuuuacaacuuccauuucucuucacaucugcuccacuugagacggaacuaaauccagccaguguauauagccugacuauugaaacuucccuaggaauaagcaugcauacagauaugcauacugccauccucccuaccucagaagcccuaggcugacaagaaaaggaaagcaucagguuguuagggggaaaacaaugucaggcuaucuagagaaaauauaaagaguuguuccagaccaaugagaagaauuagacaagcaauaugcagaugugccaacccucugagaagcaccagccagugucaccuucuuucuuugggcuuaggugagcaggguaugguuuucuaauaaugguuuggggacaaaaugaggucugaacucccugcucauaguaguggccgaguaauuuggugcauuucaccaaaggaacuccugggucuaauaccuaccuuuaaaauuaaugaugagagacucuaaggacuacuuaacgggcuuaaucuuuuucgugccuuccucuuccucuguaagagggaaguuaaaugacacaggaugaaaaaguaacaugcucauagcacauuggcaauuauacaugguuauuaucugaaaguguagagcuuuuccuauaaggcaucagacuaaguaccugaagcuuuguggguucauggucuuaguugcauauuccuuaguugcaaauccuuuucaaaagguaagaaaaaggcacacuggucuauugccuguacuugaucaagcccugauaugaaugccagggaaugucugaguaacauuaauuuccuucccugcauauuuuuugugcugaauacuaaggcugugaugcuucacuguggucacccccagguaacaagauauuaccagguaaccaggaaacguaugaauacguaaaccaugaagccuacuguaacuuccaagucagugcugaguauguauuacauaguagcugaagucuacgccucugugugcuauaggcacaaagauugcucuaggaauaacaugcuuuguaaaaacaaauauaugaacauaacggggcuugaaugaauaacaguccauauacuuaaggccaguguguuucuucugcuuuggugaggcucaguaaguuauauuauaccagguagcagaagagaaaacacauggaaacugauuuuaaacuacaaacuaggucacuaaugcaggugauugauuacccuauucugaucaccuucuaauuucugaauacccauguucagcacugggaauaacaaagggggacauuaccacagaacuagaauuuacaaaagaaugcauuaaauaaagcauuauacagcuaucaauuguuccaugugugcaaaugaaugacuacuaacuaccucugauguauccgauauuguuuuggguacaugaaauauucaugaguaacugccaugaaauaagaauguuugcauuccauacuauucauaaggaaugagccaaugcuuaauuuaaucagucaaaacuugagugauaagggcauguuaauacaagaacauuugcccaggucacauuaugguuguggguacuuucuuaacuauaaagcaguucaguaguauaagacaagacaaauuuucuauagaaauaaagcugccuauaaaauaggcauagucucuacaaaauuuucauuguacuuuuuagcccauaaugggaagaguacaguuaacaagcugggugugguagcaugugcucugagcugaagcaacaggaccacuugagcccagaaauuggaggcuagccugggaagaccauaaggucaaucucaaaccuggaggcuaaauauugucucccauguguauauucucuuucauggguacuggagagauacacagacguacauuucaguguguccacacuugagaauaauauguacguuggcauuuuaugaacucggagguaccauauaaauguaacaauucauuuucuuacuugguaucaauuuccaggcuuuuaaaauucugccacauuuauuauacugugaaaauaaaguaaauaaguaacugugaaccacugaauauaugaagcauucaauacuugaugaguacauacugaauggcagucauuuauuacaaaacagugcccuugcuaggcacugggaugcaaagagcauucucauuguccuguguaucuaaagaaauuaugcaugagauuaauuuauaauuuguaaacugccauauauauguguauauaugcaauauuugccuggugugcaaugacuuugcuuuuaucccaggcaugcacaacagaucuguguggagcuuugugaagucuacaguucuauaaagccgggaccuaacuguuggcuuuaucagugaacagugauuacuuucuaaguuucauaauggcugaaacuuaaucauaaugcuuaucaccuaacaccaccuaauaauaauuuuaccaugcuauguguugagcgaacacauagauugcuuucuagcauuauguagcacuuauaggagugaaaucuagaccaaaacuucaauucacuucaaugaggaaaugaaaacagaaaaaaaaaauggauuugugcaaggcagugugcuaaauguuacacugaguggacuaugcugucuaggauacuucccagcuggcuugacugaggagguggaaaagguuuuauuaaugacaggaacuuuuuccauccaguuucuuaaauguuuguugaaugcugcugccagagaugaauuacaaacaccuugccaguaaaggaguuuuauagggccagagugagauaaucccagagcauggguaucagggaacaaaacgggaagaggccagagcaucugauggcauguacucaguguggcccagaaccucucgaacuagauguacuggcuggagggaccaagcaugcagaacacaacaccuaaugaaacauuguauauaaaauaugcuaaccuagguccuaaaacuaaaaugugagguggaccuaguguagaucacugaucauaggagacauggucucauaaagcccaggcugguucuaauuggugacugucacagcuucucaagugcugagauuacagaugugcuuaacccaugcccagccugaagaauauaucugauuacugagugaauaauauuuuuaaagaauuauauauuuuauguauaugaguacgcuguugcugucuucagacacaccagaagagggcaccacaucacauuacagaugguugugagcccccaugugguuguugggauuugaacucaggaccuucggaagagcagucagacucuuaaccacugagucaucucuccagccuucugaguaaauauuuuaacuauaauggcuguuugcgaaacccaaccaaggccaagauuccuucaacauaaacuggagacuuccuagcuaaggaagcuccaaaagucauuuucucauuggccuagcuugaagccaggacagacuuaaagucuguccuuuaauucauuacccauuuuccuuuucuuacuguugaaguguuucaaaggagaaucaagaugaaucgauaauucuaaacguauuuguucauugccuggcucagcgucaugugagcaagaagaauauacuaucacacucauacuuuuaacuuaagugugaugaaagugcaguucuaaguacuaaaauuucuaaguacugaaaagaacaaagacauuuaaaggaugcaacccaaaguguacuuuaccucaguaguuucugaggggacugcagucacaccuugagacuacagcucucacuuuagcugggaaaaacaucaagguguagaggaggcaaguuaaauaaaaaguugcuccccuccucaugggcaugcuugguagaguggaaauaauaaaagagguucucuauuuccucgguuccacacauugcagaagaugcuacuggaugcuaagugcaacacauuuguuccaaaagggcacucagugugacuuacagaugccccggaaagcagagggaugcucuuuauuaaacagaaauauuagcucaaacguuuucuagacugaagaacacuuuccucauuucccacaguuugccucagagguugaauacaggaagguuauuauucauucauuugcuuuauugguucgccuguucuacaaggauuugcaugucucuuaggccuucacuuggcuccugagacauggaaaaaggaaacauagacauagggaagugcuggauggggggggggggucucuuuucuggguaguggcacgacuuaguccuuaguccccaaguaauaugcaaugugaguccucauccucaugucuucuccggccacugcaaugagugggaagcugggcuuuguagcaagccugacccuaaaguuacagaagcccuccacgcuaagaaacucaauuuucuaggccauuuuagcuaugacugugaccacuacuggucaggagggaugacagccaucuaaguuccacaaucuuaggcuacuuugcauuauccuggggcaaacaagccauuuuugagcugcagcaggcuuugaaauacauugaccaauuuugccuguguucguuaaaccuuuuaccuuuuuacaugcuaaugcucacaguaauuuagaaauguucuccuuacuauaauauacucaagguggcuugcuaugguaaaauaaugccaguggaugaaaauaacauuaauguuuaacauucuugcauaaaauuuaagaauaauaaaauugacaacaaucagaaaacuggaggaacgaaagaccaaauugaaagaacuugaaaaagauuaaaaaugccugugcuuugacccuuuccauuuuucuuucacucacagagggugggacaggaggccgagugaaggaaaggguccagccugucuaucuggaaucuaaguugggacuuuaaugcaguuccacaaaauugguauuaauucgcuaaauguuucugaaaauguauuuucaucuaaauggcuaucagcuaagccuugagucaaaugggaaugaaacagauuaagucaaugugaucucuuuauccaaguugccuuagagcugaagucacaauuugcuguaaggaagcuuauucauuguagcauacgcauacuuucaaaguaucuagacuuuacuuaguaacccaaucaggacauucaggcaaaagaaaaggaacagagaagauggagccagguugaagaggucugggaguucaaacaaauuuuuuucauuuucauuaaaacucaauugggcaucaaaaguguuacuaauauuagcuuuuaauuaguggaaauuggcuggauucaguaauaucccuuuguauggguaggaaugggcuuacauuucuggaauuugcaaaggaaaaaauaacugaaagccuuccuuucacaguuacugccaucaauauugcuaccaauuaagcacauccuaccaucaucugcuuugaucacauaaaugaacuguguaccaaucuguuguugaaagacuggagucaucuucccaccaacugugaaaaaacacauggaaaacaccuggacuuugugaacggaugcggaauacagaacuucuguugacucuuggguguuuugaagacuugaaaaaaaaaacuguugcuuaccaacaugucacaaugaguccguguguggguggguggaugggugggugggugggugggugggugguugagugggugggguaguuugcuguuaaauaaaaugcuuuguuuugaaaacaucaugugcuguauaugauauuuuccuuaaauuuuauuuaaugugcaugaguuuugucuaugcauuagguuuggguguuauacccguguaggccagcagagggugucggaucccaaggaaaccaaguuacagacgccaucuuguguguagccggaauguaauucagauccccuggaagagcaguuagugcucuuaaaucaguucaccuuaugcuaauacaaggagccaacaaaaccacaaaagccucaucuacaaugugauuggcaagaagagaaagauagacagguacugcaagcgagugugagugaggcagguacaagaaucuauuaugguaucuuaaccacugccacauuccccuuuuccuuugcauggagccagaacuaggcuagccuccaagucccuaaguagccggaaugacucugagcuccugauccuccuguguuagaauuacaggcuuguaccacuaagccugcuuuucagaugauaguuucuaacucaguggcccuuuuaucauaccagauaccucaguuuuaauucccuauguaaugaaauugguuauguugcccuggccaucuggcuagccugaaguccauguagauuaggcuggcccuaaauccauagagcacugucugcuacugacucaggagugcucggauuaaaggccuacaccaccaggcaggccuagccaguuccuuggguaauuugaggucucauaacuuagagccuaaguuguucaggagaaagauuaugagaacacaaaucuaauaagaucacgagaagcaaaauauugaggcucaaaagugggaguacugguaagaugaaaugaaaagaaagaacauggcugucaagaaguccuugaauagagaaaggggccucugauaguucuaaaauucaaagugacaaaauugcgucuaggagaaaagauaaauucucucaggagagaguuuguacuguuagacauggcucugccuagccauugcuaaccaguagaagugcuccaacaaaaccgggccuucguuuccauccaaugaaugggccagaaaagcaacaacauuuuaccugaaaucaguucaccuuaugcuaauacaaggagccaacaaaaccacaaaagccucaucuacaaugugauuggcaagaagagaaagauagacagguacugcaagcgagugugagugaggcagguacaagaaucuauuaugguaaaucuuaacaucuuuggaaaauagcauuggcccaacuccaagaagcccaugaaaccuuaccauuuauuacuggcaacuaaaggauugggacacggggcacucaaacguauccacugaugaguauuuaauaguuccaaacuaugucuggggugaacuaugaaacacuaaacaaaauaaaacuagcaaauaugacagagacauuuuguaaggaauaaggggugcuggccagggcgggagggaaauugaaaguggaagaguaagcagaaugcauucuauauaccuaugaaaaauuucuaauaaaaaacccuauuuaaagccgggcgugguggcgcacgccuuuaaucccagcacuccagaggcagaggcaggcggauuucugaguucgaggccagccuggucuacagagugaguuccaggacagccagggcuacacagagaaacccugucucgaaaaaacaaaaacaaaacaaaagaccugucugagcuggagagaugauggcucagguuaagagcacuggaugcucuuccagagguccugaguucaaaucccagcaaccauaugguggcucacaaccaccuguaaugggaucugaugcccucuucuggugcgucugaagucagcaacaguguacuuauguaaaacaaaauguuuuaaaaaauagaaaggaagaaagagagagagagagagagagagagagaugcucucauaaacaacguggaaggccagaugcacaccugaaguuguccucugacuccauuaugcucugugcaacccucacccacaaacguguacacacaccauccacauucauauacaauacgcaucacacaaaagaaggaaggaaggaacgaacgaaaaagagucaagaggagggcugccagcauccuugcccugauggcuagggucgcugcacgggucagcagcacuggacucccucgucugacugucacccuggucauuuagaagccaaacacugcgauucuucaaaggcgggaucugggcuaaguaaggauguggcucagugguagagggacagccagggccucgaacucagaaauccgucugccucugccuccggagugcuggggauuaaaggcgugcgccaccacgcccggcuuuaaauaggauuuuuuauuauaaauuuuucauagguauugaagaggcacacaugagccccuucaugguuugcuagaauaaaugcucuuggugauauaacuugguuuccucagccuggguuccucaacuagaaacaggcaguuaagguccaaggcaugaguugugagcugcccgggucuuccaggcaaccugcaagugacagguucuugcuaugcaugggcauccuuauucccccugggugaggagcuuuggaaacucaggggcagggagacuccuucugaggcuucuggaaagagagaauagaugugaggaucagguagaaguucccagacugucccugccauccaagagggaggcaggagcugggcuggguaugggucacaaagccagcagcugcuagcacugaggguccuugccuuucugucccauggccccucucccaucugcacugugguugcagagccugagccagcacuucccccgacuggagaaugacagaggcagaguccacuccucccauuccggggcgggaagccaccauguugcaccugggcccagcagggccugggaacacgaggagcccacggcacccaaagcccuccccucaacccagguccuugcgcaaggucaggagagggcaggcaaguggccauuaaaacugcccucccggcacaauggcacagugaggugaagcuggcacaagaauaaagaagaggaagaaauagagcuguagauagaagagacagcaacguguaauaacauggcgccuucaagggucaggaagggcuauucugcaaguaaucucagguuaauuaguuccucugugcuuuacucgaaccaaaauuugucuccuaucagggagagaagguggaguggauaagauuaaacuaagcacacacagagacaauuguuuuugcuuuuguuuuucuuucauuuuugagucagggucucacauugcaguccuggcuggcuuggaagucucuggcauacugcuggaaacccaagcacucacccuaaccaagcacucacccuaaccaagcaugcacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacacacccuaaccaagcacucacccuaaccaagaacucacccuaaccaagcaugcacccuaaccaagcacucacccuaaccaagcacgcacccuaaccaagcacucacccuaaccaagcaugcacccuaaccaagcacucacccuaaccaagcacacacuguaaccaagcacucacccuaaccaagcacucacccuaaccaagcacucacccuaaccaagcacucacccuaaccaagcacucacccuaaccaagcacacacccuaaccaagcgcucacccuaaccaaguacucacccuaaccaaguacucacccuaaccaagcacucacccuaaccaagcacucacccuaaccgagcacacacccuaaccgagcacucacccuaaccgagcacucacccuaacccagcacucacccuaaucaagcacucacccuaaccaagcauacacccuaaccaagcacucacccuaaccaaacacucacccuaaccaagcacucacccuaaccaagcaugcacccuaaccaagcacucacccuaaccaagcaugcacccuaaccaagcacucacccuaaccaagcaugcacccuaaccaagcacucacccuaaccaagcacacacuguaaccaagcacucacccuaaccaagcacucacccuaaccaagcacucacccuaaccaagcacucacccuaaccaagcacucacccuaaccaagcacucacccuaacuaagcaugcacccuaaccaagcacucacccuaaccaagcaugcacccuaaccaagcacucacccuaaccaagcaugcacccuaaccaagcacucacucuaaccaaacacucacccuaaccaagcacuacccuaaccaagcacucacccuaaccaagcaugcacccuaaccaagcacucacucuaaccaaacacucacccuaaccaagcacuacccuaaccaagcacucacccuaagcucaguuccaauagaaagaauaacuaaaagaauucuguagacaagggagggcuuucuagguuuaaaauuaauuuacuggucccuaaaaaacaaacaaacaaaggggcuggagaaauggcucauugguuaagaaugcuggcugcucuuccggaccggaccgugguugugguucaauucccagcacccacauggcagcucacaacugucuguaaguccaguuccaggguaucugacacccucauacagacuuacauucaggcaaaacaccaaugcacuaaauaaauacauacauacacaccgaacaacaaaagacuacaggucugaaaaaagccaguaggcauugcaagccuggaggugguggaccauggaucagaauucaaggcugggcugggcuacaugagagccuuuaaaaguaaguaaauaaacaaggccuuauucucuauucccacuagggaaaugaagcaaacuauaauuggauaucccucgcaucuaccuacuuggaauagcuaucuagaaccuaggaaccagcugguguuggaggcaagggccuguaaccgcggcacuugggagauuuagagcaagaagaugaagaauugggucuauccugggcaaugucaugagacucugucucaaaaaaaaaaagaaagaaagaggagagagagagagagagagagagagagagagagagagagaggaagaagaagaggaggaggaggaggaggaggggggaggggaggaggggaggggagaggagaggaggggagaggagaagaaaaagaaaggaaggaaggaaagaaagaaggacaggagagcuggaaagauggcucagugguuaccaagaacauuugcuacucuucuggagccccugaauuuguuuuuuguuuuuuuaaagguuuauuuauuuuauuuauauuaguacacuguugcugucuucagauauaccagaagagggcaccagaucccauuacagacgguuguaagccaccaugugguugcugggaauugaacucaggaccuuuagaaguacagucagugcucuuaacuacugagccgucucuccagcuccugaauuuguuuuuuguuuguuugcuuguuuguacguuuugagacagggucuuguagcccaggcuggucucaaauucucuuuguagauaggaugaccuugaauuucugacacuucugccuugaccucagugcugugacuacaagcacaccccucaccugguuuaugcagguuccggauggaacacagggcuucaggaauggcagagaagcaaguuaccugacucuugcucagccauuuugaggcuauaggaggagggggacaccaggcagugaguccccaugucaaaaaauaagucgagccaggcagagagggacgugcuuuuaaucccagcacuuggcaagcagaggcaggucgaucacugugaguuugagaccagccugggcuauacuauauagugagccagccagggcuacccuggaaaacucuaucucaagaacaaaucaauacuguacucuccucgaccuuggccagagaaguuucuucugcaaggaggagcagcuaaugcagacucagagcuggccugagacugagcaacaauugcaugcuuagcuccaaacaaggugucuauagcaacccacacacugcccaaggcccauggaacaucguggaagcagggcuggaaagaacaugagagcuaaagauggggaggcaagcugugaaaaugcuggcugccgcccucacaagcguacugcggcuguggcuaccugcauacgauuccgacaagauuagccaacauuccagcaagcacugcuaacuggacucacaggguuguuauuauuauuauauuauuauuauuauuuuaaaaggagaccucauuaagguuauaggaagacagcuucgggauguguagggagugggggagaaguacgagugaaugcauguaugaaauugccaaggaauaaauaaauauuaaauauagggaaaacccaacacuuggaagguggaggcaggaagggcaaggucagcguuggcuacggagcaaacucaaagccagcuguacugcaugagacugcgucucaaaagaacaaagguggaagaagagcucagcaguuagcagcacauguugcucuugcugagaggaccugaguuugcuagcaagcaccuaagucagguagcucacaagccucugucacuccaucuccagggggccaaugccucagacacacauauuuaaaaacaauugugagcaggguguggugccgcaugcgcaugccuuuaaucccagcacucaggaggcagaggcaggcggauuucugaguucaaguccagccugaucuacagagugaguuccaggacagccaggacuacacagagaaacccugucuugaaaaaccaaaaaaacaaaacaaaacaaaaaaacaauuguguguguguguguguguguguguguguguguguguaugugugugugugugaaacaaaacgaaacaaaacaaaacaaaacaacccuacuuucauauuuuuaccacugguaguaaaauccaacacuaaaaggaauuccuggcauaagaaaucuugaggaugaaaagucaauuuaaggguauguuugaacauagcacucugauaaagacaccauccacccauuugucuaaagugaguuagucuucccaaucaaauccucacuuaugccaaugccugccuuaaauguuuucuauguguagucuccucaauuaccaucaacauucaaaccaucacuuuccccuauaauuccauuuaccuuggacuuucacuuccagccuuauucuaauuucuugggcuuucauguuuauucgucaacuuucauuuucauuauacaaggaccugauaaguuuuuauugauaaaaguuuuauuauuugcuaugaauugaaugcggcuaugcccucauguguguguguguuuaaauaguaagcucagauguuuacuuaaaaacaaaacaaaacaaaacaaaacaaaaacauguguuuucuagccaaguuggucaggaacugacuguguagcccaagcuagucuugaacuagcugcaaucccuuucugccucugccuuuaaagugcuaacaagugugagccaccugcccagcuauaacuacuauuuuuuaaugugagcacuuucuguucucacagaggaccugguuugauuuccaacacccacauuguggcucauaaccaucuauaacuccaguuccagggauccuagcaaacccucuucugacauuggugcccaacaggcauacacaugauucacaaacaugcaaacaagcagaacacucauacacguaaaaucuaaaauaauaauaaaguagaccuauagaguauauauaauuccaaauggauuucaguagaagacccuacuuacauugcacagaaaaagcugucuggcugcuucaggcaugccaauaucagcacauguaaacaagcuuccaacuuuguuuuugaguaaucaacucauuauucaccagaucugaggcuauuucuauucaacagcacaagaaaagaagggagaagcaggaggaucucugugaguuugaggccagccuggucuacagagcuaguuccaagacaccagggcuguuacauagagaaaugcugucucaaaaaugaacacacacacacacacacacacacacacacacacacacaagcgcaagaaagaaaccauucgaauuugacugcauauguacauaaaaccuuuaaauaaaagacguaauuucaaaucaaaugaggucuuaagaauggagccuaaaccugucugucucuuuaccagacgcagggcagccagaaggcagccauucacaauccaggaagacaggaagggauaacaccagaacccaaccuccauuuuagagaggucuagccucuugagcuaugacacacuauuuguucucuaacuacccaaaguuguauuuuacuaugcuaauuagcugauuaagacauuagguaaagguguucuacaaagaaacuguaaauaaaagacauacucugugccuuagccuaucucaugauuccuuuucuggaugucuucauaaccaccuuaaccucuacgaagauacagagacacagguagcacuacagugcuguauuuguuuaagcccccaacaaacuugguggcuuaaagcaacacagaucuauaaccuuauaauuuuagaagucagaaguucagugugagacaccuaguugaaauugaaauuauuauuugaaauuaaauugaaauuauuccuucuguaaguuuuagagaauucauuucccugcccuuuuuagcuucaaauuucuuagcuaguaauugccuuccucuaugucuauagccggauguagagucuuugucaaucuuuuaucccugccauuucaaugaaacaacaccuuaccuucuaggggaaucuuuuuaucucaaggucgauugauuagaaaccucaguuucuuccuccaauguaauauaguauauuaguauauucuggggagucaguguuugucugccuacuaacacagguaagaauuugcauagguauuacaaaaucaguacuuugcaaaucuuucuucucuuccgaauugaaaacugaacauuaauccaaacauggcggcagaagccuuuaaaaucggcacugucccacugaaggcaguggcaggcagagcuuugcgaguuugagguuauuuacugagaccuugucucagaaauaaggcauuaaaaaaaaaacaaaaaacaaaauucaccccaaauccgcaucaaaaccaaagcugauuguuaauuucccuccuuucuaaacuggauucauuccuuagugccauuguu

SEQ ID NO: 50 - RNA, 947 nt, Mus musculus
gcuagggccguuggaccagcuuacucucucuuacugucuuccugaucacugaguuuaaaguggguguaggugaggauaccgaagaaugugcauaggaugcggagucccugguuuaccgacaggggauccuuaaauagaauguauccuccgcagagagugaugcagaacuugaaguguccgaacauguuguaggugacuggugacauguucccaaugauccaguaaaucgauaaguucaccaugaaagcgauuacuccagacagcaguaccauaagcaaagcagaaacugaccaggaaccaaauacuacucccucugcaaacacuggcucgaagaagugcacagccaccagcagcaugguggaagacacgggggccugguaguaaaguagcuguauggaguucaccugcaguucgugcugcuuggcuccgacccacacuuguuaaagggacgugacuaccacaccaaggguggcaaacaccauuccaagggaaugaaacuucaggucguaauaagaauuuaggauuacaccuacaguaauaggaaucagggugagcuguauucugauggagaaucucuucugguaccagaagguuuggauggcuaugauaaccggcguggucauggccuuggccagcugauagaugccuaugguguuguucugcagagaaaguuuggugaagaccacaaagccacagaagcugagggccaggaggaggagcuuggagagcggcagauuuuuaagggcaaagauguccaguuucugguagauguacaagcccagccaggugaccaugacgugcaccagugucaggcucaucuuggggaagcgugguguacauagauccauuuguugaggaacacgaugcagauggacaccagcagauugaacaggagcccggcggcgaugcgccuguugccccagacccggucugccaacgaugccaug

SEQ ID NO: 51 - RNA, 3912 nt, Mus musculus
cucagagcucauuuuuccacucuggcuccacuuguaagggcaggcccccuucacccucccacuccugggggagauuuuggugaggcagggcccugagguagaggggcugagaccuuggagcaaguccugucccugcugcagguccaguuuggaaggaagggggcaccagguauaucccccguuuuguuuacagaacuccaggaacguuuuccaguccgggucguggccuaggaggaggggguugcccauuacgaugagcaaagccuuggcucuggucacagcaagauugaaccucuugggguucuuaaggaaaccgagauuaaagucuagauccagcuguacaaagcucuggcagcuuuggacgguggagauaaggaugaugcugcguucuuggccuuggaaucauagagcccaccuucaagucuuugaugucauccaguccacgaaguucucugucaaguuuugugaugcaguaacagcuuuuuuucuacgugcuucccguacggggagaugacgcccacauuucaggggcucaggcgggcuuuacccuaauuggagaaaggggacaggaguuguuucagguaugacgucacuguagcagccucuucaggguugaagaaggaugggcuauugcccucucucucaucuuuccucauuacacccuggaaaaugauggggaagcccugcugaggcagccccucccagcagcugaaccguucuugauccaccacaucugcagcucuccaucauaguacagcugguuaggcauguccaggaugguggggugagaccuguaguugcggagcaguuuggugaugaacuggaggucauagccauuggggcccuucuuauacaaggaguuguaggugagcaggcacucuagcagagaguagccaaguccaugcuucagggcuaguggcgagcgcagcacaggccccaggcugucgagggucuccugccagcaccagcugccuuccgggauugcccguuuccuugacauccaucaguccugcuauggccaccagacucucaggcuccaugcaguggccagccucaucaaugaagaugugugugaagugaucgaugggaaacuggacugacaccaaccugcuagcagugaugagggugguaauuaagacccgauauugcugcaggugcuucuuagcaggauacacauauucccuucuuagcaucucaguuacagcaggucuugauguccucaggaaccauucggaugucccugcucagggccaggagacgguagauggagcugggcagauggaccuagagccacugacagaggaggucaggcccugaguuggaugggguacaggccaggaugugggcuuugggaaagugcuucacuaccuguuugauggccuccacuaaugagacagucuugccgguaccuggaagcccaaagaugauguagagggcaggccgggugguaccccucacaaugugcuucauggccugcagcugcucaggguuugauuccagacucugaucguagagcuugaacuucacaucugagggcagcagcgagaccccacgggaggccacaggaaaaagcaugggccauagcacccagcgucccguuaacucuagggcccagugcuggacccgaaggggcuggcgguugaagguaaaguucaccaugaagguuggcccauacacaaaucggcucaggaggcuuguagaaaagcucagcuugacacgguccaguuccaccuugugcacgaaacccuuguaggugacagggucauccuguugggucucagaggacaaaagggcaaaaagguggucaccucguagcacugagggacggcucucugucacaccaggaaccuccagugugagcauccugggauucugguccacagggucccaggucauggguaccgacuccaggucacagugcuggauguaaugcuccauaugcagcuccuccaggugcagcagcagccagagcuucaccucauagcuccuggguuucagggaugucuccagcugggccuugaucucagcaaccuccuuuggggcagugaagauacuuggucccugaagaaggguagggagcaguugucaaaggaggaugguuggguuaaguccccagggccaaacuuagcucuaguucauagcccuuggcuuggucggcccucucuccuuccucaauccgguuggucaacacagaguuucuggugagccaaggggggcguuugaagggaguuguggguuucaacugugcagccagaggacugugggcgacagccaccaggaauugggcaauguagaaaguuucugcuccucuauaaguuucacugucucugguauuauguggaguuccuugauccacuuagauuugaucguaguacaaggagauaggaauggaucaauucgaauucuucuacacgauaaccgccaguugugccagcaccauuuguugaaaugcuguauuuuuuccacuggaugguuuuagcucccaugucaaagaucaagugaccauagguguguggguucauuucugggucuucaauucuauuccauuggucuacuugucugucgcuauaccaguaccaugcaguuuuuaucacaauugcucuguagacgaaaggauggaccaucuagagacuaccauaccaagggauccaucccauaaucaccguccaaaugcugacaccauugcauacacuagcaagauuuugcugaaaggacccugauauagcugucucuugugaggcuaugccggggccuagcaaacacagaaguggaugcucacagucagcuauuggguggaucacagggcccccaauggaagagcuagagaaaguacccaaggagcuaaagaggucugcaacccuguagguggaacaacaauaugaacuaaccagcacccccccaccccacccagcggagcucgugucucuagcugcauacauaucagaagauggccaaguuggccaucauuggaaagagaggcccauuggucuugcaaacuuuauaugccucaguacaggggaaugccagggccaaaaagugggaguggguggguaggggaguugcgggggggaggguaugggggacuuuugggauagcauuggaaauguaaaugaagaaaauaccuaauuaaaaaaaaaguuucugcuccuucugcuacugacuccccggggucccaggaauucccagaggacaguggcugggaaguaacccacaaugcuggucuuacaguagauguggaguucauagcuuugaccggggcccagcgggcagggcagguccuguucuccaugguagaagacaaacuggggcguccagcacagugggaauaggugagugcgggugacaggcuagguuccuccguugugaagccuuaggguuaguaccuccuugagguucaaauccaggcggauaaggaguugccugucucgggcuucauggggcccuuggaccucaacaucuaccccaugcuucccaugaagguagucagcccuguugugaaagauccuggccaacagugaucuguguuguuugcugauguucgacccuggcuuuauucgccucuuuucugggcacaucagcccagcggucuaguuugaagaaccugacccgagucuuggugaugaaggccagauuugcgcucuucauuccauacagcauggaggagaagccaggggcaggggucccauagcugggcuugaagucgugguuguaaaucguccacagccgccuacaaucugucuccagguccaguccgguccagcccgcauuuggccagaaaacucucgaaccucuggccggucucccuaaccuuuuggcagcugaacuugcuaggcuuuguggcagcggcagaugcagcucaggcaggaggguccgcggaaaggaaacugagccuuccuuucggucucuucgucc

SEQ ID NO: 52 - RNA, 1425 nt, Mus musculus
cuuacacaagacaguccaaacugucaucauuuucagggcauuccugccaucacauugcuuuuaauaaccuguacucugcuuccagagagugugaccgauccuccccuuccucuaccauggguagagaaagaccacucugaagacaaccuuguucuccauuuuccuuugguucagguguguggcugcccuccaaucuuagccccacagucucuacuuucugagcagucuccauuucauucauccuucagagucuucaggaacucacucguccuguccgugguucaucgggucaguuuggucagaugagaggagcugaucucacuuggagggguaguacuggagggacucucuuugggagaguggagaacugcaccagcagccaguaacagaaauuggauugguaaaagcagacucccggcuagagcaaagugauccagguuuguguuccauucuguuagcuuuccaggcguugggcuuagaggguggugguggaggcuuaggaaccaaguucuuauagacacuugaaacuauuguugacacuuuguucccauuugcauggggggauccugaggaggugaaugcagcagaaaaggcagcagcaggauccucuuuggaaauuuuuuugaugacuagcaucuuugaggguugcuuggcuucccacacuccagaaggggucccaacaggucugcaugacugauucuguuugccagcuucuggauucaaagaagggaaaucuuccucuucgaacugcaacuuuucuacuuuaucccuuuuuuuucucuucccuaaucucaguugguguuuuuucuugaaaggcacagccuuuccaggaauggaagcugccauucccgugucguugguuuccuguacuaccuccacuauguuggcucauaccaucaugaccucgggaagagccaugccaaccagauagauccccuguuguuccagcauaugaucccuuagagacaccagagucaacagacucauggcagaauagggaguguuggugacaagaaucuccuguaguccguagagguccauuguuuaaaaagucaucagaggaauuauguugucgacggcuuauucaaaaucuaccuucuccacgggauagguacucuccauguuugucaaagaugguuguagaugacuuagcugacuguggcauugagaaauuuagccaagcaggaacaaagucaugcugcgccauuuagguccagugucuuuuuaacaagaugaggcauccaaccucauggccaggauccucagagugucaccucugugguccuguauccaaaguugccgccuguaucuuccacuagguuuucuuguaagaagggugcuaaaauaaccuggccagcagcacgcuuugugaugaagcacaaaaaagcccagcucuguguggcccacccucuuaauccucucaau

SEQ ID NO: 53 - RNA, 910 nt, Mus musculus
acuauucuuuuaugcauaguacaagaaucucacaugauacagaaaucaagaacuauagcuaguagcugcaugcuuauagguauguuguuuuaggccaggaacuaaaaauccauccagugguguucaccgagcagcacacauaauaaacucugaaugagaccaagacuggcaugucuccugcucaaggaugacuugcaacuucgugaagcauugaaaguaaaauccaugcagcgauuacuauccauuucaggguuaguuaaacaaaaccaaccucuuacaaguaacugaagacagucuuuaaguuccuuuuaaaaaugaagauuucaagccaucacauauuuguacaaaauccucugcgcaucuucugugugugguguguccuuggagcuccaaauguggcuuuguagggagguaggaggcucggguaggcaguuccacagucuguuucuccugugucaucuuucuguaaacaauugcaguagucuuuauauuuuaucaaaaucagagcaaggacaaaguuuuccaauaucuccaaacuuggucagggcaucuguggugugugccggcagcccagacauaguguaugugcagagcagcccacaggaggguggcugaaucuaaggcugaaaaugaagggagagaccuggaacgcucacuugcaucugcaacaaugggucauuguuaggccugagcucugucaaacaauggccuugauaggacaaaacuccuauggagaaggauagcuuugcacccugguacuucaggcagcccagcuuguuccagcugugugcgugcgugcaugugugugugugugugugugugugugugugugugugugcgcgcgcguuugauuauuggaccuaccugccaucuucccaugacuucacgucuuugcacuucuggugguucu

SEQ ID NO: 54 - RNA, 1462 nt, Mus musculus
uuaguuuucgggcagcuaguagaggacacgggcaagauggcggugguggcuggucuggugcggggacccuugcggcagguuuccaggcguuuucaccgcucggcgcccgcagcggugcaguugacaguucgugaagcuaauaaucaagguacggaugaagaacuagaaagagaugaaaaaguuuuucugcuuggggaagaaguugcccaguaugacggugcauacaagguuagcagaggccuguggaagaaauacggugacaagaggaucaucgacacccccaucucagagaugggcuuugcuggaauugcuguuggugcagccuguggcuggguugcggcccaucugugaauuuaugaccuucaauuucucuaugcaagcuauugaccagguuauaaacucagcugccaagacuuacuauauguccgcuggccuucacccugugcccauaguauucagggggcccaauggcgccucagcagguguagcugcucagcacucgcaaugcuuugcugcaugguaugggcacugcccagguuuaaaaguggucagccccuggaauuccgaggaugcaaaaggacuuauuaaaucggcuauucgugauaauagcccagugguaaugcuagaaaaugaacugauguauggaguugcauuugaaguuccugcagaagcucagucaaaagauuuccugauuccuauuggaaaagccaaaauugaaaggcaagggacccacaucacuguaguugcccauucaagcccagugggccacugccuagaagcugcagcuguauugucuaaagagggaauugaaugugagguaauaaaucugcguaccaucagaccaaugcacauugaagccauagaagccagugugaugaagacauaccaucucgugacuguggaaggaggcuggccacaauuuggaguaggagcugagauuugugccagaauuauggaaggcccugcauucaacuuccuugaugccccugccguuccugucacuggugcugaugucccuaugccuuacgcaaagguccuagaagacaacuccguaccucaggucaaagacaucauauuugcaguaaggaagacuuugaacaucuaauucggacuuugaauguaaagucauugaaaucuauuuaaaauccuuggugggacuucaccugauguguacugcgagacugcuagucauaaaguuaacgcugaagugacagcaggugucugaacuguaagaaguuucaaugugcuuaugaguggaauguuuuccacucccuacccuagauacucugcuuucuuugucuguuacuguuuaaguuaaauuugcccucuuucacuagaaggggcaagauaagaaugcccccacagaagauaacuuaugugucuaagaaguauauuaucuacauuugcuguuuaauuguuuugauaaggaauaaaggggauucccaccaauaaauaaauaaau

SEQ ID NO: 55 - RNA, 1462 nt, Mus musculus
auuuauuuauuuauuggugggaauccccuuuauuccuuaucaaaacaauuaaacagcaaauguagauaauauacuucuuagacacauaaguuaucuucugugggggcauucuuaucuugccccuucuagugaaagagggcaaauuuaacuuaaacaguaacagacaaagaaagcagaguaucuaggguagggaguggaaaacauuccacucauaagcacauugaaacuucuuacaguucagacaccugcugucacuucagcguuaacuuuaugacuagcagucucgcaguacacaucaggugaagucccaccaaggauuuuaaauagauuucaaugacuuuacauucaaaguccgaauuagauguucaaagucuuccuuacugcaaauaugaugucuuugaccugagguacggaguugucuucuaggaccuuugcguaaggcauagggacaucagcaccagugacaggaacggcaggggcaucaaggaaguugaaugcagggccuuccauaauucuggcacaaaucucagcuccuacuccaaauuguggccagccuccuuccacagucacgagaugguaugucuucaucacacuggcuucuauggcuucaaugugcauuggucugaugguacgcagauuuauuaccucacauucaauucccucuuuagacaauacagcugcagcuucuaggcaguggcccacugggcuugaaugggcaacuacagugaugugggucccuugccuuucaauuuuggcuuuuccaauaggaaucaggaaaucuuuugacugagcuucugcaggaacuucaaaugcaacuccauacaucaguucauuuucuagcauuaccacugggcuauuaucacgaauagccgauuuaauaaguccuuuugcauccucggaauuccaggggcugaccacuuuuaaaccugggcagugcccauaccaugcagcaaagcauugcgagugcugagcagcuacaccugcugaggcgccauugggcccccugaauacuaugggcacagggugaaggccagcggacauauaguaagucuuggcagcugaguuuauaaccuggucaauagcuugcauagagaaauugaaggucauaaauucacagaugggccgcaacccagccacaggcugcaccaacagcaauuccagcaaagcccaucucugagaugggggugucgaugauccucuugucaccguauuucuuccacaggccucugcuaaccuuguaugcaccgucauacugggcaacuucuuccccaagcagaaaaacuuuuucaucucuuucuaguucuucauccguaccuugauuauuagcuucacgaacugucaacugcaccgcugcgggcgccgagcggugaaaacgccuggaaaccugccgcaaggguccccgcaccagaccagccaccaccgccaucuugcccguguccucuacuagcugcccgaaaacuaa

SEQ ID NO: 56 - RNA, 12544 nt, Mus musculus
guuuuaagguuauuagauuuaggaauucuguuuauugaacaaacugcagaagggaagacuggugccaauuguuucagacuugggugcuauguuucugccucugcuaugcugcuucuucaaaauguauuuuuuagcuccugcuaaaaacaauauaaagucuaucaugcauuuucuucucauuagugagacucaagagugcuuuacagacuauauguaaauccuaagagggaaggaaguagaauccacaggguggcaguuaccuaaggaucagaagagacacuaacucuagaggccuacgaaacaggcaugugcuacaugcuuuacaaacacuagcgacuugcauaauaacuguucuaauuuuaugucaacuugacagucaucugaaaugaaggaaucucaauuaagaaaaugccucuguacaauccagcuguaggcaaaccuguagggcauuuucuuaaugauuaauggggaaggacccagcccauuguggguggugccaucugugggcuggugaucucggguuuuauaaggaagcaggcugagcaagccaugaggagcaagucaguaagcagcaugcuccauggucucuacaugagcugcugcccuguuugaguucuuauccuggcuuccuuccuugaugaacaguguuacggacguguaagcaaaauaaucuuccuucccaacuggcuuuuggucauggugcugguuauagcaguaaaaucccuaagagaauuuguauuuuauaauaaccaaauuuuuauuuuacccuccauuuggcagauggugaaacugaggcagagaauaaauugcaugccaaagucccaaaucuagucuugcuuaaaguccuacucaaguguuucacccagauggcugugcagcuccaagcauguaacgagcaagcuagaguguaguggucugccuacagcaaguuaucacgaaagacaaccgucaugggacucacacuaacaucagagcucucuccuccacccuaagugaaacgaguacuggucccgucugacacuccccacccuaagaaggaccuucuacuucccaaagaaaauuguaaagacuuacaauuaaaaaaaaagaccagggacucagaucauaacaaaaguuucccucuuacuuuagaaaugggaugugggggcagaugcaggcacacauggaggccagaugcaggcacacauggagaccagaugcaggcacacauggaggccagaugcuggucagaugucuuuucucaauggcuuuuuuauuauuuuauguguauugaguaucuugccgaaaauccauggaagucagaagagugcaucaagugcccuggaauugggaaaacagaugguugugagcuaccaugcagcuaaacuggcuggccacugagccuggagguaucugaccagucuucugaugcccaagcuucuguguggcucacaaacgcuuuaaaguuuaaacuucaacccuuugcccaucugucuccgaacucuagaacugucugcuguuugcuuuggcuuuuggagacagggucucacuuuauagagcagguuggccuuaagcucagagauauaccugccucucugccuucugggagcugggauuaaaguaguguacaacuaacuaugccuggcacuaaaaauuguuuuaaaacacuaacucaaguguuuuuagaguuuggucaccaaagccuccugcacgaggcaaggcaauagcuuuccuugggcuacagcacaccccauaguuacauuacaggaugugugcacaccgaaagcugaggccacauuccaggaaggacagaccuacacucaagacuuauugcuuuuuaagguagagucucaagggauacaaacugcuaccaccuccacuggagcgcuccacgccuugugacuggcacaagggcuagaguggaccacgugaauuccauggaaggcgcuauuuuggcugagaaugagcuguagggauagucucucaacccggauacagcuguuugugacaaagucccugucaccaaauaaacacuggccagcauucuacuucaccagacaucuguuuccuguuuuuauucuucccuuuaucacucuaugccaauuuccuuccaccuguaugccaccacagacaaccaaaaugaagaaagcccauguuuggcugucaguucuucuaugugagguagccacucugcuugaagggaugggggaggagacuccaagaacccgcaaaguacauucugagauggaaggccgcaauguguucucccuucagaugacuaauuuccucucacuucccaugaagaagucuuccugggaaggcaggggcucugagaccugcaaauguacacugcaguaccaaaggaaagccuccugcacaacuaggcggcaaggcaauagcuuuccuagggcuacagcacaccccauacaguuacauuacaggaugugugcacacccgauacaguuacaauacaggacguguucauuuaaggaaauugauuucuaugcagacaggcuauggucaaaguucuccucagaucaaggaagcaugugucauucaggggccccccagaagcuggagccaaagggcagugucacucaguauguacagcacagguccaaccucuaaacugcaaagacaugguaggaaagcgacucuacagucucuccuccuauugcugcagacugacacuguacuucagcuaaaggacuugucugaugucuuaaacaacagaagaccaagagggcccaguuuaaguccccgaacaguaaaggcuuccaggccuacuaaucaaucucugcccugcacucugacaaaacagaaaauguagguaagaaaaguccaugaaaagauggacaguaaagaaauguuuuaaacuacuuagucaggcugggcaguggcgguacaugccuugaaucccaacagaagcaggcggaacugugugaguucaaagccagccuggucuacagaacaaguuccaggacagccagggcuacacagagaaaccauguaucaaaacacagucuccccaccccccaaaagaaagguaauuuuaaguagguuuuuuucuuuuuaauccccuuucuaaagccugccacuguucagauuuucaagcacacacccucaaaggcucagucgcucgugcagcuuuugcugucugcuauuuaagauggaaaaagaacaaaagaccugagcagugaaggcugguaacagacccaaagcuuuaauacccacaagaauccaugugcagcccgucuggcucacaagucugauuuaguagaaggcaguucaggagcuguaauacuugagaagauucucaucuguagguuuuagaauuuucuuaucugccauauucacuacccagccaggagcaagaccaaagaaaaucugccucggauccuuccgagcgcugagcauucugaagaguucaucuuucguaauaucaggaaggacguagccaaacuucauggcgaguucaagucuugcuucaggaaacuuggcagggucagccagguagccccgguuuuuugcaucgguguaauagggcaccagugacucagggggaagcauucuuuucggaauugguuguccccgcagaaagaauggaauaggcuugcacagaauuucuaaaaagauuuuuuuuagaaagagauguaaauauugguucuauagguaauaacuguuacacauuuuagauuuccuaagaugagaaguuaauuccaagaacuuuguaguuaaacgggcuuaaguaagcaaaauggaaaugauucuuuuacauuucuuuucauuuucuuauuauugucauggaggggcuuucacaugcgcuaugcuguauaucaggacaacuaucgggaaguugcucuccuuccaccaugaaucaaacucaggucaggcuugcacaguggguucuccuacuuaacuaccuacuucgcauggaaagucauucguaauaguuuagaaaaaggaagauaaaacauagagggaagaaaaagaaagaacauuuguuuucucucucucucucucucucucucucucucucucacauggccuacuaugcuuguugaccagguuuuagugcuuuggcaguguucacagcugcccuuuuguggcccccucgagcacugcacucacaugcauaugucuccauggagacauaaauguguacacagaaauaaaacuaaacaaacaaaaacaaucuuuaaauuuuucagagguuggagcugugcuguacauacugagugacacuacccuuuggcuccagcuucugggggaccccugaaugacacacaugcuuccuugaucugaggagauagaaaucaauuuccuuaaaccgaccagagaacacuuaccuagacuucuugggucauagaaggcuguaguaacaacaccgccauuuuuuucaauggcagcaauggcuaauucugaagccagcugcacuucaauauuaauuuuugcuugaaaaguaucagcacccuguaaaaaaaaaaaaaaaaaaaaaaaagccuguuaguaaauagcuuagauggaagcaaauuggugccaaguguguuuucagccgagcuccccuccaaaguacccgugauucuguaacuccucugcuuaggggccacugugcuucacccauccauucucaagcccagcagacaggaaugacagcggcguccuuccccauacucuauuaguaguaaaccauuuaauccuagcagcccuaaagcaggauuauuacuauaccgacuucaggcagggacaaugagcauacaggcugacaauacagcaauuccuaagacaaaguuaggauacuaauccagagucggcauuuuuccuuuuuucaugcugaggcugaaacccucaggucuucccuucuccccagcaccauguguguucuuucgaaaaguauauuuaaaaguaauuuguguguguguggggggggggguggagugucuagucacagcaugcagcaugcauguacaagucagaagacaguuugguggcugucccuccucgccugcgcauggaucccagggauuaagcacaugucucuagguccaguggccguuuacccaugaagccauuuuaccagcccauuucuauucuuacccacaagauaaugcuacauuauaaaagacuaagaacaaaacuuccugagacuggagagaugguucagcaguuaaagagcuggcugggcagugguggcgcacgccuuuaauccagcacuuaggaggcagaggcaggcggauuucugaguccaggccagccuggucuacagagugaguuccgugaguuccaggacaggacagccagggcuacacagagaaacccuaucucgaagaaaaaaacaaaaacaaaaagagaacacuagcuucucuuccagaggacccggauuuacuuugcagcaccacaugguggcucacaaccauauguaacuccagguccaggggauccagugccgaugaccccucuucugaccucuccagguacuaggcacauaugaggugcacagacauauauguagguaagauacacauacacaaaaaacaucuuuaauauuuuaauaauaaaaaacaaaucuuaccuaucccuaagugagcaaaaagagguuucagaaccaagggucuggaacagccugaaaagcaaaacacugacaauauugacggguuggcuguccuuaagaagagggggaaauccacuuuguauucacugcccacuuuauuggagaggaaucuuuuucccuagaauguuuaacacuagagaugaagcagugggcuucuuaaaguccugucacucaggauaugguaacuuuucucuaacuucagaacagaugauuuugccauuuuaguacgggugagacuaguucccaaucuauauuugauaaugguggauauuuauaaucaauagacucaauucagaacucgggacuugauuguuaaugugggguuuuuuguuucuuuuuuuauuuuauuuuauuuauuuuuuuuuuuuuuuuuuuuuuuuuuuuuuuugguuuuucgaaacaggguuucucuguguagcccuggcuguccuggaacucacucuauagaccaggcuggccucgaucucagaaauuugccugcuucuaccucccgaguacugggauuaaaggcgugggccaccaugccuggcuuguuucuuuuuuuuaaaauugcuacucuguaagcuacuuaaccuaucucauuauucuggcucugguuucaguauuuuuuuuuagccaauuuugagguauguugacauauucuuugguuucuuuuuuuuuuuuaagauuuauuuauuauauauaaguacacuguagcugucuucagacacuccagaagagggcgucagaucuuguuacagaugguugugagccaccaugugguugcugggauuugaacuucagaccuucagaagagcagucgggugcucuuacccacugagccaucucaccaggcccugguuucaguauuuuaaguauuauaaacugcauuuuuaggaaagucuacaaaucaaguuucaauauuuuccuugagaauauauauuuccaaauaauucugugcuuacuaaucacagcauuuauuacccacuauuuccuuacauauuuaaacucaggaaagacaauggacaagcuauguguguguguguguacauuuauucaaccauugccccaggguauaauuuucaggcuaaugucugcuagcauaauacacacauaacugaagaguaucaagacaugcaauuuaaauacugccaaggucauggauuuuucuauaaaguagagcuauaucuuuuuuuuuuuacgcauccaaaguaaaauauugaggcucaaucacaucguugguauugcuuuuccaaaugaacuccucuguuugugauuugauuaggguuuguuuguuuucuuuucuuuuguuuuaggacaggauuuuaaguguagccaaggcuggccuagaacucacuauguagcucaggguagcuuuaaacauccagcaacacccugcagugguuucucaaguacugggaucacaggugcagucuaccaaaucucccaagccaauucuuuucugagguucacagucucggggcauuuaaaagguucuucuaugggcauaugcuucccucuaguggacacuaaguuaccgaccuauucagcuauguaguucauuugcuuaugaacugcuguugaauucauagaacagaauuuuuuacugccgcugaaacaggauuucaguagauauuguguagauauuaaguagcuuucagugugaggaccgacauugcugaaacuauaacaaauuaccuaccugugcaaggcuuaggugauagugagaaagacagugaaaccgaagugcaguuuuggaccagauauuaagaaaaauuauuugggaggcuggagcaguuaauggcacaggcugcucuucuagagaggcagaguuuuauucucagcacgcauaugguggcucccaaccaucucuaacuucagugcuaggggaugcaaaccuucagcuggcaucagguacauaaaugguacacagacgcacaugcaggcaaaacacucacacacuuaaaauaaaagcaauaaaaagaaaaaugcuuuggguaggaaaaggcagaugcacagugugcuucuaagagagggaacagggccacaggcugcacuugagcuccuggccagcuccugccagcuugcaauguaguaaacuauuuuuuaagggugaaguaggugaacaggucccagauggauggaguggcacaugccugucaacaggaaaaggcaggagucaaccaggucuauaccgugaguuccaaaauagccugccagagcuacccagucucaaacaacaaaaaauaauuucagaaagaucuucuuugaggcugagagagaacucagagguuaauagcucuugcugcuuggggguuugggguuugguuuccaucacccacacaguggcucacaauuacuuauaacuccaguuccaggggcucuaauguccucuuuugaacucugugcguacauauggugcacauaaacauauagacaaaacucuuauauacauaaagaaaucaaaaaaaagucuuuuaaaucuaauugaauuuccugauauauugacaggugaaacaaacaaaaaacaaaacaaaacaaaacaaaugaaaaaaagggaaaaagcuguacagauucacagaguaugccagccgucuaaaaccacagcuagagugaaccaguguuuuggguuuguuugaacuuuauuuuuauuuuguuuuuuagucuauguguauguguuuugacugcaugaaugucuguguaccauguucauacaguccccguggaggccagcaaagaacggaagaucgugugggacuguaguuccaguuuugaguaccaucaugugggacuguaguuccaguuuugaguaccaucaugugggacuguaguuccaguuuugaguaccaucgugugggacuauaguuccaguuuugaguaccaucgugugggacuguaguuacaguuuugaguaccauugugugggacuguaguuccaguuuugaguaccaucgugugggacuguaguuacaguuuugaguaccauugugugggacuguaguuccaguuuugaguaccaucgugugggacuguaguuccaguuucgaguaccaucgugugggacuguaguuccaguuuugaguaccaucgugugggacuguaguuccaguuuugaguaccauauggauacugagacuugaacccagauucucuagaugaacagccaguguccuuaaccacucaucaucucuccaggccccaagaugagguguugaguaagcaguccuucagauucaccuuccacaguuuuuaguuacugguugguggccauccacaacuccuaagucuuuaugagcuaggaaggaaaccgagagccuguacaggcugaagugcaacuccagcacuguuuagguuuuacacuguguggaggccucguguugcuccaccccauccuucgcagacacgagucugacuuuauuaugucauuuucagacuuuaugcagguacuccuuaucuuacucaaugaaggccccaguguaggacagcagcaaugcggacagcuccgacauggcaaagaggagccauaaagugugcaccugaagugaagaggugcaaggucuccauuuaauagucauaacuuaaggcuacuaagaacuauagcaauucauuucuaaccucccacuaugccuaacuuaauauuaaucuuuacuagaggucuguaugaaaagaagaaaauagugucucuacaguuugguaauguccacagugaagcauauaugugguauguguacauaaugagaguauggcaaaguauguauauaguaccaaacaacaaaacauacaaaauccaaucuagaguuaccucuucaaccagcuggacuccauaaucccucuuaagcggcuggauggucacaccucucccauucacaagcuggguuaggucaauagguugaguuggaucaacucgaccuaaaucaaugagauacuguagucuccugagacucaaaggcugauacuggugccugaaacugcaaagcaggaauguaauaauuagaaaacaccaaguaaccuuccuguauccucuucaaaccagcacgcuuuccaguguuuuccuucauaauuucugauggucuaaaauaaauuuauaagcacaacacaaacacauaauaaaacaccagugcuuccuuugguccacuaaaaaaaauuuaccucucuaaacauuuacuucacucauggacacaaguaacucacaguuuaauucaagauaauaucauaaggugcuggagagauggcucagcauuuaagagcacugacugcucuuccaaugguccugaguucaauccccagaaaccacaugguggcucauaaccaucuguaaugagaucugaugcccucuucuggagugucugaagccagcuacaguguacuuacauauaauaaguaaauaaauuuaaaaaaauaacaucauaaaauaaaaaugguacccacuacaaugugccauaaacauauuauauaugcauacauauuauauacauaauguaauauauauauauauacauacauacauaauauauauggggauguuuguguauauguaucuaaauauaucuauauuucaaauauauacccauuuaaaaagguaauauacaggcuggugagauggcucagugguuaagagcaccgacugcucuuccaaagguuccaaguucaaaucccagcaaccacaugguggcucacaaccauccguaacgaaaucugaugcccucuucuggagugucugaagacagcuauaguguacuuacauauaauaaauaaaugaaucuuuaaaaaaaaaaaaagguaauauacauggaaauaaaaauacauauggcaagauacauuuaccuuuuauauauaaauauagauacagauauauauagauauauauagauauggaaagauacauauacauuuuucaauuguuaaucaucuaaggaauuaugacagcaagcacuaucaucagcauguuguuggucugaguagacucuguacaaaugugcuuuucugggggcauagucauacagugacacagacaauagaggguaaguuacauuacuaaaaauuauucaaagcaacaguaccauaaguguguuccuaaauaaacauaagguaucuaccaaauuacuuguguacuucuuaguggaaauuacgauuuguacuuaaaaaaaacaaaaaacaaaaaacaaaaaaaaaaaaacaaccuuaccuauguccuucauuaaauccauauuuugggauucguauguaaaauggagucugcccucccucaaagcccagccuuggccggguuccucucugccuuucuccuuuauggccucugccacacuuccuaccucuucuccgaucucuuggacgucuuuccuacaagaaaaagugaguuuuaagaucuucagauacauuucugaaaacugucucaucucauagcauauuccauauuaaugcuguuuauccauugcaccagagguaaaguaccgugugccaagcccugcucuagcugcgugcucaucuuuauacuccaccaacauaguucucucagaauguagcugauccuaguaaccaaaauacaaggugaaacacagggcaaaguucuaaggaagggaugggauccaacaggaauaacaagcucuacaauaagcuaggucccuguagugauugcuaucugcuagguugaggcaggaggauucaaaguucaaggccugccuaagcuacaaaaaaagggcaaggccagcaacccccaauuuucugagagucugucucugaauaaagcauuuaaaaaucgggaaagggaaccagaugugguggcgcaugccuuuaaucccagcacucgagaggcagggacaggaggauuucugaguccgaggccagccuggucuaaaaagugaguuccaggacagccagggcucuacagagaaacccugggggggggggggggggggggcggugagagggcaucgggaaaggguuugggauuacagcucagugguauagugugcuugaacaaacaagcuaagggccuaaauuuagucuucaggaaaaagcagcuggaacggaaaaagaaaauccuagaacuaaacagccaaaacgaggcuugagugacauuaaauguuuuauuuuuaaauuaaucguaaauauguaauuagaucacauauggcuaaggaaaacuccaauuuuugcuagggacacauucuaauuuccuaaauuccuaaaagauaagcuccuggcaacuugucccccuccacagaauuguaaaacugaugugaaaugauuaauugcuucgguaaaguuccucauguagcuguaaguuccccagaaauaaaguaauugcgaccuuucaaagcccuccaccuucuaccccuuuaaccugggccuaaggggaauugugguuggcugcacuauaacauuaaaaaauuggcuaauuacaacuggauagagucggguagucuuucgguguucucuaacuccguaacaucuuucccuuaauugacuuugucaaccgccccccccccuaaaaaaaaagccguauauuaaguuacuguaaaagccgagcagccgacccacaacaguuuucuaguugcacccuggguugcacauuggccagcuggaauguagaaaaaacacugggauuuuuauaacgacgauaggcacuugcuaagcaguucaguuuaaacgcaauuuuggaugaaucgucugcaguucccgaguguguacccuccgccugcuuagcauccuuaacacugggcgcacgcggaagggagccaggcgcccgcacgcguccaucgccagagugacgcggccccugcacuccccgcaccgccgccaagcguuuacccguuuucuggaguuaggacugggcuucagguuggccaggcucacucucggcaaggaccgcagcagguccaggcuggucccgcagccgcgcgccgugccagccaugacccgcggugcuucaagggcgcccaggaagcggcguagacuccgcguugcuuuacggcuccg

SEQ ID NO: 57 - RNA, 70475 nt, Mus musculus
uguucuuucacugugcccuugucuugcuaggacauccacuucuucucuggcacugguuccugcuucuucagaauuccagcauauaaugaagaccaggugagaggacuuuccauucaagcucaccauuguugauuuuguuggccugcauccuguaagucauccuaauaauuacauucugugucugaagaacccugacuaauacuacuggccuagagccucuauguagacuauacuggccuguaacccagagauucaccagccucuucugccucccaaauucugaggucagggguauuuaccaccaccccuggcacauuuuuguguucuaauacaagaaaacaaccaaacaacaaaaagacuuugauauaguccacauguaaauggaccccaccuuucccagcuccuauaugucaccuaacuuaucaguuauguauguguaagcuacguacauaauuuuaaaauaaguuuaaggcagacugaagaaugauaaauucaaauucucagacaaaaucuauaaaaguucagaaggcuuugggaguaggucugaauuuacuugagguaugcaguuuaagagggugugagccauccauggcuaaagguugggagguucuccgaacuacuugcauuaacacuuucucugagagggcugagagugggacucaguaggaagaugcuuuaagcagagacuaaaggcccuggauuucauuccuaguauuaugcaaaauauacacauguaaacaggucuccuagaauuccugucuuauuaguaguguaauuaguguguaacauucagaauggaugcuuuuuaaauaauuuguucuaauaacaaccauaaaauaaaagccauagaaaggauuaaacuuuuaagaaucaaaauuuaaagaaaaaucuauaaaaccaaaacauuaaauuauucaauauuuuuugcugagaguuacuauauagcccuauaggcuaagguggccagccucaaggucaagaguguuaggauuaaaagcaagugcuauuacacacuuuuuuuuuuaaagauuuauuuuauguauaugagugcacuguaguuguacagaugguugugaaccuucguuugguugggaauugaauuuaggaccucugcuugcucuggucaaccaugcuugcucaggucggcccugcucccucugguccaaagauuuauuuauuauuauaaaugaguacacuugcugucuucagacacaccggagggcgccagauuucauuaugggagguugugagccaccaugugguugcugggauuugaacucaggauucagaagaacagucagugcucuuacccacugagccaucucgccagccgacuauuacauuuuuaauauuuauuuaggauguuagagacacaugcuuguucuagaauucccuguguagaccagaacagacuugaauucacagauucaccugcucugccuucugagugcaggauuaaaauuguauaccaccacagcuagcaauaucuuuuagauuuuuuuaagaucuguuuuguuuuuguuuccguuuguuuguuugagacagggugucucuguauagcccuggcuguccuggaacucacuuuguagaccaagcuggccucgaacucagaaaucugccugccucugccucccaagugcuaggauuaaaggcgugugccaccacugcccggcaagaucuguuucuacuuuacauuugcaccaugaaugugacucgugcuugcagaagcuauaagaaggcacugaaucccccaaaauuugaguuacagaugguuauaagcaucuguauggauccucugccaaagccgcaagcaccuuuaauugcuaagucuucucuccagccgcuauuuaaguuuuuauaucuuccuuuuuuaaaaaagauuuauuuauuauuauacauuaguacacuguagcugacuucagaugcaccagaagagggugucagaucucauuaggggugguugugagccaccaugugguugcugggauuugaacuccggaccuuuggaagagcagucagugcucuuacccgcugagccaucucgccagccccuuuuuauaucuuucuaaaaguuauagcuaaccauaucacuuauuaauuuuuagcaucuccuaauauuuuauaacacuggggaucaaauccagugccuuacacacuaccacuaagcuauauccuaggaucauuacuaacucuaagaaaacaucugcaaagaauacaaucauauacuauauuauaccuuuaaaaacaauuguucauagcaaaauaugaaugaucacacuacuguggucauucaguuuacguggaauaacauguucuaacauaguaauaguuuugugagguuguuguuguuuaggaaaaucaaggcagaugugguaggaaaugccuuuaaugccaauauacuuaagggagaagcaggaucucuaagcuugaagcuacugucuggacauacagagucccaggacagcugugaaagccacacaucaacguauuuuucucuuauuuuuauuuuuauuuuuuucgagacaggguuucucuguauagcccuggcuguccuggaacucacucuguagaccaggcuggccuugaacucagaaauccgccugccucugccucacgagugcugggauuaaaggcgugcaccaccaagguauuuuucaaauugaugaaaacauugguauuauaguacaguagggacagccuucacuauaggucugagauguuuguuaucugaugucauucuuugauuuuagguugaaggaagugaggcaucuguugggauaauacauucuaaaaugugucacauaugucacaagacuggaaagucauacugagguaggcaaugaauagcuaguaagauuguuagcccaaaauaauuuagcucugaaguugcacuaucccagcucuccacaaucagcaagucucuaaucaauccccuacacccuuaaaaaaaauuauuauuauguguaaguacacuguagcugucuucagauguaccagaagagggugucagaucucauuucggaugguugugaaccaccaugugguugcugggaauugaacucaggacuucagaagagcagucagugcucuuaaccgcugagacaucucucuagcccaauccccuacaccuuuacaaaguucuggauuuucucugguaaaaugaguucacagcacuuaccaaguguuuuacagaauugacaggaugggauguaaaauggacuauauuuaaagccugagucccagaaacacaaaguacagaaugacgauuggcaagacaauagauuuaacuagcauugaagauuucauggcagaaaugugugaaguuuucucaugaauuaaccuuugggaagggauagcuagggaauuagggauuugacgauacuaaaguuuggagaguaggaagaaagguaaaccugagaacccagguuugcagcugaucaguucaacguuucuuuuauaguaagucaccuuaaaaauauaugggagguuugucaaguaagaugguucagagaguaaaugugcuugcugcugagccugacgaccugagcucaauuucuagaacccauguuugaaggagagaacugacuccuacaaggugucuucucauaaacaaauguacagauacaacuuuacuacuugaggauauaagauugaaaacaaaugcuacuaaaauaaaaugauuucaggaaacuagaaagaagccuuaauuuuauuauagguuacaaaagauacacaguuuaaaagauauagaacauacaugguuuaaaaaauauagaauagguacaaauaagaaaaaaguaucccuuuguauuuuaagaguuuugauugcuggagguagugccauaagccuuuaaucccagcacucaguagaggcaggcagaucucugaguucaaggucagccaguccacagaguuuaguucuacauccagggcuacacagggaaacccuaccuugaaaacccaaaguggagcaaagaaguuuugauaaauuccauuacuuuuuuuuuuaaaucauaccacuaccucauguuuauaucaucauuuuagauuguuuuagaaauaaaaucuuuuuagaaaucuuuagaauuuuauuuucuaagcuaccaugauugaaguuuaauaugccuaggaaaugaauggcaagauuuuaggauccucauucacagauuuccagagauaaccauaaaaaugggaauuacaguagucugauuccaugccuuuguguguuuguuuguuuguuuuucgagacaggguuucucuguauagcccuggcuguccuugaacucacuuuguagaccaggcuggccucugccucccgagugcugggauuaaaggugugcgccaccaccaucuggcugauuccaugucuucuaauuuuuuucugaaauacaauuucaguagguguaugguguagcaugauauaaauuguuaaucaggaaaggaauugauuuuucuguccugggaguacuagagugucugcagaggcauuaucaauaguaaguuauuucuccacuaguaaauaagccaaaguauacaugggcagauuugcagccaugaggagggagaaagaggggagggggaagaaaaagagcacauccagcgaggguggugcaaaauguauggauuauauagggaagagucucugggggaagaacagcccaagcuccuaaacuagaaaguucaagguugggggcaggguauaucagauagggacagagggaugcugggagaagcuggaggccaggucugcuuugguauguaaaauaugcacuucagcuccuuguccuggggucugaagacagacaguuauggcuaagaguaucaggugauggaagccagagaugucaaaaaucagaaaauguggagcuagagugggcucuagacucagccaccuagagcauuggcugcucuuccaaagagcauguucaggucccagcacccacagcuuuuuguaauuccaaugccagaggauccagugcccucuuuuggucucuaagcaugaagcaugcacauggugcauggucgucauacaugcagagagaauauccaaauagaauacuaaaauacauuuuuaaaaaacauaacauccacagaauggccugugaauuaacugagcuauucccugcccuaugcccacaaaauaguucuaucauugagaaacuugguuuacuucuaaacuuucaaguucauacccuuuuaagaccuuaauuugaauugauaccaaaguaaggggcaggauuguguaguaugguuauggccuuagaacucaccaccugguuuuacuuuuacacuccuuuuacuaaggaacacuaauuagaaguguauugauuggucuucauaaaucaaucccucauuuguaaaacugaggguaaaugauaaaaucuagauuaguuaagacagcuaaguagaacuguaauguaaaauccaagagacacaaaucuaagaauacuuucguauuuucaauaaaaaaguacauuuaaaaaaucaacaauaacaagcacugccagaaguaugaaaucgaaauauaguauggaucucaagaucuggcuccugucacagaaucaaaugguuuuucaagcuauuagauagugauaaaaaucaauggugggucaauacuaggauugggagaauaaagaauagaaaguauuacugccucagaugcaacuauccuugcaguuuuguuugaauggccuuugagacaucugagggcaagaauuuuucauagaaacuuacuuggcuuuaaauauuaaaauguguuauuaaugauauuaaauauuaacauuuaauauuuacagaauuuauuguauucuauaaaugccucauaauuugugucauucucuccagaguccuaugaauuuuaaaaauccauccaauuuaaagauucaucagaggagaauuuaaucaaguauagugugagaugaguugguaccuaaacccaauccagacaagauauguugugcuauguucaaguuuuauccaucuacaaaacaaaaccagugacaauccuuaggaagggaagagacauaauuggaugguucuugauagaaaaauaaugagugcuaauacaaggccagacagaagaagagggcuugagcaaguuguaaggugcugcuaacaaauguuaguacugaaugcguaucauuauucaggggugggguuaauauuuaaagaagagcuuacaaucagcauguuaaacacuuaaaagauccagaauuacagacaugucugauaaagacuagaagacgcuuaaguuuaagcugagaaaaagagacuuaaaaauucaaaugauuuguaguacucagacugcauaauuccuccaguuauaaaacuaaaaaaaaaaaaaauucacuuuaaaaauuacauuugauucaauugauuguacacacauacauguggaggaacggagucaguucuguucuugguaaaaagcacuuuuaguuguuccuugaaaauucacugaaacauugacagauacuaaauuaaaaauucaguggaagccaagaauaaguagucuuauacagaaaccaaccuucacaucacccacaguauauucuaauugagaaguggggaaaaagaauacaguaaauggauaggaguuuacaagcaauaggauagagauaacacaaggagggggaaggcagaacggcccaugcuuuaguaaguugaaaugauguuucugcacuccccaugaaagaucauucuaugguccuuguaaaucuguuugaaguuucauugagaaaagccccgaagcuucacauaguauugcaggaguuuguuuuuguuuauuauggagaauagaaugcucaagaggaugaggaaaaauagcuugugacagaaaacuuauggauaugcaugauuauuaacauuuaucuauguugcuuagcaaaauucauauaacauauuuucacuuuagucuuacuaaauaauuugagaugcauauaaacucuaaacauucacuucagaguauaaaguaacagacauuuguauuaacaguuucccagagaaguuugggccacguauacaacaugacaagugguacuuuaacacuugaaacuggaguacauuucugcuauucaaugguacuuauuaacugugaggaaacacagcucuuuggugcucuuuuuagugugugugaacuucaaggagugguucucuccucccacgacgucaguccuaggaugaaacucagguugucaguuuugguagucaguagaucuccuuacccucugggccaucucaccggcccugauuuuccuuuuucuguguagccuuggcucccugaagcucauucuguagagcaggccucagcuucugagagaagggauuaaagguaugugcaccacccggccagcuuugaucuucauuguucuagcuagacugcaauauagcuuacauuuguuaauauacuaacaauuuuucuucucuuuagucuugccaauucacuacuuccccuggugcacaaaaauugagugcuuguucuuuuuccauuuuugcuuuauuugcugguguaauguacuaaaauuccaguuuaaaaaauacucaauauguauaacagugugcauacaagauuuuucugggauauggcagaagugcaaaguuaaaaacaaagugagauaagcaacaagcuccuuucuaaacaacucuuaaaacacaacuacuguuuuuccagugucuaucacaauaaagaacugcagaucucaaucaguuuaauaccccuuaugucucauuuugucgggaaccgcuaacuguuggcuuagagagaccauuccuaaacuuuuaccucuaucagauauuccugggaauaguaauuuaauacguguuuacgucacauaauugaugagccugcuuguaacaaacaucuucucaucaaacucaaguuuuguaguuucaaguccuugccuaagcccgaauacaaauguaauguucucauaagcugacauucucuucucuaaucuugaugcuguugaccuauuaucgaccucaguauuguucggucgugccgcuuacaguacaguccacuuugcuucgguuccucuucuggacgugcucuuuacuuaccuggucugacucugggccgccccacccuugcaaagaugccaggcauacuuuccgaguagccugccauucuggcagucccgguacgaguggcccaggugacagucggcugauuucggggcagcagaugagggccccagaucugugcuggugcucacucgucagccuccgguuccccuguuggggcugccccagguuuggcgaggucggucugccgcggccagaaggucacgcucaccuuggggccguccaaggcaagcaccgaaauaccuuccagggucagggaaggacagacaaguugccagccagggacuacgcucgccgaccgagccgcgcccguccggccagcccagcgacuuccggaucugcgcagacaccugagucaccccucccccggcuggcuguuucccggcgugcucugcggcggaaaggccgagucgacaauaacaaaccccacggcggccgcgacccagcccugccaagcucucagugccucggccggcggacucggguccccgcgcggagccgaggggccggagcagcggcugcgcccgacucccauccuuccgggccucgccggguacucggcggcugggcgccgacgguugugucgguuggcggcgccgcaggggcgguugauagccgccgccgaggccagggcggcggcagaagauggugcggagggccgccggcuguguugcugccgcgggcggaggaggcgcugccggguaagugccgccccugcucccaucuggcggcgggcuuggcccggccgcucagcaccugacggguucgccggagcgucuggcggcgccggcucggagggucgccgcggcaguccuacggggacccugaggcccgcuggccgcugacaggaucgcgggagcggcaggacgccggugcucacccgaggccugaaucgcggccuccgucuccagggcucggugcacuggagugucgggcucgggaaaccggagaggguuugggccagggccggagugcccugacgggaggaaccuagaggugaugccuuugucccgaccccggagugcaagcaucgguguaaaguuacuccuuggaaugacucagccucgcucgccccgcagauggauuuggggugggggcuuaugggaguaccaaaacuugguacaaaugacagcuuucgaacgugcugucaguacuuucucuacagagugguggaugugcuauggugacuguuuaugguuucguaauccugucccuuccgucaugagucuuuaaaaugugaucauuccaugaacugguacauaggacugaugccacggaacacucguggacucacuuauugauagagucccugcaagacauucaguugggugcggauguugacaagucuauuaugagcguuaaaauuuauacauuuugcuaaccauuuucuguaaagaauuggugagacuuacuuaucugaggguuugcaaagcuagcaagcaguuuagaagcagccuaaaaaugaaccaaucuguguuccuagucaaauguugguacuguauuucaguaggugguuuuucuuuuugggggaggggaucuauaaauggacuuguuaugugugaaauauuuuauuuagucuuauuaccaaauacaacgcaaaucaucgcuuuccaauuaaguuuuuguuauguuuuuuagcauuuauaucuguuuuaaacguuagccaaggcuuagaagguagcugcuauauucaucucaacauuccaggaggcugagacagaaagauggcuuuaaguuauuugaguuacucaguaaguuaagguggucuugggaaucauagcgagaacaugucuugaaaaaagaaaaacaaaauaaaugguauuuacauaguuaugccaugggugugucaggcccauaauguagcauuuacauugauaaaucuuauuaauguaauugguuaguggacuuaggcaaaauuuaaaaauuuuguuuuauuuugaguuagggaagacaaugaagcagcccucugccuggagagaagaggguucucuugggguggggggagauggagggaacaggcagcacucuuuauggcaaacaucaggguuugaaugcacagcagauugacuuuacacauagaucuguaaaagccaaaggacaaaagaugaaaggacuggugucucccccaguuguuuuuguuuauuuguuuuguuucuugccuuguuaguguguacugcuaggacuaaaacucaguuuccagcaugcucuguaagguguaauaucccugagccacuguuagaccugagaggaaaauguuucaacgacuaccugauuaagagagcuuugcuuagagguguacauuguaguugagguugaccuucagcucuuggcccccuuuugccaagacuugacacaucucagaguaagcugugguaaguauucauuagugaugccuugguaauuaauuauucagcagcaggcaaacuccagucucuuaucauucagaagaaaagugagaacauaagugaacauagaagcaagccaagauuaagaagugugugucucuauuggaggguggguuugaaauuuuggauaaggugucuuauugucuugagaauuuaagaagcuaugucuacuugacaaaaggacccauuuggagguaugagagagagaagaaauaaaaaauauggaaggcucugauuaaaggcauauuccaugagagguuacugaagauagaaugccaggauugagggguaguaguaggaagaggcauucuguagacauucaaguuuuuuuguuuguuugguuuuuguuuuuugcuuuuuuuuuuuuuuucucgagucaggguuucucuguggcuguccuggaacucacucuguagaccaggcuguccucgaacucagaaauccgccugccucccaagugcugggauuaaaggcgugcgccacuaugcccggcuaacauucaaguuuuaugcauaguaauuuuuuuugguuuuuuuuuuuuguuuguuuguuuguuuuucaagacaggguuucucuguauggccccggcuguccuggaacucacuuuguagaccaggguggccuugaacucagaaauccaccugccucugccucgagugcugggauuauaggcgugugccaccacaccgagcuguaguuuuuuuuuuuuguuuuuuuuuaaaauggcucauggacccugcauguguaaaggcacagaguugagugucagucgauauagcaagucugggaaacaguugaacucgaaucuguuccucacauguugauugaucuuacaaaguacaccuguaaauaacacugaacuagaguaacauauaucucauauguguguguuuagauaacccuugggcauuuuaaagaaggaaaaaugaccaauaucaauugcugguuuagaaaggagguuagagaagcagauuguggcauguuggguuaugcaauguacuuuuuagauaaaaucauaguacuuagcacauuucucuagaauucuuuuugcauuauggaccuaggaagcguaguuugcuuaucauaaaacugauuauugucuaagguccuaaaagcauuacuuuuccuuuuuacccuucuguuaaguuuagugagucugcaagugugugcagaacuugaguggucauaaggagacuuaguaguuucagcuuucucagauguuuaaugagugcccuuaagauuacugauuuuugcuggauuuaauucuaauauuauugacuuguaauuaugaaaacaaaaacguagugaucuguuuucauuguuugagacaucaguuuuuccuucacuauccauauaaaaauuggucaguagcugcccaaagaauauguauccagauuauaauucacuacuauucuguucuucccauagccuuuggugacagcaaaugacauuugauacugcccuguguuuauagucuuggucugauagaguaaaagcuaauucaguauuauagguaauuuggguuuuguuucauaguuaauauacacuguaaaguaaaauauacaauuagaaaauguucucuaaagucauggauuuuauauaguuuugaugaauuagauaugaugccagaauguuagugccguaguguaaaauuauuuuuauauuaugcaguucagguaagauacaugauaguauguauggcauuaugguggaaacaaaacugaauaucauuacuuguucuuuaaucuucacaaguacuguggcaaauugacucauaaaauaaauguaaucuuuaaauauuugggggcuugaaauguaucagcaguuaagagcacucacuucuccagaggaccccaguucaguuccagcacucacuuuauauugcucaccaccugcuguaaguccagcucuagagagauccaacaccaucuguagaacgaaggagagagacagucacaaaccgagacuuuuuuuggggggggguauuuuccuuauuuacauuucaaauguuaucaccuuucccaguuccuccccuuucuggaaacacccuaucccauccucccuucuauguggguguucauccacccacucccaccucccuugcccucuggggcaucuaucaagccuucauaggaccaagggaccucuccucccacugaugcaugacaagccaccuucugcuacauaugcaggaggagccauguguacuccuuuguugaugcuuauucucugggagcucgggggucuagcugguugauaauguugugcuuccuauaggguugcaaaccccuucaacuccuccaggccguuuucugacucuucuauuagggaccccaagcccaguucaaagguuggcugugagcaucugccucuguauuuguaaggaggcucuaacaaggcuucucaggcgacagucaucagacagacacucuuaacuauguagaccuggcugaccucaguauuauaaaaccagauuauuguguauaugaaugugccuacucuacuacugaauuccauuucugauuuaaaaguauuucuguucuguuuugguuacaagcauguuauauuaguuaucuccguguaaugcuuaccugagcaugcuuaccuagugucagagaaggcaaacacuuaagauaugaaccuuuaugaaacagauuuucuuugugaagaagauggcaguccuacuguuuucuccugguagcuguauauggggugaucuaauuugcagaggcugacacccaguuguuggucugggccaccuaaaaggugguacaccugauuugcagagacugacacccaguucguuuuuugguuuguuuguuuguuuagauuuauuuauuuuauguauaugaguacacuguagcuguauagaugguuguagccuucaugugguuguugggaauugaauuuagcacuuuggcuugcucagugccuacuugcucuggcccaaagauuuauuuauuauuauaaauaaguacacuguagcugucuucagaugcacaggaagaggacaucagaucucauuauagauuguuguaaaaccccauguuguugcugggauuugaacucaggaccuucggaauaacagucaguguucuuacccuuugagccaccucaccagcccugacacccaguucuuggucugggcaacccauauggccuuuguggugaauguuauuuucauugaugcagaaaccagucaucaucacucagagugguagaauugcuaagaacugcaguuugcagaauuagaaaugagauaaaauuacuucaaauugcuuuucuccaugaggccuuuaguuugcuuucuuuaguaacuuccagaucuugugcucuauuaaacuugaaaacaacuugaaaguauuuauauuccuagcacccaguaccacgccuggauuauuuagaucucccccauuccuacccccaccccauguauucggagucugaguguuuacuuugaaaaucuugaaaaccuugaaauguaagaaagccaauucugagguuuucguaauuuagaaaguuggugguaaggcuagagggaugggccuuauuaucacagugguaauuuuucaagaggaauuuuaaaauuaccucaguugaaaaguuggcuggacauuaaaauaauuuugaaacaaauucucacuaugaagcuuuggcugguuuggaacuuguuacguagaccagucuggccuccaucucugggauuuuacuaccucuacauccuuggugcugggauuaaaggugugcagguguguacugccauaccugacaaagcaagaugaauuuuuuucugagaugauuucugauuauuuuguauaaacauggaaguuaaacaucacccauauauucuguauaaauguaaugggaucauuuuuaauuuaaaaauuuuuguuuuagauuguuuuauauggcauuggauacccuggaauuggaguuguggagaguuaggaauugccauauggauguuggaaacauugaaagaacaaguguucuuagcagcuaagccaucuauccaccucuucccuccaucguuuauagccaacuaaaugggaaggaccaccuaaauuccugggcuacacacccagcucagaaauaauguuaggaccauauuuggacuuuaaaaauuuagauaagcagagauuggaggagcaauuuuuuaccuggccuagaaaugcaaaggguugguauaguuuucuucaugugugggagccuuggaugauacuucuggaaaaaggaaccggggugaauuaugaagcuauuaaacauugaagcuuaauacccaccacuuuuagugauuuuauuuuaaauacacuccaggacacuguaaaggauucuaauguacauuauugcucuccuccuuaccaacucuguaaauguaucauuuucaguuugaagaucauaaacugagauguuaagguauugagucccagugaaguagauagaaucuuagauagggauaaaucuuguuccaaacccugccuuucuaggugaauuaugugccagaguugucaagcucauauauguauugggguugccaacuuguuuugguuuuguuuuguuuuucgagauaggguuucucuguguagcccuggcuguccuggaacucacucuguagaggcugaccucgaaucuaccugccucugucucccaagugcugggaucaaaggcgugcacuaccacgcaggcccggcugggguugccaacuaaaggaaguaagugggaucauguagguugccuucucuggaauugucuuuacuuauuuugcagaaagacucagugaaaaggaagaaaaaccugccuugaagaaagcaggguuuagcuaacauuauaguacaugaaugguagcugcagagaagccagggaaagacaaugagaagcagaauuugaggccaccugguaggaauguugaaggaguggaauagaaagguaaaagagaauuugcagucuaaagguucugccaugacguccuaaaagaaacaauggacagaauuaaacagaaaugaguuuggauaccaggagaaugauaguuuugucuacaauaaaaugaaaguaaagauuuaaaggaaaagcagcaaauugaaaauuggacuuuuuggcugaguauggaguucagcaguuuaugugucuugguuuuuuucuuuuucuuuguuuuagacagggucucauguagcucagcuuggccuuaaacucacugagaauaaccuugaaguuaugaucaaucaucuugucuccaguucccaaguguuaugguuacugggguaugccgcaccuggcuucuacaauguuugggagugaacccagaaauuucucuauacucaccuggccaagcucuuuacacagucagccuuuugaaggcaguuacacugugaugcucagguguacuucugugucucuaccaaugagcauacaaguccugaaucuacaugguguaauguucaccugacauacagccuccuaugaguuuuaaucuacuacaguguaaauguuuguaaacaguuccuagaaugaacugcugagggaauuauaacuggaagacuauauauaguaauagcacacuugcuugccuacuaauuuuuaucucuaguucuaaacuuuuaguacuguuaccugaggucaaaguucaaguauguaccaacauaccugcucaucuuuuauaaaaacuuauuuuuauuuuguguauagguguuuugccugcauuauuacaaacaugccaggugccuucagaggggagaagcugugucagauccccuuggagucacagauggcucugagccuuauugugggugcuaagaaucaccugaguauccucuagagacguaacaagugcucuuaacugaugagccaucucuucugcaccccaacuccuaguuauugaccaccugccuaaguccugucauuaguuucuagucaauaacacaaaauuauauuucacugagaaaacacuagagagaaauaccaaaacaugucagucaugcuuauccuagugaauuuuagaauuucaauuggaggagagaaaaguuuuuuuuuuuuuuuuuuuuuuuucuccaaaagauaguacuaggaugauguagcaccugugugaccccagcauacaggaauucaaauauccuggaguauguggauggccugaacuaugcagccaaaucuuaucucaaaacaaaaacaaaaaaacaaaaaagccaggcgugguggcacacgccuuuaaucccagcacuugggaggcagaggcagguggauuucugaguuugaggccagccuggucuacagagugaguuccaagacagccagggcuacacagagaaacccugucuugaaaaaccaaaaaacaaaaauaucaggaugugcauacuaaacuuaaaaaugagaacuacuaagguggcacaagacacuguuuuagcauucagauugccacuaacuauuauguguugaaaagguaacaaacaaugcacauuggcuuuuucccucauucuuguuccuuccccuuucuuaucuuuuuucucuugagaccaaaaaaaaaaagucagucucauguacuccaggaagacugacuuggaaccccuaauccuccugucuuugcggucuguaccacccgccauaccuauucuacuggcagcaauguaaguuuaacucuuaaagagacuuaaccugcacuguguacuaaaaaugcacaaagaacugcuugucuguuuuagagucucaggguagucagucucaaauucaauugaccccccugacucugucuucuaaggaugcuauuaaguguaugcucguacaccugcugcuugauuuauuuuuuugggggggugauuguuugcuugcuugaugagauagggucucuauguagcccuagcuguccugaaauucacuacguuguucuguuucaccuugucuccccuaaauggucacucauauuuacuccuuuaauuuuuaucuuuagggagacagaagaauaaaaacagaugacucagaaaaccuauagucaagcucugcccuacuauaugaccuugauuggauucaucuaccaguucuuugauuugauaaguaaagaccuauuucccaagaaauaaucuucauauggagcaauguccguaucaauucagaccuaucucauacucagaaauaguacucgcuaauguaaaaucuuuccaacugcaaaucccauuguucaaacaugucuaaauguauucuucuuuucccuuguuuuggggauugaguccaugggaacauuuccccaagaauaaagaaaaaaaaugacuuuuuuuaaugcuaguucugaaaauuaaaugcaacaaacaaguuuaguucauagaagcaacucauggaauuaaggauuuuuacauaaauuaagggcagauguaaaaaaugaauaaugagcaaucccaaaguuacaaguuaauaguuuaguuucguguguguguguugaggucagaggaugccauccucucucaccaugcggucagcuacuauagguggugcauuuacuuccugagcugucuugccaggcugcaguuguuuuaggaguuaguugugcucagugaggauacugaguuucuaauuggaguugguuuuauguaugcagauuucugguuuugguuaauugaagcguuuguugugggcuuacaguuugagugggugagaccauaacagagagcaugacagcaggcagccaugcauggcaccagaauuuuacauucuaguguacaagccugagggagaaaguugccauuuuuaaaaaucaugccuucuuuguguguauucuugucuuuuccuucuuaggauaacauuugcauacguccuuucuugauauuuagucauuuuguauguugaggucuuuuuuuuuuuuuaaaggauuuuuaaaaaagauuuuuauucauuuauuauuagaaguaagacacuguagcugucuucagaugcaccagaagaaggcgucagauuccauuacgggugguugugagccaccaugugguugcugggauuugaacucaggaccuuuggaagagcagucaguguugagccaucucaccugcccccgagaucuuuuuuuauauaaauuuuuaaaaaagauuuauuucuguauuguauauaaguacacuguagcugucuucagacacaccaagaagggcaucagaucucauugcaaauggugcugaguccugugcacauuaagagguucuaagcauaugugauugggauauuauuuugcuuuagacuuuuaaauucagcaacuuuuaauaccccccuuagaaaccacaauguugaauguucagugaguuuacccaauucuaaaguuagaaaaggcucugaagacugccucuacccuggagacagacugcaagcauagugauucgcagacccucaccucaaacuccugaugagcaccuuuuguggaauagcucacaaacuuagaaaagcacuguacuuaacuacaacuuuuaugcaaauuaaaaucaggcuguugcuuauagaguugaaacccuacagcuuccgaagucggccugcucacuuuagucaaagcaucauaccuuuccuuuuucugucaugcuuugagcauguucucccuagcauuuuggaguucacuuuucuaaagcuuccuacuugguuccauggcuccuugucugccuugaagcugacuuccaugcucgguuagcuuaaauggcauagccuuuuucuuuccuuccucuuccaagcagcuacugacauuuacuugcuacugugagauuuuuuuuuuuucuuuucaaaaaaaaaaaaaaaaaaaagagggguaaguagaauuuagaauuuggaaaggauccaaauuuggagccugggacuguucucuuacugucaucuucaggcuguaauacuuucuggugucaggaggucuuuaguuccuuucgucauuaguuauuugaagcccauuagaugucaaaucccuggggccuagagauuauuugauagauggugaagacagaaagcagaccuuucagaagaggaugguucuucaccacaaaggugcacaaagcuguuuugcugccuugcuuuuacugaugcuaugaaaaauacauauccugcaaagggcuauagucaguguugauacuaacauuuccagauuaaucucccccauaccccuguaguugaacuaggacaucggcaagcauucuacuacugagcuguuccucugaaaauguuuuauuuuguuuuguuuuuaaauaguacuagauauugaauauaagaccuggcugugcuggaauugcaaguguguaagugccaacuuuccuaguugcagcugcuguuugguugaaauuauguagcaaacugacuuggguucagccccuggaauuuuuauuuguuguauuucuaacuccaagcaggcuaagugccuucugaaucuucauuugcaaauagaaaacagcaguacuauuaccuuacauguugugauaaaugacgcaguguauauaaagcuauuuaguauacugauuguaacaggcuuggugagaacagugacugcuaacuuucuguaccaugcauguucuuggaugugacaacaaauacagguggagccuuauuaugugucuugguuucucuguuguucuugggcaggacuuuguuagcugccguuauuuggugugaggagaaugagggugcaaauucaagagggagcuucugagugaagcugccaaucuuggaacucacaguagugauccuaagugacuccucacagcugccagucaguggaugaaagcacaggcuuccauagcuaaggagcucagggaugcuucucaauagaucuuuaguagcuucuagacuugagcuaaguagcaaaugugguacacagacauaccccuaccucauuuuauacguguguguguguguguguguguguguguguguguguguagccuugccuaaucuuuaagauggcccuaacaguggaguuuuuuuuguuuuuguuuuuuuuuuuccucuaaugauugaaguucacaguaguuuagaggcuauguuuauccuggucacugcauacuuauacucuaauauagugcuugauguauuuagugggugucuuaguaacuuuuuguuuguuuguuuguuuuuuugcugugaagagagaccaugacuaaggcaacuuuuauaaaggaaaacauuucauuggggcugacauauaguaucagaagauuaguccauuaucaugacgggaagcauggaggcuugcaggcagacauggugcggggagcccagauuucuauaucuuaaucugugggcagcagaaggagacugccacgcagguuauagcuugaucauaggagaccucuaagcccaccccaccacaggaacacacuuccuccaccuagaccacaucuaauccaacaaggccacaccucccaauagugccagucccugugggccaagcauucagacacaagcaacuauaggggccaaaccacuagauuagggacucugugaaugagucuuauuggcagucaaagaugguaugaaauauaaagaagugaauuauuacaggggaggauaugauaguguaaauggauauauggccugaggaauguggguugguaaaggcagcaaguuuguaauauauauacuccaguaacugaaauauuggaauguucaaggcaggacuagugaugugucucgguaaucccagugcuuggagcaugaggcaaguuuaaggcuaguuuggacugaguaaugagacuauuucucaacaucaaaccaacaaaaauugaguguuuugauguagcaguuuuacuuuuuuuguuguuuguuuguuuuucgagacaggguuucucuauaucccuggcuauccuggaacacacuuuguagaccaggcuggccucaaacucagaaacccaccugccucugccucccaagugcugggauuaaaggcguacaccaccaccgcccgguguaguuuuacuucuuaaaaauuaaucuuuuagaaauaauucugaauacaagaagugaauauauucugugacauuaaacuuuggaggcuaauaaguaaaaauuguggagccuugaauggaaauauuuuguuaggcauuaguacuucaggcuaugaagcauucaugauaauuuggugauuuuugucuuuagugaagcauuauaggucugcauuacaguuguagauucaguaaauauguaggcagaaaaacuggaccagauagagaacuguuauuauagauggcaguuuuaaaggaaaagaaugauuauguuguuuugacacugaauuauuucucuagaauuauuucucuauaaugauuuugaaauuucucuuuuccaguucucugaguuucaccaguaaugccacucaguugccaauaucaagcaagcgcauauaagacacuuguaaucuuuuaagaaaaguaguacuucucuucacaguaucuggcgguaagucauacuuaagccuuuauaacuguguuuuugauccauugacaucauaguuuuaaaaccuuuauuuaccuuuccuuaagagaaaauuuuauuuuaugacucagaagggaagaacauaaaccaugcuaaucucagagguuaauuuuaucaauuuuauuugucuauaggauuucuaccaccugcuucuuaaaaacaaauaaugaaggaaaaaaaaaaaccuaagaucuuacggucuagucgugguccuucauuaugaaguguucacaaaugacuuuuuaaauugagcaaguuaauggcagaguaccuuuaaauaauuucauuucgagauccauauucaauuuauaguuagugguagaaggugauuuuuguuuuuaaggauguguuuauuuuuauuucuggguauaaguguuuuccugcauguaugucugugccuggcgcauucaggggcuagaagagaacauuggaucuucuggaacuaaaauuacugcuaguugugagucacuauguaagugcuggguauugaaccuggauucuauaagagcugcaguagugucaggcgugguggcgcacgccuuauaaucccagcacuugggaggcagaggcaggcagauuucugaguucgaagcuagccuggucuacagagugaguuccaggacagccagggcuauacagcgaaacccugucucaaaaaaaaauaaaaaaauaaaaaaaagagcugcaguggucuuaaccacugggccaucuguccagucccuggcugcuggcuuuuuugggguaggaaaaggguuaguuuuuuuuguagaguagucuagcucauuaaagagacagaauacagacuaagcagcaaccaaguaggaggaaggucugugugugugugugugugugugugugugugugugugugguauuucuuuaacuugaaaucaauagcucuucucuguuucugggcaggggaugugcacacaguucaugggauauauauauuauauauauaguccuguauccuggaguggaggcaagaguuggaugucauuugucuugcucuaucucucuucugacuuauuuucuugagacacaauccuccucuaaaccuggagcuagguugggaccugcaaguuccagugagcuuucaguguuuuccuuucacauuauuuggauucucagcuuucccaugaccugcccuacuguuuauauggguccuugggauuugaacucuauccucuugauuaagcagcgaguacuuuugacccguggaaacaucuucuuagccuaauaauggccaauuaauuguaguuuuauuugcucccugaaacaagaaggcagagcagugccuuuggaguuuuuguuuugagauuaaaaucacugcuucuuggacuggccuggaauuuaauauguagcccaggcuggcuuugaacuccaagccaucauccugccucagccuccugaguacugggauaacaaacagguaagugcuccugcccucaauauacacauacacacuguuuuauguuguuuacuccucuguuaaagauucaaucuagaccuuuuuugucuacugcauucaaaucaauuacuccguugaauuucuccuccagcccccuagccccuggcaauuuuuaauucagaguauagaaaacaagaaauuauacacauuacuuuucuaaugguaggccuguuuucguccugcacaaaagcugucuguaagguguagaacuguuaauacuuuucacuagccucauucaaaacaaaacaaaacaaaacaaaacaugaguugcuugcauaguccaauauaguuaucuuaaaaucaacagacauuuuauuuuuuguuguauaguaagacuguucuaucauagugaugaagguauucaaccguauucugaaaugguucccuuuguuuuuucacuuaggaucaacacuggagggugaggugucagcuuccagaaagaucaucaugaaguuauauguguuucugguuaacaccggaaccacgcugacauuugacacugagcuaacugugcaaacgugaguuauauugcacuuauccuuugguuuuccaacuuaaugaaaaaaauuacuuuauuuuaagaaaauauucuaccaugauaaaaccaagugcaaucugaauuuaaucccaaagcccaagccgaaaggacaguuuaaugacuugugcucuuguaauggaagguuagggaaucccucuggacagacggucuagccuaguuuggugaaauucaaaacugacagacacugucuucaaggacguaaaucuucccaaggacaacacuuccugagggagauuucaugugaucucaugugcacauguaaccacacacauaugcacacacacaaaauaugcauuugcauacacauacaaacguuuuuuaaaguucugcuucuuaaacagaauggggcuagggaguuggcuuagcaacuaaagaccaguugcuguugaagagaauacaauuugagucccagcacccauauggcagcucacaaccaucugaaucuucaauuucagggaauccagugcccucuucugaccucugcagcaccaggcacauguaguacacaaugaacauaaaaauaauaaaaccaaaucuaauuuuaaauaauuaauuaaaaaacuuacuuaauuuaagggaaaaacguaaccaauauauaugaaaaaaaauagcaagcugggaauguuaaacacaaguuuuguccccccacucaccuuggagguagacagaaauccaaguuucaugacaaucagggauacuuagugaaacuuugucucaaaaaacaguagccauauaguaaaucucaaaucguaguguauuuucuuacucaucauacauaauugaugauaaaaugcuaaaauuaauuucuauaaauugugcuuucucauuuuugcauaacuguuauucacaauuuuaaaaggguaauucuaaacuaaaaguuuauuagagcaguaggcaucacuuugcuauuuuugguaauuuuuguauuacauuuuauuugugugugguguguguguguguguguguguuuauguuuacgcuugcacaugcaaaagagcauguguggaaacuuagaggacaauuugugcaaauugaguuaucuuuaucaucuagaucuuggggauuaaauucaggucaucaagcuugacaguaaaguaaguuucuuuauccacugagccaucuuguccauuuguuguuuuuacucuugugugaauuaagucaauggguuugauuugcuuauuaaugagagaauaaaacaaauggacuauuuuuaccuaauuuagugaagcucauuucuagucauuuucuauuugguuaggauaucaaauauuugaauauucucauaacuuuauaaaguauaaagguuaguucucagggcaaggaaaaauuaauuugaguucucauaggaaaaagaaacaaguaguuacauaccacuuucaaggcuauuuacuuuauuguaacgauucaauagcacugcagaguaaucucauacugaaauuauuacaaauaauuugaauaauuucuauuuagaaaauagcaguaagauagcuagaaagauggcucaucaauuaagagcacuguugcucuugcagaggaccuaggguaugugaugcuggcuucugggcacaaaacacacacacacacacacacacacacacacacacacacacacacacgcacacaugcacggaaagcacugauaugcaaacuaaaaaggcuucccccccccccauguuuguugguuuuuaguuuuaaaugguacugagguugggagagggcuucaugaagucucugagaaucuauaauuaguuugugaguacuggaggcagaaagauauuuuccuuaguaguggcucuacuaaguugcuuauacuccuguauauaaaccccuacccaugcucuuaaaguaaccccaguuaaaccuuaaaaagaaagaucagcaugagaguagaagaaagauggcaaguagcuggaaagaggaaggagacuaaugagaguauaagggagauaacagaaaaagagagaauauaaaauuugggaaaauguugaauguaacauuaauuaauauguguuauuaauauguguaauuaauaugugcuaauaaaacgcuuuuuaaaaauggcacuuaaaggagcuggagaguuagcuuuggaaguuuuugcuaugcgagcaugaggacuugaguuuggaagcccaaugccugacguuucaaugugugccuguaaccuccagagccuggagagacagaugaauccauaggccuugcucuacaaucaaucuagccaaauagugagcuuuagguucaauaggaaaccccaucucaaaaugugguggaaagcaauggaggaggacauucagcauuaaccucccaugucuacaugcaggcacaggugaacauacccaguauaugccaaguacacauaaaugcacaauuauuuaguuucaugcaugguguaggcuuaugaguguuggucauguguguagaugugucaugucuuacucuguuacccccauccuuucuuuucaccauugagguaggagcuuucauugaaucuagagcuuucugauuuggcuagccugccuagucaauacaucccaggggucuggagguaucugaauguccccuugcuacccuagaacugggguuacagacuuggaccagcacacugccuuuauaugagucaugggaauuuaaacucaaggccuuuugcuuguacagguagcacuuuaucgccccagcugucuugaauucacguuuuaaauacauucauuuuguuuguuuguuuuuauuuuucguuuuuuugaguuuuuuguuuguuuguuuuuuguuuugguuuuuuugagacaggguuuccucuguauagcccuggcuguccuggaacucaaucuguagaccaggccggccucgaacucagaaauccgccugccucugccucugccucccaaguacugagauuaaaggcaugcaccaugacugcccggccaauccauucauuuuuguugaugcaguuuuucuucuagaagaauguuuucucauuaacuaagcccaggcuugccuugaacuugcccaggauccuucuagaauuuuuuuuaaagauuuauuuauauuaugaauaugacuacaguauugcuguguucagacacaccagaagagggcaucagaucucauuacagaugguugugagccaccauaugguugcugggaauugaacucaggaccucugguagagcagucagugcucuuaaccgcugagccaucucuccagccccucuucuagaauuuuaacauguggcuauaggaauuuuuuuugaagcaauuuuuacauggcuuagauuuacuguacuuucuauaauguauuguaaaaaucuuaaacacaaacucuguguuuaaauauacauguauguucguuuauaccuuucaccauuauuuaaaaccccccaaaauaauuuuguaugcugccuguauuuuauggguucacuuuuagauaugaaaaacauaugcagccgggcgguggcagugcacaccuuuaaucccagcacuugggagguagaggcagguggauuucugaguucaaggccagccuggucuacaaaaguugaguuccaggacagccagggcuacacagagaaacccugucucaauaaaacaaaaacaaaacaaaacaaaacaaaaaaaaaaaaaaaaccauaggcauuuaauucauuuaauucacagccaguugauugugguaucuaauuuaaaaaacaggaaacuuuuacuacuaucuuuuugagaaaagccuuagaaugaaauucaguagucuaaggguguguguuuguguguguguguguguguguguguguguguuaugaaguguuuuuauaaagguacuacaaauauguaauaacuggauuuuauuuuucuaaguguggcugaucuuaagcaugccauucaaagcaaauacaagauugcuauucagcaccagguucugguggucaauggaggagaaugcauggcugcagaucgaagaguguguacuuacagcgcugggacgguaggugucaaagauccucuacugcauagucugcuuucuuagcagaugggagcaggggcuuuguuuuuguauuaagggcaauacacaaguucaccauuuauaacacuuacauuuuugucauuucugcauuuuuugauauaggacacaaauccaauuuuucuuuuuaauaaagaaaugaucuuaugugaccgugcaccugcuauuccuaaagcuaccuuuucaacagaaaaugacauggaaauaaaaguugaagagucucuuaugaugccugcaguuuuccacacuguugcuucaaggacacagcuugcagugguaugauauaaacaauuccuuuaacuaauugcuucuaaaagcauuccaaucuagauagcagagaagucaaaauuaagcauagauaacaugaaaaauacuccccuuacaguuuuuuuguuuuuuuuuuuaauuaugugugcacuugucaaagaacaacgaguggcaguagguucucaguauaguuuuaggaauuaacuugucuacuugguagugugugccuuucccuaauaccugucucauaggccucuuuauaacaucguccucuacuuaagagucggguugaggguuguggcuauagguugaucauaguuuaagaacaugcacuguucuuccagaggaccugaguuuggauuccaggauccauuuugggugaugcacaacugucugaaauuccagcucuaguguaucugaugucucaaacuuccauagaaccuguacuuauuugguguacacacauauacaauuaaaacuaguaaaaaucuuuauauuuuauaauuaauauacuaaguuuuagauaaggaagaaacauguuucuuagaagcugugaaguagcccaguuuauguuuuccuuuagaaggguaacguucagcacaguuucaguguuggucgcuaaagcguaggagugcguuuagauguguuauauaaugcuggacaagauucuuguggcaggcaaacgggcgagcacaauuugcacauugcagucagaguggcacauugguuuauuggaagcagauggggauguaugcugaggaagcugcuguucagccuaccuaauagggagccacagacuuuuauuugguuuucuuggaguagguuaaccuuuugauauuuguccauauauuuauuagucauggacuuuaaagaugcuuuucuucuuguccacaagcaaucucacuuugugauuggcugguaguaggaagugacuuaacccaggauugcuggguccauuuuguugcuguugucaucaucauguagacuuggaaguucuugagucagccugagacccucuuggugguggcaucaaggaaaaaaauucagagggauuauacuuaaguauuaaggaucauacugugggcugggugguaguggcgcaaugcauacuuuaaaucucaauacucagaaagaaggcagagaaagguagauuucuaugaggccagccuggauuacaaagcacguacuaaguuccaaaacagccguggcuacacacacacacacacgcacacacacacacacacacacacacacacacgcacgcacgcacgcacacacacacucucacacacacacacgcacgcacacacacagacacacacacacacacagacacacacacacacucacacauacacacacacgcgcacacauacacacacacacacacacacacacacacagacccugucuugaaaaaaaaaaggaggggguuaugcgugagcugagaugauuucuuuauuguagauaaaaacauauuaaaaaauuauauaguuggguccgagagauggcucagugguugagagcacugguugaucuucccgaggacccgggcucaguucccaguucccagcacccacauggcaacucacaacuaucuguaacucuuaagaucugacacccuugaacauguauacaugcagacaaaacaccaaugcauauaaaauaaaaguaaaaguaaauaguugaaaugagaguaaggaacauuaguauugaaacucaaaauaccaggcauugcuauucuuaaaacaagaauaaagacauuuuagaaaccucuucauucuuuggggucuugugcacuuuuauguaggggaaauuuuuuaucacuuuuaaagguaauuuuuagauaccuuagcagcuuagguaacuuaccuuuguuaaaggaaauuggucagauguuuucuuacuuguagaacugagauaaauuucuccacuccugugacuauagauauuuucugaauauuuuuugauguuguugguuuuuguagggguggguguguguguguguguguguguguguguguguguguguguguguguguguuucauaauacaggguuucucuguuuagcccuguuuguccuggaacucccaguguagacuaagcuggcccugaacucagagaucacccugcuucuguccaccaagugggauuaaaaaaaugcaccaccacacaacuaucuucugaauaucuuuauuuugugcuguuuuauguccucauuucuaauuuuuaucauaucuauuacauguauuauauuuauauuuauuauauguauugauucagcaaaugucauguuugaucccugagucuguuuguucacugauacuuuucuuucuucauuuugcccaguaauaguagguucaacuaggccuuguaagcuuccagccauggacucaucaccaggcauggggaaggggggggagcguuucacaggcauguuucacauucuucacaggcaugcauguguuuucuucugugaaacgagccuuaaauuagaaagugauuaauuaccccaguaacauuuugcaucuaaauuuucauugauguuguaagaucaguauucuuacccaguaaucauagcaguucacagaguuuccagcuggguaagaauguugcugucuccuaccccucuacaguugcuugaauagcaacuucuaguacuaugagagucagccaacagagaagcuuccuggucacuacuaucuuuucuucuuuuuuuuuuuuuggaugaaugugugagcugucuucagcuguaggguccuagaguccuaccacaaauucucauggacaacuaagagcagugauaaccuauauuguguuuuugugggggcuggcccccuggcacacuccuccacugacauauuaauauacauauccuauaugcagugcuauguuuuauaauaguaacuugcucucuuucugucaguuucccugacacauauuggaugugucuaacuacguguguuccucauacuuuugccuauuuaauguuaguauuacacgugugcaccaccaugguggcccacaguaaaaucugauugauuuuugguagcauuuugugagauuuguagcccuuucuucucuuucucuuuuccccucuagauuauuuguuauuaaguaguuauauuuuuacauuugcuauuuuuuccacuuaauuacuucccugcauuuggaaaacuucuuucuuaauuuauguccauauucucuuuguaccuucguauuuggucugaacuugugaaaguggucacuuuaacagaguguuauuuguuuucggcaggagcagaauuuuuugugacagggaacuucuuuuuuuuuuuuuuuuucagaaaucucccacauauugcuuuuuaguuugcacuugauacuucauucuuuauaauugaauuccaaucaucuguucuuagaaaucauuugauucuugaguggucaguuagaaagaccuugcuggugaagcaugaagcauugccuccucaacgccuguacaaaaaacugggaaugauggcgugugcuaauccuaaucccagggaugggcagccaguagacagaagugucacugaggcuagcuggccaccagcccagcuccaggcacagaccuugauuugaaggaaucaaauggaaaguggauacccagcaucuuuuuaacgcuuccaaguucauauauguauaacauauacauagcauaacacauacauagauacacacaaacacacagguuuuuuauauuuaaggacuccuacaauuggaagaugauaagguauuuucaaucuuucauguuugacaaaaauguuugugaaaauguauguuugcauuucaaacauacauacggaccauugcuuucuuuuauuauuuuccuuuuucauucucaaacaggaaauguaugacguugccaagaagcucugcucuuucugugaagggcuuguccaugaugaacaucuucagcaccaaggcugggcugcaaucauggccaaucuggaggacuguucaaauucauaccaaaaacuucuuuucaaguuugaaaguauuuauucugauuaucuucaauccauagaagacaucaaguuaaaacuuacucaguauguuuaucauuaugugaauguuuaaaaugccuuuaucaauacuuuucuagucccuggauauugguuggaggcuguguuuauuuaaauaaguauuuuuagucucuuaaagcauuuuuauuauaauuaucauuauuauuauuuuuuguguaaguacagggauguguguuucagagugcuuacauaaaaguaagagggcaacuuuuugauguugguucucuccuccggcugugggauucaggcucuuccuguuacccacucagccaucucucugacccaucuuuacagucacacuuuaauuguguucuugguuucuguuguucaaucuaucuaagaaucucuuccuagcuuuugcccaauugagaaaauauaaaugggggacagggaagaccagaacucacugacauggaaaacuuagguccuuuacauuuaaaucaagugucguugaguuuuggaaggaaagugcuaaaauaauguauaauuaauaugcaagugaacaauacuucaaccuuagaauaucuaguaaaugcuauauaaaugcuaguauauguacuuuucagauuuuguauuuagguuuuuggguuuuuggggggguuuuuguuuuguuuguuuguuuuucugucuucuuugaauuuaccuuagaggugauagcauguguauucuuuccuuuccuuaauuuuucuuuucuuuuuuuuuuuuuaagugaugcuugggaacucaaccgucgcccuuuccuguuucauacaagcaauuuugcaccccaacccccaugacuccuuuuccucaguuguuuuaauauuguagauugacuauuuuaagacaaguuuugcuccuuaguucuagacuucagaagaaauauugguaggaaagagaaugaauaauaaguaauaguaaaagaaucauuuuaauuguuuauuacaauaaccuuucccacuaccuaucuuggagagggaguccuucugaucauaucaauuuacuuuaaggaccugaaucuauuaacauucaguuuuaugauaucuuaaagauuacauauuuuccuccauauucuuuagcagcuaaacucucuuaguccauuuuugauauaguuaguauaagaguuauccuaaggcuaaaauucuuaauuuaauccuauauuuuuaauauauuaaauauauuugauugugauaaagccaauuacagugugagugacugcuauggucagucuucauaaauuuuaauguuuuuuaauuaauagguuguauuugaaacaaauuugaaagucagugucuacuucuuuaguauaaucuagcuagcuuugcuuuaaauuuguauuuuaacguuagugaucgccucucuacuaagcuguacuuuuaacuggcuaauaaaggagcuuauaugugaauaaagacauggagcagugguaaggcugguauuuugaaguacagugugauuucguuggaugauaguagaacacacucguuuuacugacucauguuuuguaucuuaaguuuaggaacugcuguuucaguaauggccaagauuccacuauuggagugccuaaccagacauaguuacagggaauguuugggaagaccggauucuuugaaugaacaugaaggcucagagaaagcugagaugaaaagaucuacugaacuggugcucucuccugauaugccuagaacaacgaacacauccuugguaaccucauuucacaagucaauggagcauguagcuccagaucccaccgguacugaacguggcaaagaacuuagggaaucuugucaaaguacuguccagcaagaagaagcuucaguggaugcuaaagacagugaucugccuuuuuuuaauguuucuuuguuagacuggauaaauguucaagauagacccaaugauguggaaucucuggucaggaagugcuuugauucuaugagcaggguaaguugugugugcgugcgugcgcaugcgugaggaugauuaacagcagaaccugcguuggaguuuggagacuugaucaaauuaucuguaaccaugcuuuugaguugauuauaaauuugggaagauuauuugagcguaaauuuuuagugcaguucaaaggguuugcauuaauagauuuugagugguucaagaauaaaucacuacaaauuaaaaaauauuuuugaacauuuccauuauuuggaaaguggucuuuuugcaguaagcaccucccuacaugagaaucuuaaacuauucaucuccuuaagaauucaucagcaagacauugggcuuucaguuacaacucuagaaguaaacccaggauaaaugucucuucauauuugcucuguaaauugauaaaaagcauuugcaucagaaagaaaauugcuuuagugacacaaaaauacuaauguuuugaagauuucaguugucagaauacgaaggacuuugcuuaaagggguacuuaguuugaaaauagcuuuaguccuugauucauucaaucuugaaaaaacaaaacaccugaauauuuggucuaggauaccuggaacagcaugugccuaccuuauuuaaguuauaaguaaaaugagaacuuuaagaccuuggcuuccuaauauguucagcaucuuuguccuugauaacaucugauagaugauaauuuaauuguuuaaggcacuugccccagcaaaaauugucaaaugaaugaaagugagccuaguauuucugcuuaaauacuaauaucuuaguaucugaaacauccauuuaugaaugcaugauuaaccauauaacaguggucacaguaaccagugccauuuuuauaauaacaacuguccuggaauucagaauaguuuugcauaaaaccuguugcuugcuagggaaguacucuacuacuguuguaucuucugaacuauauaagcagaguuaacuuucccgggcugacuuugaacucaacuguguaguccaguuaagucuuuuuacaauccuucugccccagccuuuugaguaccugggacuauguaggacuugcuaccagauccaccacgagacguuuugugaugagugagugcuguuuaucucauagagguaguuuugauugccagcaguauaauaaacaaaaggugcuuagauuuauuuuuguuugcauuuuuuauucuauuuagagcccuuaguuucauagauuaguccaauuucuguuguuucauaguguauauuuauaauguauagugugaacucccauaacugccucaggaaaugaguugggacauaauuuuuuuuggaauuuaauguuuguaauuucugaauuccauaccagacacuucugguuuaugcuuuauaaaguucuuaucaaucugaaucccuaauuuuuauauuuguuuggacugcuagauaauuucauaguaguuuugcuugcaacccaguuuuuauuuuuacauaauauucuauaauuauugauuuuuuuguagacuuccauuucacaaaucaaagaggauuuauuuuuugaguauuucuuuuauuuauucauuuauuuuuuaauucgguauuuucuucauuuacauuucaaaugcuaucccaaaagucccccaugcccuuauuuuuuuauuuuuauucauauauauguauguguuucugugggugccuucagagaccagaagaaggcaugacaucuauagagauagauauacacauggcuuugugcaucuugaugcggugcuaggaaccaaacuugagucuucugcaauagaauugugucuuuuuuuuaaaaauuuuuuuauuauuuaaauguauuuuauacaucaaacauauuuauuuugagagucaaauaauacauaaaaaauuguucaucuuaauucauauccuuucauacccuaaaaauaucauuaaugaauauuuaauauuauccauaaccgaggauucuauaucuaauguucaauacugaauuguuucaaaacauacaaaauauucucuuggggcuaagcauaguaaaauaucauaaaauauuaaaaaugaaucauugagaacuauauucaaaagcccuuacaugauaaccugacauagugggagacuauuuaaaacacauuauauauuuguguacauugucuaacaaucaguuuacuuaaaaaagauuaucacuguuucuaggagaaaaauuauuuuaucagugaguauauuuuaaaaaauuuaaaauagcaaaaacucuuugaaguuaaacauuaagaaaaugcuaauuucaaacacuugagaaaaauuaccaauaauacuucuaugaugauuuuaauauuuucaacuguuauagucuuugggaaaauggaauaaaauuauccacaaaauauuaaauaaauuuuuaugacacuaagguuuuuuuuaggaauuauguuaaagauaaauccauuguuuuucucuuccugaccauuguucacaucacuugaauuaucauccuguuuuauccuucccuaaccuuauauaaagggccuagucaaauuccuccuuuacacaucagaacgacagucaaaaagaccccgaucagcaagaugauuccauggguaaaggagaucugaguaugauguuugaguccuagauggcugcaggagggaauugauucucauaaguuguccuuugaccuguauguauaugucauggcuucugagagcucacaaucgugcccacacacauguguauguauuuacauguguuugcacauauacaaaaugaacacaguugaagaauaacuuagaggaugccuacaugcugcuauuggcagguauucagaaccccugcugaggcaggaaggcugaacuaguuuuccuccauugaagguugagcuuaggaucugacaagguggcccaguaggucaaagccugaaacuucauuuuaacccccaggacucauugugaaaggagagaaggcauuuacucaugcccuuuuacccaccaaggcucuagguuuaggugaggagauaguagaguauaccacaguuccaggagccuuuaaugaaacaaggucauuuaauaucugugaccaguuuuacuagaaaacaggcaccaccaagcgcaucauguaguuaaauuuuacacuacaaacacguagaacuaaagucagaggacaggaaaaauuaacuauuaagacaucucauugaccaaaccauuuccuuucaauagagauuaaguuuaagcuuucugucccauuuguuaaggaaaaaccuugccuuuuuaaagaaugggaucuugcugaguugccuaugcuggccugaacuuuugguuuaauucuaccuugcuucuugaguucugaauuacaaacauaugccaaacauaccuggcuauggaagaugcuuugagagaagaugaguugaugaguuacuaccaaagaguggguuugucauuagcuccacuuuauauguccuugaugacuuugaaaauaacauucuuagggauacugagaauuguuuaaauugguugagaguuaugauuacugaaguuauuauggucuugacuuuuauauugugauuuguuuaacaccaguuguuuaggaugggguucauccuauuaaucuuccuuugcuaguauaacuuuauuuccugugcauuuuucuguaucauuuucuauauccuuuguaucuuagucuguaucuaguuacugugaaauauaguuaaaacuauuuccagaagauuuuacucauauauguuuccuucucauuuagcuugacccaaagauuauucaaccauuuauguuagaaugccaucaaacuauugccaaacuugauaaucagaauaugaaagccauuaaagggcuugaagaucggcuguaugccuuggaccagaugauugcuagcuguagccggcugguaaaugaacagaaagagcuugcucagguaucguguuuaugaccacuugauuucuagcucccagaggcaagcagcugaauuucauuuugugcuagugucccucuccucauucccuccccuucuuccucccgcuugucacacuugauggacuggaguuuuccuguuuagcccaggcugucuuccuacuuaagugcuguggucucugcuugguaguuauauguuuuuuauucuuugugauguugauguuuuaugugcuuauuuuuaauaaaaaaccacaaauauuauaaaaguuuaagauagcuuaaauuuuguguuuccaugacauuuuaaagaauuuguuugcuuuuggcuuguguuuguguuaauuauuuuaguaaagcuuucaagcuacauauuguuguaaguuggcuuucuguccuuggaauagccauuucuuuuuaccccccacccgccuuuaaugggagauaggaauuuuaggaaucuaaaugaaaagugguuccuugucaguuuuucucuugagagcuuaugucauuuuccuucccaaagggauuuuuagcuaaucagaugagagcugaaaacuugaaggaugcaucuguguuaccugaucugugucugagucaugcaaaucaacuaaugauuauguugcaaaaccacagaaaacuguuggauauuaaacagaagugcaccacugccaaacaagagcuagcaaacaaucuccacgucagacugaaguaagagauuccgucagacuucaguuuuuguguuuuuaaucuucccaguaauaacaguaauuucauugaaaugcauauugaugaacucuaggguuagacuuuauagagccuugaucuucauagcuuaccuacaaaugacuuuuagcaaauguggaaaacaaugaaucuuuuucuauaggugguguuguuuugugaugcuucaugcugaucaagauggagaaaaacugcaggcacugcuccgccuuguaauagagcuguuagaaagagucagaauuguugaggcucuuaguacaguuccucagauguauugccuagcuguuguugagguuguaagaagaaaaauguucauuaaacacuacagagagguaagcaauucuaauuauuuaauuauauauuaacauucauaauugguauauuuuauuaacauaaauguuccucuucuaagugggcuggugcuuuagucaaagacggaaaacaacuauaugaagcugaaaagucaaaaagggaauccuuugggaaauuauuuaguaaguauuaauuuauuuacccuuuuccuucuuuauuuuuuggccuuuagguaauuucuaaaauaaccauguuccugguuucuuuguacagggaaguccuuuuuaagaaaucgucuguuuaaaggacuggacuccuggccuuccucauuuuguguauguauuuuuuuuuuucuaacuaggacuaaauuucuuuuuuuuuuuuuuaaggacuaaauuucuauauuauaaaaccuuauuuuuucaggguuagaagcauuuaucagaaacagauuaaguugugagugauaaaaucuaaaaucucccauauauacuuccugaucaccuucaaauucauggucuuuuaaaaauccauuuaccaacgguuuauauguauauauguguauauuuaaauauuccuagauauagucugaaucuguauaaugcuacauguauguauauuuacagaguugaccauuuggcacugggcaaugauuagugugcucacccugggaaaccucucuugcuuccagcuacucaguugucuguaguucuuuguguagggaugaggcuuugugggcucuuucccaugcagcuuaaugugcucguuaguguccuccuuguuuagcucauguucagguggucauguuggugagacuuugugguuguagcuucugauguuacuagaagacaaagucucugaacaaucuuucuguccccuuuucaguguuccuugacucuagugcuuccuugaguguuguagauguaucguuugguacuggcuuccucaacucuucauauugauugguuuucauuuuuuguagucucuguugcaaaagagaagauuccuugguggaggguaaaaauguguacgucuacguggguauaaggacagauauucaaagauuguuauggauuaagcugauuaaguuagugguuguauauucuccuacaguaaucuugauuucacuagugcugaauaguuaguuagguuugcaguacugacauggucucuuuucuguugagcaagucuuaaguucaguuagagagcuuuugcuuacugccaaggugugagguuuuuuuguuuuguuuuguuuuuuggguuuuuuuuuuuuuuaagacaggguuucucaguauagucuggcuguccuggaacucacuuuguagaccaggcuggccucgaacucagaaauccaccugccucugccucccgagugcugggauuaaaggcgugcgccaccacacccagcaaaggugugaguucuuuaccacuacucauccaagagcucagaguaggcuggcaucaucaguggcaguuuuauauuuuuuucuguuuuucauuuuaucuuuuuguagucuuccuucugucuguugcuguuucaucccauugucuccaugccgcuucauuauuugagucagaguagcuugagucuucaguaaaucuuccuuaaaauuaaacaugaaaaugccaucugauagauuauaaaggcagcuagcuggguuuauuaauuuuuuuaaauggaaaaaacauguuucaugaucaaagaaauuuaggaaaugguauguccuuccaccauauuaaguugucaaucucaaacagguuucugcaugguaguauuucuuaagaaugcacaguuguaacuagaauuuacauacucauuuaucaaugaaccuauuuuaugaagauuauccugacauauuuaaaucuucuugacuagugauuaagauaaucagaguuacuuuuaaacgguaccaauucuugccaguauuauaaaaaaauaauuaguaggucuuuacaauucauuuuucauuuagaauuaaaguuugaauucuucaaaaugagaggagcaaagaaaaaaaauucucccuaaagugcaccaacaaaguuuacuauagaggcauuuugugaccauucugcaagucaagggaaaauuggagaauaauguauuuaguguugauggaauacuagaauuucugucaaauggugcuaagacaaaaaggaaagaacaaguuuauuaguuaccaccaagaagcucaguuuccagacuagugugcccuggcauauuugcauggucuuuugcuuaagucuauuaauuaguauccucucuuaauugugaagagaucauuugauauguuuuuggcagucucuuauaguggauuuaauuaucucaagaaaucauaaauucauccuuuguauugguaaacuuuuuuuuccauuuauagacucagaagccucgaaaauuugacugugaacuuccagauauaucauuaaaagauuuacaguuucuucaaucauuuuguccuucagaagugcagccauuccucagguaacagccacgaauacuuuugaauugaauugaucuuaaaaugaugaaaguuaugauuugcuuucuaauggcuucccuagcuuguuauacuguuuuuguuguuguuguuguuuuguuuuuuaaugaguguacaagcuucuuucacuuugcuucuccaugcuuaagaaggacugacuaugcuguucauuguuuuuaagagaaugaaacaauauguuugcaguuuguuagaaacuaaaaaucugucauucuuuuucaggguccccuuacuuugugacuuugaaccucuacaccagcauguacuugcccuacauaauuugguaaaagcagcacaaaguuuggaugaaaugucacagacuauuacagaucuccuaaaugaacaaaaggcaaauuaguuguuuuaaauauuuuuaugaauauaagauguuugcacuguuacagauuuuaagacuuuaacucuguguuucagguauccacaagucaggcauccccacagucagcugcuucuccaagaauagaaaguacaacaggcauuacaaccacuaccucaccaaaaacuccuccuccacuaacuguucaggacaccuuauguccggcagugugucccuuagaagaauuaucuccagauaguaucgaugcucauacauuugauuucgaaaccaucucccauccaaacacagaacaaccuguucaccaagcuucuauagacuuggauucauuagcagaaagcccugagucugacuuuaugucugcugugaaugaguuugugauagaagaaaauuuaucgucuccaaacccuauaagugauccacaaaguccagaaaugaugguggagucacuuuacucuucagucaucaaugcaauagauaguaggcguaugcaagacacaaguacacguggaaacgagggcuuuggggaucgggcugcucuacauguccagcuggagaaaugcagagcugcugcacaagacucucacagcaguauacaaaccaucaaggacgaucugugccauuucagaacauuuguacaaaaagaacagugugacuuagcaaauuauuuaaaauguacagcuguagaaauaagaaauauuauugaaaaaguaaaauguucucuagaaauaacacuaaaggaaaagcaucagcaagaacuccaaucuuuaaaaauugaguaugaauguaaacuugaugcucuaguaaaagacagugaagaaaauguaaauaaaauuuuaaaauugaaagaaaauuuaguaucccuugaagaggcuuuacaaaauaaagacaaugaauucacuucgauuaaacaugaaaaggaugcuauugucugugugcagcaagaaaaggaucagaaguuguuagagauggaaaagauaaugcauacucaacauugugaaauuaaagaacugaagcagucacgagagauggcauuagaagaccugaaaaagcugcaugaugaaaaaaucgagucauugagagcugaauuucagugcuuagaacaaaaucaccugaaggaauuagaggacacacugcacaucaggcacacacaggaguuugagaaaguuaugacagaccacaauaugucuuuggagaaauuaaaaaaagaaaaucagcaaagaauugaccagaugcuagaaucucaugccucaacuauucaggaaaaagagcaacagcugcaggaguugaaacucaaaguuucugacuugucagacaugagauguaaguuagagguugaacuugcacuaaaggaagcagaaacagaugagauaaagaucuuguuggaagagagcagaacacagcagaaggaaaugcugaagucuuuacuugaacaagagaccgaaaacuuaagaacagaaauaaguaaacuaaaccaaaaaauucaugauaauaaugagaguuaccagguggguuugucagaguuaagagcuuuaaugacaauugaaaaagaucagugcauuucagaguuaaucaguagacaugaagaagaaucuaauauacuuaaggcugaauuagacaauguuacaucuuugcaucgccaagcauaugaaauagaaaaaaaacugaaagaacaaauaguugaauugcagacuagauugaacucagaauugagugcucuugaaaaacagaaagaugaaaaaauaacccaacaagaagagaaguaugaagcacuuauccagaaccuugagaaagacaaggagagacuggucaagaaccacgagcaagacaaagaacacuuaauucaggagcuuaauuuugaaaaaaacaaagcuguucaaacugcacuagaugaauuuaagguggagagagaacuuguugagaaagaguuauuagaaaaaguuaaacaucuugagaaucaaauagccaaaacguaaguauuaaguuuagaauguaauuuacuauuucagacguauguguuaauuauaauaccuugauugguugcuuuucugggauauuuucaaaaagugaaaaaaauuagaauaauauuuauuacaaacaugaaaauaacauuaugcaaauuuauuauugcuggagcuaggugugauagcuuauaccuguaauccaaguacuugggaggcugaggcaggaggauugcuuuggagccaauccugggcuacagagugaacuaguuuuaggcuagacuuugccuuaagaagaaaacaacaaaucaguuucagaaaaauguuuuaaaacacgugauuuguaccuuuacuaaauuuuucaguugaaacugcuuuucuuuucguuauuguuuuagaguuaugucgaugggaauauacagaaugguccucacuauugcuuuccugauacuacaauuucauuuuuguuuucucugguuggaaaacuaauguuuuuaaauuccauacuuuuugcuuguguguuuuuuacuuaauuuuuguaaugucugauuuuguuguuguuguuguuguuuuguuaccacagauggguuugguauuuucauuuggcgguaggauuuuacacagugugguaaucuauuguuuaguccuaccauuaguucucagcgugaauauuguauugugcgugcauauauguguguguguauguauguauguauguuucugccuguguuguaaugcugauuuuaaaauagcucuuuuuguauuugugugaagugagagccuuguggaaauagaacuugaagacaaaauguaaaaacgcuguaaugacugaaaaagcucauuaaagaacuggaugguaaacugguaauagccgaauauauuaaggaauuauugcaguggcuaugcuauaaaacugaguuuaguucuuaguacagcauggacuaguucaaguuuauucuagguaacaggaucaggaucaguagaucgagccuuauaaagacaaagcaaucaaaugaaaggaaauuuuagccuuuccaacugaccuuccaagauucuuguucauagcaagguagagugauaagaaaccaagaguaggagaugaagaauuugauccaauauugagagagaucagauuguaggagugggaaauuuucuccaaacugacuuacaaacgucaugcuacagcugagcaauacaagcuuugacaagaauacuugucaagguuggagucuaaagggccuaaaagagacugacuaauguuuagugagacuuugucaagcucuaagugaaauaucaagacauccucugaaguacccaccaaaguugauucuccauggcucacuggaaagcugccacaguacucaagaaccuuuuaaaagcagcaaauacuggcuuaaucuacaacauaaaaugaguaguucucaguuaccugugaggaauuuuuugugagacgaccggcuacaaccacuucuggagaauaggacgggggcucucuugucucccaaaccuugaagguguucuuuuauuggcauauuugaagcucuucaagggauuuggggaaauguagaaucucugccuugaaguauguaugagauugcaaaagaguugguagcaguguugugggggagcacagucuagcauuguacccuguuuuaaacuuaguagucagaugucaauauuucuuuauucauauuaaaauaaauaaauaaaaacacuucaaauaauaucauuuguuucacaugaugcaacuuuugucccacauaugccugagauuuccuuacccucucuauuuucaaagguaagacucaaauugcuguuauuguauccuuccuugauagaacauuuguccccuuuuuguuuuguucaaaucacugccauucuguagguuaaaagcugaaaagaaaauagagcauaacuaccguuguuuuaccuuacuucauaaacuguaaaaguagaagaaggaauuauaaaaccuuaagaagcaucaaagaaaacuuacaaaaagccauuaaaaaauaaaugccuuaggguggguagauuuaauuacuagccuuuauuucuguaauuacucuugcaacugauacugagauauauauauauauaucaguugcaaggguaaauauauauauauauauauauauauauauauauauauauauacaugcaugcagcuuccuucuauuaucuacuccauucauuaucuuagccgguucuuuguguggugguuacuuuuccugacaggcacgacccaaaucuuuguaaggagacuaccauuuacuucuauauuacaguugccaaaaugguuuuguuuugguuuuuuuuuuuuuuuguuuuguuuuuuuguuuguuuugguuuuucgagacaggguuucucuguguagcccuagcuguccuggaacucacuuuguagaccaggcuggccucgaacucagaaaucugccugccucugccucccaagugcugggaucaaaggcaugcgccaccauguccggugccaaaaaguuuuuaauuuaacuuuuuaaaaaguaucuaaacccagaguuuuguacaugcuaggcaaguacaccacugagcuauaauucuacucuuaggugguauaguuuuucauuaguuuucuuuuuuuuuccauuuuuuauuagguauuuagcucauuuacauuuccaaugcuauaccaaaagucccccauacccaccgacccccacuccccaacccacccacucccccuuuuugguccuggcguuccccuguacuggggcauauaaaguuugcaaguccaaugggccucucuuuccagugauggccgacuaggccaucuuuugauacauaugcagcuagagacaagagcuccgggguacugguuaguucauauuguuguuccaccuauaggguugcagauuccuuuagcuccuugggugcuuucucuagcuccuccauugggagcccugugauccauccauuagcugacugugagcauccacuucuguguuugcuaggccccagcauagucucacaagagacagcuauaucuggguccuuucgauaaaaucuugcuaguguaugcaauggugucagcguuuggaagcugauuaugggguggaucccuggauauggcagucucuacaugguccauccuuucgucucagcuccaaacuuugucucuguaacuccuuccauggguguuuuguucccaauucuaagaaggggcauaguguccacacuucagucuucauucuucuugaguuucauguguuuagcaaauuguaucuuauaucuuggguauccuagguuuggggcuaauauccacuuaucagugaguacauauugugugaauuucuuugugaauguguuaccucacucaggaugaugcccuccagguccauccauuuggcuaggaauuucauaaauucauucuuuuuaauagcugaguaguacuccauuguguagauguaccacauuuucuguauccauuccucuguugaggggcaucuggguucuuuccagcuucuggcuauuauaaauaaggcugcuaugaacauaguggagcauguguucuucuuaccaguuggggcaucuucuggauauaugcccaggagagguauugcuggauccuccgguaguacuauguccaauuuucugaggaaccgccagacugauuuccagagugguuguacaagccugcaaucccaccaacaauggaggaguguuccucuuucuccacauccacgccagcaucugcugucaccugaauuuuuaaucuuagccauucugacuggugugagguggaaucucgggguuguuuugauuugcauuucccugaugauuaaggauguugaacauuuuuucaggugcuucucugccauucgguauuccucaggugagaauucuucaguucugagccccauuuuuuaaugggguuauuugauuuucugaagcccaccuucuugaguucuuuauauauguuggauauuaguccccuaucugauuuaggauagguaaagauccuuucccaaucuguugguggucuuuuugucuuauugacggugucuuuugccuugcagaaacuuuggaguuucauuaggucccacuuaucgauucucgaucuuacagcagaagccauugcuguucuguucaggaauuuuuccccugugcccauaucuucaaggcuuuuccccacuuucuccucuauaaguuucagugucucugguuuuauguggaguuccuuaauccacuuagauaugaccuuaguacaaggagauaggaauggaucaauuugaauucuucuacaugauaaccgacaguugugccagcacuauuuguugaaaacucagucuucuuuccacuggaugguuuuagcucccuugucaaagaucaagugaccauagguguguggguucauuucugggucuucaauucuauuccauuggucuacuugucugucgcuauaccaguaccaugcaguuuguaucacaauugcucuguaguaaagcuuuaggucaggcauggugauuccacuagagguucuuuuauccuucagaagaguuuuugcuauccuagguuuuuugguuuuguccccucuauuacucgacaugguaguguaccuagagucaucccagaaaaacugugauguauuaauaauuuuucuguccuuauucuacuagacaguaugaaauuaaaccagcuauauagcagauaacauuuuuacuuacugguucagugggcucaauggccaauuaauaacauaauuuuaaaaaugcuaggggaaagggucauacauguauuaugccauguguagauaucacauguguagauauguuugacacaagccucuuuuauuuacauucacuacuaaauacucagaauaguuauccugcaagccuccaaggauucuuauauuucuacuucucauguuaccaguaguaugcuuggauuacagagguaugcuaccacacuugguuuuauauaguuucugggggauuccuaccuaagucagcaugcaugcuuauguggcaaguacucuacccacggggcagucucacuuacccucaagaauugcuuccuguagaaguaaauuacuucuaaguaagcauaggcaaaauuucuguugcuuuucuuuggaauaauauuuguaccaauuuugaguucugcuauugugacauaacuggaagaauugucgcaaaauggucuuaggcucagagcucuacgacauuuggacuuuaccacauccacgcaaaauggcccucuuauacuaugaaucuaaaguauuccuuaaguugccuugcucagggugcuuuaucacagcaacagaaaaguaacuaauauagacaguacucuaugcaaaacagccauggucucucauaguaauuuaggagauuauuguaguaagguuuuuagucuauacagggaccaaguagagcacuugaugauaaacuuggcaaaaggaaaauacugauucccuaucuauagggucugaauuaugauuuuccuauggcaugcugcagauuucuauguauuguucauuucuguuagccacacuucagauaucuacucggguauguggucuaaggguuaaagaagcuuauaugcuaaucuaaaccuuauaaaagaguggauuuugcuuuguucccugaacaaguagacagucuugguaaauguuuuuuguaaauggcccaaaacaacauacuuaggcagggauguguuacuuccaagauucagaggcuugcccaggggccuggagaagagagcucaguggguaagagcacugacugcucuuccgaagguccucaguucaaaucccagcaaccacaugguggcucacaaccaucuguauugagaucugacacacucuaaacacucuucuggugugucugaagacagcuagagucuacuuauauaauaauagaccuuuuuuuuugagaaaaaaaaagaaaaagucuugcaagcaauaccuuuucccuuucagagggaauacagacacugcugacuaacccaaaauauccauagccuuuguacaaggccugcauaugucuugcccaaucaagagaucuuauaauuguaaauucacccuacaagucagguuuagccagccaucgccauuaaguguguuagaucaguaagacaagcaucucuggcaacucgaccuggaggaggggagcauuaauuacacaagucuucaaagacaaugaaguauaaaaacccuuugucauuaauaguaaacugcuguggcaucugugcagcaaggucagcuucuaaucaagauucaaagccacacauuuaaugccugcuaaagagauauuaauaaaauuugcagauugauuuauggcauggauccacaagcuggaaucuaggaaucuguccaucuuuauaacauguguauugucucuccuguuacauacaugcacccccagcuuccccaucuuuuccuuaauuucaggagcaucauggcacaugaucccucuucuaauguggaaggaaagugcccuugcuuuuuaacacaguggcuacuuacuaccauuuaccuuauuucaucucaccaggucgauauuccuaccucuccugacuuguagagugaguuuacucugauaggaugucuugagagggcacauuuauauuuuauuacaagacuauauuaguuacuuucuuugccuacuuuguauguuaaucuuugccuuagauauuuguguauagagacauuauauaaagaguucauaauaucuuugcugccaggcaucccuuguaugacuugagauauugauccugcaggugugggggcuucugauaacagcuuuauugcaaugugccaugcacauucuuguauuuguuuucagugacugcuuuugaaaaguugacuagaacagagaucauuagguuaacacuuuuauugucuguaccauaacaagauuuggguucuuguuccuauacuaauagcuuaugucuaccacauugggugcauucuccaucuuaucuugccauguuuuugccaaaaucaauuugaguaauuggugaauguaaaccuccuuugguuacauuuuuaacguacuuggauaccugguuugaaagucacgguaggucuggaagcagcugaauucuguggcagaaucuugugaagaaucugaguuuagagaauggaaccgcaucccuuugaaagagaagacuccugugcuguacggaacagcagcuccucaguauuuacaaaggcaucugagacgugccccaaagcccaagucaucgguccuuucauaaaaguuguguggaaugcccugaucuacauguguuuuacuuuaccacuacguuauaacuaguuauaacuaagcucaguaugguugcacuuaaacagaaccacuuaaccuuagccaguaugcauuuaaguuugaauuucaaugugccccuuuauaucaccacuacuacuccuuugccauuucacaacuuuuugcuucccccaagccaagaaaugguaguuuagaaaaagaaaacugaacaaaaguugguuauuauagcaacuguuacuguuucauuacuguguuaguuaacucuuccaucucaagaggucuuaggcuuuauuuuuuaccccuuuagccuuuuccucauugugcaauauaccuguacuaaucacuuuuugguucaggggaucauaggcacuuuucagagaggcugagugugauagauugcuugacuagaacucucuccucuaccauugucaucucaguccagcauuuauuccgaaacacagugauacaaagacuuaaaaaaacaauuagagaugauagguauuugccccugugcauucacacccucagucacacaauuugaaugauacuguuucauucuuaguaauacaaaccucagcugcuuauuugcuacauguucuuuuccuucuauauaguaucauucagaaagcauuuuguuuacaguaaaauuugaaugugugacuguuggcaguuguagccccacuucagugcauuccauacaauguuccccuugauuaucuaaccuucuauauucuaaauuauugcuauguacccuccagcugcacaggcaggucuuugguaacuguacuagcuaauuaggauuaccucucagcccugccuaugccuaguuuaauucauuguuacaguccugaguccuuuguguuucucauuagcaccuccuguaugcagcucugcauacuagcuuugauaaagcuuaaacuugcacagcaacuuucuuucagccccaagaagaaacaaacccuucaucuuuuaaugcaguguuauaugaaauagaagaucacaaccuguuugcacucauaaaucagacuguugcuuaaaugcuuaaugaaggaggaauauuugucugcguguugaaguuuggguuagcuuuaucuguaaguuuggguguauggguaaagguucccagugaucuucugcacaaucucaauugcuagcguaguaauugcacauugccaccauaauuauaauagaaaacuaggcacgagcauaaaaaccauaaacuuuuuaacuaacccuguuuauaauuugcaccucucuuccaaaaacauuccagugucuuuuaaaaucaaccaaaugcacacugaaaguuuauuuucuaauagcaacacaacagccucuaauugagauugagacaagagccuugccaugcggccaggcucuccugacacuaugugaaccccaccgcugauauggguaagaaagcuugcagugcugggaugaaccaccaugccugguuugguucaauaccucaaaggcaauauuuuaggaaucuuugaaagguugaaagcaaauuaagaucuaagauuacauggcgaccuccaguugaaccagcaucauuuguugaaaaugcuaucuuuuuuccucuggaugguuuuggcagcuuugucaaugaucaagugaccauaacuguagguuuuuuucugggucuucaauuccauugcucuaccuguuuguuuaucacuguugcucuguaguucagcuuugaggucagggauggugauucucccagaaguucuuuuauuguugagaagaguuuuucugcuauccugagauuuuguuaugcuaggugaauuugagauuugcucuaucauugugaagaauugaguuggaauuuugauggggauuguguugaaucuguagauugguuuugauaagguggccauuuuuacuauguuaaucuugccaauccaucuucaauuuuucuucagagacccgaaguucuugucauacagaucuuuuacuugcuugcuuagagucacaccuagauauuuuauauugugacuaugaauggugguguuucccuaauuucuuucucauccuguuuaucauauguauaaaagauuuguuucaguuaauuuuauauccaccuacuuugcugaaguuguuuaucagguuuaggaguucucuaguggaauuuuuggggucacuuaaguauacuaucauauccucugcaaauagugauauuuugacuucuuccuuuccaauuuguagcccuuugaccaccuauuauugucugauugcucuagcuaaaacuuccaguacucuaucaaauagauagggagagagaggacagccuugucuagucccugauuuuagugagauugcuucaagauucucuccauuuaguuugauguuggcuaccgguuugcuguagauugcuuuuauuaugguuagguaugggccuugaauuccugaucuuuccaagacuuuuuaacaugaagggauauugaauuuucucaaaugguuuuucagcaucuaauaaaaugaucauguggguuuuuuuuuucuuugaguuuguuuauguaguggacuacauuaauggauuacuauccuugcaucccuggguuaaagccuacuuggucgugguaaaugaucucuuugauguguucuuggauuccauuuguuuauugagaauuuuugcaucaguauucauaagugaaauuggucugaaauucuuuguugggucuuugugauuuagguaucagcuuaggcuuuauagaaugaaauagaaaguguuccuucuauuucuguuuuguggauuggaggcccuuggucauguggaggcuugaugccccagaguagaggaaugcuagaguggcgaggcgggaguggauggguaagagggggagcacccucauagaggcaaagggcaggagggauuugaugggguguugagguugggagaccucgaagggggacagcauuugaaauguaaauaaauaaaauaaccaauaaggaaauaaaaaagauuacagauuacuaaccaguguguagucauucacccgggcuggcuugugcuucacuuggccauucucuucugcucccuugcuuacacgacugccaagguugacuaaagugaaucaguuuaagaauacauagauuuucuuuguauggagaauucauuuuuagcuucauauuauuuaccacuaggcaucaaauugagccaaaaucuauuuuauggauagcaaacugucucuaaaaaguugccagguauguguuuucucuucaauucauagggauagaaaagaugaauauugaagugcccauugguuucauaggugcaaauggaagcccugauuaugccacauuuguugcugucaucagucauguuacuucagaucuuacauacuucauuguuuaccuucagucagaaagacaggcuucaugaaugcagaaauucauuucucauuaucuuggguuucugggagguaaauaaccuaagucugauauuugauauauauuugauuuucucuuacuguuuuuuaaaaaugucuuuucaauuuuuaaguccugccuuugagucagccagagaagauucuucaagcuuaguugcggaacuucaagagaaacuucaagaagaaaaagcuaaguuucuggaacaacuugaagaacaagagaaaagaaagaaugaggaaaugcaaaaugucagaaccucuuugauugcugagcagcagguguguuugagaucugaggaagcuugauagaaacuagcugagcuaguucucugcaguugaggguucuuguuuccauuauuugaccuucuuuuuuuuuaagauuuguuuauuauuauaacuaaguacacuguaucugucuucagacacaccaaaaaagggcgucagaucucauuucagaugguugugagccaccauaugguugcugggauuugaacucaggaccuuuggaagagcagucagagcucuuaagcacugagccaucucuccagcccuuauuugaccuucuuaauguuugaucuuuuccauaauaaaugcauuuauucuaaaaagaaaacuuguaacagugucacaggaauguaguuagcacuuuauguaugaauuaucaauucacauagaccugaaaucugcuuuugagaauuacaguguccuuggcacaacuuaguucacauguaauugggcuuuucucugcaauucucacuguggucuuuuauaaaaacacacucaauuucagauucccauaaugaauuaggaucugaauuaacugaauucaaaacccagaagcuaaaaacuuauccuaaagcuccaguuugcuuguuauaaguugugauuaucgccaggcagugguggcacaugcacuuggaaggcagaggcaggcggauuucugaguucgaggccagccuggucuacagagugaguuccaggacagcucgaacuacacagagaaacccugucucaaaaaaaaaaaaaaaaauacaaaaaaauauugugauuaucuuaauccauucauauuacagaaauagcauaguucaugaagauaaucaaugguuaauguacuuuuacaugugcuaauuuucuauuuguaaacagaaauuaccuaguaguaagcugcauugguaacauucccucuuuuuucugcaaaaaaaaaaaaaaaaaaaaagguuuuuuuuuuuuucaaauucuaagucccuucaaguauucuugguagccugaaacuuuuacuuuguucuuuguuguuagauuuuugucugaaacugucaaaugauuuuccuguuaaaucugucuguugccauuuauggauuucuaaaagguuuuggguaaaugcuaagcaaauuaaagaaucauguuagaucauucucucacguaaguauuuguuauauuuuaaugaauggauauguuuaaugaguauaaaugaaauguuuaacaaauuuaaucuccuuuguuaauuaaaaugcaguuaaaauuaccaguugucugucagaucccucuaggcaauugaauaugugaacuucaugcagugggugaaaccuggggaguaauaagugucaucgcuauggaggccccgagggcauugcacauguucaaauaagaggaagauaaccacacgcuaguaugguaaucaagagcuagccaaagaucaaagauuucagaggaaagaaaguuucccaaagaaaacgucauguauccaacagcacucuauuaacagcacuguugaucauuuaacuuccuucucgaaaaugucaggcauuugccuuucugacaauauaaacaaggagaaaauuuuguuuucaaguacugaguucaaacaaagaaaauaauaaccuuuacuggaauacauaccauuugcuuagucaugugacuccauaaauguaccucagaaaagaauacauuacagucuuauuuccauagcauugucuccuaaguguaugcagcugauugacuauuacuacuguuguuucagaccaacuuuaacacagucuuaacaagagagaaaaugaggaaagaaaacauaauaaaugaucuuagugauaagcuaaaaaguacaaugcagcagcaagagcgggauaaagguuaguguugucuuaauaugauuuuaaaaauacuuggaaguguuuucaguauguaaugugucuuugccuuuggggucuuagauuugauagagucgcucucugaggaccgagcucguuugcuugaagagaagaagcagcuugaagaggaagugaguaaacuccgcacuagcaguuuucuuuccucagcaccuguggcugcagccccagagcucuauggugcgugugcaccugagcucccaggggagccagagagaucagucauggagacggcagaugaaggaagacuggauuccgcaauggagacaagcaugaugucuguccaguaaguaggcuuauuuuccauucaguucaccagaggcuuuuauauucagcagugcuugacacuggugucauuagucuauaauccuaacaggaggaucacaaguuaaagcucucuuuggguaacaaugaacucaaagcaauuuagcugaggcuggcucaaaauuuaaaaaaaaaaagucuguacugcuauuccauuaaauuauaaaauucuaaagaaaggagguauuuuuaacuuuacuaauuguucuuagcccauauaaaaguaauuuuaaaaggaguguagaaacauguuaagagaaugugguaauuaaaauucauaaaugacagaaauuaauccagaguggaaagugaccucuggagggaaauaaacccagcugucuucuauguacaggagaggcaguuaaaacaaaucaauauaggaagcccaguauaagguauaaaguaugacacgcaucuaauaucuucaaccugauauuggugggguaggggccagaggcaagcagaucuucagagcucauucuccagcuauucuagaagaauuaaugagcucagggucagugauaaaacucaaaaaagguagcaagcagucucaacgaagacuccugauguugaccugguuuucacacauauguacacaucuauacaaacacaugcauagaccacacaaccacaccaaaacaaaaauuaaaaaugacaaucaauuuucccaacuuuuguuaauaacaaaaagaugaguuuguacaauuggaaauuuuaacacaucuuuauucagauguauagcuauugaugccucuaagaaggauacauauguaugaacacugguauauaaguagaaauuggacuauucuagaguaaacaaggaucuaaaaccaaguauaaucuauguaauauucugagagagcuauauaaccucauauacauuucuuucaaaauuaauuauggaaaacaguguuuacuaucugagaaaguaugaauuuuauaaaaauuaucucuaaguaaaaacaaaguuuuguuuauagucucaacaagugucuaagucugaacacagauaaucagcuguucugauaaauauaggcuaccuuugaaaauuaguacaggcucuuuacucuaucuaacuugucgagacuggccucaaacucagagaucugccugccucugcuucccaaaugcugggauuagccaccaugcccggcuaagcuuguugaugaauguacaauucaggguguacauucugugaaaaugcuuaagccuuacaaacaaccauucuuucacuuuuagagaaaacauguuaucugaagagaagcagaggaucaugcuccuagaacgggugagcagacucucugugaaguacuugcuuuauaugaugacucuggggaaaacauuuauaugccuuuuguuuuaaagacauugcauuuugacuugcauuuaugaauuaagacuuuaugauuaauuugagagggccugucauuuguguuccuaguagcugaauaauuguaggaucaggucucacuauguaacuucuucagugauugacaucuccagaaagcaaaaaggacuuauuuuauaaaguuuuacuuaauaacagcucagaaaacagcaauauaauaucaguaagaauuucaacacauuuauuuuuuuaaaaaguagauuuuuuuuaaaaaaugagcaagaauauaaaaauauuaagauugcuguaaugaaauuuuuaauaauauuaauugaaauaaggaaaggaccuucaguugcauaagaauuguguacauacacccacagaaacacacauggaucacacaaauacaccaaaaauaaaaagguaaguauuuggcaauuuuuauuaauuaaaaguacuuugaaaacagaaugaacccucaauggcuaguuucauucaucuauucaugacuauuuuuaccagugucuuuguuguauaccaguuuagaaaauaauccagagacaaacuguccaguuuaacucaaauauauuagccauuuucuuccuguuuugugauuaacaccuuaggaucagacaaguuguaacaauauguugcaaaugcagguuguaccucugaacuagcauauuugggugggauaaaugcagcauuuauuguguguuuauaaauuacacagcuaaugacaagauuugaaaacuuuaaagaaucaaguuuuaggacaauauauucaguguucucauucucacuaaaauguuuagugaucagaauggcuacaauagacucucuagacauguacuccuuuugaagaugagaaccuugcuaaucauccaaggauaaaucacaggucuguuuuuuccuuguagacauugcaguugaaagaagaagaaaacaagcgguuaaaucaaagacuggugaguucuuuugguuauaucucuuuuuuaaaacuuuuguauuuugguguagacaucauguaccugaaggauuucuaauuuuguuuuuacacuuacuaagaagagaauggagcaugugugccaucauagugucaguauggauucagaggacaaaguaaguuuuuugccaccaugugugccugggcauugaacucaggucaccaggcuugguggcaccugcuuuuaaucuguuaugucaucuuucuagcccagaaugugugugguuuauucauacucguguuaaggcguauuguacauuagccaucacuggcucucaagugauggaauuuggucagaguugcuauuuugacugauuguagaauuaccuguucugcauuuuuuguagauuuauuuuguguauaugaauguuuugccugcauauauuuaugugcaacuugugagugcauguggauacuugggaucggucgcaugaacgcuggaacugaacaccaauccuccauaagagcagcaaaugcucuuaaccacugugcccagaucuuguuuuuuguuuuuuuguuuuguuuuguuuuguuuuguuuuuguuuuuacuugaaaaucguguauuguacuaagaauuugacaaaguagacugacuaccuuacuuugacacuuagagaaaaaaaaaagaaaauauagucuuuauuuuuaaggaacuacuauuucuugggauuccauaauuaugcauauaaucuuuguauguuuaauucagugaguuagugcuuuguaaucuuuugaaaauuuacauuuacucuggugaauuuugaaagugaagauaaaugguuguguccugacuugugucuuuuuuuuuuuaauuccuccagcaccccacuuuagaggcauucauguuuuaauagagcaauuacuuaauuucccccuaaaucagauugaauuccuagcaccuaaaauauuauuuucugauaauugcauauuucaaaggagacauaguuucaggcuuauguuuagugguuuuaaaaaaaggagaaauacuuuucaugcagcuacccauauaucacagucaauguguggagguaaaaggucaaauuuugacauagguucucucauuccacuauagucccaaggacugaauuuaugaauauagaucaccaggguuuaugcuacaaagacuucuauuauauauuuuauauuuuuccuuucuaaacuugcuauguuuguucaaaaaacucuucauaaugauucagaacaaaguuucugcugggcuuuuuugugauuuccuuugucuguguaauuaauauaaaucugcuuaccuuagccucagcuagacucuucagacaagggcaaaaaucaaccucguucuucaccaaaaucgcacaaaaacaaucucuaggccacauauugaaauccucuugggccaggucuguacaguucaaaucacucucaguuacaaaguuuuuuuuuuuuuuuuuaauauuccuauuagaauagccaauuaagccccacuuaaagauauccacugcuuuccaaacacaaaacccccaaaucuacauucuuccaaacaaaagcaccgucaggccuaucauagcaauaccccacuccugguaccaacuucuguuuuaguuaggguuuuauugcugugaacagacaccaugaccaaggcaacucuuagaaggacaacauuguauuggagcuggcuuacagguucagagguucaguccauuaucaagaugagagcaugggaacauccaggcaggcauggugcaggaggagcugagaauucuacauuuucaucugaaagcugcuagcugaguacugacuuucaggcagcuaggaugagggucuuaaugcccacguccacagugacacaccuauuccaauaaggcuaccccuccaaauagugccacucccugggccaagcauauucaaaccaugacaccaacugagccauuucacuggccccugcaauugauuauuuuuaauaaggaacagugagccgaguguagugacacacaucauuaaucccagcacucaggaggcagaaagaggguagaugucuaugaguucagggccagccuaguuuacagggaguuccaggacagccagggcuacauagacccugucucaaaaauguacaaacaaauaggagcagugaagcaucccucucuauuuucuuuuucuguuuguuuguuuugugacaggauaucucuaguuggcaaggaaugcauaguccuaccuucagagugugaugauuccagcuaggcauaugccaucauuuauugccagccucuguuuuauuccuuugccuuuacacaaacuaaaauuagguguuuuauacugguaguauuacuaauuaagaaggcuuuaaagaagaguggccuauuccaaaugacaucaccuaauacauuuuuuuauggagaguccccaagggaauaugagcccuauuuggcuaagauuuuuaguaauauuuuguuguuuuugcuuucauauagggcagucggguucaagaagcauuucaaaacugcuuuuuucuagcaccuagaauaguggaaccagagaaguagagaugcuccugugugacccagagagcuagcacaugcagcuguguccagagaagggugcauucccacacauuuacugucuuuacacagaagcauugacauguuuuucuccaagcguagcugguuuuuguagagugagcuuuuagaaugucugaauaaaauugaacauguguuaaaaaugacuuaacuucacugguaggauauaugucacuuuccuggguaauuuaaucaaaucuuugaaaggcacuaggccuucuuagauaauucuauuaccaguuccuuagauaauucuauugccuuuguacaaaauaguguuuggaauggaguggaugaaauuuaauauacaaauuuagauuucaguguugaauugaugaauguaaauaagaaugucuguaaauuguggauguacauacauguggucucuucaccuugaacacagauuaaaacauguauaacagcagaacuuucugaugaguaugguacugugugugcagcuaaugcaugauucaacuuuuuugucucagaugucucagaguuuguccucagucucuucaaggcauucugaaaaaauagccauuagagaguaaguaucucguuuuuauuuuguguguuuuacaucaaauuguuaaugaaaauguguuguagucaccaugauuauuagauccaugcucauuggccaagugccuugugcauaaugauaagaugauuggaaagcaagguuuuucacuguucuccuggagcuuugggacuguauucugagucaccccauuagaguucuaucauucacacaaaaggccaggaagcuuuucuugacacuagcuaauaugucagcugaguguccauccuuagcuucuucguccucacuucagaucggaagaucuugauuuuaggucgcuaugcuuuguuucuccauuuuauguuuuuuaugugcuauaaauuuauuguauaauuugaaaauuucaucagucaaacaguuuaacauuauagcuuuccuggaccaaauuaccucauagaaguuguugucuuccccgagcuuguuuggcaggagcuuuggaauaauaaagaaaagcaucauugcagcucagugaacccauguugugcaaaaacuauugaacuugacacacuugguuuucuuaagacaagagucuuaccauguagcccauucuggccugccacacaccguuuucuugccuugcuuccucgaaugcuaggguuaaagggguggaucacaguaccugguuucuggauuaaguauuugagaagacccuuauuuuauguauaguagauuuuuguuauuaauugguuugaaggauuuuuguuuguuuuguuugauuugucuaggguuuuuguuguuguuguuuuaacaaaucucagauauccuuguuuaucuucccuaacugaugauaggauaggauagaauagguaggauggcugucugcuuagccagcuguguauuaaaaucauuagucuucuagagaccagugaauuaaucuuacugcuuccaaagauccuuuacuuccuuuuaauauauuaggcuuuggcguucagucaguguacagugcuuaccccauaauuguagcagcauuuaaaacucuucccagacugcucguggcauccacauguagucccaguacugagaaagugaaggcaagaggcaaagucaaaggcuauuccauauagcaaaugucuaaaagaggaaagggaaaaaggcuucauaguggaaaaaggcuuucuaguugacuuugucagccggagaacggagcacauaaacugacucugagguuggucuucagaacguguaaagauuuugagcacaguuugagagguggacacuaguuaaguguacauguagguagguguaaauguuuccuccucugcuguugaaggucuguauugagccuuuguaaggccagauucagcacaugguguagccgccagcagccacggguuccugguuccugagaggaaagauggggcuuuggaugggaaaggcugugagagaaauaacaagccaagacgaagauuucugaucaaggccaauguuuacuuacgaguuugagcuuaugaaaggggcggggagggggcccaucccccaccauggcaggaucgcugcuuugucaguauagugucagaacaggcucagccucucugcagguaguggugucuuggagaaaagcugcagauguggcaggacaggagacuuuaccuaggucagaagacuccaccaacuguggcaagccaggucugagcagccugcucaaggcugggggaagggcacaacaaugauuugauucaguugcuuuuucuuuugaaaugaagaguaucacauuuaagaauugaaauuccagaaauguuucuugguguaaaaugaaagauugggggaaaaaaugaacuggcauuuuuucuacugcacgcaagcaguggguauagaacccccaaacagugagccaacuggauagucucaaguuuguagcauguaauuaacgaaugcuaagacaauaaccuacuucuccuuaguuuucaggugggagauuugguucucaucauccuagaugagcggcacgacaauuauguauuguuuacuguuaguccuacuuuauauuuucugcacucagagucucuuccugcccuggaucucaaaccaggugagggagguaagugcgcauacacuuguaaguacuaaucuugaguggaagacacguauucccuccuguugucauuaggaaaggcugccuuuucaaaaaaugaaaucuggggcuggugagauggcucagcaguucuggaggucaugaguucaaauccuagcaaccacaugguggcuuacaaccauccguaaugacaaacaaauaaaaaauggagcaagccgagccaacgcaagaggcagaagggaaaggggugggaaaugaaaaauuaaaaagaauaauaauaaaauuuaaaaaaugaagucuacauuaucuaccuauuuuuaugaacuuaauugauaauuauaaauuuggcuguaauauucuacaauagaucaacugcucacacugcauauauauucaaacaugauauaaccuaguaauugcaaaauuacuaucaaaauuuugauguucauuuuguugguaauuaauauaugcuuauuuacugaaagaucuuaccaguguuuuucagaugaguaguuuaaguagugccuuuccuguacuaguuaugauuuguuuuccuaucuuguucauuuguucauugauucaucaucaucauuauuguuuuauggaguuuuauuuuguagaaacugagcuuuguucaucaugcugaguaacaaugcccauuauuuauuagcucauuaaagaguucaaagagaagagaauagcuauucuggaauuuuuagacuaaguaaaacugcuuagaaaauuaguuuaccccaagccaagugugguggaacaggccuuuaauuccaguacucugucuccucagaugcagucagacguaggcccugaaaagaagagggaaaucaguuuccucacaugaucugauggucaaaccccauucaugggcuagggcacugucacuugaccaccccgucauggcuuuugauggauggccuauuuagaaugucugugugacagcaguuauauagccaugaaaagugaaaagauaaauuuguuuucagaaauagguagcauuuuucuuauuguauauuuuuggauuuuugacacagucucauauaucccauaccaguugcaaacugucgugcauccgugguugaucuagaacuccugguucaucucccuguaccuauccacugcuauguuuccaguuauagagcacuaugccccaauucaucugcccucuagccuuguuccuguuucacuuguuuccuguauuuauuuaagggguguuuguuuuucacaguuuggggaucaaagcuagugucuugugucucuaaauuuuaucccagcucuuuacauuuuuagaugaaaaugaugcaaacccacguauuuacucagacuugccuguuaacauuuuaccuuauuucuauuauuucuuauguuuuucuaaacauguacacuacuaaaguaaugaauuuuaaaaccaagugcuugucuucucauugguguucucaguuccugcccaggaagcccacuucuagacuucauuugauucuuacuauuaacugcucacugaguccaaguuguguguguguugcugcugcugugcuaggcacugguuacagcuuccuucacacacugaccgacugccagccacucagaagucuggagguugucauucguuccuucaguagguggcaguguugagucaguuauugguucaucacuuagauuacuaguguuccgugaaugaguauuuuaaaaagcacacauauuuauauauuggaacacaccauggauauuuuuucuucaauaaauaauuuggauuuuacugguuuuuaaagugauuaaacauucuuuugagaacaccauuauuguuuugauucuaaaguucuuuuuuucaugaaugaacuuugaaaauauauuaccaauuuauuagcuucaggugcaucuagaagacccuggguccuugggaaaguaauggaaaaggaauacugucaagccaaaaagguaagaguuaacccuguaauaguacacuuagggguuuuaguauauggaaauaguuacuaguguuuucugauuucuguucaccuagagcuugaauuuuauuaaauugaguuuaacccagaaacuuaguaaauauugcuauuaucuuuagauagaaguagguuuccaacaguucauccgccuauaaaggagaacaggcaguguaacucauguugaaggcacuagaagcaacaaugagcuugauuuguaugguuggccuguacucauuuuuauacgcuacagcauugauuaaauuaaaaaugcucucaagucuuuauuuggaggcuaaaacgaaacugacaagccaggauuggugguauaccucugaccagagcacuugaagccaaggcagggauggaaggaucuauugaguuccuagucauccugggcuaugaauauaugcacauguuauccaagccuuuguaaggcaggggaaggagggaugcuacacauuugaagccagucuugucuacauagugaaugccagggcauccaggguauauagcuagacuauaguagacagggaaggggggauaacuacaccauccuccccacccccaacacucauuaauauuaguuuauucucauuuggucgggagccuaucuuuuauaguuugguacagaguagagacuccaccuccucuucaauacucuagcaguaagcagugugcuagaaggguacuuguaauuuguuucauucauucagugacuccuuuucucuuuccuucuuuuuuuuuuuuuuuuuuuuuccauuuuuuauuagguauuuagcuccuuuacauuuccaaugcuauaccaaaagucccccuuacccacccacccccacuccccuacccacccacucccccccuuuggcccuggcguuccccuguaccggggcacacaaagucugcguguccaaugggccucucuuuccagugauggccgacuaggccaucuuuugauacauaugcagcuagagucaagagcucagggguacugguuaguucauaauguuguuccaccuauaggguugaagaucccuuuagcuccuuggguacuuucucuagcuccuccauugggagcccugugauccauccauuagcugacugugagcauccacuucuguguuugcuaggccccggcauagucucacaagagacagcuacaucuggguccuuucgauaaaaucuugcuaguauaugcaauggugucagcguuuggaugcugauuaugggguggaucccuggauauggcagucucuacaugguccauccuuucaucucagcuccaaacuuuguuucuguaacuccuuccauggguguuuuguucccacuucuaaggaggggcauaguguccacacuucagucuucauuuuucuugaguuucauguguucucuuuccuucuuaggcacaaaacagauuuaaaguuccuuuggggacaaaguuuuacagagugaaagcugugucauggaauaagaaaguauagccacagaagaaaucucuacaucucauaccauuuuugauuuguccuccagugcugauaaacuacucuaaaaacagcuggccauuguuggguuuuuuuuuguuguuuguuuguuuguuuguuuuuacaaaagucaacauaacaauauacuucauugguggacugcacuuaccuuuuaaguggcuacaucuuaggaacaauaaauuuauuaaaauucuuggcugaaucaaaaugguuuuguuuuguuuccacccaaauaacuagaaauucggaccaaaauagauguuuuccaagggcagagccugcacuguggcuugugacuagccucauuaguugccuguuaauaaacauuagcugaauaguuaccaguguuguuaccagcauuuguccucuugugaauucaagaguccucgcacucuuuaacauguucuuuauaaaauguauaaacccuuccaaacuauuuaaagaggaguguuauugcaugcagauaaucauaauuuugaguuugccucagaagacuacuaaagcaaauuuguucauuuuuuuuuaaaaaaaugcccuuuaauguuucaaaaaaaaauaacaguguaauuugacugacuuuaagaucagccauaaauaaugagcagucuucaaaagcacuuuucacacagaucaucugggcuccagggaggaagagucugugccacugauguuuucaagugcaggacucacucaaaccucucagcaucuuaggacuguuucaaguaaucauauugaugaacucguaauucaugguugaccuucagaagaagauauucauuguauauuaacauuuagaggucauuuaaauaacaaaagucuguauuguaaaggaccuguacaauuuuaagacaauaaagaauugaaaguguaaaugugugugccuuuuaaagguuacauuuuaaauauauugcgugauuucugggaaaggugaaaaaaauguucuguaucaaagagaaaccuguuuauuaaaaaauguuguuuguauccuauguaacagggugaagugguguucuguggaacagaaccauguaaacucaagguuuaaaagcuggcacugaacaaagauauugaaguagcuaggcuaguugauuggaaagaguuucuucaggguuguuguuagcaguaauaaaugauucuuuuucagaaauauuuaauuucuccauaaaaauaaguuggauauuuuuauaaauauguaaucuaauagaaugaaaauggaauaaacauaguguauagaauaccuaauucaaaaacauauuaaugaauaaacgaacaaaugauuucauguuucuauucaguccuucaaugacaucuuuauauauagacuacaaguguaacaugacuuuauguauuuuuaaaacaguuguauuugugauugagucuguuagugcagucuauuucacuuaauuggugcucuucagauuuaauauaugguuuuaugcuguggaauuacuguguguucugacacacuaacucucuuucguuaacacugagucuuguggucguugauugucuuuguuacccaguacuuucauauucaucuuaccaguguucacacacauguuccaagcaagugagaacuaaaaagauuuuguuacaaagaaaacaaaacaauuccagaagccuaaauucauugagcuuuuguuuuuacauaguuaaaggcaauaugaacuuugcagcuagaaugaauaccugacuuucagucucagauguggcuuuuagauaaaguuccacaaauggacccauugucugaugucuaaaacaggguacuggaaccuauguaauauaguuugcacuuucaaugcaaaaauuuuuagguauguguucaguacucaacauguuaacuguuguaaagguuuauacgguauagucuugggggggacagaaauguauaggggccccacagaguuccagcaucacaggaggcugaggcaggagcauuugagcaacagagaaugacaacaucugaagaacagguggggaaaaacggcuuuuacugugaacuuuuaaagaaugcuuauguuacauauguuuauugugacagugguaauuuaauauaauaaaaacauuauauaugccuggcucaugccuauaaaugcagcacucaagcauuugaagcaagagaagaagacccugugucucagaaaaaaauaaguaaaagcgauguauagaacuaaaauuaauuuuuaguuuugaaaaaguucauaagguauaaaagcaguuuuuaaaaauuuuauuguagccccuaauguuucuuagauuuuucaugucacacuaaauuauacauacuuuuuuuucuuuuugagauaagguuucucuauguaucucuggcuuuccuguaacucacuguagauca

SEQ ID NO: 58 - RNA, 5500 nt, Mus musculus
ucaggaaacuagaaagaagccuuaauuuuauuauagguuacaaaagauacacaguuuaaaagauauagaacauacaugguuuaaaaaauauagaauagguacaaauaagaaaaaaguaucccuuuguauuuuaagaguuuugauugcuggagguagugccauaagccuuuaaucccagcacucaguagaggcaggcagaucucugaguucaaggucagccaguccacagaguuuaguucuacauccagggcuacacagggaaacccuaccuugaaaacccaaaguggagcaaagaaguuuugauaaauuccauuacuuuuuuuuuuaaaucauaccacuaccucauguuuauaucaucauuuuagauuguuuuagaaauaaaaucuuuuuagaaaucuuuagaauuuuauuuucuaagcuaccaugauugaaguuuaauaugccuaggaaaugaauggcaagauuuuaggauccucauucacagauuuccagagauaaccauaaaaaugggaauuacaguagucugauuccaugccuuuguguguuuguuuguuuguuuuucgagacaggguuucucuguauagcccuggcuguccuugaacucacuuuguagaccaggcuggccucugccucccgagugcugggauuaaaggugugcgccaccaccaucuggcugauuccaugucuucuaauuuuuuucugaaauacaauuucaguagguguaugguguagcaugauauaaauuguuaaucaggaaaggaauugauuuuucuguccugggaguacuagagugucugcagaggcauuaucaauaguaaguuauuucuccacuaguaaauaagccaaaguauacaugggcagauuugcagccaugaggagggagaaagaggggagggggaagaaaaagagcacauccagcgaggguggugcaaaauguauggauuauauagggaagagucucugggggaagaacagcccaagcuccuaaacuagaaaguucaagguugggggcaggguauaucagauagggacagagggaugcugggagaagcuggaggccaggucugcuuugguauguaaaauaugcacuucagcuccuuguccuggggucugaagacagacaguuauggcuaagaguaucaggugauggaagccagagaugucaaaaaucagaaaauguggagcuagagugggcucuagacucagccaccuagagcauuggcugcucuuccaaagagcauguucaggucccagcacccacagcuuuuuguaauuccaaugccagaggauccagugcccucuuuuggucucuaagcaugaagcaugcacauggugcauggucgucauacaugcagagagaauauccaaauagaauacuaaaauacauuuuuaaaaaacauaacauccacagaauggccugugaauuaacugagcuauucccugcccuaugcccacaaaauaguucuaucauugagaaacuugguuuacuucuaaacuuucaaguucauacccuuuuaagaccuuaauuugaauugauaccaaaguaaggggcaggauuguguaguaugguuauggccuuagaacucaccaccugguuuuacuuuuacacuccuuuuacuaaggaacacuaauuagaaguguauugauuggucuucauaaaucaaucccucauuuguaaaacugaggguaaaugauaaaaucuagauuaguuaagacagcuaaguagaacuguaauguaaaauccaagagacacaaaucuaagaauacuuucguauuuucaauaaaaaaguacauuuaaaaaaucaacaauaacaagcacugccagaaguaugaaaucgaaauauaguauggaucucaagaucuggcuccugucacagaaucaaaugguuuuucaagcuauuagauagugauaaaaaucaauggugggucaauacuaggauugggagaauaaagaauagaaaguauuacugccucagaugcaacuauccuugcaguuuuguuugaauggccuuugagacaucugagggcaagaauuuuucauagaaacuuacuuggcuuuaaauauuaaaauguguuauuaaugauauuaaauauuaacauuuaauauuuacagaauuuauuguauucuauaaaugccucauaauuugugucauucucuccagaguccuaugaauuuuaaaaauccauccaauuuaaagauucaucagaggagaauuuaaucaaguauagugugagaugaguugguaccuaaacccaauccagacaagauauguugugcuauguucaaguuuuauccaucuacaaaacaaaaccagugacaauccuuaggaagggaagagacauaauuggaugguucuugauagaaaaauaaugagugcuaauacaaggccagacagaagaagagggcuugagcaaguuguaaggugcugcuaacaaauguuaguacugaaugcguaucauuauucaggggugggguuaauauuuaaagaagagcuuacaaucagcauguuaaacacuuaaaagauccagaauuacagacaugucugauaaagacuagaagacgcuuaaguuuaagcugagaaaaagagacuuaaaaauucaaaugauuuguaguacucagacugcauaauuccuccaguuauaaaacuaaaaaaaaaaaaaauucacuuuaaaaauuacauuugauucaauugauuguacacacauacauguggaggaacggagucaguucuguucuugguaaaaagcacuuuuaguuguuccuugaaaauucacugaaacauugacagauacuaaauuaaaaauucaguggaagccaagaauaaguagucuuauacagaaaccaaccuucacaucacccacaguauauucuaauugagaaguggggaaaaagaauacaguaaauggauaggaguuuacaagcaauaggauagagauaacacaaggagggggaaggcagaacggcccaugcuuuaguaaguugaaaugauguuucugcacuccccaugaaagaucauucuaugguccuuguaaaucuguuugaaguuucauugagaaaagccccgaagcuucacauaguauugcaggaguuuguuuuuguuuauuauggagaauagaaugcucaagaggaugaggaaaaauagcuugugacagaaaacuuauggauaugcaugauuauuaacauuuaucuauguugcuuagcaaaauucauauaacauauuuucacuuuagucuuacuaaauaauuugagaugcauauaaacucuaaacauucacuucagaguauaaaguaacagacauuuguauuaacaguuucccagagaaguuugggccacguauacaacaugacaagugguacuuuaacacuugaaacuggaguacauuucugcuauucaaugguacuuauuaacugugaggaaacacagcucuuuggugcucuuuuuagugugugugaacuucaaggagugguucucuccucccacgacgucaguccuaggaugaaacucagguugucaguuuugguagucaguagaucuccuuacccucugggccaucucaccggcccugauuuuccuuuuucuguguagccuuggcucccugaagcucauucuguagagcaggccucagcuucugagagaagggauuaaagguaugugcaccacccggccagcuuugaucuucauuguucuagcuagacugcaauauagcuuacauuuguuaauauacuaacaauuuuucuucucuuuagucuugccaauucacuacuuccccuggugcacaaaaauugagugcuuguucuuuuuccauuuuugcuuuauuugcugguguaauguacuaaaauuccaguuuaaaaaauacucaauauguauaacagugugcauacaagauuuuucugggauauggcagaagugcaaaguuaaaaacaaagugagauaagcaacaagcuccuuucuaaacaacucuuaaaacacaacuacuguuuuuccagugucuaucacaauaaagaacugcagaucucaaucaguuuaauaccccuuaugucucauuuugucgggaaccgcuaacuguuggcuuagagagaccauuccuaaacuuuuaccucuaucagauauuccugggaauaguaauuuaauacguguuuacgucacauaauugaugagccugcuuguaacaaacaucuucucaucaaacucaaguuuuguaguuucaaguccuugccuaagcccgaauacaaauguaauguucucauaagcugacauucucuucucuaaucuugaugcuguugaccuauuaucgaccucaguauuguucggucgugccgcuuacaguacaguccacuuugcuucgguuccucuucuggacgugcucuuuacuuaccuggucugacucugggccgccccacccuugcaaagaugccaggcauacuuuccgaguagccugccauucuggcagucccgguacgaguggcccaggugacagucggcugauuucggggcagcagaugagggccccagaucugugcuggugcucacucgucagccuccgguuccccuguuggggcugccccagguuuggcgaggucggucugccgcggccagaaggucacgcucaccuuggggccguccaaggcaagcaccgaaauaccuuccagggucagggaaggacagacaaguugccagccagggacuacgcucgccgaccgagccgcgcccguccggccagcccagcgacuuccggaucugcgcagacaccugagucaccccucccccggcuggcuguuucccggcgugcucugcggcggaaaggccgagucgacaauaacaaaccccacggcggccgcgacccagcccugccaagcucucagugccucggccggcggacucggguccccgcgcggagccgaggggccggagcagcggcugcgcccgacucccauccuuccgggccucgccggguacucggcggcugggcgccgacgguugugucgguuggcggcgccgcaggggcgguugauagccgccgccgaggccagggcggcggcagaagauggugcggagggccgccggcuguguugcugccgcgggcggaggaggcgcugccggguaagugccgccccugcucccaucuggcggcgggcuuggcccggccgcucagcaccugacggguucgccggagcgucuggcggcgccggcucggagggucgccgcggcaguccuacggggacccugaggcccgcuggccgcugacaggaucgcgggagcggcaggacgccggugcucacccgaggccugaaucgcggccuccgucuccagggcucggugcacuggagugucgggcucgggaaaccggagaggguuugggccagggccggagugcccugacgggaggaaccuagaggugaugccuuugucccgaccccggagugcaagcaucgguguaaaguuacuccuuggaaugacucagccucgcucgccccgcagauggauuuggggugggggcuu

SEQ ID NO: 59 - RNA, 5500 nt, Mus musculus
aagcccccaccccaaauccaucugcggggcgagcgaggcugagucauuccaaggaguaacuuuacaccgaugcuugcacuccggggucgggacaaaggcaucaccucuagguuccucccgucagggcacuccggcccuggcccaaacccucuccgguuucccgagcccgacacuccagugcaccgagcccuggagacggaggccgcgauucaggccucgggugagcaccggcguccugccgcucccgcgauccugucagcggccagcgggccucaggguccccguaggacugccgcggcgacccuccgagccggcgccgccagacgcuccggcgaacccgucaggugcugagcggccgggccaagcccgccgccagaugggagcaggggcggcacuuacccggcagcgccuccuccgcccgcggcagcaacacagccggcggcccuccgcaccaucuucugccgccgcccuggccucggcggcggcuaucaaccgccccugcggcgccgccaaccgacacaaccgucggcgcccagccgccgaguacccggcgaggcccggaaggaugggagucgggcgcagccgcugcuccggccccucggcuccgcgcggggacccgaguccgccggccgaggcacugagagcuuggcagggcugggucgcggccgccgugggguuuguuauugucgacucggccuuuccgccgcagagcacgccgggaaacagccagccgggggaggggugacucaggugucugcgcagauccggaagucgcugggcuggccggacgggcgcggcucggucggcgagcguagucccuggcuggcaacuugucuguccuucccugacccuggaagguauuucggugcuugccuuggacggccccaaggugagcgugaccuucuggccgcggcagaccgaccucgccaaaccuggggcagccccaacaggggaaccggaggcugacgagugagcaccagcacagaucuggggcccucaucugcugccccgaaaucagccgacugucaccugggccacucguaccgggacugccagaauggcaggcuacucggaaaguaugccuggcaucuuugcaaggguggggcggcccagagucagaccagguaaguaaagagcacguccagaagaggaaccgaagcaaaguggacuguacuguaagcggcacgaccgaacaauacugaggucgauaauaggucaacagcaucaagauuagagaagagaaugucagcuuaugagaacauuacauuuguauucgggcuuaggcaaggacuugaaacuacaaaacuugaguuugaugagaagauguuuguuacaagcaggcucaucaauuaugugacguaaacacguauuaaauuacuauucccaggaauaucugauagagguaaaaguuuaggaauggucucucuaagccaacaguuagcgguucccgacaaaaugagacauaagggguauuaaacugauugagaucugcaguucuuuauugugauagacacuggaaaaacaguaguuguguuuuaagaguuguuuagaaaggagcuuguugcuuaucucacuuuguuuuuaacuuugcacuucugccauaucccagaaaaaucuuguaugcacacuguuauacauauugaguauuuuuuaaacuggaauuuuaguacauuacaccagcaaauaaagcaaaaauggaaaaagaacaagcacucaauuuuugugcaccaggggaaguagugaauuggcaagacuaaagagaagaaaaauuguuaguauauuaacaaauguaagcuauauugcagucuagcuagaacaaugaagaucaaagcuggccggguggugcacauaccuuuaaucccuucucucagaagcugaggccugcucuacagaaugagcuucagggagccaaggcuacacagaaaaaggaaaaucagggccggugagauggcccagaggguaaggagaucuacugacuaccaaaacugacaaccugaguuucauccuaggacugacgucgugggaggagagaaccacuccuugaaguucacacacacuaaaaagagcaccaaagagcuguguuuccucacaguuaauaaguaccauugaauagcagaaauguacuccaguuucaaguguuaaaguaccacuugucauguuguauacguggcccaaacuucucugggaaacuguuaauacaaaugucuguuacuuuauacucugaagugaauguuuagaguuuauaugcaucucaaauuauuuaguaagacuaaagugaaaauauguuauaugaauuuugcuaagcaacauagauaaauguuaauaaucaugcauauccauaaguuuucugucacaagcuauuuuuccucauccucuugagcauucuauucuccauaauaaacaaaaacaaacuccugcaauacuaugugaagcuucggggcuuuucucaaugaaacuucaaacagauuuacaaggaccauagaaugaucuuucauggggagugcagaaacaucauuucaacuuacuaaagcaugggccguucugccuucccccuccuuguguuaucucuauccuauugcuuguaaacuccuauccauuuacuguauucuuuuuccccacuucucaauuagaauauacugugggugaugugaagguugguuucuguauaagacuacuuauucuuggcuuccacugaauuuuuaauuuaguaucugucaauguuucagugaauuuucaaggaacaacuaaaagugcuuuuuaccaagaacagaacugacuccguuccuccacauguauguguguacaaucaauugaaucaaauguaauuuuuaaagugaauuuuuuuuuuuuuuaguuuuauaacuggaggaauuaugcagucugaguacuacaaaucauuugaauuuuuaagucucuuuuucucagcuuaaacuuaagcgucuucuagucuuuaucagacaugucuguaauucuggaucuuuuaaguguuuaacaugcugauuguaagcucuucuuuaaauauuaaccccaccccugaauaaugauacgcauucaguacuaacauuuguuagcagcaccuuacaacuugcucaagcccucuucuucugucuggccuuguauuagcacucauuauuuuucuaucaagaaccauccaauuaugucucuucccuuccuaaggauugucacugguuuuguuuuguagauggauaaaacuugaacauagcacaacauaucuugucuggauuggguuuagguaccaacucaucucacacuauacuugauuaaauucuccucugaugaaucuuuaaauuggauggauuuuuaaaauucauaggacucuggagagaaugacacaaauuaugaggcauuuauagaauacaauaaauucuguaaauauuaaauguuaauauuuaauaucauuaauaacacauuuuaauauuuaaagccaaguaaguuucuaugaaaaauucuugcccucagaugucucaaaggccauucaaacaaaacugcaaggauaguugcaucugaggcaguaauacuuucuauucuuuauucucccaauccuaguauugacccaccauugauuuuuaucacuaucuaauagcuugaaaaaccauuugauucugugacaggagccagaucuugagauccauacuauauuucgauuucauacuucuggcagugcuuguuauuguugauuuuuuaaauguacuuuuuuauugaaaauacgaaaguauucuuagauuugugucucuuggauuuuacauuacaguucuacuuagcugucuuaacuaaucuagauuuuaucauuuacccucaguuuuacaaaugagggauugauuuaugaagaccaaucaauacacuucuaauuaguguuccuuaguaaaaggaguguaaaaguaaaaccagguggugaguucuaaggccauaaccauacuacacaauccugccccuuacuuugguaucaauucaaauuaaggucuuaaaaggguaugaacuugaaaguuuagaaguaaaccaaguuucucaaugauagaacuauuuugugggcauagggcagggaauagcucaguuaauucacaggccauucuguggauguuauguuuuuuaaaaauguauuuuaguauucuauuuggauauucucucugcauguaugacgaccaugcaccaugugcaugcuucaugcuuagagaccaaaagagggcacuggauccucuggcauuggaauuacaaaaagcugugggugcugggaccugaacaugcucuuuggaagagcagccaaugcucuagguggcugagucuagagcccacucuagcuccacauuuucugauuuuugacaucucuggcuuccaucaccugauacucuuagccauaacugucugucuucagaccccaggacaaggagcugaagugcauauuuuacauaccaaagcagaccuggccuccagcuucucccagcaucccucugucccuaucugauauacccugcccccaaccuugaacuuucuaguuuaggagcuugggcuguucuucccccagagacucuucccuauauaauccauacauuuugcaccacccucgcuggaugugcucuuuuucuucccccuccccucuuucucccuccucauggcugcaaaucugcccauguauacuuuggcuuauuuacuaguggagaaauaacuuacuauugauaaugccucugcagacacucuaguacucccaggacagaaaaaucaauuccuuuccugauuaacaauuuauaucaugcuacaccauacaccuacugaaauuguauuucagaaaaaaauuagaagacauggaaucagccagauggugguggcgcacaccuuuaaucccagcacucgggaggcagaggccagccuggucuacaaagugaguucaaggacagccagggcuauacagagaaacccugucucgaaaaacaaacaaacaaacacacaaaggcauggaaucagacuacuguaauucccauuuuuaugguuaucucuggaaaucugugaaugaggauccuaaaaucuugccauucauuuccuaggcauauuaaacuucaaucaugguagcuuagaaaauaaaauucuaaagauuucuaaaaagauuuuauuucuaaaacaaucuaaaaugaugauauaaacaugagguagugguaugauuuaaaaaaaaaaguaauggaauuuaucaaaacuucuuugcuccacuuuggguuuucaagguaggguuucccuguguagcccuggauguagaacuaaacucuguggacuggcugaccuugaacucagagaucugccugccucuacugagugcugggauuaaaggcuuauggcacuaccuccagcaaucaaaacucuuaaaauacaaagggauacuuuuuucuuauuuguaccuauucuauauuuuuuaaaccauguauguucuauaucuuuuaaacuguguaucuuuuguaaccuauaauaaaauuaaggcuucuuucuaguuuccuga

SEQ ID NO: 60 - RNA, 1427 nt, Mus musculus
uuugcucuugggaacgagagauagggcccggaacaaggauggcagcuggaaggugaaggacagccccagcacucaguagcgguagugaucaggcuugaaggggccguugacgggcaugccgagguacugggccugcuucucagucagcuuggucagcuucacauucagcuugcccaggugggcuucagccaccgccucguccaacuucuuaggcaggaagugaaccccaacaggguauuuaucuggguggguccacagcucaaucugugccaucaccugguuugugaaggaguugcucaucacaaagcuggggugucccauagcacaacccagguugaccagacggccuucagccagcaagaugaugcggcgcccauucuuuagccaguagcggcccaccuggggcuugauguucacuuucuccacggcguucucauugagccacuucacaucaaucuccacaucgaaguguccaauguuacagacaauggcgucauccuucaucugcucaaagugccggccaaggaugauauccacacagccugugguggugacaaagauguugcccuccuuacaggcuucguccauagugguuaccucauagcccuccauggcagcuugcagugcauugauggggucgaucucgaugaugaugacucgggccccaaaaccccucagggccugggcacagcccuugcccacaucaccauagccugccaccaccgccaccuugcccgcaaucaucacaucuguggcccguuugaugccaucuaugagggacucccggcagccauagagguugucaaacuugcucuuggugacagaaucguugacauugauggcaggcaccuucaguaucccauuggacaucaucuuguagagguuguggaccccagucguggucuccucagagauaccucggaugccugacagaagcuguggguauuugguguggaugagguuaguaaggucaccaccaucauccagaaucauguugagggguccguccuugaagugcagcgucugcucaaugcaccacagguacuccucaucugucucgcccuuccaggcaaacacuggaaugccagccuuggcaauggcagccgcugcaugguccugaguagagaagauguugcagcuggaccacagcaccucagcacccagggccacgagagucucaaugagaacagcagucuccacggucaugugcaggcagccggcaaugcgagcacccuucaguggcuuggaggcugaguacaucucccgcaugcgcaucaauccuggcaucucauucucagcuauauccagagccuuccguccccaggcggccaguccgauguccgcgacuuuguagggcaguuuaucagacaugcuggcggcgcuuccgcuaggacugaugaacucagugaagggggccgggcggcgcg

SEQ ID NO: 61 - RNA, 413 nt, Mus musculus
auuccugaucaucauaaagggagccugaggaaaggccuuuugugcuggaguggacaucaaagcacucucagaagcuaaaaaagcgagacagaauuggacucaugauguauucagagaagaauacauccugaacaaugcaauugcaucuugucagaaaccauauguugcccuuauugauggaaucaccauguuuggggaaguuggucuuucaguucauggucauuuccgaguggcuacagaaaggucucucuuugcuaugccagaaacaggaauaggacuauuuccugauguggguagagguuauuuccugccaacauuucaaggaaaacuggguuacuuccuugcacugacaggacacagauuaaaaggaagagaugugcacagagcgggaauugacacacacuuuguagauu

SEQ ID NO: 62 - RNA, 2052 nt, Mus musculus
uacuaauuaugcaaagauaaguuuauuaagaacaaaauaagacaaugaaacagggaaaaacaucuaggacagaaauaaacaugaaaucugcugcucgauuauaaucucagcacuuggcccugaguuccagggcagccuugguuccauagugaaugccagauauuuugacaauaucuaaaacccaagccaauuaaacaaaagccaccgguuacaaacaaaaugacaacuauuucuggacuuaaagcaauccauuggccaaaugcaccaccugaaccaacaccaaaaagcacuauacuuuuaauauuauaguuagggccaaaguuuuccuaaaacaaggggucuuuuuuagaaccacuguaacuacuuuguuuuucucaagcacacuccauauuggugcccagguuacuggcuucacaugcaaccucuaccgacaguaaaaguuaaaagcaacaccagguaccugcauccauuuacaauacuugcaaaucacagguagauauaauuuucccccgcccuccccgcuuugauaaauacacaagcuuuguuauaaaaauaaugcaaaaauguugaaaccaaucuacuguaacgcaguauccaaagucaagauaaaaaggcaggccuuaacuuauuccugguucuggcuauaucauuucuauaauucucaaaauacaccaauuuccagucagugucucuauuaacucguccagcacugacucgagggaaggcaaacccguccuuuuaaugucaaaugucacugagggcagcggccaccuauaccgcccaaguuaacuuuuaguacagucccagcuuuucagaacuggucccgaggggagaacgcuacuuccuccucuucccaccuuggggcggcacuccuuucuucuugccagcuaaagcagaaggccaggaaugcuuuuugcuucccaagccuccuuuccucuuuucucccugacccggcgggccgcccuuucucuugcccgaagguccuugccggcccccuuuccucuugccuuucuggcucauuuuccuccucuuggcagccuccuccugguccucuucccucaucugcuuguugguggcccucgucacguccagccgagguuucuugcuguucaugacucgaaguagcuccaacugguucuuuuucucggcugcgaaguccccaaagaggggcugaaacuuccucuucuugccggagccccggggagcuuucuccuugggaaggcgcuccuggaagcgucccaccgaagcgguggaaaccuuggccacuugcauggcgcggcccagcucuuccuuacucugguguccaguagggugcaggccggcugagcugggcaucugcaucuugugcgcgcgagccagguuccgcagacgguucagcucauucuuggccacgcguucuuucuuggccugaguccucuuggcgaacuggucuuccauggggucggcgcucccaggcaccucgaucagccauucuuuagugucaucccgggcgcgcuuguagccccaacggcgccgccacuggccacucgccucgucccacacgagguuggucuucuucuugggacggauucccuuaaggcgcgcgaacugcugccagcgggugagcggccguggucggggcagcggcuucucgcggggcaggcgaguggcgggcuccggcaagcgcgcgaccaccgccuccuccacgcgcucggucggcagccgccacagcugguugaugagcagcugcguguugucccgcgccagggcccgcagcucggccuccggcgacggcccggccuggcgcagcacggucgggggguugcgguccgaagccagcagguugcccaggucgaacuccagcuccagcuccuugugcaccgugaugcgcugcagcuucuccgccuccuccugcucugccuuggccagcagcuccuccacgcgcuggcccuccauggcucucgcugcggcucggaucccucacuucgggacagcggcgggacguaucgccacuacagcagcacccuaaaccggcaaccacgugcggacguccggacccguaauccggaagag

SEQ ID NO: 63 - RNA, 1264 nt, Mus musculus
ccuguuuagguguuugcacuuauuuuaucucuuuuugaaagaaugucuuugcuuaugugguagagauuuuauguaauuuuuugagauguauaauggugugcugucaaccuaaacacugacaggcaaauagaauuguacacuguaguuugaauuauuuauaauugacacacucucucccucuccacuccugaaguaugcugcuauagaaaguagcagaaucggcuugcugcuaugagagauggaaagagcgaccaccacuugcacugugugaaaagauaagcaaaugauggcacguucucaaguuaacuaauggauucaacuauucccaagcagauucuuacaaagaccaaaacaccacuaugccucaaaaccaaaccaaacagcuuaagauuuuuaaaacucuauuuaucuguuaauagaaaugggacuacugaauauuuuaaugccuaguucuucaacaguagaccuaaaggguuuuaagcuuuaaauccaauugcuaguuuuugcauacuauauguuagugagaaguaaagaauauguguggugguauuaagauuaugccuucuugauaacaauagguaaaacaauuugaaucuucuuagcauguuaaauguuuauuuuuucuaauuaaugaacuucucacagaaauuuugcuuuguaaaaccaaugauuguggaaaaaaaucuauauaucauuucaguuacuuugggguaacaauagcacauaauuccuuuuuuaaaaaauguagccuucagcugauuggauguaauaaucuccaguggccaaaguauauaacucagacacguuacauauucuaaaacauaauuuuucuugagcauuaaguuaacacaaauguuaauguauuauacauaagcuucagcuuaugggacagaguacauauuuggguugguauugguugaauccuccaguuaacugcuuuguuguuguuuuuuuuuuuuuuuuuuuuuuuugcaagauuuguaaucauaaaacuguuaggcaucuuaagucaucuuuuucuacuguucauuuauauucuucaguuuucugaagaugccagacguacagguagcagccauucaugcauggaaacugacuucacacauaccaauacugcauuuuguuguaagguuuucacauuaauacagcaauuacacugauuaaauugaguuuuuuuaauauaugaaaaacuuugcauuguaagagaaucuugcagacaauguugaaaucuauuaacauccaaauaaaagcaucuguguacaag

SEQ ID NO: 64 - RNA, 31479 nt, Mus musculus
gagcacgccuccugacauguccagggcaucccuggccgggcccggccgcggcuaggagcagugggucuugguccgccccucugucccucagucccgccuggcccugaccugaccgggccugcuuuccgcucucggucaccugagggaaggaguuggggaagcggcgggugggucucggagagggagcauuggccccaggcuggaggaggcugaccccgcguccccgcccagcccgcgccuaugcgguacuugaaggauggcgaagaggucgcgcaggugggugccauccccucggacccggccuagcggcccugucucgacucuugcucucuguccuuuccugcugguccccacuuaggcccucucgagccuggggggcauagguuuuccuguucggugggugucccacacccgcuucggccgcgcuggccugagagcaucuaucauuauuagacuccaucauuauuagacgacuguguguaggacucucucuaacaaaugcucagguugcugcauugacggauucucccacagcucacgcccagacuucuaacuucucacagccacuuucagggagguuucuugccagguaaguuugcccacugucaggggauacgccacgccaggggaagcgguuguguuugccuggaugacuugaaaugggguucucuccucugacuuaaucgugccaaaucaaaacagaucuccuugacaaaccugggcgggcacgguucugggaaaucuugagaagggaauucgcuaaaucucccuugugcgcacugcucuucugagcuuuucuuuuucuuaguaucuucugaggacauuguuacguuguuacuaucgaguaaacuugauccuaaaccaaugugucuuaguuacuuuguaucucaaguauucauguuugauucugauuguaucggcauuguaacaaguaggacacaauguuguuguuguagaaagaugugcuaggaugucuuuaugcaccuaacuuuuauuuuaugcuauuguaauagcuacuccuaaauuguguggcauaaucagaugacaaaaaaaucuagugucucgauuuucaguauuaaggaaaccugaaaaguauuucucagaauuuccauuuaucuagauacacagcuucaaaaucuaagagucauauucccugagcugaaauuuaguacugagagucauucauugcagaguuugauuuaaaauaacuacgcauaaaauacuuggcuuuauucauauauucuucuauauguagguugguucugcagauaucaacauaaauuuaauuaugacauaauuacuuuauauaaaguggcugcagaauagauugaacauugaaguggaacaagugugcauauacgcauacacccacaggcacacuaccuuggucuuuuaucauuuuggaugagguaguuguagggguuuuuagcagcaccuuuaccuuuacucaguagaagacaguagcccuuuuuccuacagucaggacaaccaaaacuguuuacagauggugccacauaucucuggggggauggaaucuggaccaugcagguaagaacugcugaucuacaacuucaaagacauaacauucccaucuucauaaaagaugcagauuuaaagauaagauugcuggaguacugcuuuaggcuuuuugaguuuugaagucuaacaaugcuuuuaaaugauguguaaguuaauugagacaauauagaaugauguaaaaaaugauguaaaaaguuauaguucuggaguaauugugcugcagugaaacacuucucuggaaguauguagauagagggugugaugagagaucaccaucucuggucuguuucuuuggguuuucuucagugaguuccaggugcuguuaaauuucuuauauauuuaaauaugauuccuguauuagaagauaaugaaauguuugaggaugaaauaccuuauucauugggcuuucuucuuuggcugagaaucuuaguagauaugaauucaauauauaauagagaaacaaaggucuucagcauacaaacacugaggugaaugcaauaucuugcauaaggauaugggcauaaauauaguagacuuucucuauguuauuugggggaaaaaaacaccuaaaagcagaaaauguuuacccuaaauauaaaacaacugaacaauguugguucuuuuuagcuuucuaauggcugcagaguuuuucacuaagauuugcauauagaaaagguuauguaguuuugugacuuaaaauaguuuuagaauuuaauggggauuuuagugauacaauuuacagcuauuucuuauuaggauaucuauuaacaguauguauuugauuuuuaaauauucuauguauaguuucauuuuaugguaugugugugcucaugcaugagugcaugugugccuguguacaugcaguugugccagggugugaaagaugaaaggacaguuaucuggaaguucacugcugccauaguuguccugaggaucaaacccagguugacaggcuuggcagcaaacaccuacugagucaucuuuccugcccuaguuuagcuuuuaaaggccaauuaaaccccuagaaauaaguucacaauaauucugaugcuacaaagccuacuuacuaggcauagguuaagauauuuauacuuaagaugaccaaugauuaaauuaaaaugauaagaugaaagcuagguucuacauaggaaguuuuuuccuuagugguguguguauuuguguguguguagcaaauucauguuuguuucuagaaacaugacugaagugaaugaaugcaaaacuauaagaaauauuuuuaggaugauaaaggauauuuuuaggauuuuuuuuuugugucuuuaacuagcaauauuauuuuggggaaucagguaaaaucuauuucaguuucuuuucguuuauauaugggacuuggacuuuuuagucuguaagguagcuuauaguuuuaauccaaaucuuugaggacuuuugugaccauccuguucuguuuaaaaauaacauucucuaaaagaauuagaaauauuauccauuguuuuuguuuauggauaauuauauaguuuuuuuaaaaaaguauuuauuucaguguuuguaauauuaaugguucugauuaucugaagucaaacuuugucuuucucugauaaugcuaguuugcagucuagagguggaagccaauauuugcuauaugcaguacagcauauuaaccgcuggguggccugauuucacuuuguuaaaucaauuugauaaaugaacauaaauugagugcaguugaacugaaaauaauuaaauauacaguugcccugaccuuaaauugaccugaaauuaaagacuuuuuuuuuuuuuugagacaggcgcucacucacuaguacuggauagucuuaaauucacugucucacuauguagccugggcuggacuugaauuugugaaaaauccucuagaaucagucucccauguauuggaauuacagauauaagccacuaugaccagccuuguauuauuuuuuucuuaaagauuuuuuuauuuuauguauaugaguacacugucacugucuuuagacacaccagaagaggguauuagaacccauugcagauguuugugagccacuaugugguugcugagaauugaacucaggaccucuggaaggacagucaguacucuuuuuuuaauuaauuuauuuauuuuuaauuuauuuacauuucaaauguucaaccccuuaccugguuacccccucccagaaacucccuaucacaucuccccucccccugcuucuaugaggguguuccuccaccuauuuacccaaccacuccugccuccccauccuugauuccccuacacuggggcaucuaucaagccuucauaggaccaaggacuucuucucccauugaugcauggacaaggucacccuuugcuauauaugcagcuggagcuauguguacuucuugguuggugacuuaguccuuggaaacucuggaggggucugguugguugauauuguuguucuuccuaugggguugcagacuccuccagcucccucaguccuuucucuaccuccaucauuggggaaccugcacucagugcaaugguugacugcaacucuauauguguaaggcccuggcagggccucucaggagacagcuauaucaggcuccuuucagcaagcauuucuuagcauccacaauagugucgguguuuggugacuauaucuggcaugaauccccaggugggacagucucuggguggccuuuccuucagucucagucagugcucuuaaccacugagccaucucuccagcccaaccuucuauuuuuuuuuaaagaguuauuuauuuauuuuauguauaugaguacacuguagcuguacaaaugguuaugagccuucaugugguuguugggaauugaauuuuaggaucucugcuugcuccagucagcccagcucuggucaaccccacucgcucagucccugcucccucuggcccaaagauuuauuuauuauuauaaauaaguacacuguugcugucuucagacacaccaggagagggcaucagaucucauuacugaugguugugggccaccaugugguugcugagauuugaauucagguacuuugaaagagcagaccugcugagccaucuuacccgccuguuuuuuuuguuuuuuguuuuuuuuuaugauaaauauuugagacuugaggaaauuuggauuaaaaaugugaucaaguugagggaauuuuacuagaaauuucuaauuucucaaauuucagacuagagguuacuuuuucaguaaacaauauuuuucuuuguuuaauucaucuuuauuagguugucuguuagucuguauuucccccaaaaguuuuaucuuaaaaaccaaguuuaauuuguguauugauauauaaguaaaaucaugacuaucguauccuauuagcuuauaauaccccaacauguuaagauauuuuuuuguuguuucauaauccucuuuauuuacucauagaacaguuuucauugaaaauaauuugcuuauguauuaaaaauuuauagaauuaacauuuuccugguaaaguguggugguauauauacaucuguaauacuagcucuuaaagacaggaagggaguucauuaguucagugcagccuagguuacauagugaaguuaaggcuaccuugaaauaguaguauauuguuuuaaaaccaaacaaaacuaaaaagaaaacaacaacuaagccagcaacaucaacuuuuaaaaaauaauauuuuucuugacucuaaauaagaacaguaacagugacugaggaaaccaagcacuagauuggugagcuuuuaguuuuuaauuagaguaacauuuuauuacuucugcuguucucuagauuaauuauguuagaguagauauuauuuauuucggggcuggagagauggcucagcgguuaagagcacuaacugcucuuccagagguccugaguucaaaucccagccaccacaugguggcucacaaccaucuguaacaagaccugauucccucuucuggugucugaugacagcuacaguguacuuacauauaaaaaaauaaaauaaaucuuaaaaaaaagaaauuauuuauuucacuauaaaaguagaaaguucaaauuuauuaaaucauuacauauuacuagcacugauuucugcaauacaaaaaugccuucaaaugcuguaagacauugaaaaaugauuacaucugucuugguaguuucuaacuacuacuguuaagagguagaauaauuucauuguuaaauaugaaaguggaacuuuggcaaaguuacacaugaagacuaauccuuuucccuuaaaauuuuuuauagcuguguauguguuuagucaaauggauuugauaagucagaggaaauuagggguuccuacauaggguguauguauguauguguguauaaaaucuagagcuugauuuuugugagauugaauuuguauauugcauuuagauauuaaaagucauucguauauugcauuaagaauggccaaaucuucagacuugauauuugauaucagaaugaauuuuuaggaacuauauuuaguaaggcaaaaauaauuuugaauucuauuauauuagaccaucuauuuacaaaaugcugaaucacuuuuucuuaaagguagguaauauauucaucuuauaguugugcgaaguuagucuguuuaggguuauacaguuacaacuugaaccuuguucucauuuuagaauacacuuagguuaaucuuugguaacuuccaguuucuuaguaugcuuucuucaguuuuaaaaugugcucuauauauuaaggugguugaauagugaacuuuagcagucauucuugccaguguuguuuucagauggucauuacucuggcuacuuaguaucaucuaauucauuaucauggaggcuucauucuuuaaaaugucccucccuccuucccuuccuucccuccuuccuucuuucucaccccaccccccuuuuaccccauacaauucaggcucugagcuuguaauccaacuuauuuuuggagacaguguuucucacugaaccuauagcuugcugauuugccuucccccaauugccuuuacucaucauuuuuccuaggugcccuuccuuucccaaauagucucuuuuugcuuucauuucacaauauauuccaguaccaccuaauguucccgucauccccuuuaggacuuaauuuuguauacucugauuaauauugagauuguauuguuuauucugaguagcuucuuuagucaugucugcauauacagacucagugcuuuaaauaauuuaaauggcauacuuuagcuuacauauugcauucuuuuguagugaggacgaggaugaugaccuucaauaugcugaucaugauuaugaaguaccucaacaaaaaggacugaaaaaacucuggaacagaguaaaauggacaagagaugagguaguugccugggaagcuugacuagucucauaguuaucaguauuauagucacgaaaggaauuaugaaaacaaugugagaaaauuaucagcuuaguugugcauucuuuuuaaaaaaucaaugauaugaacaauuguuugauuuugggauugacugaaacaguguaauagaggaauuuguacaauagugacuuuaguucuucucaaaacaaguaccaaguaugacucaagaguaugagaauagggcuggugagauggcucaguggguaagagcacccgacugcucuuccgaagguccagaguucaaaucccagcaaccacaugguggcucacaaccauccauaacgagaucugacucccucuucuggaguaucugaagacagcuacaguguacuuacauauaaucaauaaauaaaucuuuaaaaaaaaaaagaguaugagaauaucaucuacauaccagggguggaggaaauauuucuaauuuuuauuccucucaauaggaugacaaguuaaagaaguugguugaacaacacggaacugaugauuggacucuaauugcuagucaucuucaaguacgugaaaugucaaguuguauuucuguuacaacauuucuuuauuuaaaccauuaguuuauauauucuauuuuucagaaaugugucuguauaguuugguuuucauccuuaaaacaucugguuaaauuauuuucugguauguuuguaguuguuuguuaaugguuuagaaaguaauuuuccaauucaggcugaguaccugaaauccaaaaauuggaaauuucuaaagugcuucaaaaucuacaacuuuuugaguacugauuuagagccacaguuuuacacuugacuuaauguaauacaucacaguaaaaaugccagguaugccugaaauguuacuauuauuagauuauguguauaagguagauaugaaacauagaugaguuucaucuauagacuucuguuccauccccaggacauauuauuuuaugcauauguacauauuuccagaucuccaaacugaaaucugaaacaauuuuagucucaaaaauuuuggauaauggcugcuuaacuuguaaagcauuuuuccaggggccuaaaagaacuuuuacuauaaaacaaaauggcauuaacuuuugguagaacuucaaaaauauuugugacaagugguuuuauuuuauuuugauuuuuguauguugguaauugaaccuagggccuuguaaacucagccaagcacuuuacuauugaucuauguccucaacugugauauaugugaaauuauuuugaagaacuuuacuauuaaaacauuuugacagcuaacaaauaaaaucaagaaaaaauuguuagguuucuuaucuaaugcauauguuuuuggguauuuuuauugauuuuuuuuuuugagaugaagucuuacauaguacuuacuuacuuacuggguagccuggaagucauuauguaaaucaggcuggccucaaacucauagauaucugcuuaccucuuucuccugagugauaggguuaaaguuguaaaguaucauaccuagcuauuuacauuuuuauuauuuuacaguauacuuguucaucauaccaauauucgcauauuauuggcauauaauuuuauaugcaauaugaaguacuucugcauguacucauuuguuucuuaagagcauugugaguuguuagauaaauuaccuaaauuuuaaauuucaguguugauucuuuuugguuucagaaacaagguuaccuuuggguuuuuguuuguuuauuuguuuucauauaaucauagaaucucucaguguaacaugaaaacugagaaugaaauaaugggagaaaacaaauuauagaguuagugcaaauuauauucaaaugucagcucuguuaauuuagagaaaauacuucuuuggccuuccgcuacuugcuucuauaguauugugagaauuacaaauauaaacaagguuggcacaguuccugacauuuagcauuuagucaguaaaagcaaacucaagggcuggagagauggcucagcaguuaagagcacugacugcucuucuaaagauccugaguucaaaucccagcauccacaugguggcucacaaccauccauaaugagaucugaugcccucuucuggggugucugaagacagcuacaguguacuuacauauaauaaauaaauaaaucuuuaaaaaaagcaaacaauuagaaguuauguauacuagauuuaaacuagagguuaaaauuuauuuuauuuauauaaguacacuguagcugucuucagauacaccagaagagggcuuuagaucccauuacagaugguugugagccaccaugugguugaugggaauugaacucaggaccucuggaagaacagucagugcucuuaaccacugagccaucucuccaacccccuccccucacccccaguuaauuuuuuuuuuuuuuuuugguuuuucgagacaggguuucucuguguaucccuggcuguccuggaauucacucuguagaccaggcuggccucgaacucagaaauucuccugccucugccucccaagugcuaggauuaaaggcaugcgccacuacgccuggcccccaguucauuuuuuaaagugucaauuuuuaaucuacuuaauugaaguauaauguauaucuucuaugaaaguguuucauguuuuauugguaauuugaaagguauaauuuauaaauauacuuucacuaccacauagagacuagugaugccuuuaagaugcuuguacuaaauugagcugcuaugcuuaaaaucuuauaucugcuucauauaguuuaauccugucauuuauuucucaauucuggauuaauuuuuuauggacuaugucuugcugcuugcuguauuauaaggauaguauagagguacaugucuuaauuucaaauauguuguuuuuaauuuguagccuaaaccuaugauuaauugaaagagcagaauugggauuuuaggcauguaaaauaagcauugcauauaauaguuugauauugaauauuuuuuugacuaauauuuguucauauggguauacuuaaauuugggcuaauuuacuuccuggagauauauagucaacaauaaaauuguccaaauuuuuucagaaucguucugauuuucagugccaacaucgauggcagaagguuuuaaauccagaauugauaaaggguccuuggacuaaggaagaagaucagaggguaauauauucauauucuuuugaaaaaauuuauuauuuauuuguguauauauguuuggggacauguauguguguuuauccuuaugccacagcucacauguagaggucaaaggauaauuugugggaacuaguucucuccuuccacccacugugugggucuuagagaucaaacuuggucaucagguuuaaugccaagugccauggagccauuccuugcuccuuguucauauucuuuauguucacuguacugauggauuagauuaauuuucuuauuaacaugguuuaacacaaaguaugauauguguguguguguguguguguaugcuaagguuggagguggacauacauguauugcaaacauaugugaggaggcuggaggacuggugguguuucuuaagacaguaucauucgggauuuauuuuuaugacaugggggcucucauuggucuuaagguugccaaguaggaguagguuggugggccugugagcauuauggaucugccccauugcugggauugcauguauaugccauuaugccuggcuuuuaaaaauguuguuucuggguauggaauucagguuuucaugcuugcaaggaaagcacuucaguaacugaaccauuuuccccagugcacacuuuaaguuuguugguucuguucuuuggaggcuauaagcauaagaauugaauguugaaugccuugaaauguagcuuuuucucuccuagggcaaggauaagugagacaauuuauaauaaguacuguccuuuuugagagcuucauuuacaaaaggaaaaauacuuuaaaguuuggcuuagcaacaugucaggcauaguuuccuaucaaaauuuaauuaacauuaaaaauaaauuuuaauuuuauuuucauauuuaauaacuugauauauuaggaaaucacucuuaauuuuuccucuugaccguaaugaaucucaugauuagacaaguaucaggacaucauguuuccagagggguuguaauaaaaaccaauuauuugugcaauaaaaguuguugaagaauagaagcaucugcucucuacuaggaauugcucuuuaauucuuacccuuagcuuuccuguugcuaaggugccuguggaauuaggacauccuuauacccauaagagcaaacaaacaaaaguuacuucauguggcucaggacugaucugacuuuucuuaaugggcgaugauaaguuuugaaaaugugaucuggggcuagugaagaggacaguugucuucugucuucuacauagucacugugguuuguauuugucuaacacucauacuuacaaaucauaaacaugcaaauaauaauaauaaaaaugauuaaguaaaauacaaugugagcucuguuaaaaagauauuuaauggcuggaucuaguacauugucuauaauucuagcuacucaguaggucuagauaggacauucauggcaaguuuaaggccuaccuggguaacuuagugagacccuguuuaaaaaucgaaaugaagaaaagggcugggaauauaauucaugguagaacacuuguuaaacauaccuaguacugggcaaaaaagaaaaaccaaaaagcuguaaucaaauaaucaaagcuguacauuuaaccuuuaagucuuauuuuuuaaaaauaugacaaguagacacauuucaagaaaauugugauagauguuaaacuuaauuaaucuaccaauacagagugagcauaauucuuugugauucaugugauacuugacugggucagaguagcagcgaaguaggugggccaaggagaugaacuguucuuuaaauuuuaguuaaacuaaaagcaaacaaaauauaggacaaauguacaaauguuacuucaguuacuucaaauuacuucagaauaauuaucuaugaguaauuagccccuugaacuuuuugaugcauuuuggguauugauuuuugaacucguugagugcugaaggauagcuauuauuaacauuaccuucugugaauuauaguuauagcugaaauuuaauccauguuuucuuuuuuuggucuuuugagacaggguuucucuguguagccuuggcuguccuggaacucacucuguagaccaggcuggccaccacgccuuaaguagaauucuuaauuuggaguuuuuuuucucuuuuuguuguuguuguugaggugcuucagaucaaaccuaggaccuuguauugggaauaaaagaaaaaccaaaauguuccguaaugaccccaaccuugacuuguuugaguuacauuuuaaaauucuuucauaguaauaguuuuucaaucuuugauuuugcuucuuagguuauugaauuaguucagaaauaugggccaaaaagguggucuuuaauugcaaaacauuuaaaaggaagaauaggcaagcagugcagagaaagauggcacaaucaccugaacccugaagugaagaagucuuccuggacagaagaagaagacaggaucauauaugaagcacacaagcgccugggaaaccguugggccgagauugcuaaguuacuuccuggaaggugcuuacauaaauaaguuucugugcuucaacaugaccuugacuaccuuacuauugaauauauuuucaaguauuuccuuucuauuauucacaauucaaguuuagucugcaugcuaugagcaaccauuuggguacauuuguaauuuugugguaaagaauauaauuuguacaauaaaaugguaaaaccuuuaagcuuugcaaacauuucaucuacuccacaagucauguuuauguguuauugcugguaaggcagaacuuguacagcugguggagugauaucuaaauuagagaucucuuucacauacugugcacaaggccaggggacuacaaguacuuugauugaaguaaauucuugugaaugcauguuacggaaacuuagcucuuaagcugugggaguagaauaugaaagcccauguagcugaaguguaguauucuccucugaagcagugacuaagugcauucuccacuguacuguucagacaccuucugacagccacuaggacugcagaucuuaucuuaggcaauuucauaucuuaacucagaauacauauccucaugcuucauagcuauagucucuauguaguacuuauaguaacuaauaugcuuuuauaugcauuccuuaaucuuuguauacuuuagaaauauguaaaggaaacauuaaugcuuuguuucauaggaaauuaagaugcaguauuauauuuucuuuuguccaaguuacuaucccugggcugugaacuucugauauauucaguauuuuaugcaccuuuuuacucuguguagaaccucacuuagugcuuuaacagaguggguuucuaguaaguguauauuuuaugcagaaugaaauuuauacuacaaauagcuuuagguucaucuuuauaaaaagaaccuugggcaaaaagggagcugaugaacucauuguuuaaaaauauaauauucugagaaauaguuaagaauauuugaaaucuguaacuuguacuuuucuuuuucuuccugucucuucuuaauggaauugaggauugaccccagggccucauucauuauagacaacuaaacaagcaugauuuuuuuuuuuuguuuuuuguuuuuuguuuuuuguuuuuguuuuuuggcaguuuggguuuuuuuucccauuuccuguugcaaggccuuuguacuugguaugccuuuuauccagaggcucuuucuuuuauuuuuuguuuuugagacaggcucuuacuauguuguccaggcuagccuugaauucccucaucuguuaccuucaggcagaugauccuacgccugccuuuuuuccuguucuuguacuggcagcucaucuccucuuugaggucucguggcuagagaucuuucugguccaccuauccagacuuaaccccacugcaaugauaaucuuguuuuuuauuucuuuguuuuugucuuucuucuguguuacuaugcuuucagugagaauuuaaccucggugacacaagggacuaaauacucaauuuuaccaguuguaaaaauaugucuuauaagccgggcugugguggcccacgccuuuaaucccagcacuugggaggcagaggcaggcggauuucugaguucgaggccagccuggucuacaaagugaguuccaggacagcuagggcuagacagagaaacccugucucgaaaaaccaaaaaaaaaaaaaaaagucuuauauauuuguucaaguuugugcuaaaauuuguagaauuccuuuccccuuuuaaaauuauauacuuucauuucuuaggacugauaauucuaucaaaaaucauuggaauucuaccaugcgaagaaaaguggaacaggagggcuauuuacaagauggaauaaaaucagagcggucuucaucaaaacuucaacacaaaccuugugcgacuauggaccauuugcaaacccagaaucaguuuuacauuccuguucaggcacauauuuuuaauaucuuuauuauuuaaaaacaaguucuuuaguugcuauaugggaacuauuggauuggguugggcuuuuuuuuuuuuuuuuuuuaggacaaguaaauuuuguuuuggggagugacauggauagacuuaaauuucuaaucugaaaaaguaagccauaauuuugacaaauauuuuaguacaaauuucacuugaaaguuuccuucuauaugugauuuccacauugagaaauauagugcgugcauauaauaguacucuuuaauucauuucauuuauggacauaaagaugugcuuuaacaucuaugucauuucuccuccaacauuguucuguguaauguaguauugccuaucucacagguguguacagagcagucuaaaggagaaguaguaaaacgaucauggaaacaguccuuugggaaacaguaaauagcugaucuuugaucuuguuacacugcucuuugccugagugauuuagccuucauuuagacagacucauuagagguuacccaaauucaaauucagggagcucucugucuuguccccuacaacacacauuuacccaccuguaagaaauauguuuagugaucuucauaagacuugcuuuccccugucuguauauguauuuauaguagacaguucuuaguucuuuuuacauaaaauguaaaaggcuguuaggaccaaguaguaucucacaaaagauagacuugggcacaguguuaaagucugcuuccuaagccucagguuucauuucauucuacuuuuuaugaacauuacuaaguucuuuuagacuuacuuuuaaaagaaacaaaguagucacaucuuaauuuauaaauaggaaaacaugggacuacagcaguguaguuaacugcugucauuugaccuuaaggauuuuaauguuuuguuuuuaaaacauuuucuuuaaaguuuuagauuucaauaguguaaacagcaagguuuugcuucugucuuagaaaaauuaccauuuaaaguuuuuuugacuuacagaaagauaauuuuaaaaauuacuuguugccaagggaguguuugacaaucucaaccacaguguguugaagaggauaaggguaguguuuaaaauauuaagaauuguuucccauuuaacaauuuugaaaacuuuauauaauuuaaauuuuaaacuauuaagaagauaauucuagccuggcaacuuuggcgcaugccuuuaaucccagcacuugggaggcagaggcaggcggauuucugaguucgaggccagccuggucuacagagagaguucuaggacagccagggcuacacagagaaacccugucucuaaaaacaaaaacaaaaacaaaaauggauaauuuaguuuuucuuaagaagugugaagaaaaaauauguugguuugaaauacuguggcaaauuuucauugaaaacuuugagaaaaauaaguuccuaaucuauuggagcuuccaaguugagcaauaacugauccuaauugaguauugucacagcuaaccucuagguuagagcucagauagaaugauuuuugcauuagaugaugauuuaggccaauauagaaaguagacagauuauacuuauuuguauuugauugccagauuuuuuuuuacaaacaucucauacauuuuauuagugccccuaaauuaaaauaaacuuuacaauuuuuauuaccaauguuuuaggaaugaggcagugauacuuagugugcugucagagugucuguuaggacuacaugccugacucugauugguuucuacuugaguaacagaaaaagcccucuuuucuuuuuuucuuagagauugauaguagguggugauaagaguaugaacacaauuuauuaucuucuguaggcauuaggggagcccucaaaagcugacuuuuuaaaacauaugguagaugauguugguaacagacaauuggcugauagaaccaggacuggaagccaaguguggugauauauaccuguaauuucagcacuggggaggugagggcaggaggaccaggacuuugagaccagucucagcuauauaguuagcuccagcuugcuugggcuucaagacaaaacccugucucauaaaaucaaaagacaaaaauacaaaucuaaauguagguuauuuccuacacuuaggguuuuaucaguagauucuaaggacagaugauacaauuauuaaauaaaaaacuauuguaguuaugaguuuucaaaguugcuagacaauauucagucuccagguuuuuguuuuguuguugguuuuuuguuuuguuuuguuuuucugauacaggagcucaacaucuagccuugagauuuuacagaguucugucugccucuaccucuuaagcauuaaaggcaugugccauccuucccaguguuccacuuuuaauggacauuuuaucacaaccuuucuugacaucagauucuuaaaaaaacguauaaccucuagcaauacuuuacuucuuguuucagaucccuggguaucaguaugugucgccugauggcaauuguguugaacauguucagacaucugccuuuauucagguaaggcuaauuuguaacagaaccacaaaggaagauaguaaccauguguugcuuaccuauaaucccaguuuuugagcugaggcaggaggauugccacaguucaaaacaagcagagcuacauagcaaguaucaggccagucagggguacagaauaagaagcaaaaacaauaaaagucuaacaaaugaaaaacaggaauccuggugauauguacagaccugugaucccagcacuugggaagaugaggcaggaagaugcugugcccucccuccacuaaaaacaaaacaaaacaaagcauuugacauaguuuuagauguugaauaguacucauuuccuuaucuauuaaacuaggauaaagaacauugcugaguuuuuuuuuuguguuuugucuuuuuaauuuuuguuuuuacuguaaguauuauuuaucuaaaggaaaauguauaaauggauuugaaaaauaaaagccauaaaaguaugaggugacuagcagcacuaguguggcaauuuguucacuuuuauagcuuaaaucauucaaacaguuccugaauuguauaaaacacuuuauaauacauuuaucuaaaauauugcagagguacauuuuugaaacauaguuaaugcaauauguuuuuaggauccccccugcuauucauuuguaaaaguauuauguagcccuggcuggccuuguaguugauauguagcccagauacucuuauaguccucugugguccuccuguuugcaccuuccuacuguagggauuacagcuguaugccaucaugcugcaugguuuuaggugaugcuggagacucgccugggcuucugcauacuagacaaauuacuaccugaauuauaucauuaccacuguuuuuugucuuuuuuuuuuuuuuuuuuugcuuuguugagauagggugcuaccauguagcccaaggauagcuuuaaacuugaaacccuccuuucuuucuguuuccagagugaaggaaugacaagugcacuaccauaccugaaauaaugcccccccccauuuaaauuuucccaguuuucuuuuacaaauuugaaaauauuuacaaguacccuuuuagauuccagaggaaaugugguauagauuaguaacauuuggauuuaguauuauuaagcuuuuuauaggcugaugaaaacacaaucuuaaagcaguugugauggugcuuguuuuucuuuuauuuaacuuauuuuagcaacccuuuguugaugaagauccugauaaagaaaaaaaaauaaaggagcucgaguugcuucuuaugucagccgagaaugaaguuagaaggaagaggcuuccaccuguaaggaacgaacuuacguguuugcauuugaugguuggaguccucacauggacgcgcucauucuuuucacuagcuguggaggacauuuucccauuuaauuugcaguuuugauguuuccagaguguugacaugguucuguauuaggauacuuuuuuuuuccuuaaaaaauguuucuuaaaucauaaaugacuuagaguaaaaucuuucauuuguauuuuuuuguguguguuauauuaggcuuuuaaaacuugguauuacauguaaggguggauuaaauugaaaagcuuguaaaauacauauagguauagagagauaaacucuaaauuauuuuuauuuucuuugaaaaauugucuuucaguuuauuuaggcuaugaaucaauaacuaauagcagaagggagcauuuggauuuacauucucuaaagaacuuuuucaaaagaagaaggcugauauggaugccuuugauuuagccagaauaacuaggaguauuaaauuaagauaagcgauauaacugcuaguagaauuaaacacguuaugcuagauggauuagagaaaaaaaagauguacauuuauacuuggauaagaauuucagaaguuuaaacugauaccugcagucuuuaucuuuagagauggguuuucuuagacugagccuacagcucaguggcagagaauuuaucuaauagauauuugaucuuggguucagucuuagcacucagaaaacuugcuuuuccucuucuugacuugcgacuuaaugagagggcaaaaauguugagaguuaugggaacuuaagguagcauuacucugagagaauaaagcgacauguucaguuauuaucacaaaacaacugguauuaucuuagaggaucuaagaggguauuuaaaugucauguuauaauaauuauuauaggugagauuuuacuauaggaaaggcaauuuuuguuuugaaacuauaaccuaucaguaaauaauaagaucgcaaaugugcauauuucaaugauaauuuuagcucuguuaaagaaaugacaaguaguccuuauuuguagaugacuaugucauauuuaagccauuuuggaaauuuuugggcugggauguagcucaguguuaggagccuuuuccuauguuugaggccuuucgcuuuguccccaaaugcuucaaaccaaaaccaaaacaaaacaaagucacguuuuaaaaauauuaaaaauguuaauuucuucauuuuauuuuauguguaugaguauuaucugcauguauaucuguguacugcauauaugaagugccagaggaggacagaagaaggucuuagguccccugaacugccauguaggugcugggaaucaaacccagguccuuuggaagugcagccaggguucucaacugcugagucaacuuuccaguccaguuugguuuuuaaaaaaguaauaguguuggggacauguuaggggggguaugagggauacagaaggggaauagcggguggaaaugaucaagguacauugugcacauguaugaaguuaucaaagaauaaauacuuuaaaacuaauaacaguaccuuagcucaggaugcaguauaucugucucauuuaauaacaaaacauacuagcucaaguaguuuacauuuuauauuaaaagagagaaauuugcugacuucuuuuuaaaacuugaugucaaaguauggcuaaaugggcuauuuuaaauccuagagggauguuacuuuagccuguaguauagacuucauacaaauuuauuuauuuuuuaaacagauguaugauaauaacuauuauuauuuuacugaauucuauuaugcuguacuuagcuauuucauguauauacuuggugauucucauauuaauuaauuaaaguagauggaauucauuagagauuaagguuaggucuguauaguugcaaugcugugguuuuucuguuugguccaguggcuuccauuuuuguuuguuugcuuguuuguuuauuuaaugcguauggguauuuugccugcaugugugucugcaucgugugugcagugcucguggagguuagaagagagaguaagauccuuggagacuggagguguggaugguucugagcucacaugugggugcugggaacugaacguugaauccuuggaacagcagcagaugcucuuguccacagagccaucugucaguccugaugcauuuuuaaacaguagaaaccauuuauugagugauuucuuuaaaaugggcaguauauucuuaagaauauuauugcuauaugcuauauuuaauguaaaauauaauuuaaaauuccucaugugcaccagccucauucugcacauaugacugcugguucccauacucauuugcuaaagauaaagaauacuuucauauuucagaaaguucuauugaauagugccauacgugcuacaaguuaucuuuccuucaugagucuucaagaucucauuauuauaagagcaggaaacgaggcuuccaagauaaguaaaaugccuuggucauauuucuaaaaagagaaagaaaacuaguauagccccugauaucagaguacuuaaucugcaaugagaucagagaugaggaauagaauaugguaggaugaaauaagucacuuaguuuuauaagaauugaggagaaauauguacuuuagauucacaguugggauauguucuuggaagaaguccuauuugaaccuaguuaaaacucaggaugacuaucuauuagcaagauagaugaauuaaggcaguauuguaaauagaagagaugaaaguauauugucagucacauggcauacuucuuaauaguuaaacugucucuuaaaucaagacuagcacuuuuuguggauaguggguuagggaauauucuagauaaaauaacaguuuguaaagagacucuccagagugaaagagaucauucauuggggaguuaaaaaugcuauagcuuuggggaguuaaaaaugcuauagcuuuguagucacauagaaggagaguuguaaguggacuuguggaaugaaguuuguaaagaaaaugaggccagguuuuaggucuuuguuauguuaagugguaauuuuauugagacagugacuuuauacuuaaaauuuauuuaggaaaucuagcuaaguuaugagauuuaguggaaacaaauuauauacuaauauugaagaaagacuguauuuggguacuauauauuuuuagcuaaaauaaugugaaguauguuauugaaauuuuucauuuagaaucuaaauuuaugccuacauugagaauagcaaauaauacucaaauuucuuuuguacuuuuagcaaccuggaagcuuuucuagcuggucugguaguuuccucauggaugauaguaugucuaacacacugaauaaucuggaggaacacacuacugaguuuuauagcauggaugaaaaucagacuguuucugcucagcagaauucacccacaaaguuccuagcuguagaagcaaaugccgugcugucuucucuacagaccaucccagaauucgcagaaacucuggaacuaauugaaucgguaaguuugaaguugugaaauuaauuaugugaucuaauguagaagcuuaguuuaaauauuuaauaaacauguaccaacuuaauguuaagcauugccuaauuuugaucucuuuuguaaagguuucuggcaaaaauauuaaagguuuaaguucuuaaguguguaucuuaaaaagauguuuuuauaauuaaaaacaauucauuguuuauuagauuacacaaauuacacaaauauauuaaaguguucgaaauuagggaaacuauaaagaggaaaauuaaaauccccuguacauuuagucuugaucauuugauguauauaaacacaaauauauaacucauguuauauuuuuaucuuuuacuuauauuaugagccugucuuugguuucucagcauacauauaauuuuuaaaaauuaauuaauuauuuuauuuauuucuuccugaauguugucccugaucuucccucucagaguucuuuuccccauucuaccuccccuuugccacuaagauauucauucuuuuuuuuuuuaagggauuuuuuuauuagauaauuucuucacuuacauuucaaaugcuauccccaaaucccccuauacccuccccccgcccugcugcccaacccauccacucccucuuccuggcccuggcauuccccuguacuggggcauaugaucuucccaauaccaagggccucuccucccauugaugacugacuaggccauccucugcuacguauguaacuagagacacagcucuggggguacugguuaguucauauuguuggcccuccuauaggguugcaggccccuuuagcuccuuggguacuuucucuagcuccuccauuggcagcccuguguuccauccaauagcugacugugagcauccacuucuguguuuuccaggcauuggcauagccucacaagagagagcuauguuagcguccugucaggaaaaucuuucuggcauaugcaauagugucuggguuuggugguuguauaugggauggguccccgggugggacagucucuggaugucuuuccuuccaucucagcuccaaacuuugucucuguaacucuauccauggguauuuuacauauaauuuuugagcaagaucuaacuguauauuccugucuggccugaaacucauuaugagaccaggcugucuuugaacuuacagaaaucugucugcuucuguuuccugagugcugggauuaaaguguguguccaugucuggaucuuaaauauauuucuuaaacaugaauuuuagaugcuuuauaguacuccuuuauaugaccgaaaggcaguugauuuacucaaugcaucauuguaauugugcauuuugaggguaucuagauuuucaguaucaccaacaaguaauacuaauagaggauguguuguugagucaugacaauuaugugcuuggcugaauggaauuucuaaaucaaaguauauguuccauauacauauuaccaaaugguuauagaguuucaugguguuuucuuguuaaauagaaugguuguaugauaaauuauuuuuuuuaauaauagccuaaaauaaucuguucuuuuuauguaaaauauucugauagaaaauuucagcuacugcauuagaugaaacauuaucuugguauuauaaaaaauuguaguauuuucuaaggugguuaugcuuaauuaaagaaagauguuuagacaaagcuugcuuuuacugguuaaaaaugaguagcuuuuuucuuugguuucucuguauagccuggcuguccuggaacucacucuguagaccaggcuggccucaaacucagaaaucugccugccucugcucccaagugcugggauuaaaagcaugggccaccacugccuggcuguaaauaacuuguuaaaaauuauuaucauguguuacuaaacuguuaagagcuuaacuuuauuaagaguucauuuuuuuguaggauccuguagcauggagugauguuaccaguuuugaucuuucugaugcugcugcuucuccugucaagucuacuccaguuaaauuaaugagaauucaacauaaugaaggagccauggaaugccaguuuaacgucagucuuguacuugaagggaaaaagaacagucguaaugguggagacagugaagcuauuccuuuaacauccccaaauguggucaaguuuagcacuccuccaaccauccucagaaagaagaaaagaauucgagugggucagucugcaggcagugagcuuggcgauggcucacuuagcgaaguugguaaugcagcacucaaacacacaccagugaaaacacuaccauuuucuccuucucagguacaaguguuuuacauuugccgauggugacuaaguuagaccuuuaguaucuuuaaaagcaauugacuguuuuuuuuuaaauccacaaaaauagauauguuuaauuguaugcaugagaaugguaaacccagaaagucagaaaggguaauauucgcaucacagcaccauagacuuucaagaguuaaaagggaaguuuccuuugucauguaguccuauuucucgauaagacugaggaaaacuggccccuaaaaaguaaaaugauuuauuugcccaaaggucucuaaugcagagcugagacuaagaucuaguaugacucuuugauucuugauuguucagcauauauuccugacaugguauaaagagaccuuaucagcaauuuagauuuucauuuauauguuaauuuuccucuuugacagucuuuggaagaaaugaagauagcaguuuacucuaagaaucucauguuuugauguccaagaccaucugcuuuaguccuuagugauguuccaaggagcagauguauacauuaggauuauuuuuuuauugggcacuuguuauauuccaggcugugugucucuucuuacagcaucuccuguuaaucuucuuucaaaugacauuggaagccaaagggaguaaguuuuaaaaugaagcaacuuguguuuugauauuuuaauuucuucccuguugcugagauaaaauauccugacaagcaauguaaggaggaaaggauagaauuauuuuagcccccaguuccaggugacaauguuguggaagucacagugguagaauuugagacagcugcgcaugucaauauccacuaugagugcgugcaugaauacaugcugcuguugcugcucagcuucguuucugaggcccuccagaaucugcuacuaggggaaugguucuuccacuuuuaggcugaguuuugccaccucauuuaacccaauuaagggccucacaagcuagcacaagcccauuucccagaugauucuagguuuugucaaguugacagcauuaaucaucacauaaauguuaaaagagaaguagggagcuuaaugaucaaauauggagaauucuggaauuuauugaagguuuguuuuaagguugggaaggugguagguaugguaguacauaauagcuacuguggucugaaaauguuugagauaauccaauuugcauggucuacaacguccuuuagcucucaaguucagaauuaucccagggaaaguuuccacuuccagagcuuuauauguuaguaguuuuuacugaagucgauucuaucuagaaagcaaguagaugauacuuauaucccaugacauuuggauuucauccugugaaagacuuugauauuuaauucuaggugaggugauucaaauauuaggagacaggagugauagagcuugaguagauugcacuuguaaguggcacucuugaagcaauuucuacuuccucauaucacuacugcuagucugcuagcuacaaaaguaaauuaggauuucauaguaguaugaaauguuaagucucauuguauaguuuagaaagugaucucauguauugucugcuuaaaguaucuggucugucuucuagacaggcaaguuugccuggcauuuaacuuucaauaaauaagcuaauuggugucuuuacagguaugcacauacacccagucuguuauucuauucugaguucaagauacucggagagaaaaaugcacuuggccuuauucacaguuguuuuuuucaauuauacucuuaucucagaccaggagauaguuguuguaacaacucucgauggcuucuguagaucaguacuugaugugcacugcuuuauauuuuugugcuauuagaaagcaugaccgaguuucuguaauguuuaguaugugcuuaucugcucaaagugcugggaggcagcagucaacagaacacaaaugucuugccuuuaugaagcuuaauuuccaagaaguagcauguaaauguaauauuacugauaaucuuuuccuaaaacaauagagaagucuuagcaguuugauauuuauacaggaacuuugauguucuaaaaauugucugaauucacuuccucauuuaguuuuuuaacacauguccuggaaaugaacaacuuaauauagaaaacccuuccuuuacaucaaccccaauuugugggcagaaaguucucauuacaacuccucuucagaaggaagcaacccccaaagaucaaaaagaaaauguaggguaagucuguauuaaauaauuauguuaggaaaaacuggaagcauguuagaaguaugucagcauuuuauucaaaugaaugguguauccauaaucuuuaguucuauaggauuuagaaguuuguaauuguuguuuuuaaagucacauccucuuguuucuguagaauacuggaaacuggcuaaauuuagcauaaaaauuuuauugcaagcaaaauauucuuaguacuuuuuucuaagucauuuuuucuuuaaaauuauacgaguauaaccgacucuagacaaccauacuuuagauagcucugugugaugcauuaaaaaucauaugucuggucuacagagugaguuccaggacagccagggcuacacagagaaacccugucuuggaaaaaaaaaacccaaaaaacaaacaaacaaacaacaacaacaaaucaugucuauauaaaaauauagcuuaugcuuuuuauggcuuugcuuuuguuaacauuuaugaccucacaugugacaauaauauaaauaucugaaugacugacuagauucagaacuccuacuauuagaagaucuauacugggcaccacaccaagaacuccuacuccuuuuaagaaugcacuugcugcucaggaaaaaaaauauggaccucuuaaaauugugguauguauacucuuuauucucaagcacuuuucuaguuuuaauuuaaaaaacuggguuuuaucauuuugaaauuuuuaguauuaaaaaaguguacauugaaauggaaacauuuuguuucuuaauuuauaaauaugaguuuguuuaaucuuccuuggucuuuagauaacccuuuacuuggcuuauuuuaaauuuuuauguucucguguuaacuagaagaaaacaguuguuaguggcaugcuuaauguuaaaacacguauguaguaguuuaguaguuucacuguaguagaauuaauauuuugacauaucuaaucucuuaaauaauguugcauaggaaacuaaugggucagggaaucuucuugaaguucaguuuuuucuucuauguacaagggagguggggaaggaauuucuggccguugccuuuuaaaaucuuuaaaaauaauuuagucccagccacuugccuuuuuggaagaagacauucgagaaguuuuaaaagaagaaacuggaacagauauauuccucaaagaggaagaugaaccugcuuauaaaagcugcaaacaggagguaaccuugaguauuguguaugcauuucuuuucagaguuaguuagaggcgggucuuuauguaauuuuggcugcccucaaacuuccaaacgcccgccaucacuuucugagaacggugauugcagaugugcuucccaucccagcucuuccaguauuguuguagucaguguuuaccauguuggagagacuuggcuauaaugugacccuguaaauuacuuuucuuagcacucugcaucugugaagaaggucagaaaaucccuugccuuagagagcugggacaaagaagaaccagggacucaacugcuaacugaagacauuucagacaugcagguuuguaaagaauucauauauguuuuuaaauggcugucuuaagucauaauuguucucauuucauauggauugcuuggccagauaauuuaaaagagaguuacagaaaauuuaggguuauuuugccuaguucagagagaaucuauuaucugugaagaauauaugauuuuuuuaaacuuguuuuauuuugagaaguuagauuuuuguaugauaucaaaaaguggagguucauaaagcuuuaaguuuuaguauuuuaugaaauuaccaaauauuacuauagcacuagaaauguauuuauguaauuaccaagcuauuacuauagaacuuagugagauguuauuauagagccagaugcuuccuaguagggcagugagcagggcuucuauuaccauucacucaguaguuucuugucucuguuuuugaauuaguuauuuuccucuuucuuuuuucucuuagucagaaaauauucuuacaacaucuuuauuaaugauaccauuauuggaaauacaugacaauaggugcaacuugacuccugaaaaacaagauauaaauucagccaacaaaacauauacacuuaauaaaaagagaccaaacccuaacccuuguaaagcugucaaauuggaaaagagucuucagguauggauucauaaauuucuugagugauuuuuguuauuguuuagucaaugaucacuuaaacuuacugaucacaaguuauccuuuuucuuuuaaaguugaaauugacaaguacaacaaagaaugacuauuuugucacugaaagcaggcuuggguuugagagagacucauucaucagugcacaugucgucuauacaacuggaacuguagucggagauuuuuuggcuauuuuguuuguuuuggguuuuuuuuuuuuuugcucauuuuuguuguuguuuugagacaggaucucaccucauuauguagcugagcuugaacucauauaugcagcuucagcuuccuaaauccuggggcacagacuuuugacaccaugccuggcccuucggugauucccuaauuuauuuuguguguguagauauuuaaauccacuucugauaaguaauuggaaacauuucagcaugauuuuguuuguauaauggcucccaauaaacuucguggauuaaaacuauaaaacaaaacaaaacaaaacaaaaucccccuauuccuguguguucaguaaauagaugaaaaugaaggcuagagaaauucuuauccuguuauuuuaggaguuuucccagagaggaaaauuagagaagaagauuucuucuuuaugccacacuauaugcagaguaaauucugacauuuaagcauuucuugaaaacaucuuuggcaaucagauauaguagcuacuugucugucuuaagcuauggcuuucagagagugacauaauacaugcccuuaguuguuuaaaauguuuuuaauucccgguguuuaguuaacuuagagcuccuuggaaaaguucacuauauaguagcucuuauauauuaauauaggaacuuuuauucuuuaauaaggaagaaaacaaagaaggugcacuccuuguucacauuuaacauuagaucuucccuuuaaguuagucugucucugucugucucugucucugucucugucucugucucugucucugucucugucucuuuuuuucuggcacuggaguccaaaccugggcucgcacaugcuagacaaauacucuaccaaugagcuacaucuccaacuccuuuuuuuguuuacaaaacuagagggcaaaaagggauuauuuuuuucccuauuauccauuugcuuuguggggaguuguugggaacaaaacuauuauacugucauuauaggccagugaacaguguacauaauuguaauaauuacacaaaauuaucauaaauauuuuaguauguauuuaaaauaaagcaucucauuuaaaaagauucaauguuaucaaaacauuuuuaaugcaauuacuuacaaaauuccuagacaaaacaauugauuuuuggaagucuaguuguauggauuggcaauguggcuuaguggguagagcugccaaaccugauggccuggguucaguucugcagcccacauggcagaaugagaggacuaacuuuugaaaguugucuugauuuccgcguauguuaugugcccccccuuugguauuuaauuuuacuaaucuucauaucucuauucaccuuuccuucauagucaaauugugaaugggaaacagugguauaugggaagacagaagaccaacuuaucaugacugaacaagcgagaagauaucugaguacuuacacagcuaccagcagcacaucaagagcucuaauacucuaacuguuacuaaagcugauaaaaugcccuaccccuuuacuguauuuuaugcuaaauuagguugcaaugaaauuugucucaauuaauucuuuuaaagguuuuaauacaucccuaaaaugguucacguuuuuuucuauauugaacaggcaaaaaacuaauaagcuacuuaaaguaagggguaggcaaauuuauuauuuauauguuuaagaaaugagaguuuuaaaauuuguuuuaaagaacaaaaugggaaaauaagcauguuucuggauauuccauaguaaauucucacauaauuucuuuacaggauauauguugcuacugucucaaggcuguagucuguuauaaacaaguuaaguaugugugaccucugaaagucuacauuuaggaagcacagaggcuuuaugaaguacuuuugcaugugugcugauuuacuaagacuaccauucauaaagaaacacagugggaaggagucucaaggaagcuagaaguugcacuacuaauuuugguauuuuucagaaacaaugaaauuaacuacaguguuaaggauauuuauuugugcauaguacuaaaaaugcauugaaaaugggcuuuuucuuacuaguaaagagucaguauuucuucauaagucucagaagagcugagaauuuuguugaauguauuguacaguauauaggagcaagaaaacuuuguaaauuggaaagaugucuguuuuuauaacuuauuuucauuuuuaaagcuuaaauguagauauuuauauauacagggugucuagaagccaguguuguuucuugccauuacagcuaacauaguaaacaauaacuuugacuuucaaguaugaaauaguuaaguuauagcugcaaagaauacaauaucuaaacuguaugucacaucuaccuaaauauugcacuauauccuuuaaaucauguugguuuuaaaguaguucuaaaauguacuaaauaauaauuuaauauuuucuuuuuaaauuauauuggagggucauauaaauuaaucuggugaauuguauauguguuugaaauuuucauuuuguuuaaaaaacaauacgguaccuuguucccuaaaacagucugcacuuagaaguuuauuguauuuacucaauguuucagaaguagaaaauauuaucuuuauuuauacaaa

SEQ ID NO: 65 - RNA, 644 nt, Mus musculus
caugaaggacauaauggggcaccccaaagcgcgcaucaacaccagcauguuaccacaguauaucgaccaguccgugugcuucguggggaagcuagaaaagauucaucccacuggaaaaauguuuauucuuucagauggagaaggaaaaaauggaaccauugaauugauggagccacuugacgaggaaaucucugggauuguagaaguaguuggaaaagucacagccaaggcgaccgugcucugugcgcaucuuauacccuguuuaaguaaucgcuuugaucuugaacuuuacaaugaagcugugaaaauuaccaaugaguuuccucaguuuuucccuuuagggcuuccacaacaugaaugagcuucuucaauuucuuaagauugccaguaagcuacauugaaggcuauuaaagaagacuccugcaguuuaauggagcgacuccuauaauuucuaauauucaauuuguucuuuuauauauauauauauauauauauauauauauauauauauauauauauacauauauacauauguacauauauauuguaaaucuauuaugacaguuuacaacuaagccuuuuuauaaacguuuuaaaaagugauacuucaauauauggucugaauaauaaaaaucaaaauauaa

SEQ ID NO: 66 - RNA, 98791 nt, Mus musculus
gggcgcggcggcggcgcagcgacauagaaaacacuuccuuaggguuggcucggcucggcucggcuaagaucagucuugccggugaaacgagaacaugcuggcucggaaauccguucgugugaacugcgagggacgcaaagccucggugugggaaugguacagccuuucgcgccggaaggcgggacuauuggccugccaggaaggagucggccggcucggcucguacugcgcagacucagaugccaccauauuguguguaggaggaaacuugaguuuggggaauuauguuuaugugaguguaggugcuucaaacgaaauaaauuguuuggaauacuaaauaucucuagagaaacagagguguaaguaucuccggauuauugguuuuggagggggaagaucgcgugacucuuuuaagauaauuugcgguguguuaagccuccgggguuugugguuggcguuccgcuuuuguguuuucgcuacuguugcgagguggcaagcaaaaguuaccgguugcuaagauuaacuuuuuuagggacuuuauaggguaacauuuuauacaaguguuaggagcggugaaugccuuaggcgcuacuuuuuaaaaaagguuugucucagugcagauuuaaucuccgcaaccugugccuuccagcaguuaaugugaaauuuguuucagucguauuuuuagguuuucuucccucacauucucauccccaauugcccacuagacuguaaguugaaggcaugcaugaaauuuguguuuuauuuaauucuaauauauuuaauuuuuuucguaacacgguucuuaaagacuucuccagcuucaucaucuucuuuuagcucccccaacccaguuuuucauucuauuagaacuuuuuuccuuggcuuaguaauauauuaguuguuaggcauugcuugaaaugcacuucuugacauuucugcuuuagagcacacagauuuuaaaaagcacagcucggagaugccuuuccuuaacucuucgucaguaacugcuccuucacaggaauucgaaggcucuguagcugcuucaccuggaccccgggguuuuugcaguucuggaacuauguaguccaggcuggccucaaacucgagagcugccugcuugagugcugggauucaaggcgugcaccacuacugcccgucuguauccucuucuaaugcaggugcuuuugccugggcugcaggagacccuguuucaaaaagucaaggagcugggcaaacaaaacagagcaaggacauugcaacauucuucuaauuccaguacuugggagguggagaauggagaaucaagaguuccaaccccgcuuucucccuggacuauuggagacaaaauaacgaaaccaaaaauaaaaauagaaucuucuuaaaguauaacuucgggcacacuagggacauuagaguacauuaguaucuuaaguucuuucugagaagcuuguguaagcuuguuccaguggucacaauacacagccacucgaaacauacagaauaacauguugaaaugguaaugaaagcccaggacagagaguugaccagacugcuggugcggacauuccuucucucacauccacacuucgugacuggagaccguccugggcuuggauggcugggauuuagccugggaguggucacauuucaggaaucccugggcgcagcagcgggugcaccggguggccuccggggcugcagggggcgcccucggccgcgcggccuccgccagcagcccgaggggcggggccgcgccuggccguugguggagggcgggcggggggcugggccugggaggcggaguccugagcgggcgaccgguuuuuagguccgcgccggagucgccggaaccacggacuguggagcccgcugggagcguggcuucucgcugggaguaagucgguggguagcggguguggacggcugugcgaagagucggcgcccuggcgcgggaggccggcccgggucgcuguagccgggcggggguucgagccugccgggcggagccgggaagcuccgggguguugugggggcagggcuugaggcgcgggucgcgaggcgguggcccggcuuggccccaggugcuggucucgaggcugccgggcugggggcggugcccugcacgcgcgcugcagacucccgggcggccucugggcccgccgguugccugacaacgcguugacgcuuucagaggcaucugccacccgcugcgucucuggagaccuuaguggcucuccugcgccuucucuucugcuggcgcaucgcugcuaagccucgcagagugcuugcacccggaggguugguuaauguuuaacacuuugcaaguuaaacuuaaucuucuccauaucccuaugaaaucuguugcuuuucucucacugugguugcuugaugagagaacuuucucugccuugauaguguaucuuuguguggaauuagaaucugguuugaaagaaauacguacuguguguauguauauacacacacacacacauauauauauacacacacauacauauauauauguguaugauguguguguguguguaucuuaauuuucucuccuccuacagaaucccagcugucaaacuccgucaucauggcugcaagugucuacguuuugagccauuuuuuccagacccaaaucaaguuuucauuaaauguuagcagugagacucaucuuuugagauauaucuggcucugaagauaauaagauuaagaagcuaacguagaaguuuugauaagacuuaguuuucaaacaguuuguacaguguaagguccuaaaagcaaucaaaacaauuuuauagcugggugugguggcacaugccuuuaaucccaccacuuuggagacagagguaagcagaucucuugaguucuaagccaaccagaguuauauagugagacccugccuccaggggggaaagaaaagaaaagaaaaaaaggcuuuauagaaagccaguuauucuaagaagcuaaguuuuauguggaagaauggcuugucauguugauaagcaaaaaagagcuccaaaaaaguagggagacacuuuuuuuuguuuuguuuuguuuugcccccccuuuuuuugugaacuugcuggugugaaguauuugcugacgugcucccauagagaggcucuuucucucuggaaucucugggauggccugggaggggagcagauagguucagauaaggcaaacaggaaaggaugcuuucaggacaccuuuucuuuagcaaaauucagagugauuuguccagauuuggaugguacucauagucaaaugcucauguauaugcuaaggagaagaagacugugagacccuuucuggcuaguucaaugagaaacuucauuuuccccucugucuuuuaugccugcccuuguucuugucuacaucuuauuucucccugagcaucugucccuaguccuuuuuucuuguaguagagucauuuuuuuuugcagguagcugccucuuuuuuuuuuuuuuuuuguuucauuuuaaccucauacuauagguaagauuuauuaugaauuuuuaauuagaauuuaauuaaaauuuuucccacuuccugauggcaaaguucuguucucuuacacuuuuuccgaagucacccaguucaagcuccagucauauaauuauuucccagcgcccucuuacuaagaaacucggguugccauuauuguguguucuugaugcguccauacaucagugcaguaguaguucaucuaaauuguuuaacuacaguauugcuccuaauagccuuuggcaaaaggucauuacuggggaaaaggcuauugguuaauagauaguuuauuguaguuacuguuaccuaagaugaguuucagaaguuguaauaauaauugguacuaaguuacuguuaggagggaauccugacauuuuauccagcuucaggucuuccgcauucauucaagugaacauugcccagcauuuacuuguggguuaucccuaccuguguucauuugaccccauguuuguccuuguaucuuaaaguaguuacguucuguuuugauggaguauauugaagauugacugcuuaaacuugggaucuuuucugccugccucuguccugaguagggaguaacugggauggcaaguacuuaccauuucugucuguugaaaacacuuacuuaccgcuuaaguaaacaucuuugauguuguucaaauuugauucuugaauuuuaaccauguuuggaaauuucuguuagcaugucuuacuaguuucaacuuaauguaugugaacuaaacuuuuucaaaccagacagcuugcugggauuuguguuuuuaggguuccauaucuccaggccuuguggcauuagugacuaguagcuccuuuuugucccauauuuuguuacugaauuugauacguuuuuagaaaaaaaaauuuuuuuuccccuagaaacuagaaacauuacaguuucuguccaguguggugaugcauaccuuugaucucagcacucuggcuggauagauagauagguggguaucuuagaguggaaggccaaccugaucuacauaguaauuucagguagagagauuccuuccuuccuuccuuccuuccuuccuuccuuccuucuuuccuucuuucuuucuuucuuucuuucuuccuuucuuucuuucuuucuuagguuuauuuauuauuauauauguaaguacacuguagcugucuucagacacuccagaagaggaugucacaucucauuacggaugguugugagccaccaugugguugcugggaauugaacucaggaccucugaaagggcagucagugcucuuaaccucagagccaucucuccagcccccgagagauccuuucuuaaaaacaagaauaacaaaacuagcuuuggugaagaaaguaaucuuuuuacgaaguuguaaauaauauacacugaacacacaggucuugcagcuguuguggguuguaagagugagagcuggcucauucccagaacucagcauuucccagcagcccuccccaucuuccagcuccuggauucuuucccuccuuuccaggaugcucucgaguccuggcugugugaacauagauguccuuuuuggguucacacauucacagucacauauucuuuucagcacagaccaguuguggacguguuagcaacggucccugcagaaagagaagcaccucugacuaaagugcauagccacauagaucuguguguaugaauguacauauguagcaggcaguuugacagccuaucuguuuagcacaauaaccguaguauguucccuccuagggccuuugacuuucuuuagccauggccucuugaccagcuuuacaauacuaggcauugguucacgcuguucaacaugccucagauccaagcagaaagugguugguuauccguucauaacagucauacuaccaauugccacagugggcauaucuucccuaucaggguuuggugcuggguaggaccauugauggccacccugcuccuaguggucuguauaacaucuucuaagcuaauuacaaagugggauuuuuuuagaaaaaggcauuuggauaggagguuccuugaauagcuaggcuguuaugcucucagagacauaaauuauuaacugaaaaucuuggugcuagauauggguauauccacggguuugugcucuugaagguucuggagguuucucagcaagcacaguugcugucuuuuuccuugcuugccaaccacagcuaggugauaacaccccauugcugagggcaccauguguuuggcuuguagagcacagagaaaccagccuugaacuggcuaggaagcuuacucuccuguguagcuuauauaugaaccauuuauaugaaacuuccaaguuagacaaugauagcaauagguaagacaugauuaguucucugagaucagaggaggagugacuguagaggggaaaacuccuguguguuguugacccugucuggagaguuggacagagacauugugucucagaauaaggcuuguuuuuaaaguuaagcacaagggaggcagccugugggcaaacucuuaaaccgaugcuaagcccaggaaaagaugcuaagcccaggaaaaggauacauagcuuuuuagcaucugcaggguccugcacugcuguucucaucgagugagagaugaguuacguuacccaugggcucuccugcucaggacacuuuucuuuuuuguuguuuuuuggggguuugggggagccuuaccauauggccuuggguguccuagaucauugucuagaauaggcugccuggucaacuuacagagcuacacuugccucugcuuccaaguacuaggguucaaaugcuggaugagugcugccacucguagccuucaucacaauggguuuuccagcagugucucaucgcccucuaaagucuauagccugcaugggauuuuuacuauuugaauaaggcagauguuauucuaugccuauuuuaugcacauaugugcccuuacuaucugggaaauccuuguuuaggacaagcucagguacucaguuuuaggcuaucaaaaaaagguuauaauauuauucuuuauuaauauauuaacuacacauaauacuuuuuuuuuggagacaggguuucucuggccuugaacucagacaucuaccugcuucugccucuugaguucuaggauuaaagagguguaccccaaagacuuacaauuaauuucaaauaguuuuuuuaagagaaacguauuuuaaagauuuaagcuuuucauuuccuuuuguucuuugauugugugacuguggguugugguaguggcugccgaucucauuuguuacuacuuuuuuaaaucauauaauuguauagacuguuucauugcgaaguuuccauucaugcauauaaaguacuuugaccauauuucuuuuucuguacauuaaccuacauuguagccuauucugugauauugaagaggaagagacagaugguauuuaugucuaugcuucaguaugaaguucacaauaugauaauugagauugaagaccuuguuuacaauaugauaauuguggacuaagaccuuguuuuaauacuuagcuaaaaccacugcaauaucauuguacucacugaagacuuuuuuuuuucagaaucuacaaaauggcagauagcuuggaugaauuuauugaagagcaaaaagcgaaacuggccaaagacaaagcagaauuggaaagugauccaccguacauggagaugaaggcaagauuaguaauugucguguaauguguuucauuaaauuagauuuagugguuuacuccuuuaaucgcagcauuugggaggcagagaccuuugaauugcuguaguuugaggccagucuaaucuauauagcaagaauucuaugcuagucagagcuacauaaugacacccugccucaaaagcagacaaacaaaaccaguucugcgccccgaaaacccaagcaacaaugauaaaaacccagcugaacaugcuucauugagacuguuucugagggauuuggauuguuguuucguacuuggguuugauugggacaccauuguucugcuucuagguaucaggugagagguuuugaguguacuuuuuggugggauuuuuugaucucacaauauucuguuuuguaaguauucaaauaauugauugacaagcugaauagaagacagagguuaagccucaagacuuuuaaugagaaaaauaguauuaaaugaauaauaaauguuuugaaaugcauauuaguaaauuuacaaggguaauuuauucuguacuacuugcuuuuuagaacaagauguuauaguuguuucugaaaagcaaugucuggaaaguuuucuuaagcuguuuuuauuuugacauaagaguuguuguauuuagcagauacugagauugcgcuaggagccaugcugggcucugggaacacugcacugaugcagacagaugccgucucucacgggcucagaacguguuaacaaguuggccugugccauggguucuaugucaugagcuuaucuguaucaaauggcuugcuguaagacacuucugacuuaccuguuucccagugucucauuugguuuagcaucugucccacacagauaaccaaauuaagaugauacucacgacauaauaacuguacauuuuauuauauaaguuuacacgauaguacucauauggguaggguacagcuuuaaaagguuacauuucagugcagcauuugaaguaagugucucuuauuauaauuuccaugcacauaaacuaaggcguugggaagcugaguaaugagacugagaugccgaguugguagaagaggcuugguuccugacauugacuaagugcauguccuuuuaagcacuggccaugguugucuuccuucaaaacagucuacuuuguaaaaggaguuaaagcaagggcuuuguguguaccauugucucuagucaggacaucuuuaugauguagggcuauuuuguuuuuuguuuguuuuguucuggagaucaaggaaaugagaccagaggcauuaaaugauucguucaaguagacaaagggauggauuuaaauugcuauccucaucuaguggcagggcaugcucacaguuacuugauauggagggugagugugcauguuuaagcauauuacuguacagcuuuauucaaucuuuauauaccaguacaagagucacugcuuguugagaucuugugguuuccgcccccccccccagcaucucugggucuuuaaaucuuccucuaucuugucuuuauagccccucccuauacgugcguguaccugagugucuguuguauauguucauaugggaguguccacacaugcaugugguugaguguguauggaaggaagccugauguccacaauagaugucuuccuugauugcugccaccuucuuuuugagauggaggccuuucacucaaccuggaguuucuagaauuugcugugcuaccuggcugaugaacuucaagaucugucugucugugaucucucagaguuuggguuacagacacacgcugcugggccuggcuuuuacauggguguugguuugggaauacaagcucagguccucagacuugcacagagggcacuucacugacugagccgucuccucauccccacucuuuacauaucaugcauauguaaauauuacaugcaaguacaacaucacauaacuaagaacuacauuuguuuagugucuccagccuauccccuagccuccuggcccaauagcagaagcuucccaauuuuguuuuucacucuuuucuuucuaguggcuggcccaguguacuuaauaguaacucauuuuuaagaggaugaauuagguaucagaacaguuguuacaguauguaaguacuuuacacuucaaucucugugcuguguaauuuuuucuaaguuauuuaguaugucaaauaaguuaaauuguacauuuuguggaguucuccccuuugauuuguaaauaugucuuuuccagggaaaggcgucagagaaacucucugaaaacaguaaaauauuaaucucuauggcuaaggagaacauuccaccaagcagccaacaacagcccaagggacccuuagguaugguacuguaugcguggaacuaacuuuaagauauccuuucuuuguagggcauugugaaagagguuuguuucuucagaaaaaagauuucuuuggaucuucauuuuugagucuuacauauggcaaugggguuuguguaugaaauguaacucagagaacguuaccuauuucauugauguugccuaauugugauugguggaaaugauauuagaaacuguguaugauguaacuaaaaaauaguaauaaaauuuuuaaguguguuuauguauauguauacaugagagagucuguauuguuuuaaauucaaagaagggucuagcaagauggcucagcugguaaagaugcuugccaccaagccucaggaccugaguuugccccccaggacccauaugguggugugcacacacauauacaaguaaaugugcuuacuaaaacagagcaaggaaguauaaaguauaugaaaaguuauuuuguuagggaccauuuuuuguguguauguguaugcacguguaugugugcauaucuguguaguggccagaggucauccuuggauuguaguuccucagaggaggucuacuuuuugagacagagacauuuacuggaaccugaguuugccaauuagacuaugcuugcuggccauccgccaaauuggguuccacuuguuucuucuuggauuucaaguguguaccaccacacccaguuuucuacauaaacguuagggauugaacucagggccuccuucuuacauggcaagcucuuuuaccuauuaagcuaucuccccagcccaaggacuauccucuuguugaugaccguauuggaccuauaaaguuaauauugcagccauacugauuuuuaaaauuaugucuuaguaugaagucuuuggaaaccuuuuuuaaaaguacauauuagcuugucgauacauuuuuaccuuaaaacacauaauauugucaauaauauauaucuggugacugaaacauuuucacaaaaaguaagucaaauauaauggauccuuuugauucagucguuguuuucaugggacuaauucaugaucacagguauauucuuuguuacugcuucgcuuuuaauaugucacuggauaagaagggagacuagcagagaggcaguaguguugugucuggccaggagagacuacacaguaguuaauggccauacuaucaguaucaaauauaaagguaacucaauuuugauucuugcaaauuauuaguuaauaggcaacuuuagagaaaugagauguuaacuuuuaguaaaauuucuuaaucuucaagcuuauuaguuucuauaacuauaaaauuaguugguuaauacuagggguuggagagguggugcagcagcuaagaggacuuacugaucuccccagcacucacacagcagcguacagcggccugucuguaauuccuguuccaggggagcugauacccucuucugacagccacagggaccaggcacauauguggugaacagacaugcaggcaaaauauucguauaauaaagauaaagauguaaaaauaaaauaaaauuuuucauuugaaauuuauaugaauuaaaguuaaugcuaaggacuaauuuaaaaauuuaauaguggccgggugugguggugcacaccuuuaaucccagcacucaggaggcagaggcaggcggauuucugaguucaguuugaggccagucuggucuacaaagugaguuccaggacagccagagcuauacagagaaacccugucuugaaaaaacaaaaacaaacaaaaaaaauuuaacaguagauucuuuuagauacuaaguuauuaaauuuaggcgaaauugugggaagccacaugugccguugcagaguggcgcugacuacugcuggccaccacgcauaaguuuggacaaccaaccaauguguacauaugcaguaaaguuuuuugcaaagacacugccuggcccgggcaugauaaugaggcuuugagaguauaaccaaucagaugugagacaugcaaauuagguaugauaaugaggcucugugagguagagagagagagagagagagagagagagagagagagagagagaagccaaucagaugaggaacaugcaaaugaggcuuagugcauaaccacgccucuccuaggccuauauaagcagcaccaguucugggcucggggucucuucgccucugcaaucaagcucucccaauaaaugugugcagaaggauccuguugcagcgucguuacugcuggccaguccggcgcgcgcaagacgaaaucaccgaaauucugggauuacaguuuggcuuuggguugccaugccuuugugauguggcauguuuguuuuaagguuauuuccuuauaguauggacauuugucucccaggguugcuaugaguaguaauugaguauguaugaagagacaguugacauguaguugggccauaaaaaaaaaaugcucccucauguuugacgucuucugcaagagaguuauucugugacccguaugugugaacgguagucuauagguuaauaugcaacagccuuugucugacuuagaaucagagugaccuuaaguuaugaccuaggguguucuuuuguucaggaauccacagauaacuguauccacuuauaggacuccucaccccccuuuaauacaaauagcauaaaucugauuugaaaaucuguacucaaauccuauuuccugcugauucuuguuucuaccccaauuucuguuaugacugucuuacuuccuacugggugcuucuguguagauaucaugggcuuucaaguuuucugguucuugccaccuuauuagcaagcugcuuccucauucuugauuccuuuuucucuuugcuugucacaucagauaacuagggaggaccaguugauuuuaauagaauagaauuccuaaugucaagcaaguucuugccaucucacuggcugguauucuugucugcaggcuuccauucacugugauuguuuugauaaccuccugauguuuucuuuguacaauccuuuuaugucuuugcauacuuuuugauauguuuuaaagaaauuaaucugauacacuagucuguauuuccuucaacuagcuucucaucucguuguauagcuuuagcugggcugcuguggccaguucucugugcauuguguucugcuggauggcacagugcuuggcacuuguuuguuggaaaagauaguuugaaugaaugaauguucucauuccaaaaauaaagucaguuuucuugggaauauagaauuuaauuuucaugggaccucuuaaaaauuuucaacuaaaauaacuauauuugaagcacauugacuauaaagaaugcuguacaauuuugucuuagggauacucuugcuguuaugaaacacaaugaccaacuuggggaggaauggguuuauugagcuuauagguccugaaucguagucuauugagguaagccaagguaguaauucaaacagaugagaacauggaggcaggagcugaugcagaggcuguggaggagugcugcuuacuagcuugcuaagccgccugucuuguagaacucagaaccaccagcccagguguggacccaccuacgaugggcuauguccuucuccauuaauuaagaaaaugcuuuggggcuggagagauggcucagcaguuaaaagcacugacuagucuucagaggacccagguucaauucccagcaccucauggcaguucacaacugucuguaacucuuaagaucugacacucuaacacagacauacauucaggcaaagcaucaauacagauaaaauaaaaauaaauuauuaaauaaaaagagagagagagagagauugaccuccaggcuuauagaauuaucuuauggaggcauuuuuuuuuaaucgauguuccuuucucucagaugaguuuagcuugugucaaguugacauaaaacuagacagcacaaauuuauuuuauuuuauagcuucaaacuggaguacuuguauaauuaaaauaagucaaauauggggcuggggagauggcucuauggguacagaacuugccaugcagugugaggaccugauuugggacucaaaaagcccaggugaaguuggcaugauagcucacaucuguaaugucaaggcuucuagggugacauagcuggcugggacacgaugcauggagguuugcuggacagcaguuugcuauuuguggugguauacagugaagagaaucugucucaaacagugccucaccuauauaggguaaucuuaaauucucaucucauacagaucaauuuggaaaugauggaucaaauucaagucugugacaacauaguuaaauauaguaguaaugaucaguaauacauaaaccgcaaauacucauuuucaccaaugaaaaguauugaugguuuaaagugugacuaaauaccaagcaacacuaaauuuaagguuuuuaaaaguucauuucucuaugguaaugaugauauacauagauacuauuguuaacuccuguuuuacaucccauaaaaggauuuaagguaguaucauaaugucuucugaaaucaacuaccuagauuugaacuagauaaacuuuaauguucaggaggcuaauuugccaaaagaguaucaguccuccaaagggguauaauucacugauggagcucuugucacacauuuacagagaccugacuuccaccucuaauaauacacaaacgcacacacauacacacacacacauacacacacacacacacacacacacacauacacacauucacacacauacacacucucauacacucacucacucucacacacucacacacacucauucucacacacucucauacuuccccucucucuuucucucucucucuuuucaaucuucuucccuuucccucccucccucccucccucccucccucccucccucccucccucccucccucccucccucccucccucuccgucccacucacaaagccaaaaagaagagccaggcagauaauggugguauaccauuuugggaggcagaagcaggagguuagaaaguuuuaccugacauagguuuaaguucagaaguucucagauuacucucuuucuucucagcugacuacauuuuugggggaaacuacugccuccuaacauuugauaauucuugaaagugauuuagacaacucagaauaaaaacuaagguagcuugguuauuuuuucuuuuucuuuuucuuuuuuucuuuuucuuuuucuuuuucuuuucucucucucuuuucuuuguguguguagaaaaauuugaggggucuacaaacauugcuagaucaauaaaugcauuugucuauuuuagagacuauaagacaaaaaguacaaaaaugaauuguauuucaguaaugaaaugaaauaucaaguaaaugaucuuauucauuucaauaagcagcaaaauauuuaagacuuacacaaaagagacuguaaauuucacggcuuauugaaauuaacaauucuuaaaguaagccauggguuuaacuggagcagagaaaagauguacauaauuuauuggaaaguacuuaaugagaaggcaaaacaauauugaaauuacuuuaaaauuuuuuugagcuagaguuuuaaguaucuaagaacgcccuugaccuucugaccuucugccuuuaccagugaaauacugggguuguuaggcauacaccccauggcucaaauuuugaugauuucuuuuguuuuuauaaggaagaaaacauuuuuuuuccuacuguuucaguuuuaaauuugaguguaauaguuacuaaauagguacuaguuuuccuuuuauuuggauuuuggaaccaguauuucacucuguagcccaggcuaguguugaacucauugaguagucugaaauggcuuuaaacuagugacauaguauaaaaauguguagguacauggaugauguguggcugcuucuggacuguguagcaacuuacuaugauuugccucaugcucuagcagaagccugguuuugcccgcugcagauauuuucugugauuuuaugauguuuggaauucggaggacuuuacagaggauauauaaaugcuagguccauaagagugguuguuggucauuuaggguggcugguugcaguuugcuaauagcuguggucaaagaagaaacaaaaggaaagaaauuaguuucggggaucucucucgucucuguucuugucuuucucuuauugaguauuaagaguugaaauggagcugggcaugauguugcaugccugaaacuuaaugcuugggagagagguaggagaaucaagaagucaaguucucagggguggcgcacgccuuuaauuacaagcacuugggaggcaguggcaggcggauuucugaguuugaggccagccugggcuauacagagaaacccugucucaaaaacaaaaacaaacaaacaaacaagcaagcaaacaaacaaaaggaguugaaaugggagcagggauaaggggugggaaaaagaagaucccacaaaguaggaaugacuagcuccgucagauacgugcagcaggccuguuucugcuucuggagccaucgcaccugacuacguucacucugacuuuuguuguuuguguuuauaauugggcuuucauguaauccauauggacucccugggguugacauagagcccucccguuguaguuauucuucuggggguuacuauaccccuuuuugucuuuaaauauuuacuagggguuuuuauuccaucucagaccauauuguucccagauauaagacagaaaccuuuagauuuauaguaagcuuaaaaagcacuacggcugggcggcuaucaguugucugugguguuuugucugcuuccugguggugaucccugagauaucacuugcccaguucugacugggccacuccuacuccaucaggccagccuucauggccauaugcucauaauccaugcuacccuauggugagcuccuuucuucuucccuuuuucucucucuuccucaugguucuuaccauagaccacaagcccaggaaccuuugcacugcuccuccucuucugcccagcccaggauguaggcaucuuuauuaaccaaucaggcauaacguggggggcaaacaucauuggguguacacaaucuucucaucucgggcaaccagcucuuggggaccauuauuuggcaucugaauacauagcagcagcaggccacccugcuuucaccugaguacagcagcauggcuagucuaugugguguucuggggauugaguucagcgcuucaugcaggcaaggcaaagauucuaccagcuaagcuaccucucuaguuuguaguuuugcuguuuuuaaguuacuguguuauuuugugcauuuauaacugacaauaggaguuauuaaaauuuuugauuaaauuuugugaagggcaccacaguaguuuucacauacauuuuuaaaaaauucauuguuacuuuaguauacaaaguaaugauuuuuauuaugaaaucuuuauauauuuauauauauauguguaugcaugaauauaauuauacuuuguuuuuauuugcuuucccacacuauugcccuucccugugcucccuuaaccucaugcugaacacauuaaaaaacccaaacauuguauuuauuuaugacauggggguggcagugcuguggugguugaggucaguucucucaguucauuguguggaggugagcugaggcugucaggugggcagcaagugccuugccccacugagccaucucacugcuccuaaguacagcuuuucuuguuuuuaaacuauguuuauuauugcguguauguaugaaaugugggcaugagaacccaggcacaugugugaagaugagaggacaguuuucaagagaugaaauucuccuucucaugggacccaagcauggaaaucagggugccaggcauucugggcaaggguuuuacaugcagaaccaaguaucuauugggugcuuuuauugcuucuuuucagaguucucuuuucaguuuauuagcccuuacugauuaggugauuugcuuguuuggcagguuuuaagguucuguguuguucaauuauccuagauauucauccuuuggugugugguuggcaaagguuuuuuccuucuguaggcugucuucagugauugcugccuuuccugugcaggagugugguguuuccauuucauccuauuugccaguucuugaauuacuuccugagcaguuggugaaaacuguugccugugcucuaucuuugucuuaguuagggauucguugcuggcuccuccugucuaccugugucuagcuuguucucucuucaaguugucucucuaaaucucuccugggaaaacugccucuucucuuugccccugcuuucuauaacugucccaggaaaacugccuccuccuccuccucucucccauugcacugcauagcuucccuuuccucucucuuccggugagaguugggcagauccuagucugucaagucuuucucugacuccucacuuuuucuagcacucagacaucacuuuuaaacauugaugcuucuaucuacaaacuaacuuuaccuuccuuguuugagauuacagguguguacuaaaggcaucuuuauuccagccagagggauuaaaggugugugcgaaggcuaaguuacacuacgacuagaaacaggcauuuucaguaaauaacacaaucccgggguucacagugugcucagauauccugcaacaaugccuggcugauuucaacauggcugacugauuuuaacaaacaaauuucaaaauaauuuuauggaaaauuggggaagauuauccaaaagauaaaguacauguuuuaucauuuaaaaagaauacaagaaaagagguggcagaauaauuuccuauugcucuaaaauuuagguaauggcaaaauggagggaguguaaagauucagauuagcaaggagagguuauugaugcuggcagcauguauguauuucuuguggcauacguauucuuugguuuacucacugcagaugagugcugacucgugaucucucauugaguucagugagucuuuccaguccgcugcagcugagacuuggacaguguagugcucacaucuucauaagccaccugccaaugcagaggcuuguaaugacuuccuguaaccaucucguuuguugcuuguuacauagcacuuucucacgggcgugugcuaugaaaggaagucagugcuuccuaggaauuuguguccuguaguguuuguugugagugcuuucuuaggaggcaaauucaaagaaugauugugugcuuuaggcuuacauauaucuuaucccacaauuuuuacagaagucuaauacuuuuugacuguuggcccugaaacauaaugucaacugucagugucacugaugcuuauuugaaaugacaucacuuuaagugaccuuaagaugacacuaguauuuuucuugcuccuagaaucaucaggaacagcaaccacguaagucucacugugucuuagcucaggguuagaggcugcugcuacuacuuuauagagaugaauauuuacauuguuuuguacagucaguuuuauucauuuaaauugaacuuuaugaugaccauuuguaugaccugugugaaugugggaugcaggagcuauagaaggcuuggaugucagacagcuuacuggagucgguucucccguucugugaguuccagagacugaacucagucaccaggcccuuuuguuguuuaugacccacuugaaacaauauaagguuuuaguacuagauuacaaaauaauuagaugguauuuuauguuggcuaaaccuaaaauuuauauauguuuacauuaauauauucuuugagacuaggucucacuguguagcuccuccugacuuacagcuugcuuuauagaccacccuggccuuuucaaacuuggagauccacugccucugccucuugaauacugcaauuaaagggguuuacuacccuucccaguuuauaauagauuuacuaauaauacaggaaguauucucuaugauugcuugcuaagauaguguuacaaauaguauuugaauuagcaguggaaaccuaauauacuuuccuguuuuugcauacuggggauuguaucagggcuuugugcccauuaggcuggugcuuucuauuccugaguuacauucuuagacuuuacuucugagacagagucucaaacuugcccagacugggcucugguucauucuagcacagucaagccuuaaacuuacaguuuucagucugcuucagcuuuggaguaguugguuuauaaagaugaaaugcucuuaguaaaguugagcuuaaauagggucaguaauuuauaaaugaccauguuucaacuguucccuccaguucuuccagagaggccacagauagaauuaaaaauuauaguaagacacacaguaagaaugacuuccaggaagcagcaggcugccuauuuccagcuugggaaagcuggucccagaggaaggcaccacuguugagcacuguugucguucucuccuugacaucacagagcauccauugugacccugugucacagacaugacgcucugcuuaucaguuacucuucucucugcaguugaacugcgaaguaccaggagagggugacacuaauuaaacugaaacuaaaugaagcaaauuaauuacauuucuugcuuuaauuucgcugucuucuggaaaauaagauagcugggcuagugauguagcucaguugguggaaugcuugccuagaaugcauaucugcccauuuuuagcacccuuagcaccauuuaaacugggucaucuuagcacgugggaguuggagggaggagaaucagaaguucaaguccauuuuuggcuacacgagguucaguccagucucaaaauaauagcaacaacaacaauaaaaacaaaggaaaagaugaaaaaccaagaugcuaaauuaaauuuaaucaggggaaaauaauauacacuuguacacauuguuacaugugcaauaaccuaaaauuauuuuaauguagguacauuaaaaaacucugaaggagacacaagaaauacaauguucugggcaaggaaacaggauggcuugguuucacaagugggaauaauauucacugcuacaucuguguaucacccacugaagcauucaaaauaggaaaccugauuccaguccucgcaugcuuuauuauaggagggagaacuucauugauacugauuugaaaaggaaucugcgacuuaagcuguuuucuuuuuuaggaauugaauauggcuuaaguuuaccgcuuggagaagauuaugaacagaagaaacauaaauuaaaagaagaauugaggcaagauuauagacgauaucuuacucagguaaguuguucuguuagugaguuguauuuugucuauuuaaauuuauuccuaaaauuuacuuuugagaaguguugaucaugggugauauuuggccaacuagugaaaaauaaauucuugguggaaaaaugugaaaacguguguuguggaauaauaaacucuuccuggagcaacaaggccuuggguuuagucucuagcacaggacgguguuuuacuagggaaauggauuuuaauauuaaaggagauuaacagcuguuaaacagugguuguuucuguaaagcuaucuuugucuaaagaagcauauccacuauuccccacgauguauuaaagugaccugaaggguuuuagauaguaauuacuuuuucuuuugauaaguguauaaauuuucuguuuacaguuuuauuaacuacuacauuccaucuuuuuuuuuuuuuuuuuuuuuaaucacugugacaaaguauccgagaaaaacagugugagagaaaagauuuuagaggugcagucugcgucagcugugggccugugguagggacauucuaccgaacaaaauaauaucauggccagcagcaagggucuggauaagaaacagcccccauugaugaguccucuugcuccagcaugacuaaccaguucccaacaccuuccaacauauugccaguagcuggaggucaccuucagcaggagccuuuugggacaugucauagucagaucuuaacagcucuaacagcuuugcuuuaugauuuaauaguuuuauuuaggagaaccccuuugcaauuaucaaauuaucuauuaauaggcuuaugauuagguuuuacaauguaguuuccuuuauaaguuauaaaaauacguuaagcaaucaugauucuggccauucacaauacucuuggcuuuuccauugcuuuauaaauacuugcuucaaacugucuuuaacugacugucauuggaaaggacagacuuuacugaacacauguuaucaucaaugguuuguuucucuccacuuuagggcauuacacaagcaaagagaaagguaggguugccugcguaauguucucuuuuaguuuguuuuuaaaaagauguaauagcuuauuauuugcacuuacgugauucuaaucaaguagaaaaauggcuucuuuuguguuuugaggcuuuugaguggcaccuuucugcgucuguguuugccaagaugacaguccacacauuacaguugucuauugauauggucaugacuuugauuuccgcucugcauuuguuuucauugcuuccuuuauaaauguccuggaacuguugcgugcuugcuuuuuagcuugucuauuucuguuccacaauuuauacugguuauaauauaaauagucaagauaauuuaaaauguuuugaacuaccuaaugucaugauuuggauuaauugauauuuuuguacugagucaggcugaucacauuuguuaguuuaugugggaaaacagcaccagaucacucaacuaauguuuaaaaaccaccaguaguuaaauauaguauagaucaugucuucaagggguuuaggauuuagcuguggauauauuucaucaagaucaggaaauguucacuauaacaagauguccugauaaagcauuacagaacagguagaauuugaauauucaaaaggcaaaauaaaaaaaagcuuuuuaaauggaggauauagacugaagaaauuguguacuauaggcuuuugguucauuugaaugagacauuuaccagccugacuagcuggaugauggaggauggagaaagagugguguagauagagaggacugugaugcugaaaggccguccaugugauaggcuguggugaauguucaggaggggauaacuguuguaggacagcuacuuguacuuguuagagacucauuaacuuaaagucuacagcuucacugaacuuauacuaauuuccagucuguuguuuaugaugcuuuccagaaugauccuauggcuaacuaaauauuugucuccuuacuaacuuuugaggaaaaauucuaauuccuucagcgugccacgccuuuccugcucuagcuugacuuccuaggccuguaccucacaccuuuccugcuauacccaacucuuacucguacguguaugauuagacaaagaaggugggggacugggcaugucuugucacaacagcuugugcacuguccgccuuccagagcugaaagguggaagaaugaaaggcagauggaggagccagacagaagggccagccaaagguggaccaaggcuagccagccuuucucaaaaccagcugguauacccaguaucagauacaaagcgaucugagggauagagauguagcuguguaguacagcacuugccuugcaugcauaaggccgaagcuguagcccuaauaccacaaaaaagagaaauggucugcucaguggcuggcugaacacuguguguuucuuuaacagcuuuccagcaggcuugagaugaucgcuguguuggcagucccacagugguggguauggucaugucaggcuggauggguagucacaugagugaaaagaaauugucuuuuuaaaaaggaaagugcaagugaucaagggagcacaaaucuugaccccaaggaaguuguuuuugugauggguuauuaagaguacagcuguaaaguagugguauuuucuuagaaccuuugggugguaucugagcagguaguaguuaaaaacaaaaaaaguaccuggguauggagaggaagcuaugguuucucugguucuugcggguagauauguuuuccaauucuguucuugggucucuuguacuuucagacugauaaauugugugaauacuaauaauaaaaaagcuaagcauaguggcacaggacuguaaucccaguacucaggagguggaggucaagggucaggaacucaaagccauccugggauccauugcaauguugaggcuagcuuaagcuacaugaaaccuugcaaaaaaaacaaaacaaaccaauaaaaacaaaagaagugggcgagggaaggaaagagcagagaauaacacugcgcacggauguccacacuuguaagguuagcacuagaaggaaagagcagagaauaacacugcgcucggauguccacacuuguaagguuagcacuagaaggaaagagcagagaauaacacugcgcacggauguccacacuuguaagguuagcacuagaagggaagagcagagaauaacccugcgcacggauguaacacuuguaagguuagcacuagaaggaaagagcagagaauaaacugcacacggauguaacacuuguaagguuagcacuagaaggaaagagcagagaauaacacugcgcacggauguaacacuuguaagguuagcacuagaaggaaagagcagagaauaacacugcgcacggauguccacacuuguaagguuagcacuagaagagcaggggcaggagcauuucuguaaguaugaggucagccugaaguacagaaggaaacugucucaaaaccaaaacacagccugcaguggccugcacacuuuuaaucccagcacucaggaggccagccuggacuacagagcagguuucaggacagccagggcuacacagagaaacccugucuuagcaaacaucaagcaaagaaagaaagaaacaaagaaaacaguucaaaaguucaauguaaccguugcuagggagaaccacuaaagaacagauaccaugguuuuguuuuuguuuuuguuucuucuaauuuuagaauaaaggaugcuugguguucucauugagcagauugaacaguuuuuaaauugaaucaguaaauuaauuucauuuguuccuagcucuucuugaaucuuaaacuuucuauuuggcuguuuacuugguguuuucacuuugaaauaguacucaugugcuguguguuaaaaacauccuagaacauguccaaaaggaacucaugagcaccauuuccauucuucugcuauagacgcuuacacuuuccauagcuugcucuuuuuauuuuaguaauuuauuuugauuauagcaguuaugaccugauggaucccaaauguaugaaagaguuacaguauuuacuaauucaaguucuuagggucagauaugguggcacauuaaccggggucggggaaggggucagggggccaggaaggcagagugcugggagcaggguguagcagguagggagcagggggcacacggggcacacggggcgcagggggcgcaggggcucuucuuugaaaugauuagaugugucggguacuugggcaugagagugagcagagggaggagcuaaucaggccuuguuaguuucuuaacagagaagcuuauuagagucccauacgaacuuucaaguuaguuuuuguaacuuuagauuuauugggauuucauuagugacuugauuuauauauaguccauuuacuuuccauagacagacagucuguuaucaaacaugccacguuuuuaauauaaugcuaccuaagcagauagugcauuauauugccgguauuuguuuuguuacugaaggaucagagggaacauaagcuuauuauuguuuucuugacguuuaaacuaguaacaggaaaacauuaaauggucaauaauuguuuaaugauuucauucaugcaggaaauuagauaggccaacauauacugauuuagcuuuuaugauauaguauuauagacaacauuacccauuuuagaggugaaaaaaaaaugaaguaaagaagcuaagugacuuauuuagcauuuuuuacuaaguagucaaagauuuuuuuauuugcuuuauuuaaaaucuucaaagagacuauauuuuguauccucuuugaucccuucucuaacuuuguguguaggacagguaccauucucacuuuauggaagaauguguaucagagaaauuaacugacuuggucaguguugugugacuccuauguguggauguuagcuggagaaacuugaguucuaggucuuugggugcccagacugaugcucagaaauguucacuaaugagugcuuaguguacacgaauggaggacacacaagcaaaagcauucgaggucuaauuuugggauucugugcauacauuuauugagauaacuucaacaaacaucaaaacaacacuacaggcauucauagagauauuggugaagaaguuaaaagaaugaagaauauauacuuagaggaauuuaaauugggaaaaccaaccuuuccaugauuaaucaccuugauucaacagagugaguuccaggacagccaggacugcacagagaaaaccugucuagaaaaaaaaaaaaaaaaaaaaaaagagauauguauguguugcaaauccaaauuaaagcuugaaucucuuuuuuagggaguugauuugaagaauuguuuucauagucauuuugugugcuuuguagacuagucucugaauuuaucuccauuccacccugcugugcauuauggagcggguuagaauauagaauguaaaguuuugaaaccuagaaaaucaaugagcuaauguauauuuuaaugugcauauauacagaaaaauuuccuaucuacuggugaaacagacccaucuacucugggaguuucucuucccauugaugagcgguuaucugccaagguagguggauaggaauaagaguuuccugagguuacaaaaucaugcaagaacauacuuuuaauuacaucauuugucccuacuugaguauaaucuuuuaaaaagucuauggaauuucuaguugaguuauuugaaaacuuauuuuaaacauuaaugauagauggugacauuagacuuuaauguguucuuuucuguauuuuauuuaaguauuguuuauuuuaacauugauaccugagccacaaagucugugugauacaguuaucagugacauggguggcugugaaaggguaguauugcuggaccagcuauguuucuaucacuccacugaugcaaacccugauugccuaagaaaugguagcaacauuaaauaguauguaugacacaaugaacaguuacuacguuucaaaaagcagaccuaacuuguacucuuuuagauuguguuguuucaguaacauugaacacauuaggauuuaagaaaaugucuuaaugcaauauauuugaauagagcagugcuauuacaguauuuuaauuuguguguguaauuuuuaucacuuuguguuuaauagcccuucuguaacuuggggaauaagaucuugguggucggggauuauggagggauaugcuacugauaauuacugggacaaaagaaucaagauagcuuaucacuggaguagcuccagucugugagugacuucauguguuaacgaaucagacagcauauauucauguauguuugcauauggcagcagaggcuuagagagcuacagguuaguucccugucugugcccuucagugacuucuuguccuuaaaaucauuaggagagcuaagaguucugauguguaugauucuacuuucauagaaggcuccccuccucccugaaguuaacauuguuuuucaauuuuuuuguaaaggaaagauugaaacuugaacgcaaccgagaauacaaucaguuucucagggguaaggcagaauccacagaaaaagucagacagguagaaaagaauauugagguauguuuuacuuuuauaaagugaucuuuaauaucaccuuuaugaaugggcugcuggcaggcggguggugguggugcugguggucauguuugcuccacccuccuugacuuuguuuuuuuuuuuuuuuuuuaagauuuuauuuauuuauuauauguaaguacacuguagcugucuucagaucucauuaugggugguuguaagccaccaugugguuucugggauuugaacucaggaccccuggaagagcagucagugcucuuaccugcugagccaacucaccagcccccgacuuuguuuuuguuuuaacugguuuuuaaauuuugacaguuucuagacuacuuuuuuucauguaauagaauaacugaaggauggaguucuuuuuaaaauuuuauuuuuuaaaucauuuaaaaaaauauaucauuuucucgcccaucuccucccuucaacucuuuccauguuguucccuauucccuuucaauuauauggccuccuuuucuuuaacuguuauuguuacaaauauaugaugcauaaauacauaaauauaagcccguggaguccauuuaauauugcuuguauauauaugauuuaagggcugagcacuugguuuugguauugaguuagggguucauucucauggaagaguaucucucuccucaccugucauuaguuguguguacacuacucuagccgcuaacuuacagagcucugccugccuccucagccuugaguaaaggcacgcaccacuacacuuagcugacauaacaucauuuaacacacauacauguaauauauaugcaauuuuagguaaauauaaauuaaugauuuccuauggcuuuuuaaaaagacucauuuauuuuucucuuuaauggcuuuuuugauuaaauaucaaaguugagauauauauuaauuuuaaggauaguuauuagaguucuauguaagaaagacuuuaauuaaauuuuaaugacaaugucucauuaagcuuuuuuucuuuuuuaauucaacagccuaagagucaaagaaauaaaaacccuauuagucaagguaaaucugaucuaccuuuacaaauacagacugcauacacacauucagagggacccuggcuaagccggcaagaggagggccuguaccgacagcuagauggugaaauugaauuaaggagcagaagaccgcuuaaacaaacaaaggaagaaguaggcauuucuggugcagaacauccaagccuuucuggcagcgcuggugucccagagagaagagcccgcagggcuaacggggagcgggugcuugacagacaacauugcagagccgaccgagacccuggugugagugaagacauggacgagagguuuagauuugaaagugauuuugauagaagacuuuugagaguguauacaaauggcagguauuuacaucuucacuuuucuucucuguauuuacuuaauacugguguuuuauaguuacauuagggaaaaggagcuuuauuugauuuaccguauuuaauuuaguuauacuguuuugugaaacaccauuuuaugugucauugaaggggggagauaaagaaaacacucuaaauggggaccuugguaaagcuagaaagugguaaaguguauccccuuaaucuaaaagugaauggaaacauucuuaaagaggggauuucuugucucagcuuaaccaaguaggagaguaaaaaaaaaaaaaaacccaaaaaacccccaaauugugcaugugaauuuaaauucuaaagcagcaauggauucagauccacagucuggauuccuguugccaguggcuuccaaagaaaucucagguuguuuuggaucauagcuucccagaugacugacagggauaaaacccaguucccuacgcaguaaguuaaaacuagguugcuaggcauccuaaucuuagauguuaaaauguauguaaaaagggccauuguaacauagaugaaaugcaguuugugccuuuacuguuuguacauauuaaguaucuuuauguuuuuuaaauggacuuuuauguaauugaaaugacauuaacuuuucauagucauauuuuccaguguuuuuuuacuuccuuuaacuauuuugugaugcuguuuggaacuucuuaacuauaagucguuguuuuuauuuaccauauuacauaacuugauauauguuuuccuaacuauuagcuauagaaauacuauagagccuacauuugucauugaccugcuaacuugaaagauuacuuguaaauuuuggggccuguuuuguuuaauagccugaauauuuaauuuuuuaguauuuuagaaaauauuaucaggaauuaauguuauacugucaguauuuugauuacuaauaacaauacaaagauaacaucugucuuuauucuguaucuuaguuuagauaauuuaaauucaaauuuaauaucaagaauuagaaauguggaucguguacucuaguuucuuugagcugaaucuuaauuguuuguaguucaggaaaugcuccaaauccuuuaauaauaucuuauauuuaaaguuuauuaaaagaccucucaguucucaguuugggaaccacagcacuccugggaucuugauggugucuucucuguaccugagaauuuuauagaacuuuuauuuccuuuuuaugauauuuaccuccagaauauaaugaaaacauaacuuuaaguuuggaauuuuaugagacuuucgacaauugaugccuugcuuuucacauaugaaaucaaaacaacuuauuguauucuaauucucugaggacugcaucauaacggcacguaucucauaaauguaacgaccuuuaccaacuuccuucaacuguacugagaguacuuaaggcugguucuuaugaucuccauucugaacacuguuucuucaaacuaaaaggcuacauuuuguuaauauaucagcugccauaucuccauauguuuggcuguuccucauguuucuugauaauacagguuauauauccaccucuucucauugaaaaaagaauucacauuagccauuccauagguuauauuuaguggguguaguuauuaguaaaugaaauaacccuauuuauuuucugaaauuuccuuguuccugcauuuuuuaaaguuaaguuuuugaucaguucuacuuuuauagugaugcuuuauuuuuauaaauuugcuaucaguuucuuuguacuuauuuagcaacuuccuaaacauaccugguguauaaugaaugaauagugcguuuuuuucuuaagcuaggguaguggaagcucucuaggagagagcucuucuaaagucauaggauuggucagugcucuuaaauaauucucacaguggcucucacugugccuagugauuuguauucuguguguuuguguguauuguuuauguguaugaacuaaugaggaaaauugauguucaggagauuucugaaguugaauguaaauaggguuuuuuuuuuaaugauacuuugaauuauagauucuuaaaauguagccugugcuaguguuuauuauuuuuuaacugaauagaaguuaauauauuaucuuucaauguuuuacuuuaguauuaacuagucaaagaaaauuuucaguauuagaaaugcuguucuucaguuucugugugaucaaugugguuaacauuuccauucaauuuaaauauaguugcauauuuauaauuaauagauauuuaguaacguucugaaauaguucuuucucugaagcuugaauuuguaugaaucacauagacuaagugucuaguguccuauguuccuucagauuuaauauguaagauaaaaacgagaaaugucuaauuagaagccauugguguuugcuucucacuuuguaccuuuaauuuuucuucagaaaaggucguuuuuaguaauuuuuaaaaagauucauuuuuuaaaaguuuuauguguguguauauauauguguauguguguauguauauauauguauguauguauguauguauguaugugugugugugugucccuauuaaaguuuauguguacaaugugaauguacaaaauaguggaggucggaggauuucauauucucgggagcuggaguuucaggccauuguuagccaucucauaugguucuggaaacugaaccagggucuuccucaagagcucuauguguucugauugcugaaccaucucuccagccccauuuaaacagauuuuuuuccuucacauuaaagauacuaggaaaauacuaacuauagaagugagaagagacuggaaaugauggguuaauguugcucacagguaguaucucagaaagcagaacucaguagccaguuacaucacacacaugcauggaugcauggaaacucacacugcucaguagccagauaaaucucucacauguguggaaacucacacagcucaauggcaagauauuccacucacaugcuuggaugaauaaaaacucacauaaugcguaccgagauacauggaaauucauguacuuggauacauggaaacuuauacaucuuuuuuuuacuuguuuaaaauuuuuuuugagaaaggcucuuauuagcacauguugacucaaggcuaaauauguaaguauaguucagacugcccucuaacacgggacaaucauuuugccucagcuucugaagugcugguauugcagguaggaccuacaacacccaaagauauucuugauaugaaaacaaacugauguaaguacuacucuuaagaauuugguaguuucuuuuauuuuuuaaaauuauacuuuuuuuuuuuaaauuggagguucauuuagugcacuuguagaggucagaggucaacaauuugccauaacuuucuuuucuuuuggagauugaagucaggcuaucaggccuucgucugcugggccaucuaucucaccaacccuagugguuucuuuuaaaguuaaaagaaauugagagucauugacuuuguguucucuaucacuuuagaaguuucuuucagaugauuuuuuugggggggguggggcuugagacaggguuucucuguguaguccuggguguccuggaacuagcucuguagaccaggccgacuggcuuugaacuggcuucugccucuugugugcuguaauuaaagacaggugccaccaccgccuggccuuauaguuuauuuuuauaauuuguucuaucuaggucuaaauguuucagauucacuucugaaauaggauaucuuaaggaaaaaagaaaaaauauauucauuauuauuuaggaguuguucauucauguugaagauuguacuuuuaaagacuccaguucuuuaaaaaaaacauuaacauauuuuaauuuuuagcauaaacuuggcuucugaugugaacuuuguuucuuugggcauuaugaguuuuuaaaagauuuauauaaaugugauacacaugucugugagugucuuuggagaccagaagaguguguuagauuccccucauuguaagugccugauuaggugccugacaaguaaaccuauguccacuguaagagcagcaaguguccaagaagagggaggagaaggcuuuucuuuuaacaugcaugcuuccucucccccccccccccgccccccccccggcaggaggaugaugaaaauuugguuauuucagucucuggaucauauuuugaauugucuaugagaagaagcaauuuuuuucuuuuaugagggcaauaccuuuuuuaaaaaagggucuaaacacuuauauuucuucaaaauguaaaucaaguuaugauuucuauuuaaaugugcuaauucaugccucugaauauuaagggcaauauugacggauugaggugucgugugugaaccuguguauguaauagcuagagagagguuuaaccuuuagcacagaucauuucuagaucauaagaacaguuuucauuuagcuguaguucugacgucauggccaaucagagagccuguuaggcacugaucugaguauccuuagcugucugucagugcacuacagcuggguaguguggagggcagcucagacugagaggcugugagacagcaauggugaggcuccuaucugcuuccagaacaguuccuaaaagagcuguuaaucugacauaaaaaucaucguaagcuagagagagcugagaguaaguauaucagauguuaaggugaagugucuuaauuaacagggaaauuaguaagugaaguaaauccauaaaaauaauaguuuuauuuuaaaacagaaucagguggcuaugauguagcauaacgauagagugcuugucuauucaauauuuucuuuuuuagguuuuuaacaggguuucuuugugcagccuuggcuguccucaaacucacccacucuguagaccacuggccuugaacucaccucugugaguccaccugccucugccuuuaauugcugguguuaaaggugugcaucaccacuguacugccuacccaguauuuucaagucccugaguuggauacccauuccugcagaaaggugaaguguauggagauucaauguagcuauugaaucuaaauuuaauaagaauaaaaaguugacuaagagucuaaacuacaucuuguuuucauggaucucuauaucugaaacguuuuaaaaggucuugccuuauucuaugggcauuguaguuuuauuuauuagcaacaaccuuaaucuauuuaagcuauuuaagauaacuguuaaacuuuguauguuuaguauggcucgaaauaaccuuuugggaauaugauacuuguuguuaugaucugugcaugugccaaagaacccaugagcuauauuuuuguauggguucuuggcucugacuauuacaguuaagguuguaaauacaaauacugauucuagacaaguuagccggaaaugcaggaagcuguaguucuuugguaaauuuuagaacaaauuucuauguuuuuaauaauugucuuuuaauucugggaccugaaguuauuaguuuguauuucucugccugccuuuuuuaaaaaaaaauauuuauuuauuauauauucacuacuuuguuuauaugccagaagagagcaccagaucucauuauagauaauuaugagccaccaugugcuuucugagaauugaauucaguacccucuggaagaacagauagugcucuuaaccucugagccauuucuccagccuguauuucucuguguuacuauuuugugugucaugucaggucccuaacaccauuucugagcugggugauucuugagaauggcucacaguuuuuauuuuguguacagucauaaccaaagccugugacucuguuuauauuaguuuuauugagauagcaucuugcuuuuuguuuuauuuauuuuuugccuuagccuugcagacacaccaacacacccagcaggcagcaauaauuuaguguaguuauaggacagaaaggacgaccagcaaagggagaaggugcauggggcagaaucagaggcaaaccagaugaguuuugaaacuucagugaugagacacagaagauacaauucccacagcacuaaacugggacucaaugccuaaaguauugaggucugcuuauauauaugcccuguccuagcacaagcuaacauucgggcggcuuccuauaggagaagcaaguguuucuuuauagccuguauguuugugcaacuaguuuaggaacagugacacacucauuaauuaguucuuagacuagugggaaccuccugaaacauauguuguaagcugacaaucaagggcugccugugucacagcccuuucuuaguguagacauucuuaagccugcugcacuagauuuucuguacauguguauuauuauauugaugcaguauaccucaauaugaaggacauauuaguuauuaauuccagccaauuaaagacuggaauuuguguuuguauuuaccuuugcucuaaguaguagaauagauugauguguuauuuuaaaagaguuuugagcaucugugcuucaguuuaaauagugcuagcuuuuuaagagaguuaaauugaaguaaauuuucaaaugguguggagaguacugugcuagauauggguaaaaacuggaagcaauuccugucuucauggccaugucaucguguuauuaggacuacuauaugagcagauuuccuccagauaagugugguuguaguuuguggugggaccaaguaaggaccauaguaggcaggcucauugguagaaugcguuuguuucuuuuacagcggaauguggccagaauucuuaaucugaucagcgacuuuauguuaaugguguaguuucucaaccauacuuuucaucuucuucagaaggaaaacauaauuuguuaacagccacauaaagaaaugugaccugaaaauuuuuguuuaucguggaugcuaauaaauguucauauaaaauuuuaugcugguuucucuggcauaacaaauuauacuaaaaaacaaaaaacaaaucaguguuugccaaauggaaaaaaaaaagauaguugaaaacauuuucacuguuuuaaaugucugcuuuuuuuauggaagaaaauaaauucuaacuuuguuuuucuucuuuaugaucuuauaagugaagguucuucaggccuguucuguaucagauuguuuuaaaauauuuucuguuuugcuucuucauucuuucaugggguuuacugugccaauuuuuaauuuaaaaaccuugguuuuauguauaaugaaauaauucccagaauuuaugugucuuaaucaaaaaacaauuuuguuuugaguucugccugcaaacuuaaguguguacagggauguugucugcuccauguccagaauaagacuuggccugcugacagugccuguaauuaccauauuaaccaauugauaaaaaucugugaguguguuaucuuauaucuauagcuggagagauggcucagaaguuaagagcucuuccugauuuuccagaggaccuguguucaguucccagcacccacguugaaugaccuacaaccucuucuaauuugaguuuuaguugaucugacaccuucuucugggcuccucaggcaucagcaaagacauggcuuguguacacacaugaggguauacacacacacacacacacacacacacacagacauaaaaaugaaaauaauuuuuuaaaaauuaaaaagcauuaaauuaaaaaauuaaauauuuaaauguaauauugaaauaaaaaguuguauagaaauaauuuacaauaauuucaguuaaaaaacauguauuagggucuggcuuuauagcauuauacagaacuuuccuaguauauucuuauauaugaaaacaacagcaaacuugaauguaaauucuuacuauuucuugcuagcuagcagaucauauuugaagcaaaucuaauuugaauuaacuuuaggaugcaguuucaguaaacugauagcacaaucuuuugcucaccuuaaugcuaacacauaagacuguagaacccuagagauauaagguccacuguaugugggccgugcuuuauaagcuaauguguuuugaaggccgcaugggagcagacgaggguauguggauggggaugaugucccagaagagccaaacacacagaucucagcugcugaaaauaaaagguacgugacagcaaugaucuccuugagucuucacacccugacacagcaccugccuaagacuggcuucaggaaaaguggaaaaguacaccguguuagcaagccgccuuuauagugagaggaaguaguggggggagagguugagggccugggaaugagcaccuacgguauuuccuuuggcauucucucugucucgcucccccuccuguacuauggcuugagcacaaaucauugagugagguaagcacuuuaccacugagcuacaucccuaggccuauaccauuauuuucaagaauaaguuuuuuaguaaaguuuggcagggcuuucaguguaacccucucucauuauaaaauauauaaauucguuugaaagaaugaaggagaaauaacauaauugaaugguguuauaaugaauuugaaacaucugggaauuguggcuugcagagaugacacagcgguuaagaaguuauacuguucuuguagaggacucagacuugaguucgagcaauacaucugauggcuuaacagcugcccuuaauuccagugccagaggagccuaauaccucagcaggcacauacacacauacauacuuaaaaggaagucaugguacugcaguuggacugaaaauggauugagaauauccccuuagugugaguuuuuaaguuuauuuuucauuuauuuuugauuauuggugggguuuuaaugcuuacacuguaaaauuaguauucaaguuucuauugauaacaaagcaaauaacuuucuaguuuuauuuuggugcuuuuuuguguuguccauaagaaugaauaguuuaaaaaaaaaaacaaaaacaaacaaaccaaaaaccuaaaagaaaacacacgggccgucaagaugccucuguaggugaaggugcuugucacagaccuaaugaguugauccuuggaauccacauuaugugggagagaacugccaagguugaccucugaccuccacucugaccaugccacauguguauuauaaacacaaacaaaaauuuuaaaauugaugaaauguaaagcaaacccacaugagcuuuggggauguggcuuagugguagacugguugcucacauggacaaagcccaggaauuaacccccagcauaguauaaaccucacaugguggggcacaccugugaccccagcacuacgggugggaggggcagaaguucaaaguucgagacuuuagagggaauugaaggugaagaugggguacaugagaccucuccccccccaaaaaaaagaaaaaaaaaaccaacaaaaccucggaucagggacuggaucaugaggaucugcauggggaacugaauaugauggaacuacauucugugcguggaugaaacauguacaguugguguaugcugcucaggaagacggaggaagcuguccuaaaauacaguauaaggaaggcggugugcaguguccugaacagugcccguucuuagaggaaacaaagugacuaucaucccuggcuguuagaaaaccugcuguuuguuucaauuagguucccuugacaaucagacucuuuucuuucaagaaaguuuguuuuugaaauucuuuuuaaagauuuuauuuuuauccuaaagggauaaucuucuuuucuaaaugggaauauaguuaggaguauaguggggguauuucauauaaaaacagauuucaaaucuguggacccagugaagcaggcugaagaauaaggagauaaaauaccauaguuuuaacuagcauuuuugaaagaaaggauaauucauauucaccuuuucuucuucaaggguacauguauguacagguguuugugaaggcuguaggugaagcucuagugucuuccuccauucgguuccacuguauucucugaggugggacuuugccauggcuggccagcaaacccuaggggcacuguuguagucaccucccuagcugcugaguuagcucuugacugugugcugaagguugaauacagguccucauguuuuccaaguaauuuacucacugagccgucucaauuccuuauuuuuuguucuucaagacaugggguuuuuacauguaauugaauuuuacuguguagcccaggcuggccucaacccuacaaucuuugcuucagccuucuaaaugcuggcauuaaugccauguaccacuauucccagccuuuauguugaauuuuauuuccuaaaaauacguggauuuuaauauuugcucucucauauuguuuguuuuaguguucacuguaauggaccacccagaucugcugaucucgauaucacaaguccauuugcaggcaugcucuuugguauguccagcacuuucagcugauuagaccuuuguagaguguugaacuaaauguccuuagugagaacucaggguuguaaguagugaugacuugugaagaacagcaggcauuuauugaggcuuacuuuaugaugguuaccauacaagcaucuagugugcauuguauagaacuguugauaccuuaaagcuuaauaccuaaguuagcuaugguuauagaugauagcugaaaaucagucugaguaauaaauuagcuauaugguuagagaugauagcugaaagucagucugaguaauaaauuagcuaugugguuauagaugauagcugaaagucagcuugaguaauaaauuagcuauaugguuauagaugacagcugaaaaucagcuugaguaauaaggcuguuuauuuuuuaaagcuaggauuuuguuguauuaugacuguuucuuuuuauucuguuuuauauguaacucuugauucuuugcuuauuucuuguauuuuauuucacuucuuuugaacacuccauucuacuacucuugcugccuuaaucauuauucuugagugugugugugugugugugugugugugugugugugugugugugugagagagagagagagagagagagagagagagagagagauaugcugagagggauuugagacugugacugugaaagacauagacauagagacugacagagagaacugaaaaagaaacugagacucucagagacugagaaagacuuugaagguuuuaaaagcccaccuccagugacacacuuccucuaacaaggcugcccuuuccuauccuaauccuucuaauccuaucaaggagcuccaucccagugacuaaacauucaaaauguaugagccgaugugcgccauuuauauuaaagcuaucauauuuguucuuuuucuauaguuucugaauaaguggguuuuuuuuucaaaaucaugaugacccaaauuuucuauuuuuuuuaaaucaaaguucaagguuauuacugaauauaguccuuuugguuugcuauauauauuauguuuguccucauuucauuucagaaaugguauggugagccuugauuuuugcuuauagcuuuguauacaaaagaaguuguucuuugaacaacacuuuaaaagcuuagcuaaaauuuaguuuuaguaagauacaugagaaaauugaagccgggcgugguggcgcacgccuuuaaucccagcacuugggaggcagaggcaggcggauuucugaguucgaggccagccuggucuacaaagugagcuccaggacagccaggacuauacacagaaacccugucucgaaaacccaaaaaaaaaaaaaaaaaaaaaaaaaaaaaaaaauugaauagcauauuagguugauccaaccuaaaagcaaccuaaaaguuaaauuuugucuuugagacauaguuaccugguacuuuuagacauuuauuuccuagaaaugacuauugugagaaagauggcuaugcucacaaaaacuuaguucuuguugccuguaagguuugagcaaguuugucuuuuaggucagaauaaagacacaugcuuaggcuauauuuugaauggacguuaaaggggaaguaagugguaaugugaaagcaggcugaaaauuaauuuuaucagcaagguuacaccuccauccgcagaggaguggacuuaggucaccgguaugcaguuaggagcugugggcaacacgacacagcaguggaguguuugcagugaacgagaacgacugacaucauucaaagugauggcucaucuuacauuugaggagcucuaucccugaggagguuugcacagauaggggacuuaugccucuccaaaggcgguggauuuuguuucauguuacuccaacuccacuuguacuaaaauuuauuuuccuauuguuuagcuucagaaauuucauuugggacuuuuacuuaaucaaaaaacaaaauaaaacuaaggugaacaugguaguacauaccuuucaucgcaacacuuggaguugagguagaggcaagcagauuucugugcaucuggggccauccuggucuacauagugagugccaggacagccaaggcuacauagaccaguggguucucaaucuguccaucucaacccucacagggguugcauaucagauuccugguuaucugauauuuauuugcauaaugguucauaacgguaucagaauuguaguuaugaaguagcagugaaauacuuuuguaguugggggucaucacaacauaaggaacucuauuaaugagucacagcauuaggaagguuaaaaaaccacugauacacacucuuucuuagcagggaggaguuagggggagcacaugagcaaguuuggagggaaauaacaaugugcuauggcauuuagaagagagcacagauuacuuagacguauauauuuaaauucauacaauugaaagcuuuccuucaguuuuguauuuuuguugcugccuguuuguaucucaguccuagggauugaguggagcacuguuaugccuaccagcuaagaguuguaccacagagcuacauucuuaaugcaugucggugucucuuauagucugggagcacaauucacaaaauauuauuucaaauuuguggggcuuaugaaaagguuuuaaaagcuuuuuauuuacgucccugguucagaauauuugagacagaaucuuguugagugacccaaguuggacuagaacuugcuuugugguucaggcugacugaguucacaacccugucugccuucuaagugccgaaauuacaugcgugugcuucuuuccuccuuuuccuuuguuuucugaggcacuguuucaaagaauugcuauagaccagguuggucaucaacuugagaucuacugagauugcaugcaugagccaccaugccuauguaaauaaucuuuuuuuuuuuuuuuuuuuuuuuuuuaauuuucgagacaggguuucucuguauagccuuggcuguccuggaacucacuuuguagaccaggcuggccucgaacucagaaauccaccugccucugccucccgagugcugggauuaaaggcgugcaccaccaugcccggcuuguaaauaaucuuuuuaauggcuuagaaaauacaguguguauuuuaaagauuguuuauggucugguuuucagucauaaugguuuguaacucaguuaaaucaggcugcuugaucuuaaugauuuuuuuccccaaucauuuagagaaguauugauuaucugaccuucuugccuauagguguagugauuuuuuuuugagcagucuuguucagcagguuucagcaagaccuuugugcuccugaggaagaggguagguuauucuugcuguugguggagcgcugucucugucugucucaauguuccuaucuuuccccaagaguggugguuuauguuuguguagggguuucaucaggauuucaugcagcaguuccuuagcccucaccagauagugacagcuguugauuuguaugagagaagucuggaaaguaggacauaugguaugccuaagagccauggaagggccuuuuccaggaucuguguauugcuucucuuucugcugagccuuuggcagaggcuagcaaaugauuagagauuccucuuguucugggacuuuauaguuuacucuuaugcacacauggcuuguaaaaauccuuugaggaaucagcugguuucuuuuaugcacuguauggcagcuuccucauccccauagucugcuggugugacgaugcuuggguucccaccucuguauggauuacugauuuacuccuugauguucaguucuucuaguuauugacaaccucagcuuucugaugagcauuaaaaaagucacaauuuuguagauaacggaaccuauucgcaguguagagucagagggaugcucuuuuguggcuuuuugccuucuauacuacggaauaccuccucauauagguuauccuuguucuaguagcuucuauuuuuuucuucauuauguuuauaggaacacuaacuauuuuaacacuguuauuucaucuacuuuuugucgugugugugugugugugugugugugugagagagagagagagagagagagagagagagagagagagaaugauagauugagagagagagagagagagagagagagagagagagagagagagagaaugauagaucuaucuucagggccuugcccaugguacacaauuguuggaacuccauuauuaggaucauuagaagaaaacagagggagggaccuguuuucacuuuuggauggauacuugaaguuuauagaagcuauaaagguaucuuaguuacucuucuguugcugugacgagacacuugugaccaaagcaacuuaaagaagaguuuauuugaugucuaguggcagaugguuagacuccauuauggaggggacagcaaggaagcaagugauaagcugcauaggaggaggaggaagcugagaguucauagcuuaaagcacaagcaugaagcagagagagcaaacuggaaguaagacaagaccguaaguucucagcccacucaggcacacuuccaaacagugucacaaacucggaccaagugucuaaaggccaggacccaggaggaacauuucucauacaaaccagcauauaaaggguuagggaguagagccuucuguuacucagaggaaaguuuugcaauuacuaaugcauguuauguuugacccaugauuugaacuuauacauuaagaaaguuauugguguauugcugugacuuuccucauaacuauaguaauuacuuaaacacugaaucucuuuuuuuuuguuuuuuugagacaggguuucucuguguagcccuggcuguccuggaacucacuccguagaccaggcuggucucgaacucagaaauccgccugccucugccugccgagugcuggaauuaaaggcgugcaccaucacugccuggcaacacugaauuucuuaagcuugaguuuuaguugcaugcgauaaauaagaguuaaguuuauuucuuuauuuuuuauccaggaggugaagaucgagaacuuaccaagagaaggaaggagaaauauaggcaagaacuacuagaacagauagcugagcaacagaagaagaagagacgguaaugaaaagcuugcauuuagcagaaagcauuuucgugaaaugagaagaauaaaugacaguuuuuuucuacuguaacuugauugugaaucaccuaccagugucugcuagauuauugcccauauacaaacagacucaaaaguaguuuccuuugaaaauaagaaaugguaagcauacacucaugcauauaaagugucuaaaguguuuacaucacaguacuccauuguagucgacccugucuagaaucuuuuuuauuuucgauuaauuuuccuuugacaguuucacagauguaacuaaucaauuuuaauccuucugacccuuucacaauuuucuuaaucugugaagcauuaagauuaggaauaaaaauauugguuccaaagaauuugaaaguuaccuuguaauuuuuuuuucucaccuccaagaggaaaguaauauguuaauaucuacuauuaagcuaccuuaaaaaaaaucauuaauuuuuguagugcuggcuuucaaacucagagccuugugcuuguuaguuaagcaagcccuguacuauugagauuuauuuuuauauuauguguauggguguuuugcuuguuggucuacauguaaaauguguaugcuggugugugccugguucccugggggccagaagagggugccuggguguguagaacuggguuuccagugcugaugagcugccaagugggugcugagcaccgagccuggguccugcaagagcagcaagggcucugaacugcugagcgccucuccgguguuauggagacucucuuuaaaaaucuuuauggaagggauuuaacuuuuuggcaugaaaauauacaugugcucuuaaaaagauuuuaauuuuuuuuuuuaaaaauaaaauacuugguuuuguuuuugucuguuacucugugcaaauuacuuugucuuugaaaugucuccagucuucauuuagagcuaaggcacuugacauguaaauuacaguuuccuauguacuaugauuaaauuugacuuuagaauuuuaaagcuuuauuuucaaaggaauuauuuguauuuggaaauguacuauacaggcuucauguacagacauauuucauuuaugacgacaauuuugacaaaguguguuuacuacaauuuuucaauuuacaaaaucuuaauuuuguuuagagaaaaagauuuagcauuuggaauuacaacuucuggaguacaagacccugaaaaaucgguaagaguucuuggcaucuuuuagugcuuaauccuuuauucaaagaagccucaaguguguuaguagccggggaggcuucacauguugggauacuguaaagggcaguuccguuggauuuucauaagugucaaucauaacuacugugaaguauagaaauguuaacuguuguuacauguuacccacuguuaguuuaagaugacuccccuuucauuuguguaucauuuuuuuaguuuguuuugucuucuguguauuugugccacauccaugugaaaguuaaaccaguguagcuuaaacuugauauuaauacugcuaaguaugucuuaacaauuucuuuuucuuaaugaggauaauuuuuuaaaaaauguguaacuugugucuuucauccuguuacugugaaacugaaggauaauccuacucuuuuuacuugacuuuugcaauucucaacguccuuaaguggaguggcucccacacaucauugcaguuaaguaaggaggagguaacgguuucuugcuuucccacagugcccuuuguugcuguuggauguguaguguuuauuugcugaaaguuuuuguuucuuuugcuaaugaugguuaagaccucuaguuuuaauaaaaucuucagucuuucuaaaggaucuagcaaauccuuaaaauuuguguuaauuauuauucagauauagauaacuuacugaucgacuuaaguaugugugccuuggguuauuugcuuuaaaauuuggugcuggggugauggcguagcucaguugugcguguuccugagaugugcagagccugguucagucaccagaggcugcuggcccucguguuuuauucugcuccagugugcuucuuuuuguguuucugacuauuccugucauacacauuuuaaccuuacaagucaauccugacccaggauggaucauauucuuuuuauagcugcuugaggagcugaggccucugugggcuacagaguaaguuuacagugagucuggcaucuuaauaaggcucacaaaguaaaguaaacagcaaaccaagggaauguaaaggaucaguagcucaguggggagcugcugcuuagcagggugaggccuuacacuuaaucccugguucccaguaacagggaggaaacacccuucccgaaaguauggccugcagggggaaaaaaggguccaaagguaauucuuuuuuguuucucauuaaauaccuuuaaaguagccauugcaauaaaaaauuagcuuuucgaaacuugagcuuuuuaguauaauacauuggcauguuaaauuuuacaguauaucguagaucuuauuuauucuggaauugaaucaccuaaagagugucaaguugaauaaauaugcauuagagggaauacuuaaauaucauuuaauaaauuuauuaaauuaugaauuauaguuuuaguaauuauauaaugaucuauguuaacaaguuuauacaaccauauuauuuuauaaauuuauaaaagaaucauacaaauauguaaauuauauuccuauaauuaaauauauguuauaauaacuuuauaugauaauuauaaaauuuaaaacuguagauuaauaaauuuauaaauuauuuuauagucuguaguagaacuuauuuauucuggaauugaaucaccuaaagagugucaaauugaauaaaucuguauuagagggaguaguuaaagauuauuuaagauuuaaaaauuccauaaaaugauauucuugaguaaagauuagugagcagcucuggccuacccuguuguggcuuuuuuguaaauucguucuuauuguggcacagcuuccuucagugcucacaugauuguuguagggagacugaggccugcaaagccuucccuagugggucucccaaguagcaacugaggagagaugugcugcugcugcugcugcugucuaagagagagaccugcgcgggaguucacagcugccuggacuuguucuuuauccauguacugaucaugagccugcaggugacuuaccugcuucucggcagucucaguuuccugcuuauaaaauaagaagcagaucuuuaaggucuuuuuuagcuguaaaauuuugcuguucugugacugucuuaagugccugcugggguccuuggagguccuugucacccuuaaacuuaugauucuauguaacaaacagguucuuuuuuuuuuuuugucuuuuucuuuauuguagccugauagacuaaagcaguuuaguuugacaccaagacacuuugaagagaugccaccugagaggcccagaguagcuuuccagacaccucccccucccuucucugccccgucuagcccauccgucccaccaguucauuccgccccuucucacaaugaagacuugcacaguggacucggcagcacccuuggugaacuggcgcaucccaggugcuuguuuaaauguuugucuuugggaauuaggguaggccgcgugugcuccaccuuacaagggugugcugcugcagaugaugcuuccgagaugccucagggccaugagcaacuucgcugaggaguuuuuuucuucuucauuguuauugauacuucuucucugcuguuagaaaaaggagaaaucuucaauguuuuuaucauuuacuauuuuuaaaaugaauuaguaacuacauguuaguauaagguaugcauuguucaguuauuuccacuuggcaaucauugaauuguuucuucagcuuauuccaaaaaauuuacuaaucugguacaugucugucuggcuuaacaguuuucucugggcuuacucuugggcuguugggauuauaacccuggauuucauauugaacaugucauuucuauagggaaaacacauuaugcuaaucuauauauaauagaaacccuguaacacgaauauuuucuggccuguaauuauuaauauacuaauuauaggaauaucuuuacauuuguagauguuuuucuuaaucuucuaauacauuucugagauaucuuucagcaggacuuggucuuuuauuuguuacuaacaaacuguggggcuuuucuuacagccuuucucagguacuuccuucauuuucuucaauggcuucccuacuccaaaggcugagagacuggaauuagagagccacagugcuuucuguuguggguuagaggcuggaguagucggcuucacuggacuuuaugcaaaaaaguuuucucauuuguaaaaggugaugguaguacuugacauaguuagagggcugauguaaacauuaguuuucuauguauagauacaauuuaggaguugcugauaauagauuguuuucauaacaguuacucagguuguuuuugcuggcgucugcacugaugauggugagguuagacucacugacugaccaauaacguguggaaccgcugccuaccgaagagacuuugguguuaccucagcccucagauucuuuaaggcaaaauauguuaauguuugaguaaaaaaaccuagagucuccccuuuuucuuuguuuaucuaaaguuauuugccuuugccauuucuauuagugaagaguaaauccugugcugguagaagcacauuugcuccucagugaggaaauguggaaggacaagguuuuauacauuuuaaauuuaugaacucuuaaauauaucagggccauauggauucucaaguagccacauugugguuuaacuuucugugaaaaagcaguagguuuuacauauaaaaaauauacccuuugggucggggagauagcucagucaguaaaaaugcuggguguugugggaugaauuuguguucucagugcuggcaggcagagacuggauaccuggggcuugcuagccagccaguguaauuagugauuucuuggccagugagcaaccccaucuuacaaacaaaguggacagcuccccagaacuuacauacaaggaugacugcuagcuugugcauuuguacauacucaugugaccagccucuccuacacacacgaguuccuauacaccaugugugugcagcuauugacaugcauaaacauacucaugcuaugcacucccuugcccacacagaaccauuuguaauccugagguggcggagcucuugguccucccucucugugugugacucucaucauaugauacuuccuguuuugggaaucuuccggcuuuccuccugucuccuuauaucugaguauuccugcucuguauuccucuggcauucuuugucacuugccucacggaugcugcacuguuguaacuguugauuccguauuauuacuaagggcagaggagcauacaugccuuuguuuaauaugguacauaauggcuauuggauauuacucaauuacuuuaacuuguuugcaucuuagcaaaguguuccugaaguuguaaaauuuguuacuauuugcuuuuugauuccuaauuuuucuugaacaauuaguacaggguugauguuuaauuuuaauaacaccuuuuuugcaaaagaucuugauuaaaaguaauaaaauaugaggacaguguuuuugguuuucuuuugcuauaggguucugccugugccucugaauccacccccgccuccgcuccuugccccuccagcuucuaacuaucgaacuccuuacgaugaugcguacuauuuuuacggugccagaaauacacuggaucccaauauuguauacugugaguuuucuauauguucuauaaacauuuuccuggugguuuaguaaggauaauuguuuuuauggaagcaauaguauguaaaugaaaaagauagaguuucauuuaaucaaaguauuauacauuuauugacaauagaaucauccuuagaaucaaguccaauuuuauuaguuuguucugauacucgauaaagauaguuuaugagaccuaauauggccaaauaauguauggaaggcagauguggguguauaucuuuaucauuuuuucccacuucccuagcaauuuacgacucagucauggggcuucaauuuuuacucuguuaaguuuguuagcauaagauuuuaugaauuacauuccuccauacauuuugauggacagacuguagcaauagccauuuuuaaaugcagcuaaagguagaggcaggaucaugaguucaaggcccacuugggcaacugaggaacuuuguaguccccuugggucauaaaacaagacccaguuuuaaaaccaaaauaaaacuaauugugucucuuaguuacuugcuauaacuguuuuaugcuuuccuauguucuuuugcugacucuuagccuggaaggauguauuggugcuuuggaaaagcuugcgguauaauuuucuuuagggauaagauguuauuaauaguaacuauucugaaauaaaugucuuuuuuucuguuucccuuuagaugguucaggaaugauuggaggacagccugccccucaugucucugccccugucacucaccagguagcaccgccagcuguguaagucuuaaaauaaaauaaaguuaaaauaaacgugcuuauauuaugcacaguauaaacucguguagucuaccugcuuuaagagcauuugguguaguguuuagugcaucuguaacauugcauggucaucucacaaaugagaacucuauccugugaguucagugauggacagcuccauuucucuugugacaugggcugccagccccuguucucucugaggcucagacaggguuuuacugugacugacucauuuggguccuuagcugcugauggucauuguaacuuaugcuaggauuuuucaaggcugaauaauagugcaucgugugcuuaccuuuauuuagccacuggcggacaccggagcuccuuuaucaucuuaguuguaaacaugcugcuacuagacucauuguauuuuucccauuucuuuuguauauguaguaagaaauacaguuuugggguuacauggaacuuguuuuagcacgauuuuggaggaacugccauauuacuuucuauacuauagaauauauacuauuugccuucccacuaucagugcacaaagauucuaauuucucugcauauuacacagcaguuccuauuuucugaccuuuagugugagaugauauuucauuguacauucauguauauauggagggcagaggucaacucagguauugcuccucaggaucugccugucuuguuucugagacaagauuucucacuggaaccuggcacucaccuaucuggcuaccccaggagucugugugucugccucccccugcuggcauugcaguugaacugcaccacaccuagcuguguguccuuaugcuucuguguugucuucguuacuuuucuuagugcugagacaacccuggugaaagugucuuaaggggggaaggauugauuuuggcuuauaguucauuuuuaaaauuuucuauuuucuuucuuuguucauguguuugugcaugugcucaaacaugccacagcaugcaugccacagcaggacagagaaccacuugcaggagcugcuucucauuuguaguccuggaaaugcacggcacagcauuugcuguuccuguugacccaucuuguuggcuuuguuuuuaaagacuuuuuuuuuuuuuuuguuuuuaaaaggugguuuuauaugccaggcaaagaauuguuuuuguuuucuucuagaaugugcuuguucuuauaauaaauugauugaaauuguuuauuugcucuuaggaauacuguuggacagaaugaacagaaaguucuuagugauggacucaggaauucaggacuggucuuugaggauaagccaaaaccuucuacacagucgcuucagucuuaccaagaagcuuugcaggagcagguauucauucauucauuuauucauucacuguugacugacuguagacugaaggggagaacaauagcaggcaguacgguaagcuuugaaguggggaugcuggaauugcuguaggaaacaguaggcuugucugggacaguuaggacuggguguguaguuaauauuugagcugcauguuaguuucuagacguuccugguagauuuagggaguuuuauuauuuuuuuuuauuuuccuacgucuucuaagaccuucuuauuuauuuggugugugucugugugcaugugaguuuccuuccaccauauaguuuuugggggggaucaaauucagguagucaggguugguagcagguucuuugaccuucugauccaucuuuuuggcccuagaaaaaccuuuagugagcuguugaucaguucaguucagcuaggaggugcugaggcucugagccugugaggggagaaggaggauguuggcagacaguugugauauuuaaugcacaggguacgcaugagaggaugagaaagcagagcagaggguuuaaacaggaucuguaguguccaguguaaggagacugaugaggccauaguccaguagggaacaucuuaguagaaugcuuacaagaaacacauuggcaucucccauacuuuauguugguuaaagaaaacuuacuuaggagcuuuugggagugagguucaagguguggguccauaucuaaauugaggacuuucuugggggaauucuauuggauuucuugguaaacuauggguuuaguuuuguuuucuugggguaagguuccaucuggaucaggcugcccuugaacucauuauguggugaagaaaggauuaccuugaaauuguagucauccuguuugcuucucccuccugagggcucggaauacaggugcacuccagagugcucuguuuuaugugaugcagaggauggcucugaggacauucuaggcaagagcuccacaguccuagccccuugcaauuuuuuuugugaauauacuuauuauuuuuauuuauguguuaguguaucuuugcacaugaguccuauggaguguaaggagucagacccccuuggagcuggaguuauaggcaguugugagcugcucaaugugggaaucaaaguaagucuuugcagggcgaguacuuacuccuaacugucccagcuccuuggaaaauaucuuuuuucagcuuuuauaugggaaaauaucuagaaagaauuaauugccauuuuuuugaaugugaaaguucuacagaagaaagacugaauuuuguaaaucaaacacuggcuuugagugagaauauuuaaauguuuccaauagaguuagauuucucaauucaagaaguuuauuuuuuccccuguagugcugguccagcacucuacuguugaguagaguagaauucuuacuuuauauaccuaaugagugaacaaaauugccauggauaggcuggagagguggcucaugaguaagaacacuuguuacuuuugcagaggacccagaauaaucuuuuuggguguguucuugaauuugguguucaaguauuuuauuaaggauuuguguguguguguguguaucugucugucugucuguuuuagucauugauuuauugcaauaaagagacacuaugagcagugcaacucucauuacauuaauuggauuaauuggaggauugcuuacaguuucagagaguuagucuaugaucaugcacagcacgggcauggugggagcauggcagcacucaugauguuggaacauuagcugagagcuauguccugauuugcaggguugcgggggagggagaaagaaaaagagagagagagagagagagagaggaagaggaagagagaggagagagagagugaaagagagaagaagaagaagaagaagaagaagaagaagaagaagaagaagaaagagagagagaguugcaggguuggggggagggagaaagaaaacaagagagagagagaagaagaagagagaggagagagagaaugaaugagagagaagaagaagaagaagaagaagaagaagaagaagaagagagagagagagagagagagagagagagagagagaauaugaaugaaugaauauaugagagccuggcaugggcauuugaaaucucaaagcaagugacacacuucuuguaacaaggccacacuuacuaguccuccaauaguuccuuuguggugacugagaauucaaauguaugaaccuaugggagccauucuuuuuaaaccaugcagcauuuauggucaucagagagauuggccugugguuucccuuuuuaacgcgggaaauuugguuuuggaucaggauaggacugacuuugugacacagauuuggagauacuccuuuccuuucuauuuuaagagcaauuugggcaguaugguguaaguucuuugaaagucugcuagaaucuuaugcugagucuguuggcugugggccauuuuuguuaggagauuauuauuucuucuauuuuguugguagcaaugcgccuguuuuaauaauuuacuucacauuuuuucauuuauuucuuuaagaauuuucauuuuagugggauacuaguuuuguuuucuuauacuuuuuuggcuacagccuuaugugucuguggcggcccuggaacucacuucguagaccaggcuggucaccugacuaugcuccccagagacucaucugccucugccuucugaggacugggaugcagcuuuuuacauugugucuuaagagucucugaauuuccucagcaacuuuuguaauguuucugcuuucaucucugauuuugaaaauucagaccuaccuaccuccuuucuacucaacuuccuuccucuucucuucccucuuucaguuuggccuaaagguuugcuggucugguuaauuuugucaaaaaaccccaacuuuucauuccauugauucguuuguuuguuuguuuuucugauaauuuuaucccugacuugauuucuuuucuucuugucuauucuuuuggguguuguuuguucauguuuuucaaggucuccaucuaagauuuuuuuuuuuuuuuuuuuugagacaggguuucucugucucuggcuguccuggaacucacuuuguagaccaggcuggccucgaacucagaaauccaccugccucugccucccgaguggugguaggcacuucaugccauacauuuuccuuauaagagcugccuucauaauguccauagauuuugguauguugugauuuuacuuucauuaauucuagaaauuuaaaaauuuccuuuguaauuuugccuuugacccaauuuucauccaguaggguauuauuuaacuuacacgagagaguaauuuuuuuccuuuucuauuguugacauucagcuuuauucuuucauggucagauaaaauauguguucaguuuuggagaaaguuccauggcugcugaaaauguauuuuuaguguucggguggaauguucuacucuaagugucuguuagagccacuucauuuauagugucuuaacuccagagcuucucuauuuugauuuugucuagaugacuuuuuuuuuuuuacugcaguggaauauugaaguuacccacuaucaguauguuguguucagucugugauuuuagaucuaguacuguuuguucuaugaacuugggugcccuugaacuuaguguuuagaauugcaguaucuucgugguggauuuuuccuuuauugagugugaagccccuccccccuucuaaguuugguuuggaauuuaucguucuguuagauauuagacuaucuaaaccugcugguuucuuuguccauuuauuuggaacaauacauuugucuauacuuucaucggaaauggugucuaugguugauggugagguguauucugauaacaagcaaaccaaucaauccaguuuucuaaucuaguuuguuagucugugucuuuuuguuggggaacugaggcauuuauuacugggaguuuugaggggguuauuuuuggugaauguuuaucaagaccuguuuuguuguuguuguuguguugacuucuucuuaugcucagcuguacuggaacuauuuauucccuauacucucuuggcuguguauaauuaucuuuuuagacugaacuauuccuucuaguauccucuguagagcugauaucaugggcauaaauucuuuaaaucaugaaauguuuuucuucuucaauuaugguugacaguuuugcagccuguaguagucugguuggcaucuguagucuuucagagcuuucuauccagggccuucuugguuucaaacuuuccauugaaauuuuugguaggccugcgauuauauacaacuuggacuuuugcaguuuccaauagccuuucuuuguuccugaggaaucuuuaugauuuugucgaauagguuuauccuccuguauguuugcuguuuuuauaguguucaguacuuucucuuucuguuugugguuuucuuuuguuuguuuuuuagaugaaacauuuauuucuucuaccuuguguuuuagauaugauccugucuguaggugaggcuuugcucuggucucuuuguuggacaugaugaguuuuucuuuucuucagguucuauaucuauauuaagucguauuuucacguuacuuuacucuuugacucagagcucacuuguacucugcagucuucaucuuggcauuugcucaguauucuccuggagcugaggagguuaaugcuguuuugaaaucauugucuuguucaucagccaaguugcuuuuuucagggacugugauggagggcuaguuucuggaggagacaugcugucuagguuguucaugguuguguuuuuguaaugggauucaggcaucuggaauuagaagguugaugguguuuugugguaugguaucuuuucuuaccuuuauuggcuguguuuggaacuuuucuguugccucaacucguuagauuuugggccagcugaaugguguuuuguuuucagucugggggccaugcuguuuauaugcaaauggagcugucagaaguauucuuggucuagggagggauaggugcaacuucugggcuuuggaguaaacuuucuguaggcuagggagauucuuguugcauauggagagcucucuggauucuacagguuguucuuaaguggcagggcugggggucacagugggugugagcagugcuguguggggucuccgugcugagcugcugugggcuugggaacuuggucuaggcuggccagaguacuuggguacaucagagugucugauuguagaggggauggcugaccgucugguugguccucagauugagucuggaugcuucucuacuagggguuuugggucaguuucuacuuggauuucuggcguugggugagggguucuccuugaaguuacaggucaggcucccgaauucacaaaucagcaucuuuauuuguuacucuuaacuuuauggugaagaagugcacuuaaaaauauauguauauuuuucuuacuagaaaaauuaaguaguaggauugcuaguguuuugucucaaccuccuauaagucaauauuuacauuaagcauaucuuauguugucaagauucgggaaagagaagcaagaaggaagaaagaacguuuagaaaaagaagaauaugaagcuaaauuagaagccgaaaugaggaucuacaaccccugggggaagggcggagguggugcuccucucagagacgccaaaggaaaucugauaaguaugauguguucauaaacuugcuuuuaaaugaauuauuuccagcauuuuaagaguggagaguaggaagaagugggaaucagacuggauaagaaggguuuguuuuaugauuuaaugaaaagaugcugcucugauuaugaauauaaugcacgcuagaaagccuuucuucugcaaagcaguauacuucccauccucugaugacaguccccgaacugcagagaauaauucauguuagcuggugcucauccagacuaggacuuagaggauauucuuauuauuuuuuuaacugaaaguaauaaaacuugcauagaguaguucucagaacuuuucaggagggcuuaagcaguauccuucugggauaaguuuguaguaaagcgugaauucuugaguuguaagauacugcuuuagaauuguuuaucugggaggaaaugaagacauggccucugagguuuccuuuuuuuggcaguaacguucaguguguuuacuucaugucguggucaucacgugagacagagaaaguguagcauuuuaucaaggacaguggaacauuuuuuaaauaccaucuucagaguaaccagucaguacccaaaaaguauccaguuuugucuaugggcuuuauaucuuagagauaucuuacuccacugagaugcuuagggaagugcaccaugacgacgguggcccaccgugugcuuauagcggacuguaauccugcuguuugcuugugggcuuugggcuuugcuucuucuguuuacuuuuguucuccugauggagaaaaacuaaagaaugugagucuuuaccucucacucucuuacaucuuuuaaaggaagaauacuuauuaaugaagugaggcagaaaaaaaauguuuuaaaguaaacaccuguuuuaauuguaccauaaaaaaaaaaucaguguucuuuauucauuagaacucuguauuuaaguuauaaaaggcaagauauuguaaaaugcuuguguaggugaauggauaagcuuauuuauccuguguguguguguguguguugggggcacuacuuagcaguacaaggaaugaauuguugaugcuuaacaauuuggaagaguuaaaaguucugcuaaguaaaagauccauucugacaauuaccuuuguacauuuccauuacaucacauucuuaaaauaacaaagacuaaagaaccuuccuggggauuguaggcugggaauaggagcaauuaagagagagagauggaucugcuuuguugguggagcuuugcagaacuuaagugauuauaguggugugacucgagacuguauagguuaaaauuuuaacaacuacagcagugguccucaaccuucauaacacugugacccuuuaauacccucaugguguggugauccccagccauaaaauuauuuuguugcuacuugauaauuauaauuuugcuacuguuauaaaucauaauguaaauaucugggaggcaagauaucugauaugacccccaaaguggucaagacccacagguugagaacuucugcuauacaccaaaagaaauauguggguagaaggaaaguuaaacccauaaaauuaaaaguuugaccacuugaaaaugacuggcaaucucucauaggccuggugagagguauggcuaaacagccuuuaauguacauuugagcaaaugucauauuuaauguguugucuuuuccuuagauuuauauuuguuuuuauauaugucuauugagguaaaacuuguauuuaguaaaguuacauuaaaaaacaagauuuauuuauuuuauguauaugaguacaugcagcuguagagaugguugugagccuucacaugguugcugggcauugaguuuuuaagaccucugcucgcucuggucaauugugcgggcuccaguuggccccgcucacucugucgcugauuccuuuggcccaaagauuuauuuauuauuaucguaaguacacuguaguugacuucagacgcaucagaagagggcaucagaucucauuaugaguaauugugagccaccaugugguugcugggauuugaacucaggaccuucagaagagcagucagugcucuuacccacugagccaucuugccagcccaauaaaguuacgcuuaaaauuuagugacagcuauugcuaaaaucauuucuaccacacucaagauguagaucuuacuuuagaacugcuaacaggacugcccccucuguccccuuauggacaguccucuuacagcccuacaagccugugaucugccuccugggugccuuuuaauuuuguaauaggcuuucaucguaauauuugugagauuccuuucuuucuguuacugaauggcauugcauuguuuugagguaucaccauuguguauccguuugcaguugauagacacgaguuauuuccaguuuaaugucauuaagaauagaauugcuguaaaugguuuucaaccuaugugccaugaacacuuuggggagccuaagacugucaacauuacaguucacagcuguagcaaaauuacgguuaugaaguagcaaugaaaauaauuuuaugguugggaucacacaacaugaggagauauauuagaggauugaagcaguaagaagguuaagaaccacugaucaaagugcccaugugaaugugugcuuuuaugucuuuuggguaaaugcguaggaauagggucaguugguuguauaguguuuugcuugcuuguuuguugguguuuuuuaucuuuguuaguuuguuuuccaaacugugccuuuuuucauucucacuagaaaagcagcacauuucugauugcucugaacuucgcucagcaucacuugacuuuuguagcagcuuuucauggaauaauauauagcuauuucaguuguuauaaaaccuuuauugugaaauaacuuuaauacacaaaagaguugcaaagauacagcaagaguaacuuucaguguguuuccuucacuguugacauuuaugcaaucauggcacaaguguaaaagcuagaaauaacauuaauacggugcuguuaaugaaauuauagauaguaucuagacuuugccauguccuccuacugucuucuuccuauuucaaaugcuauaauucuuuuaguugccuaucuuguuuauuggauuuauuuauuuauuuauuauugcuguguauuuaugcuuaauguauaagugugucaugccagaggucaaacaacuuugagaggucagugggcaacuuugggagucaguccucuccuuccaucaugguaucugauaggcaaucugacucagguggaaggcuuggagagagagcacuuacuuuuaccugguugacccucuuaucggccugccguguguuuaaccugcagucugacaguugucuuuguaguugccuauuuaaaucuauguauguguguguaagcuuuuaugcauguucuguaccacucaguacauccauccaaagugcaccacaaaguggauuuuauuauucagaguuauaccaaaaggcagucuguuuuagaacacugugcacauugaauugcauugguaccacagugaaauacuaguuaaauaccaguuagcacuacuugucugacuucaugguuacaucauacacuucacuaauucuguaguaaguguggaaauuuagaugcuggagccuuuuucuccuuuucuuuuguuuuguugagaccuggcuucucuguguaguucuggaugaccuugaguuguaguucacugugccagcuucccaggugcuggaauuaugggagucugucaugaccucuccuugaccuuccagcuuuguugguuuucuuuuucaagauugcucuggcaaucagcuuacuuugcuauuagucauauccaaaagaaaaaaauggugccauucucuuuagaauuguacugaccucacagguaacuuuggugugggcaacaucuuagcaauaucuauccacuagugcuuuuaguuaauuucuuuuaucaguauuuuauacuuuuauaaaucauauuuuauacauauuuugccaacugcauaacuaaguuuuuaauguuuugaugcuauuaagaugguauuuugaaaauuaccuuuuuucauguguauaguguguguauauguguguguucagaugcaccuguguguugaggagaaguuguuauuggggguuuuccauaauuacucuccacauugucacugaggcaaggucccccaguuuaagccagaacucaacaguauggcuaguauagacagccagcuuucuccaguagccuuuuguuucuacaacuugugagugcugaaacuagagccaggucuccauugccuaucagcauuuuugugugugcuaaggucugagcucgaggccuuccagcugcuccuugcuuagcaagugucuuagucccucagcucuuuuccuuuuccuuuguauauuuguguaaagaaugaguuuggcauuuauuaacauguacauuauguacuuggauuacacuaacuccccuccucagccuccuuaccuaccugauguagggggagugugugagggcacaggucugauguagugggagugugugugggcacaggucugauguagggggaguguguggggggcacaggucugauguagggggagugugugugggcacaggucugauguagggggagugugugagggcacaggucugauguagggggagugugugugggcacaggucugauguagggggagugugugagggcacaggucugauguagggagagugugugugggcacaggucugauguagggggagugugugugugggcacaggucugauguagggggagugugugagggcacaggucugauguagggggagugugugugggcacaggucugauguagggggagugugugugggcacaggucugauguagggggagugugugugggcacaggucugauguaggaggagugugugagggcacaggucugauguagggggagugugugugggcacaggucugauauagggggagugugugugggcacaggucugauguagggugagugugugugggcacaggucugauguagggugagugugugugggcacaggucugauguagggggagugugugugggcacaggucugauguagggggaguguguggggggcacaggucugauguagggggagugugugugggcacaggucugauguagggggagugugugagggcacaggucugauguagggggagugugugugggcaaaggucugauguagggugagugugugagggcacaggucugauguagggagagugugugugggcacaggucugauguagggggagugugugugugggcacaggucugauguagggggagugugugagggcacaggucugauguagggggagugugugugggcacaggucugauguagggggagugugugugggcacaggucugauguagggagagugugugugggcacaggucugauguagggggagugugugugggcacagaucugauguagggggaguguguuugggcacaggucugauguagggggagugugugagggcacaggucugauguagggggagugugugugggcauaggucugauguagggggagugugugagggcacaggucugauguagggggagugugugagggcacaggucugauguagggggagugugugugggcacaggucugauguagggggagugugugugggcacaggucugauguagggggaguguguuugggcacaggucugauguagggggagugugugagggcacaggccugauguagggggagugugugugggcacaggucugauguagggggagugugugagggcacaggucugauguagggggagugugugagggcacaggucugaggacaguuuguggauauugauuucucuuuacuauguagguccuggguauugaaaugaggcuuuacuugcugcccccauuucuacuuuuugcuuuuaaaaaaaguguguguguguguguguguguguguguguguguguguguguguaucuccugguccauucccagggaggucagaagagguccuuugagcuccaaacucuacuguuuugauagacuggaacaaaguuuuaacuguucagucaucucccuauuucuccucugucucugucucugucucugucucugucucugucucugucucugucucccuccuucccucccucucccucuccccucccucugucuguccaucuguuugucgagacaguguuucucuguguaacgauucuagcuagccuggauucacuuauguagaccaggaggccucugccuccaccucccgaguacugggauaaaaggagugcaccagcaugccuggccuuccucuuuuuuucuuuuucaguauuucuguauauaagagagaguaugugggcaugcacguaguauggugcauaugcagacguccgagaauaccuuucugagguggaucucacugcguagcuaugcagacaccaggauagcuggauuccacaggcuucugagcuuccuggcaauuuuccuguguuuugcuguaggagagcugggauuacagauaggagccaccacaccacaucuacauguuuuucuauggguguguuccagcaauuagacucagguugucagguuuucgugacaaucaccuuuuuaaccaauagauacaucucauuggccccuuuuucuaauuacuauucuuuccuacucauguuuaucuguuuuuuaagcucaaaauguccuaaguguaauaugauguaaacugucauauacugagcauuguuuuccuauguauguucacguguuauuuggacuauucuauauggcauauuaaacuugugacacauucaaaaugcauccuugaguguaauauucuuccugauaaauaauuuuauaucuauguuuguuuacuuuuauuguuguuaucccaguguuuugggagggguagguagauauggaucguuauguauguguguguguguauauguauguauguguguguguguguguauguauguauguguguguacauauacauauauauacacacacaaauauauauauacauauauauauacacauacuuuaaaaaaagauuuauuuucauguacauugauguuuugccugcaugaaugugcaauggugccagauccuuuggaacuggaauuacugacaguuguaaguugccacguggaugcugggaauuaaacuugggcccucuggaggagcagcaaguggguggucuuaaccacugacucaucucucuagccccuguuuaugcaguuuuaaaacuugaauucuauauaggucuguugcugagauuagugguuuggcccaguuuguacaugcuagacaaacacuaccaacugagcuaggcauuauauauuuaauagacacagcaagucuauugcuagguaauaaaccaucccaaagguaguguuuuaaaauaagaacuacauacuacuuugugguucuuaagugauuuuugaguggcuuuccugguuguuuguguaugauacuuuagcccgggauuguuuucccccauggcuuccauagcucagggggcuucaauuucuuaucuucagaucucuccauaacauccccuccugugccauugugguaggcuuucuuuucagugaguccagugaucagagaaaaugcagcucaugucuuuugugaaucaaacccagaagucugggaucagccccugcaguguccuaauugacauaacgcuggcauaaguugauaaggagaccauuguaaggaagagacuugaguuccacauugugaggaagggcugcuaaauaaagaauuucuggauacacuuuaacacuguauaauaaacaugcguuuuuguuaguuguuuuuaggagagcugaugguuugggacaaauuuuacucugacuugaauuucacuaaguuuguuuuauacuaaagaaauucugauuucugaauugacagugguuauguuaauauggcuuuugaccaaaugucaaccauuuauguguccuuaaccucuguccuaguuuugaguugauuucauaguuucuuuauaguuuucagugagguugcuucagagcugcagugaucauccagccaauuccagccuuuucuugcuuuuccugcugauguccuauuuaaaaauguauuguuuaagaguaauuauagaaauguguuuauugaaauaaauggauuauuuuucccucucagcugauuugaauaggaugcacagacagaauauagaugccuaccauaacccagaugcaagaacauaugaagauaaaagggcuguuguaucuauagaccaaaauuuagccacuucaaaugcugagaaccuagaagauucugcaaauaaaaacucagguuuuuaaucauauucuauauuuaaaaacaacuaauuuccaaugcuguucaguaacauuucguuucuguucuguucugauaaacuucuuacugagacuuuggucacauuaggaagcauaauauauuuucuuuccaaagagaauagggaaaggaggcuucuaacauggcauguuucuuccccacucugaaguuugcucugcguguguaguugcuguuaacguucuucuuuugauacuugaggggucuuucuuugcacauauauacagcacugacugcaucagugagaaaguauuuggccuguuaucauaaauuauacaauaaauuaguuuuuuguuuuaagugaucacuugcccuccacauuguacagaaaaagaacuaacuagacauuuagugucgggucacaucuguguggaugagugaagcugccagacguuaagcagugccuuaaaguugcugagagcugaaauuacucaguaucuuaccacauaagugugaauguauucuauacauuuuaaaaucaaagcacauguagaaaauauacauuuugcacuuuguauuggugcugauaaaagacuuuacuauaaaauuuugcuuuugcucguuuucaguuuuauuguuguuuugaaucugcuuuuacauuuuccuagaagggcugugauggugaccucaguggucccuuuaggucggcacuuuggagacagugguuugcuauuucuguaggcagcccuguccauuguuccuacugugcugggagagugguuccacugggacccacaguagacuuuuacuauuugcgucuugcuucaauuuuuggaacucuaaaauuggagccuuugauuuugacaguuauuaauuucuuaaucugaaagaguucaguguauaguaggaacaacaaauacuuuuucaugugaauugcugcucuuuauugcugcucuucuugucugcugcuucugagaucuccgugcuguggcucucuguuucugcauacacaguaguguuugcuguucuaagcacgauuaaguauuuccucuuucuugggcauuugcuuacgagauacagaccccggggaauaaacaaucgccaagacacccuucccagccugauugagcgcgcccagcagauuugaccugucuaguuuuucuguaguaugccaggcuucccucuggugggggcuaaugauaacuuuaaaaauaucuuaaaauaucaguauccucauuuuauaugaauggaaauuuucuagacuuucuuucccuaaacuauuaacuaaacuaaauuuugucaauauaagaaacuauccagcugggcgugguggugcaugccuuuaaucccaccacucgggaggcagaggcagaggcaggcagauuucugaguucaaggcuagccuggucuacaaagugaguuccaggacagccaggguuacacagagaaaccaugucuugaaaaaaaacaggaaaaaaaaaaaaaaaagaaacuauccaaggccaccuaauuggugcuaugccauauagauaugcaugaguacugagaggccaaaccuacucuugggaccggacuccaucuuaaaagaaaaaaagccugagaacuuggccagcaacugaacacaagcuacacccaaguuccagguccauaccccagaguuacucccuagcugcuucccuagcaacagucaaucaaagauuagucugauugacuuagauguacuuucagagcguuugugauuguucaugguuuugcuucagagcacgcaccuguuggcuuauguuagucauacaccuagauacuugccaggcugaaaccccucacuggcucgccacuuucuauaaagccuuguucuguugagagcugggggcucccauucugcagcaucagagauggugguguggcccaagcucaagcuuagagacccuagugcaauugcaucggaaucugcucuuugguggucuucugggguuuaugaacacuuccuggcacaacauauuuauuuguguguaugaguguguacacauaugugugcauguauacauguacaugugcuguuuaauauuuuuaaaaggcuuugggaaacuuggauauauuucagaguuuuccuaauuuaugcuuuuaagcuucauccucauuugaggucuuaauuuggcuucuuuuuccuuuuguuauuuuuagacagugucuuacacuauguaguccugguuggucuggaacucacuaugucaccuggcuagucuuaaacucauagagaccugccagccucugcccccagugcuaggguugaaggugugggccacaguucucagucucgguggcccuaguacgcaauuuccccuuuucuuuugguuaagagcugggacagguucucauugugaggcugggacuacagaugugugccgcccuaccugacucaggcuauuaguguuuguuuuguuuucuuuuucuuuuuccuuauggcuccuaagugaacugcuaugaaaucuaauacuaguuuggcuucaguuguuuuugugugguuacuaagguaucuagucacaugucuauuuucuaauaguacuaguucccuguaguugugagaaaaguucucccccuaaaggauuuauuucauccauauuucuuuccuuuaguuguuacaaaaauucaaauuuugagggaaauuaagguaaaagauaguguuuucuacagugccgagauuuaagagaaccuuuauagaacagguuucuaggggaaaaaguucucauaauuuucaagucuugaugugacuuuccaugaauucagucaacuaaacauuaaugaauuuaaauacaaagggagagcagagcugaacugcuaaaugccgguccuguaagagauguaaguugauaaaugucguccuacgugagaugacccaagcagagauuagauguuguaaguugauaguaauaagacugagucagcagcuggguguggggaugcaugucccuuagacggaggcaggaagauugcugcagauuaaggcuagccucgucuacauagugauuucagagcagucauggacacauaacauacuaagacccuguuucagcaaacuaaaccaaccaaccaaucaaacagcaaaagcaauaaaucaauaauuuaagaaucauauaaaaauuuaugugagauuuaaauugucauuuuuuuuucuuucugcauucaaagagaugucuagggaaugauuguuuuucaaauagcuuuucugaaacaauaucuucccuuugagacuauauaaugcuauuuauaaggagcauacacuacagcaaacuaaugcuacauguguaucccuuuaaaaaguacucuguaugugcuucagauagaacccaaggcuuugugcacgccaggaaagcacuaauuucagcagguuuuuauuuuauuuuauuuuauuuuuuauuuuuuggguuuuuugagucaggguuucucuguguagcccuggcuguccuggaacucacucuguagaccaggcuggccucgaacucagaaauccaccugccucugccucccaagugcugggauuaaaggcaugcgccaccacgcccggcuaauuucagcaguuuuaagagucaauccuauuauuacuauuauuaguuuuuuuuuccucuuauuuuuuuuuccuccuucaauugugggaauugaauccaaggccuuccaaugcuaagcccugccacugcacuguauuuccaaccccucaggaauauuccuaaguagaggauauucauguacauuuuucuaucaugaccaauacuguacagccugugcugugaggccauguucaggcuugcacauuccguuggugucuuacacugcucuggacaggacuuccagccccucacuuucugacugcuuucucuugcuguccucuguguccucucccacucuuaucucaccuucugcuuuugccuuaaccucacgacugguguauguaauacuucuuuucauaauguggacuuauuagcugacuguuuuuuuccuaauuguguguuuuugcaaauugucuuuugaagguccuuugcaaacacaaagcucuccuuuugcccggggaaacacauuuggugagccacucagcgagcuucagauuaaacagcaagaauuauacaagaauuuucuucguuuucaggugaaagccuuguuugguuauaguuccaucucuuaauggcuauaauaauaaacuaaacuugcaagaauuuuauucauuguguacuaauuucuaaaaugcuaugcaguuaaccaaaauguuuaguuucuaucagguacagguauugcuaaaaccacauuguucaaaucagaaucuuuucuaaacuucauuggaagaucaauaguugguaaagcaaugaaugcugagauuucuaaaauccacuucagaaauauagggagaaucuuuguauaugcuuguuagggaagaaaauuaagccccgucucuccuaacagaugugauaucauuggcucaguacagauaauaauaaacagaaguuacauuucagcugaguuugguggaacaggccuguaauuucagcacugacuaauaagcaggaggacugagaauucaaggccagucagggucucaggaaacaaagcauuuacauauaauauaaugauauugugcaguuaaauggcccuuuuuguauuaaacagguagcauuacaguagugaaauauucaaaguauucccaaagaaggcacuuaagcauuggcuucucacugagaagaagauggagucagaugacuggggugucugcucagaagggacuuggguuucucuacacguauacacggacaucucaguguggucugaaaacauuuuuuccuuuuguauaaauuuuuuuuacugggggacuggguagagcagagcaugggugucuuaucagagcagugaaugucugcagggaaauaccuuacagagcaugugacagauaacagagccucacagaugucagacacucucaggucagcagguugaguguggugcagagucagcagugguaauucuguuaccaugacaacagcaacucaaaauguaaguuauuuucuaaguuuauuuaacacaucuaccaugggguaagguacaauuaucagauguuuuuaaaucacuuuauuguucacaaaauacuuuuacauguauaggauguugucuuagucagggcuucuauuccugcacaaacaucaugaccaagaagcaguuggggaggagaggguuuauuuagcuuacacuuuugcucuuuaucaccaaaggaagucaggacuggaacucaagcaggucaggaagcaggagcugaugcagaggccauggagggauguucuuuacuggcuugcuuccccugcuugcucagccugcucucuuuuagaacuaagauuaccagcccagagauggucccacccacaaggggccuuucccccuuggucacuaauugagaaaaugccuuacaguuggaucucauggaggcauuuccucaacugaagcuccuuucucugugauaacccccgccugugucaaguugacacaaaacuagccaguacagauguuauuacauguuagauucucuagagacaguaucucuauuuuaggaccugcagcuaaaucacagauggaguuucuaacuuaugaagccugucuuuggguagugcagucucaucuauggggucacuaggaagucuuucccucugcaaagccacugacagcgaggagacugcaaccguuacuuugaucccucagcacucuucuuugugaguccuuagugcacuuaugaguagagaacucugguuuuguuguuuuguuuuugaaaaaggguuucucuguguaacagcccugacuuucauggaacucacucugucucuuggguucugggauuaaagguguaugccaccacugcccuaccgaauauauuacuguuucuuaguggucucaaaauccuuuuuauuuucaguuacaaauccuauagaauucuaagcagcugaaugguauuuauuguuacuaucgguaauauccuauagacaauaucuaaagcuuaagaauugaaauaaauguuuuaaaauguucagaaaagaagcuuuagccaaggauuugcacaaauaaauaagagucaacuuaauguaucagaagccuugcugcuauucaaauugaguaaguaacauuuaugagugaauuuuaaguauagguuuaaaaauaaauuaaaaaauuuuaauaauucaguggaaagaaauuaaugaaaaauuggaacaucucauagaguacuuuuguguuauauaguuugaaaacucaccuagaggauaauuuucuccuuuuuaaaaacacuuagcauuucugaugguacuggccugugucuguuaggugugcggucugucagugcuuacauuggcaguacuugauugaauguagcagguaccuacucucuguaauuuuauuguuuguucuuucucauggaagaaggaaaagauaggccggguucgggccugacacagugcucucucuggauuugguacacuugugguugucuacacuuugcuugauauugaaugucuggcuucacauuagcugucauaaguaucaggagaggcuguaguugguaacucauaguucauguaggaagauucaaguucucguuguacagaacacugucagcaugcagccuuaaagcuacaggaguucaauggcauaaaaauaccuccuguaggaaaaauguaaaacccagcaugacacagucucacaagaacucccuguuccuuuuccucauacacacuuccuagaugaucccugcaucaacaggacugccuaagcaacacccggacaagaacagcaccaggagacauauugacacagaagggcaaacuaucaaggggccucaccccuagacagagaauuacaggcaacuaaggaauguugagaacaggagaaauuagcuuccuuagggaagagcaugucagcugcuuauccaaucccaagugcucagcccugaaaucauauacauacaagcagcauuauauggacugagcacgauugugucucuguguguguacauauauaauauauaucaugaauuugagagaauagggggugggagggaggaaagagaaaaugguguaauuucauuuuaauuaaaaaauauuugaacaaaagaucuauagacaauguuaauaauuguaaucuaaauaauuauaaucuauaaggauagccuuaaacugaucauaaguauccaauagcagaugggccuggugguguacaccuguaauccuagcacuugaaaggcuaaggcaagaggaucacccuaaguuuaaggccauccuggggucacuuagggacuucaaggguaaccgcagagugaaaguuuguuucagaacacuagaagauuaauaguuuuauuuauuuacuuuuguacuguuuccuagggcuuccuccuguccauaugcucuacuuuagaauauucucucacuguguucucgguggaucucaggauuaguggagacgaguguaauucuggcacccucugguucuuuguucauccucuguacacacccgggagggagcaggaccuguguguucugagcguaggccugccccugcgcugcuucccaauacuugggauuuuaccugccagugggcagaaaagcacugugaggaaacgacucuuuguaaagaggcuaacacacucagcuaacucccguguggggacucucuucacggucaagcacauugacgugcaguaggaaucaaucauccaagcacagagauauccucagcaccuucugagcagaaaacacuagugugccccuuauaccuucucauuaacccuugagcacucaauaacucuugcuaggugagaaaauugaguuccagccccauuucccaaguucacacaauacagauuaagcagagaugaauuugaguaguagcuuuuaacaguaucuuguauccuuccaaguaaaauacaggauacccaaaaaaucgagaacuuggcaaauagaaggcauccagaagaaagugauguuguaacucaucaguaggugagcaggauaaucacuaaguccaauucuuuagauugaggaaaagagacaaagagaagaagccgagcgcgagaagcugagaguugcugaagagaaggaagaaaagcggcuugcggagcagagggcaaggauucagcaagaguaugaggaggagcaggagcggaggagggagaaggaggaggaggugugucuguuucuccagccaaagugaaagaguuuuggugacuugagaagaugcgcgguaguguaugagauaauugauauuuugaaauccauuuuuaaagugcccuauuguugucuacguuguguauuauuuuaauuuaagaaagagacaaacuguuuuuaaacucuaggcuaauaaaagaugucuacuauuuuauuaaauagauagauaguaucuucguuuuguaaaacacuaucuuuuauauauucaacuuuacuucuuuuagacaaaguaacauauuuuuaaacguucagcaaaugcaugcaagacgugugucuuuuuuaaauuuuaaagcaaagguugaaaaaugaagaacuuauucgguuagcugaagagaggcgaaaggaagcggaaagaaagaagaaagaggaggaagaaaaacauaacuugcaacuucagcauuacuaugagagagaaaauauuaucggagaugaaacaaagguaugucuuggacagaggcaugucgggccugggguucuggccuggcagggugggaguaguuagagacgggagaaaggagggcuucaacuguauaugggcacugucuuguuccuguggucggucccauguucagcucugcugccugagauacagucuguagagcagagccaugugcacugugggcucacagcagcuugccagagugacugacugacaaauauaccaacaaaaauauugcccuugaauuucauuuaccuagugauucauuuuuuauguauuagcuuguaaaugagauguaauccaccaaaaagacugcuuuuggagucacuguuuuuggugcauagggcuggcauuaagaguugaguacaugaaucagaaguugcaauuauuagacaggacuuucaucuccagaaaccuaauuugaucuuagacaccugaaagaauuugacuguuuuauaaagaguauuuuauuaaaagcaaaaguaaucugaucuucuuaaauaguugugacuauugaguauagaguguauguguguauguauauauacauauauauguacagaaaucauuuuuuuuucagcacuugagacagccuucuccuguaguuccugcucuucagaacaaaauugcaagcaaacuccaaagaccuccuucagucgacaccaucauaaguuccuucauucacguacauacuuuuuucucaggguuaaucuugaguuaugugggauggguacuuuaugggggcuucauuaguuugcauguugcuguaguugugacugauagcacuugcuguccuaaagcucgguucuuaaggaagccacagucuguuaaaccaaguucaugguuugucacagcuccacaggaacaccaguguguuguucuugucauuguugucauguauuuguuuugagucauggucucauucuguagccuugguuguucuggaauuuguuauauagacuaagcuggccuccagcccacagacaacugcucaacucugccuuccaugugcugggauuaaaguucacuaucuugccucgcuaagaaagucuuggaagaaguauguucuaacuagcuguaguuguacuugcggauucccauauguuuagauggaucuacaguuaugaaaggaagcuaggaagguuggacuuugaguaucugcaaacucaaagguggggcaagccagcuaaagaaccugugguuugguuuggccuggccugauagugccuuuguguaaaggcagcugggaauggagaugcuaugccgugcugggguggggaggcuugugcacuuuguguuccuccaugggcuuguggauugcacacaugugaucuaccagaauaagcauagaagugaucuaggaacauuuucuugaguuguacuugugacagucugauucauuuguucugugguugaaaaugcauggggauccuuggaucaaggagacgauccuuguucaagaagagugugggcacuugagcuugaguaauguucuccugggcagggaagacuaaacacagacaagaugcuuucgugaaaguccaaaugugagauuaaggacuuagggugguaagaggucagggauacuuuucagguuucuggugaugguuuuacagaguuggaguuugaaaauugaguuguggcugaggcagacauuuuggauuggauuuguagcuugaugcuuacuaaauuaaugugauuguacagguauguauauagaggaguaaaaagggcugaggagucuggagagauggcuuagugguuaagagcacuggcuuuuuuuccagagguccugaguucaauucccagcaaucucauggugacuuacaaccaucuguaaugggauccaaugccgcccucuggugugucugaggagaaccacaauuacucacauacuuaaauaaaucuuuaaguuugaggaaaugaccagugugugagcaacagaggggagcugcagacagaaauugucagccgugcuagucguuacucaccaaggacauucaagauagaaucgcccacugagucugaguaugugacuuggggacacuugaaaggaccagaaucagcacaagacaccccaagaccaaguucuuaagcacaaaggagagucauuugccccagagggacaaagagcagugaauaagaaucagagacagcagagagaggaugaagaagaggggagggaacaagggagagggggaagggugauucguuccagagugggagacaagggacugccucaggauagaagagucagaaguggaccauagcgaaauagcaguuuauaaagguaaaaggggaaaccuguguuagggugagguguuuaauuguaauugggcauguuaauuaggugagccaaagggggcuuuugauugcuggacuucaauacuuugauagcuggaccuugguaguuagccucaggaggagaaguggccgaauaagggaacaguccuugguggcuagcuuuaggaaugcaaucuagugaugcauuccuaaaugcaugggaaugggggaaaaggauaaggcuugccagagccauguuugccaugcuugggauggcuagagucccuccuaucacuuuauuuguuaaggguagucccagugaagcaguggguguggaggcugggaguaaggagguagaccccagaaacaugccuugauuauucuuuucucaagagaacaguaaguacacuuaacugcugagccaucucucagacccugugaagccuaguugugaagggaagaugcugauggacaguugauggugaagcggggccgggggagcuuugugcaugggcugggaggaucacacuuagaagaguaaacaucagagugguaggagacgggaggcacuuaacaguacagcagacacacagggauuaacauuggucagaggcaaggggccuuccauaugcuuuacaguguagaggcugcuugccuuuuauacuuaggaauagggacgagacucugacugugccuguccuguuggccacaggaaagcuccaugucccgggcacagucuccuccagugccugcaaggaagaaccaacuccgugcagaagguggguuggacgucuauaaaugagaguucagaaaugacgggcaaagugcugugcucugugcccccaacccccacaucuugcauuaguggccgugagccccccugcacacagacuuucagcggcuuuucacaguucacuugcauucuugcuuuuguguucacacaggguacugugugauugauuauacagccaccaggacaucagccuucaaagugcaaugcacuccuguugugcccuuuacaauugcccuuuguaggcccagcaacaucucccuaucgcagacuguggaucuuaaugcuguacuuuaugauguguauguguguaaacacacagaaguauccuccauaaacauuucucugagcaguuuagcuuuaugaaaagccagguuguguuugguaauuaaucucuucucuucucuucucuucucuucucuucucuucucuucucuucucuucucuucucuucucuucucuucucuucucuucucuucucuucucuucucuucucucuucucuaugggaauuugcagaggagaaaaaaaaugugauuauggaguuaucagaaaugaggaagcagcuccggagcgaggagaggcguuugcaggggcggcugcugcaccuggacagugacgacgagauccccaugaggugcuucugcgcaucuuccuggaguuggauugcuucaucucagagccuccugcucccuccuguguccucuaaaagucagauguagaaauguaguuccuugaggaaaauaaugacagcagugggaaacucauuaggaugauugcacagugugguuuaugacuguguggauuguguguuguguacucauuuccuggcaagacauagcucgcguuuuugucagaggucucaacuucucuaaagccaggacucuguagguuagcccuagcaagagcaaagacagcauggguuagguuagaauuaggcuaacgucacaagcaucuguuaaacacauaacugauagaaucuuaaauaugugucagagacauuggcucuuaauucucauuucauagagcagcuucacagaagaaaguccucauuucacagcauuaucaagcucucugugagcaaggcaaauguuacagaccacuuacaaaugaggucuaauaacccaauuauaaaagguuaaauuauuuacuuacuagaauuauggaaacuagaaaggguccaaauguaaaagacuccuagaaguugcuuuuggugauuauuccaaugagucuuugugugugcaugcauauauauauauauauauauauauauauauauauauauauauauauauauauauacacuuauauuuaauccauguaaaaaauauauuuaauucauguaaaaaaaaucggccugucacccagacacauuguaaaacaacauugcuaguacauacagagaagcacuuugaaaagccagccagcuguagcccaggcauguauggagcugggccuccuuuaggcauuuuaaccauauuugcacauugaacacuucaggaaugccuuggaggguucacacuucaucaggaucaugcuccuuuccauucccuuuaggguucaugagaggggagaaggaaacagauuugaacguaagaguugugagauuccagagcccauuuuuugcuuuaguugguggucuuuaaagggaagaccgucgggugcaaucaaaagugugaccaagucuuuuaaaacuacuuuaauccuuuaagauaaauaaaauaaacacaugagauggccacuuccuuaaguacagaacccaaauucuccaaauggacaaaaauauaagaaguugaggcuuauccugaauggguccauucaaaggccaagaagguuugauugauugauucugucuuuuaugcuguuuggcagccuccauucucucuagcaucuugugugaguagagauuccuaauguaugcuccggucuuccuuaccugagaaauuugcuuuuuuuuuuuccuccaauuuuuuuauuagguauuuacuucauuuauauuucaaaugcuauccagaaagucccccauccccccugccuucacuccucuacccacccagucccacuucuugucccugauguucuccuguacuggggcauauaaaguuugcaagaccaaggggccucucuucccaaugauggcaaacuaggccaucuucugcuagauaugcagcuagagagacgaacucuggggauacugguuaguucauauuguuguuccaccuauaggguugcagaccccuucagcucuuggguacuuucucuagcuccuacauugggggcccuguguuccauccuauagaugacugggagcauccacuucuguguuugccaggcacuagcuuagccucacaagagacagcuauaucagcgucccuucagcaaaaucuugcuggcgaaugcaauagugucugcguuugguggcugauuaugggauggacccccagguggagcagugucuggauggucuauccuuucgucucagcuccaaacuuugucucuguaacuccuuccauggguguuuuguucccaguucuaagaaggggcaaauuguccacacuuugcucuuccuucuuuuuaauagcugaauuguacuccauuguguaaauguaccacauuuucuguauccauuccucuguugagggacaucuggguucuuucuagcuucuggcuauuauaaguaaggcugugauuaacauaguggagcauguguccuuauuaccaguuggaacaucuagauauaugcccaggagagguauugcuggauccuccgguaguaguauguccaauuuucugaggaaccgccagacugauuuccagagugguuguacaagcuuacaaucccaccaacaauggaggaguguuccucuuucucuacauccucaccagcaucugcugucaccugaauuuuugaucuuagccauucugacuggugugagguggaaucucaggguuguuuugauuugcauuucccugaugauuaaggauguugaacauuuuuucaggugcuucucagccauuugauauaccucaguugagaauucuugguuuagcucugugccccaauuuuuaaugggguuauuugguuuucuggaguccaccuucuugaguucuuuauagauauuggauauuaguccccuaucugauuuaugauugguaaagauccuuucccaaucuguugguggccuuuuugucuuauugacagugucuucugccuuacagaagcuuugcaauuuuaugaggucccauuuguggauucucgaucuuacagcacaagccauugguguucuauucaggaauuuuuccccugugcccauaucuucgaggcuuuuccccacuuucuccucuauaaguuucagugucucugguuuuauguggaguuccuugguccacuuagacuugagcuuuguacaaggagauaagaauggaccaacucacauucuucuacaugauaaccgccaguugugccagcaccauuuauugaaaaugcuauuuuuuuuccccacuggauuuuuagcuuccuugucaaagaucaagugaccauagguguguggguucauuucugggucuucaauucuauuccauuggucuacuugucugucgucauaccaguaccaugcaguuuuuaucacaguugcucuguaauacagcuuuaggucaggcauggugauuccaccagagguucuuuuauccuugagaagagcuuuugcuauccuagguuauuuauuauuccagaugaauuugcaaauugcccuuuuuaaaucagugaagaauugaguuggaauuuugauggggauugcauugaaucuguagauugcuuucggcaagauagccacuuuuacuauauugauccugucaauccaugagcaugggagaucuuuccaucuucugagaucuuugauuucuuucuucagagacuugaaguucuuaucauacagaucuuucacuuccuuaguuagagucacaucaggauauuuuauauuauuuaugacuauugagaaggguguuguuucccuaauuucuuucucagcccguuuauccuuuguguacagaaaggccacugauuuguuuguguuaauuuuauaucaagcuacugcacugaagcuguuuaucugguuuaggaguucucugguggaauuuuagggucacuuauauauacuaucauaucaucugcaaauagugauauuuuugacuucuucuuuccaauuuguauccccuugaccuccuuuuguuguggaauugcucuggcuaggacuucaaguacuauauugaauagguggggagaaagugggcagcuugucuagucccugauuuuagugggauugcuuccaguuucuauccauuuacuuugauguuggcuacugguuugcuguagauugcuuuuauuauguucagguaugggccuugaauuccugaucuuuccaagacuuuuaucuugaauggguguuggauuuugucaaaugcuuuuuccgcaucuaaugaucaugugguuuuugucuuugaguuugcuuuuauaguggauuacaaugauggauuuccguauauuaaaccaucccugcaucccugggaugaagucuacuuggucaugauggaugaucauuuugauguguucuuggauuugguuugcuaggauuuuauugaguauuuuugcauugauauucauaagggaaauuggucugaaguucucuaucuuuguugggucuuucugugguuuagguaucagaguuauuguggcuucauagaaugaauuggguagaguuccuucuguuucuauguuguggaauaguuugagaagaacuggaauuggaauuaggucuucuuugaaugucugaucgaacucugcacuaaacccaucugguccuggguauuuuugguugggagacuauuaaugacugcuuccauuucuuuaggggauauaggacuguuuaggucauuaaucugauccugauuuaacuuugguaccugguaucugucuagaaauuuguccauuucauccaggcuuuccaguuuuguugaguauagccuuuuguagaaggaucugaugguguuuuggauuuuuucaggaucuguuguuaugucucccuuuucauuucugauuuuguuaaauuaggaugcuguccgagugcccucuaaucuggcuaaguguguauucaucuuguugauuuucucaaagaaccagcuccugguuugguugauucuuugaauaguucuuuuuguuuccgcuuggcugauuucggcccugacuuugguuauuuccugcggucuacuccucuugggugaauuugcuuccuuuuguucuagagcuuuuagguguccugucaagcugcuaguguauacucugucuaguuucuuuuugaaggcauucagugguaugaguuuuccucucaguaauguuuucaucguguucccauaaguuuggguauuguacuggcugguuuuaugugucaacuugacacagcuggaguuaccauagagaaaggagcuucaguugaggaaaugccuccaugagauccaacuguaaggcauuuucucaauuagugaucaagggagaaaggcuccuugugggugggaccauuucugggcugguagucuugguucuauaagagagcaggcugagcaagccaggggaagaaagccaauaaggaacaucccuccauggccuccgcaucagcuccugcuuccugaccugcuuaaguuccagucuugacuuccuuggugaugaacagcaguauggaaguguaagccgaauacacacuuucuuccccaacuugcuucuuggucaugauguuugugcaggaauagaaacccuaacuaagacagguauguugugguuucauuuucauuaaacucuaaauuaaagucuuuauuuucuuucuuuauuucuuccuugaccaagguaugguugaggagaguguuguucaauauuuuuguaucuguuagggccuguuuugugaccaauuauauggucaauuuuggagaaguuaauaugaggugcugagaagaaggaauauccuuuuguuuuaggauaaaauguucuguagauauguguuaaauccauuuguuucauaacuucuguuaguuucaaugugucucuguuuccaggaucuguccauugaugggagugguguguugaagucucccacuauuauugugugaggugcaaugugugcuuugagcuuuacuaaaguuucuuuaaugaauguggcugcccuugcguuuggagcguagauauucagaauugagaguuccucuuggaggauuuuaccuuugaugaguaugaagugccccuccuugucuuuuuugauaacuuuggguugggagucgauuuuauucgauauuagaauggcuacuccagcuuguuucuucagacuguuugcuuggacaauuguuuuacagccuuucacucugagguagugucugucuuuuucccugagauggguuuccuguacgcaguaaauguugggucccauuuguauagccagucuguuagucuagccagucuguuagucuauguuuuuuuauuggggaauugaguccauugauauuaagagauauuaaagaaaaguauuguugcuuccugucauuuuuguuguuaguguuagaauucuguucuugugucugucuucuuuuagguuuguugaaggauuacuuucuugcuuuuucuagggugcaguuuccauccuuguauuuguguuuuccuguuauuauccuuugaagggcuggauuccuggaaagauauugugugaauuucguuuugucauggaacacuuugguuuuuccaucuaugguaauugagaguuuugcuggguauaagccugggcuggcauuuguguucucuuaaugucuguauaacaucuguccaggaucuucuggccuucauagucucuggugaaaagucugguguaauucuaauaggccugcguuuauauguuacuugaccuuuuucccuuacugcuuuuaauauucuaucuuuauuuaguucauuuguuguucugauuauuauguguugggaggaauuucuuuucugguccagucuauuuggaguucuguaggcuucuuguauauucaugggcaucucuuucuuuagguuugggacguuuucuucuauaauuuuguugaagauauuugcuggcccuuuaauuugaaaaucuucauucucaucuacuccuauuaucccuauuauccguagguuuggucuucucauuguguccuggauuuccuggauguuuugaguuaggaucuuuuugcauuuuccauuuucuuugauuguugugcccauguucucuauggaaucuuuugcaccugagauucucuuccaucucuuguauuuuguugcugaugcucgcaucucugguuccugauuucuuuccuaggguuucuaucuccagaguugucucucuuuggguuuucuuuauuguuucuacuuccauuuuuagauccuggaugguuuuguucaauuccaucuccuguuugguaguguuuuuguguaacucucuaagggauuuuuguguuuccucuuuaaaggcuucuagcuuuuuaccugugcuuuccuuuauuucccucuuaaaguccuccaucaucaucaugagaagugacuuuagauccaugucuuguuuuucuggugugaugguguauccaggacuugcuauguugggagaguuugguucugaugaugccaaguaaccuuggucuuuguugcuucuguucuuagcuugccuccugccaugugauuaucucaagugcuggcugccuucaauauaucugauuggagccuguccuuccuauaaucccaguugauucaggacuccucagaguccagcuuucucugugauccuuugauugugggcuccugugaaccugagauucugggugugucagaguuuuggggcagucaagcuuccucugagacccugaaauacuggugugacccagcuucugucauacugggauccuguuguccuaagauucugggcauguuauauuggcuggacguggugucuccuuugaggaccguaaagcugucuggucacagauccuaagauagugugcagaguccucuggggacuguggaggugucugccaacucuaaguccuaggugaccgggugcugacuccgacaggaagggcgggcgucuuuguagauuuuuauugccaugcaguaaacagagcucucaucuuaaagggaauaaaagaucauuuguuccagagacauuucugacugaccguggccugggagaacagauuuagauugcccuggcaaaaaguuuuuaugaaauuuuuauagcuuuacagaacaaauaaagucauacaucaguguauuugucaggcugggcggugguagcauacuccuuuaaucccagcacuugggaggcagaggcagagggaggcggauuucugaguuugaggccagccuggucuacaaagugaguuccaggacagccagggcuacacagagaaacccugucuugaaagaaccaaaaaaaaaaaaaaacaaaaaaaaacaaaaaaaaacaaaaaaaaaacuuaaaauuguauuuguacaucagggagguaggcaggguggggaagcuuuucuguaggcccaggaugcuaucugauggcauuuuuagcucuuggguuggcagaagcuaguggucugcuaaguuauuagauuucuaaaaggcuuuuauuuauugucacaacauaguccaauacagagcagguacaggaauggcuuuccagcaggccagaacuuagcccgagacagauaacuagccucuggaccuguaacauugcagucugucugcagcacugagaggcaggugagcuaggcagucucugcagacaugcguuucuuucaggggcuuuuguucacaccucaauggcgcuucucagaaguuuuccuucaaaccaucauucuagaugcauggugcaguuccguaccaaccuugacaggaccaugcuguggcccuucuaaaaguuucugagagaaaaggaagccccaugagaugaacccagguguuaauaauugcauuugacuguagcuuagauuacagguuuuuuguuuuuuuuuuuuguuuuuguuuuuguuuuuuuaaagaggagggaugggguuggggauuuagcucacagguagaacgcuugccuagcaagcccaaggcccuggguucgguccucagcucugggggugcuuuagucucagcacuggaaggcaguggcagacagaucuuuuacgaauucaagaccagcuuggucuacauagugaguuucaugccacccaaaaacucugagacuaucucaaagagagaggggaauuuggggggggggaguagagaguggcagugggggugggagggagaaggaaggagaggacagaggagcaagggggucuacacgguguggauggacagaagcacugguugguguuugcuuuuaauuucagagcuagaauuuccauucucuguccauuuucuuugggggaaguggcaacagucaacuauuagcagaaagcacccuaccaaagcuaccgggaauauucauuacccggauagcaacagaacagugauguaaagucaugcacaguuagcucccuagcacaccauuaacagcacguugugaguauaauuucuacucugggcugagagaaagguaagacguacugacaccugauuuauguuauauccugugcaugcaugggacuuuacacuucuuguaauucucuugcucacaacacgaugcaauuggauagauuuuuuuuuuuuuuuuuuuuugguuuuucgagacaggguuucucuguguagcccuggcuguccuggaacucauuuuguagaccaggcuggccuugaacucagaaaucugccugccucugcccccugagugcugggauuaaaggugugcgccaccaugcccggcaccuggauagauuuuuauaaugacauuaaagucguuucuaaaaaguaguaugccugauuuuugugggauuuauuuauuuauuuuuuauuaugagacagguucucauguagcucgaggugacaucaaauuaguuagcugaggcuggccuugagcucaugaaugcugggauugcaggcagugacaccaugucccuuauaaagucuguuguuuuuaacaugggugauugacagagcaggguagggcagguugaauauaugugauaacucuggucaaagaugccaaguugcuuuuacaaagaacagaaugucagcucguuuccuaccauacagcacauugaucaugauuugcuauuuuuaggaaaagagagaggaacccaauggauauauuugacauggcuagacaucggguacaagccccugucagaagaccaucgccuaagggcuuagaugcuacuacuuuucagaauauucaugacuuuaaugagcugagagagagaggugagcauaaaguuauaauuguucucuaugugacaucuucggguaguagggagaaaccacaagcaguugcuugucuagggauugccuuguaacuguuguuuaugugaaacuuuuauuaaagaacaucaauuuaguguucuucaauuucauggcuuuguaaugucuuuugaaugagguuauaauuuaaaauuaagguuguuacauuaccuaaguuuuuugucaaugcggguggucaaacucagggucuugugaagugguguaccacugagccaaaucccuaacagagcacagagaguuuccacuugcucccugccuuugcauaggcacagccuucuccauuacagcggcuccucagagguacacagugguagagcugaccuacugaguggguaugcauuagggcucauuuuugaugugcuuucugucagguuguguagaagugugauuacauauucuuaucaguguagggucauauagaaaaguuuuauagcccuaaaaguacuguucacccuccuuucucuuuaucccuuuauguuuccaccauuucccucuuggaaaauguuguaguucguaaagcuggaaucacauuagauccagccuucucagauuggugccugucacuuagcaacaugcacucaacucuccucagcaccucuucuugguggcuucuuuccccauauuuuuucugagacagaauuauacacaguaguccauacugaccuagaacucacuauguagcucuggaauaguagcugucccccaaaacuacaggcaaaagucugauuuaauuucauuuauuaauuauaccacagcuagucauucauuuaagaacauguuggaugcugccuuccauauuuuagucacaaacaugugcauaccgauucuuuuucuaaagucucaguugaaagcaagauuuaacuuaguuauguaacuuuugugacagauucagauacucgaguggaucugagauuaauguacccagauccuccccgcgaucaucacaccuuggagauucagcagcaggcccuacuccgagagcagcagaagaggcuuaauagaauaaagaugcggagagaugcaggagguaagugcaagccuggcugcuuuacaugacaugcaacuggggccucuucccucuucagccuuuaaguuguuaguuuucuuuguaugucuguuuaaaaagauuaauuugugauuuuacacacacacacacacacacacacacacacacacacacacacacacacacacgcacgcgcgcacgugaagguacuguucuucagaggucagaagagagugugggaucccuugaaucugguguuagaggcaguugugagccucuagguggaugccaggaaccaagcuucuguccuguaagaucagcgagcauucuuacccaaccagucaucucucucgucuuuuucuucccauuaauuuauuuauuuuacauucugaucacagcucucccuuuucucccagccuccccucccucccaccuucagccccuucccucauucucuucucccuuucuccuccaagacagggagaagggccuggguaccaaucuacccuggcacauccagucacuguaggacuagacacacccucucccacugaggcugcccaguuacaggaacaugaucaggcaagaaaaagagucaggaacagccccugcuuauuuuuugugggacccacaugaagaccaaauuguacuucuccuacaugugugcaaggggagggggcuuagguccaguccacgcauguucuuugacuggugguuaggucucugagagccaccaugggugcagguuaguugacucuguagucuucuuguggagucccuauccccucaggauuccucagcaccucaccaccccucccccaccucccgaaagguaggccauagcacuggcagcuccaugcucaugggacucuuuugccauaguuuuggaaaggaacacauucugcagagggcucugauuaaaccuguaggggucauguauccaugcuugggaguucagcuauucacuauuauuauuauuauuauuauuauuauuauuaauauauuauuauuauuauuauugcuggugggguuggguacuugaucaugccugaugacuuccaccccaagagcuaccaacagagggcacgagugcucauuugauccuggagcacacuucuuucccugugugggagguuuccuuccuuccuuccuuccuuccuuccuuccuuccuuccuuccuuccuuccuuccuuccucccucccucccucccucccucccucccucccucccucccucccucccucccucucucucucucucucucucucucucucuuucuuucuuucuuucuuucuuucuguguauucugucaagcaucagauuugcauguauguuuuugaauaauuauuuggucaugugaaucuuaccuagugcuauaagcaugacuacgagggcacagagacugaccuacacuagcaggaugugagauggugggcaauaagcuaggcugcugcucucaaggggcugcugauacuguguaagucaggucaaauaaacagugucuaagucuacaggagcauguaacuauacacuaugaguggggccuacaaguaggauggaguuaccucagcauccauggccuuacugagcccuaggugcguauugugaccauaccugggucccacuggcuuugccagccuauaggccauugcguguggggaggguaaucuguuacuuguaggaaaguuaagacccuaguuuggcaggcugcuauggcuugcagaaugugaggaaggugccuggccucaggagguaugauaggaauaaaugauguaacacuuuaggcugaucuuauagaucaaggcuuggauauacacuuuuauaggagauaucuucccuccucaugguguggaauuuuaaauaucaaaugaugaucuggucuuaucaguuuaggcacagcaaaacuaacaguccccagagggguccagguacuucucacugguagcaaacagugacgaggucauuauuagauaugguuuaacuaugcaaagucucaaggaaaggacaugggccaucauugcggcuccuuuacucccauagaguucugucuuuggagaaacgugggaacacugccaggcugcagaagggacugggauaccucuacagagcccugugguuggcuaccugcaguuuaacauauuccaaucuguaguggcuccacugaguggcuuugugcagaaacuacaggggcaagauugaagguuucuuuuaagaaaaacaaugcccguguuaauuuuuuuuuagauaucaaaguucacaaagauuuuauuaaugagucauuuaaccagaauggauacagauuuaaugagaaaguaguauaguuucuaagauuguucuagugugugauagugaaaguaauuuucaauagaagguaauaauagaagaucugaaauguguuuuugucagucuucuucaaacauuauucuuuuguucuguuuacagcugauuuggacaccaucugcacugauaaugcacaagggcgcagaaugguaagcaaccaguucaaauuccucaguuagaauuugcggcccauguuaguuaagugaguauuccagacuuugaauauguccauaauauaguauuuuaaaacauaauuuagauucuaaguguguagagaugugcagcuaagauguguagaggaaauugacuguaaugggugagaauaacaccugagugccuugagcugcucucuuuagauuugucauuugggggagggggguguguauacaaauaauuuuuaugcuccaguuuccuauucaguauuuauggaaugaaauugaucauacuuacugcugaggauuacuacaaagauccaauuaauauuugcaaggugcagauagguuuggcauauauauucugcaacauucuccuaaauaaaaauucgugcaggcauuacugugaggguuaugugagauaauacaucuaauuuaaaaucccuuagaguagagccuggccauacugauugcaguuguuaguugucauuaagauuuaucgcagcagaagugucuguagucauauggaagagaagcaacaauggaaccuuacacuuacccugcagugacacuguauaagacugcagugaccagaagcugcucaguguguucaucuagaguauuagaaaaagaaucccuuuguccuggaggcguguguucugaaaagaaggggauacaguauacugcuggcuguggggaggacgcugggaggguuggcaugggggacuugugguuuauaacacaacagagguggggagguaacgauggaaaccuugacaauacacagaggaagugaggagcagaagggcguccauauugugccuacuuucacaguucauguguucgcuucaguguguuggauauaggauggauuacuuugagaaucuagacagcugugcuggucuagguugaggugaggcagcagaaguauucugaaaugggugcuaggucugggcuagagagguggaaagcaagaaaaacguagggguugggaagacaggcaguuguuugacacagcaaguuugaguugcauaguacacagcagaaguggugagcgcacaggccagagccuggagauacacauggcgcuggagauccuuaggcucuuucuagccuuuccccagaugaaguucggccugcucugugugcuuguucagggcuuccaccuaauguuguuguuccaguuucucuaagcucccguuuugcuaaguuuuaaaaaaauacucauuauuaucuugcccauagccuuacaucuaacaaaccaggcccagcucuggacccagugggcuccagacugaccuguccugcaguaacauggugccucuuuuggaagacugcaguuugguagauguuuccaugugugauggcuacuuuauuucaugcaaaagaucaugaaauuuacuaucuggggguuuugguuaaaaaguuuggcuaagaaacucaguauagagcacgaguuuaucaugauuuaaauaagaaaaagccaccuuuccucgaaacugaguuauauagaaaagcauauagggugagcaaguugucauuaagaagacuaggugugcucuggucaugcuccaguuaugggaaggacuauaaugcagaaguuacaguauuuagcaggcugaugacagugggcuccgcugcugggacugucauuauuugccuggaaugaaaguagaaucagcaguauucaaagaagagauagaaauucaacauagagaagaacugagugcuccaaaaaaugucaaugggaacaagacaauucauugcuuuuauuuacugccaguguuggagcaaagugcagagaucagauuggaaguuguaggcuccuccuaacacacaaagugguuuuauacaaauguaaacuugaguucuuucccacaaggaagcucacugugcugucuagugcuguacuuuccccuacagugugcccugcuguaacuguguuguuacugugcaguagcuguggucaggccagcgugucuauaguaccauugcuucccuuccuuccaugggacucuagacuucagaacguaacaucauacccuaguucuuagaagaaugagaaagcagacugcuuagauucacugagaacagacucuaagugaugcuuuaaagagugcucagcagugcauccgcugcgucaugcuuguucacaccaacaguggggucccuuuaucagcugaaggggcagggaugagggagcagugaggaagcuagggguaaauaucucucuguguccuggugaggcuagugggauacuggagugcagcgaggagggacagccuugucagccaucuuuuuugucuugguggugggauuagaguggaaaccuaugcuguuguguuaguaugauuuauuuuccuacuccagacuaaaaauacagccauuaacauacaauuguuguuuuuuuuauuuuagcccagagaugacacuaaugauuuuuugaaaaauucauuacuagaaucugauagugcuuuuauuggugaguauaucuaaugugauauuaauuuuuaaguuguauguauaucuauggcuguuuuagaucuuuaagauagaauaucacuuuguagcccaagcugaacuggaacuuacuauggcccagggugaucucaaccuuugauccuccugagcucugggauuagggcugcaucaggcugguuuagccacuuuugaaaguagugugguagcuacacaaaauguuggacagucaccauaacaccuggcaauaauuccuaguuucugucccaaagaaagaaugcucacacagaauauucaaguggcaucauuccagugccaccagcuagcaguagucaccaauggcaagugcagaugcaaagugugaugaauuagugacucagcaucuacgugauccaugcggagagagacccaggacuuuguuuuagaauuccaccuauguggaguguuggacugggccugcaguguaaugccagugaucauaccggagcuguuugagguauuacaaauucuagauaguaaugacuaaacaacuauaaauucacuaaagaaaucacugaacguguaacauuucaauaaagcaauuaaagaaaaagacaucaagacucuaagcuuugaguaaaauugccauauucuuuguguggccuguuuaggugcuuauggugagacauauccuguuauugaagacaaugccuucccuccaccaucacagcugcccucugcaagggaacgcaggaggaacaaauuaaaaggacuagauuuuguauguaugaucuucucaguuuagaagauugggaguuugguuucaguauaugugguccaauuuaagaauuggaggaggcuugcuuugaaaaccaaauguguguggucuaaaucuagguucugcucuguuauuuuggugaccuuauagcucuguaaauggcauggacauccuguccuauaaauguuaaacuuacugccucagucuuuaucucacucuuuauauaguauacagacuuuggagaagccauaaaaagcaacuguuagcauuuaucaaaaagccuguuauacccugauaauaacaugauaugguagcaacuccauuuuggucaaguccuagcauuuaaauaaugaccaaacaguacaacagggagaauaaagucuuuucaaugaauggugcuagagaacccguuucucuaugccagaggaguucagaccuugucucucaaaauuacaugcaaaaacuaacuagaguguaucacaaaaacauguuuauauaaacccucccaaaauacaaauuggucuuuauuuaaacacuaggacuaguuucuguauucuuuucucuacuguugcuuugugcaucugccccaccgguaguaacacacacaaguggagucucaguugccuguguuuggccuucugugcccuacuuccugagccuuaugccagcaauuauuucacugaagugcuaccucuaagcccugacaaagacagagacaggauccauaugcucccaguuagcucuucaguguguguugaucggguauaaccccaugcuagcugacuguuggaguguuccuaaauucucucucuuaacuuuaggacaguagucggcugcacaccccacaagauggucucucuuuaaaaucuaucuccaguguaaaugucgaucaaguuagaaugagaaaugaagacagaaugagaagacugacugagcagcagaagaaacccacuaacacagguacuuccauacaagauauccacuggcugaugaaacaccugcagggaaaagaauuuucaaguccuuugaguuuuacaaaaggucaaggucauaaacuagcuuggaaauccagggcuugggauuaauucugcagcagguucuucauacuagguguugguuaagaguauuaucuauaucuaggcuguuuucagcagguuaaagugcugacuaguauguugguaaucacucacuguuuuuaaguaauauaucuuuuaaagacaauuuuaccuuuacuuggcuuuuugugacaugaagaaaaaaagguaguuuuucaguuaauauucuaagccaacaagcuaaucuucucaugaugaguggucuugggugaaacuucucacaaagcacagggcagcuucagaccucuccugccagcccgugccacacucucuuccuuuccuuccuuuuccucuaagucaggcucuuagucccuggcugggaccaugggccagaguuguagcagaguugccuaucuuaggucuguuaagcugcacugcaggauuuucauugaugcaacuuuuucuuaaauauuucuuucuuuuuuuuuuuuuuuuuaauuuuuuuuuuaauguuuuuuuuuuuuuuuugcuuguuuguuuguuugguuuuugguuuuucgagacaggguuucucuguauggucuuggcuguccuggaacucacuuuguagaccaggcuggccucgaacucagaaauccgccugucucugccucccaagugcugggauuaaaggcgugcgccaccacgcccgguucuuaaauauuucuuaauacuacuuuuaaacugaacucauuucuccaguccaggagugguguuuugugauaguaaauauuuuucacuaaauaugaaaaaacacaaaaacaauuaaggaaugguacuuuucaugucauaauugaaaugucuuaaaaggcauuuuccauucauguauaccuagaauuccuucuuuguuuuagagccaguaaccuugaacuaguacccaagaagaauauauuugagagacaauagagauucuuucagguuuucaauaucuaaacuaguuuuguuuuaauauuguccuuuuaaacaggagcuuuuugguacaauguggauugacugcuuauuaaagugguugcacauuguaccccuuugcuaagccaauuuagaccaagagauguaauuuuuuuuuuuuuagaaaaagaaguugacaucacaggguaggaagauagauuuuuccuacuuuauacuuauuaagucaaauacagauguagaauuugaauaagaucaaaugugauuaacgaacaagucaccuguuaacgggcuuagauuagugcaguaugucaguaauuuccucagaaugacuuucaguguaccuaucagugcuaaauuaacgucauuccauuguuuuuccuaugguaacagacacacaauaagacagccuauauuucuacagucagcuuuuaauguuugguagagccugcuuuguagcugucagugccagaguccguguauucccccccccucccccaucuuagucccuuucucagcaugcuuucuuauuucuaacagggaaagucaguuggugggggaugcuuguaaucuugugaagagaugcagaguuguaaugggcuggcuuguaggugcccuguguaugucaccugcuacccgacuuguaucuuuugccuucuguagaugaugaggguucacugguugauccugaugacaucaugagacaccugagugaugauggacgcaacucugcggcaacugagcccuggcuccgcccuggcacuucagaaagucugaaacgguucauggcagagcaucugaaugaagaacagcauaaggggccugggaagccaggcacguuuacuuggcagggccucucugcugcacaugcuuaaaauaaacccucucggauccaguagugccuuuuacaguggaacguucaccuguaucuugaauacuaugucuugcuuguggcccuacuuuaauauuaguuauuuauguaaaguguauuuuucccaugaugauacguuauguauauauaauguacauaaaagcccugauuauugguuucuaauuguauagaauuauuuuugcaauuuugcuaugggugguaaugaacucuugauugagcuaccguaugugcauuaaaaugugcuugccauuaagagguggugagcuagaguguacacagcacugugaaacaauacacuguuacuagccuacuugccacuguuagcauuguggagaaacaauucagagagacuuguuuuauauacuugcuguugcugugacuaugccagcugcuaggcaaugaaagauucaaacaagcugcucauuuucauaucuguaguuacacauuccauaggagcaaagggauuugugaucauccaugagccaugauuaaauguuacauuuuucugccuccaucuuauuuuuaugcugauagaagcacagacuggguuacuaauuuaucugauuucacuauuucuuaacacaaauaaaguucuauuuuuauuaacuaccagu

SEQ ID NO: 67 - RNA, 3750 nt, Mus musculus
acuauguguauuucuugaucccaucauacaagacaagcacaaauguaccacccaugccucugagaacguuggaccaugcacccuugaaaaaagccuugcucccuucauagcaagcgaucuucugccagcagucaagcaugccuguguacaugauaucagguccuuugcgucuugacugcaucaugguacaacagcgaacagugucaaaaggauaggaagucaggccagcgacaguagugacagacugcaaucauccagcugaugaagaugugaguauucuugggaucugggagcauucccuuugcagugucauagauaccaacguaggcagcuggguagaugauaaugcccuguacugacaauuaaagccuuggucggauuuguagauuuuaacuaggcagucaccaaagccuuugaauucccuuucagcuccaguuuugcccacaucagcugcuagauggguacgggcaaaaucaagaggguacacaaagcacaaggauguggccccaguggcaccaccugaugccagguucccugcaaaguagcaccaaaacuggguccucuugucuacaccacccagaaagaucugcuuguauuuaucuuugaaggcaaaguugagagccuggguggggaaguaucugaugacauuggccagauucccacgccagaaggacaggacucccuguuccuugggguuacaaaccacgaagucuauuaugcccuuguauugcuuaucugcugugauuagcuugcuggcaugcugcacauacagcagcagcuugacacucucgaugggugcuaccguggucuuugugagggccgcgaccacuccaccauccaagaaguccuuagggaaggacacaggguaucaucugucaugucgaaagcaaaaaaaaaaaaaagaaaaagaaaaagaaaagaaaaaaaagagaagagaagagaagagaagagaagaaaagaaaagaaaagaaaagaaaagaaaagaaaagaaaagaaaagaaaagaaaagaaaagaaaagaaaagaaaaagaggcagaugaaugcaugacaggacuggguugacaaccggcuuugauuuccaaacucucaauacaaccacuuuuuuugggggguggggguucgagacaggguuucucuguauagcccuggcuguccuggaacucacucuguagaccaggcugcccucaaacugagaaauccaccugccucuuccucccaagugcugggauuaaaggugugugcauuguuguuagacucucuuguauguaagucacaccccaugcaagaguuuuccuuggggaucacagagcagaagguauucugggaaaaacuagaauuuguuuccagagucuccuuucuauuaaucacccuacuaugcuauguaaaauaaaacuuagaauuuacaaggacagaaaaaggcaaaauuuagucuuaguuaaauuaaugaucugaacuccaaaaguuuggucugaugacugcuauugccucacagugugauuuuuguucucuaguccauaauagaguuguugaguugaaaugaacuauccuaacuuuccuagcucaucauuaaucaugcagccaacacuccaaguguuaauuauuauaguucuucuguaaaguccauaaaugcucacuaccaaucaauucaaacauaaagcauuucucuauggugcaaauauccaaaauacuuucaaugagguuuuuuuugaaauucuuacuauguuauuacuaccugcugucacuugacagugcaacagaacagcagaaguuauuuuuccacuccagcuguagcuauuaucuauuaaccauccuguccucaucauucccuccuacucacaaucucuaaccauugauauuuauuauauuuucaauuucuauuaggacgauuucacuuaaauuuuucauaguacuuaccuucacuuaauauuuuacauaugugcgcacuauuaacuuguuucuauuuuacguauacaauauuuuucuuauuaauuuuuuucauucuuuaacagauguauacucuaagagcaaggauuuuuuuuggggggggggaggaaaggguuuauucaucuuacauuuccacauuguuguucaucacugaaggaagucaggacuggaacucacacagggcaggaagcaggagcugaugcagaggccauggagagauguucuuuacuggcuugccuccccuggcuugcucagccugcucucuuauagaacccaagacuaccagcccagagauggucccacccacaauggguccuccacccuugaucacuaguugggaaaaugccuuacagcuggaucucauggaggcauuuucucaacugaagcuccuuucucugugauaacuccagccugugucaaguugacacaaaaccagccaguacaauugaccccuugucaacuugacacacaaacacaucacuaguaagccucaacccuuaguuacuuauucagccccaagaucuaaauaacuuucaaaguccuacagucuuuacauauucuuaaaauuucaaucuccuuaaaauauucaaucucuuuuaaaauucaaagucucuuaacugugggcuccacuaaaauacuuucuuccuucaagagggaaaaauaucagggcacagucacaaucaaaagcaaaaauuaaacuccaacuguccaaugucugggauccaacucaugaucuuuugggcuccuccaagggcuugggucacuucuccaguccugugcuuuguagcacacagcugagcaaggauuuuuauguugcuuguuuagccagugcaaaccaaguuagacagugguaaauauuugaaguaauugcaguguagaacuuuccucuguccuugauaugaccauugucaucuggagcauaguuguuguggggacuguuaugaaaagaaacucaacacaugauacaacagcuagccagaccuaugguauuagagcugcauacaucccuucuuaggggaaaaaagagaggaacaaaaucucgagaagucugucccugaaaacugcugcuccuucuugccuggcuacauaaucaugggaaugcuaaaguauuugaggagaaaauauugauugggagugugacauuugguauuguagcgaccuccuagaggaguccacguucaucucgguaaugugcuccuucacuggccaaguuucuggguaugcuaguuauuuuugccuuauuguauauguuggaaacaaaucacuguaugugccucaaucucaaugagagggaaauugacuucaauuuuuuucaaaguaagaguuucaaauaauuuccauauuauauaaagagcuguauucagauacaaccaaacuuuuauuucagaacauauuuuuaaauauacuuacuuuauuuuauguguguuggugcuaggcugcaugugaaccuaagcaucacaugcgggcagugccuaaagugcccagaagagaugauuagaucuccuguaccuggcauuucagacaguugugagccuccaugugagugauggaaaucaauccuagguccagugcaaaccaagccagacugugguaaauauuugaaguaauugcaguguagaacuuuccucuguccuugauaugaccauugucaucuggagcagccagaacucugaaccacuuacugagcccucucuuuagcccuccuauaaugcaauuuuaaucucacauagaaaacauuuuguuacagcagaauauaaaaauguauagcgaugccugucaccauacacacaaagcugguagaccauc

SEQ ID NO: 68 - RNA, 13738 nt, Mus musculus
uucagaagucuagggucccgagacccagcgggugccgcccuagccuuggccugagguagguaggucuuuggcccgcuggagggaccuaccccgaaggcuacaggcuuccagcacggcugggaacagugcucuguaaucgcuuucaaaauucguuuugcaguuguuugguuguuuuuguuuuuucuuuguuuuacuuaguuaguuguuuuuggcuuuguuuuuguuuuaaacuucguaauuggauuuuggcuuuccaccuccggagucgcuugucuugggaguuagagccugcgcuguucggggcucagggggagauagacggagaggccugugugguggcugaccucgcccccugacccuauguucuuuaacaucugagucacgacccggguuguuuuccuuauuggacacauugaucccugaucuuaaaauccucggacccuacgggucuucacuccuuagcccugcuguguggcuacugagaaagaagcauuucgggggccagggccgccgcggccaggucggcgacaaccgagacaucucucugcugccuggcuugggacuugucaucccggagucuccagaggcgaccuagguugagauggcuaggguugccaagagauuggagauguggcgggaaggggcgcugggcgugggucucuagagggaggacgaauaccgcuccgcuccccucggugcuguugggaccgccggggucgcugacguuucgcuaaacuccuuggggugccgagucgacucagaaccccuucugcacugucccaccgagagcgcacacuucuccuaucucggcugcauacucaagagcgccugaagccacugccugcuccgaaaccggugcagggucgugcccuaguagcuuggcuaaaaaaauuauauuaaaaaaaaaaaaaaaaagacgcucguagagaccuaggcgggugguucguuuuguugggcugauaauuaagagagacggaauugaaacccguuuuguaggagccggguugagggcuugggagcgggggucaccggcauuccuuagucaaggugguuuagggagcaaaagagaaggcgaccugagccagcaccuuucagucgggugacaccaaggcagauuuucguuagagguuugagacguuuggcuuuuuaguucgguuuggugugggaguuugugccuuuuguguuacuuuuuucgagcuaggauuggcgggaucgaauugggaacuuuguucauugacuuugaugggguggagggaaguaguuaagaucaccuaggaccccucacucagccagcucgguuucccacagauccgcaaaacucagcuugcgauggccuuaccgcccucuggugagacccagucccaggacaaggcgaacuaccugccccagagcaacccucaccaccugacuaccuacuacgcgcaugccccaggcuacagucacuuuaggaaccucgccaccaccgaggaggaguuucaaccuuggaaacuggcagcugcagugcuugagucccaggcgauggccccucuugaugcuuuucggaugacugcucccuuguugaacccgggucuggcuguucagagcgagccgcucuacaaucugcccugguacaaauugucaccauggaaccgaauuccucaauucacucccgaaguaccacgauuucuagacagcacugagcauaggagcagcgguuccagcaaccaaaauuugguccucggcggcggcgguggccaaaucaguggucagaggugggaagcugaaaauuuacuucugccauccccgguaauugcuucccuacuaccugauggaauuaagucgucccagucaauaucugucccccaaaccuugaaucaagaggggaagcugccguuuugcggcuucaacuucacagaggaggaacugagcuucguucuguauggagccaucgcuaguccggagcacccaaccgacuuacagcaugcaauuucaggcauccugguucccacagagaguucugguaaggaaaucuacauuuugggucuggguugguugguacagguccggaccacgcaguauuaaaacauggauguauguuggggcgagugucucucuaaaccgccuucucugcuggcuucucaugguccuccuugccuaaccguguaauuccugagauugcuuuuagugagcucugaggacuaagagccaagugguuucccucgguggcuuuaggaauguacaaaguaucuacaugauggucuccagaaauucacaccuggcagcucuuuaccucagaaagcauugucucugacucucaaguuugcaaaauggaguucauuacccaccaaaccucccccaaaggguuuuuuugaggcucaaaugagcaacaguguacaaaaagccugugucaaugauacagcagcaguaaaggguagaggauaaauguccaauguaaauccucucuagggacugagggaacccugucgggaaggcaacucacugucuuuuucuagggucuaaucaucuucauaaaacccuggacaaagacucccuccagcuuccggaagguaggcugcacuccuugccuggauuuauuucccacaacuaauguugacucacugcccaggcucauucuccuuuccucuccugccucggguucaccuaggucucugccucaugcagaccucauuuggugaugugccacacuuuggcguguucugcagcgacuucauugccaaaggagugagauuuggacccuuucgagguagaguggucaaugccagcgaagugaaggcacacagggacaacucucggaugugggaaguaaguguguuucuggggguggggggugcugaauuuggggaggacgaccugagguugggggaggcgguacccuugaaggccuuuauugagaaagacauugguguucgcuccagcaggaccucacucugcaugaaauccacguuguagugggugaagcaacuuuaaucuguacagaucagacauggaaaguacauuuaaagaauuaccacuguguguuuuauuuacaggcaaaccaaguguuuuaaauaugauagaguguuaaaagcaugcuacaggaaagaaagacaaguuuuagacuuucauguuacuuucuuguaaaauuagccaaggauuaacaaaacaaauaaagcaaguuagugccugucuaagggaggcugcugagacagcagcuucucguuuacaggacccacuugucagaauaaccagguaacuuaaaaucugaaagcccugacccuggacuucuagcaauauacuuuaggaugauaaccugugauuuuggcaauguggaagagcugaauuaaacaguaauuuauacuaaacuguacuuaaacuaagcugcggcacuagcugcccgaucccacgccuccacacugggcagaagagaaagaauccuccgcagcucaucccaaagggcugggcucaaauaagaccuaguuaguucccuuacccuugcuuauaaaacuaacguacaccacaguagaaacucagggaucgagaaugugauaagggcaugaauucauuuuuaaaguauguuguuagccaggcguggugacgcacacauuuaaucccagcacuagggaggcagaggcgggcagauuucugaguucgaggccagccuggucuacaaagugaguuccaggacagccagggcuauacagagaaacccugucucuaaauaaauaaauaaauaaauaaacccugucucuaaauaaauaaauaaauaaauaaauaaauaaaguauguuguuacauagucuauagaggaacuggagaaaugcuugccugguaugcccaaagugcuggacucaguccccagcaccacauaacacugcaugguggcacacauaagcaugguggcacacacacaucagcaugguggcacacacacaucagcauggugacacacacacaucagcaugguggcacacacacauaucagcauggugacacacacauaucagcaugguggcacacaucagcaugguggcacacacacaucagcaugguggcacacacacaucagcaugguggcacacacacauaucagcaugguggcacacaucagcaugguggcacacacacaucagcauggugguccacaucagccugguggcacacguaagcacugcagagggaacagcagguggauuacaaauucaaggccauccucaacuauauuuuaaauucaaguccuaccugagacccucugcagaaaggcguuuauaugcuacuucuuauaugggaaucugauuuauagaaauguguucuauaguaggaauuuggguauagauguuaaauuucauuuuauagaucagacgaaaggaaaacaaaagcaaauacaaagagcucaugcuuugggggggugcugggugugcuugauggacccugaacucaggaagcugaggcagaggcacaaguguggggccaaccucugauacauagaaagauucugaccaaaacaagauaaacacacacacaaaaaaaaaccaacuguaugugucaucuuauuuagauuuuugaagauggucaccugagccauuuuaucgacggcaaagguucugggaacuggauguccuaugucaacugugcucgguuccccaaggagcagaaccugcuggccgugcagcaccaagggcagauauuuuaugagaguuguagagacauccagcggaaccaggaacugcuugugugguacggaaauggcuaugagaaguuccugggcguucccaugaaccuccgugucacugagcaaggaggccagcagcugucugaguccucugaaggugagucugcccagagagaaucuacuagaacgcuuacuggguucccuaacguccaacuaagaugccagagacccuggagagguggauuggcgccaucuuuuuuucuacagcgucuuuuucuaagguuauccaucuuuucccccuucccauucuugggaauaaaagacaaagaacgcaugccagcauauugugggcuagugaguuugauccacuccugcucaggccagcucucucaaaugaugggcugcagcaacuuagugagguggaaaaucaauuuagugauugaaaccagcauaaaaggaaaaaaagaaagaaauuagaauaggaaauauugaugagaaucacuuaagaaacucuguuguuaaguuuuuguuuuauauagaaacauuauaagaaucagggcuuccaguuaaaacuauuuucucaggcugaggccucuuguuuccuauacaaggacucuaccguugagcuacagacacuuccagccucuaaacuggauacuuuguacgcaccuuuaaucccagccuucagggaggccuaggcaggcagagcucugagucugaggccagccugggcuacagagugauauggagauaccucaaacaaaacucucaccacuuccagcccccacccaccauaagauuucacuguggcaaauuugaaaaaugcgggacuaugcucucuucucuguuuuuuuguuuuuuucuuuuucucuuucuuuuuuuuuucuuuuuugagacagaaucucacuauauagccgggauuggccuuguacucaaaaccuucugccccaacuccccaagugcuccugacuguugaacugugugugagucugugugcgugugucuauggcuguguguguguguguguguguguguguguguguguacaccuggagaucuuguagagaggcuagcuaguucuuagcacagguggggcuggcacuaugacuaugcgccuugcucagcuuccagggguugcugcuggucccuggaugaucacaucugaguggcuaggaggcagaggacaaucaacucaccauaggaauaggucuucagauuugguguuuuuaaggaaagagugacgcugagcccucagacuaugcuagaauuuucagguuuguguuuuuuuguuuuuuucuucuuuguucccugucucaaguaguccaguauggauggcuggacugcucuuccuacuuccgacccccaaguucuaggauuauaagcauguaaagcuauacccagcuuuaacuuguuuguuuguuuguuuguuuguuuuuugacaccugguuucacuaaguagcuguucugaaacucacuguguagacaggguugaacuccugacuuccucuggcuccuggaugcugagguuuaaaguguguaccaucgcacuaagcuugcaaucuacuccuaaauauuaccuguccaacugguuuguauacauaaacauuuggaaacuacugacucaguaggugaggaaaaauauaaacuacuguguguauaaaaggaagacaucaucacuacaguguaauaagcagcccaaagagcagguaaaacaacacauacauguuaucugucacacuauggugaugcucagugugcccagccuggucuacacagugaguuccaggacagccagggcuacaaagagaaacccugucucgaaaaacaaaacaaaacaaacaaacaaacaaaaaguaugcacaccacacucugcccgugauaccauuucugacaaggugugaaaggcagcuuuuaaagauuaauuuauauugagaagucuuacaagugacuuccuaugaugacuguuaauauugagugucuaguuuuguuccauugcuguguugaggauuaaaucaaacucggguccugacuccugccaggccagugcucugcugcugauccacaccccagcauaaggucaauguuuuuggagaugauuaauaauaaaagaaaaaaauagugguuguguguguguaaucuugauacuugcaagguugaggaagaagaauuuuaaauucaaaucuagugcggguuacucagggagauccugcgucaaacaaaaacccacagcauuuugguaggguuggugggugccuucccucacaaggucuggggcuggaaaggcggacucuugacuuagugucauaaguggacuguuugaacagaccaggcaugccuggggaugaagcaggaaugacucacagacaacagcugcgucacuauaaccccagccuaggcuauaucucacaaagcagggaaaccuggagcacacuguacucucaacagacuggagaguguccuuuccaugugccucaguuggucuaaaccucuuccaggcagcucaccugguuccugccucuuccaggucugcucuuugcagccuccugcccucugagaagggcucuuagcuuugauugcuugcucucacaaggaguuaccuagugaauccaguuaguuucagggaucccugaaaguauuuggaguuuugguuuauuuuuugcuuuuugagacagguuucucuuugaagcccucccuggcuguccuggaacuugcucuguagaccagggugaccuugaagccugagaucugccugccccugucucccaauguguuagaauuauacuguuuuguauugugacauuuacaugagaucauggugauaaacaaaaaagggaaggcuacgguuuaacaguuauguguuugccaaguagaugggggucugugguguggcaccaucacccagccuucugcagauuucuacuuacgcucccuccugguuccucucccuugagggcagaccguaaggucucugguucuaguauccaggaacaucuugaguggggacguucuuuuaccugucccgaauauagucacacaucuuguugacuugggguccgagcugucuucuugagcuauggauuuguuauaccuugucugaccuguaaaccugacccuccugccucugucuuuucaguagugggauuacucuuggcacagacaccuggaucugacaccucuuugucucuaguuucucucuuccuucuuuguccguuggaaaaaaaaaaaaccagacuuaccuuucugugcuugcuuucugacacucagugacuuaucacuccugggucagagucaguaaguguuagaaucaacgucugugaauuacugaaggcacgaugcauucaguauauguaguccaggcugaccucaaauccccuuuggagccaaagauggccuugcacuccugauuuuucugcccagguucacagguguguuccaccacacccgguuauggugugugucugucuauagcuguuuugaauccucuuugagguggggaagaggagggacagagguuaacacaccuuccgacacuuccaccccuguguuugacagagucugcagaagguuacagaugugaacgcuguggaaagguguuuaccuacaaauacuacagagauaagcaccugaaguacacgcccuguguggacaagggggacaggaaguuuccguguucucucugccaaagauccuuugaaaagcgcgaccgccuccggauccauauucuucacguccaugagaggcaccggcccuaccuggugagcaguugcugguuugaugucuuccuaguguguuuuuacacucccuugucgugaacacacagagagggguucaugggacugacuagaacauucaaugcuugccgugccgggguaguguggaagacgccaaugugugagcgugagcgaaugugcccaggaagaagcagggaacagacguaggagugggcgaggacaguucagccuuggggcgaacacagccgugagcuguacuggaagcugggaagagauuaggugacuguacuuuguuccacacccggucaggcucuagauagucacuggugcagaagaaacacugacaugguccaaagaauggaaggcuacaucacagucuguguucuuucuuuuuuuuuuuuuaagauuuauuuauuuauuauauguaaguacacuguagcuccagaagagggcgucagaucuuguuacagaugguugugagccaccauaugguugcugggauuugaacucuggaccuuuggaagaacagucgggugcucuuacccacugagccaucucaccagccccgcagucuguguucuuuaugaggaugagagacgacagugaugacaggaagcuguucucugccagcccagacacccauugcucugccaggcuuggucaaaagggcaaaaccaaguuuguccuuaaaagacaagauggaguucuguguuuuguuacaguguuuauaguucuguguacaugugugcguugugcaugugugaguagagugccccugagaggacagaaguggccaccagagccccuggauuugggguugcagaugguugugagccaccaugguugugcuggaaacugaagugcaguucaugcauuuagccaccaggucggcucgccagcuccuugucauacauagacucuuauaguacaucuuauacuaguguuacacuaguguauaauaugcagcgucauaugccagugcuaacauuuauaguuuuccacauuuuaauaucucuaaauugaucuguguucuacaacugggccauaguuuuuuucuuuuuuuuuuucuuucuuguuuuuguuuuaauguuuuuaaaaucaggggguuuuuuuuuguuuuguuuuuuguuuucuuugguaaaggauacauuuauuuuuauuuuauguguuuugcaugcaugaaugcacaccauguacauucaguugcuuacagagaccagaagaaggcaucaggucccuuggaacuagaguugcuacugacagucaguugugagucaccaucuggaugcggggaaccaaacguggguccucagcuagaacagcaauugcucuucagucagcucuccaggcccuaaauucuggguugcuuguuuguuuguuguuguuguuguuguuaccuaauuuauguggugguguguauguguguauuguuguuguuguacauaucuguguauaccucuuuggagucuuuccucuuuaucacuuucugccauaguuuuuugagaaagggucugucuuagucaggguuucuauuccugcacaaacaucaugaccaagaagcaaguuggggaggaaaggguuuauucggcuuacacuuccauacugcuguucaucaccaaggaagucaggacuggaacucaagcaggucagaaagcaggagcugaugcagaggccauggagggauguucuuuacuggcuugccuccccuggcuugcucagccugcucucuuauagaucccaagacuaccagcccagagauggucccacccacaaggggccuuucccccuugaucacuaauugagaaaaugccugacaguuguaucucauggaggcauuuccucaacugaagcuccuuucucugugguaacuccagcugugucaaguugacacaaaacuagccaguacagggucuuucacuaaagcuggaguuaggcuggcagucuacaaaccccagcaauccucuugucucuccuucccagagcccuggggugcaagucgugguuggccgugcuugcuuuuuaauuaaauggcugcuggggguugaauacaggucaugcuuuugcauccacugagccacccacccagccaucggaaagugcuugggucccuucucucuaguuuacaaggucauuuauuuugucccucauaguaacaaaagcucugcuuaacccuggguuuaaaaucucuccugaacacaagcagcaccuauccaccgaagcugcuccaagagugccucacccugaauuucuugugugcuuucccuaacagucauguccagagaguucaugagguuuuuuguuuguuuuaaaguuaauauuucacaagaagaagacucaagagaaacagacauacagaacauuggauaucugguuuaguuacaguuugggugcuagugguugaacaauuggaacaucugcugaacaagugcucgaccacugagcgacagccauggacucacaccaaaagaugcaggguacacacuugacgauuccauccugccagugugggagcucuguagucccuuugcuuaggaaggucugaggcagcuucuagguugcuugcacucuguaaucucaggcaauccuuggccagcgacuuguugauccacagaugugcauagaauaaagaaaaugauucucggacugucaguauggcucuuguguuauaaugcuugcccugaaagguugacaaccugaguuucuuucugcgaacaaacucaggaaucaacagacuuugaaguguuuuucugaugauuaucacacauuugccuuucucuaaacagacaaguaaacaaauuagggauuuuucaaaaacuucucucacccccaggaaaauauauguugagacagaguuuggggugggguggagaugaaauuucaacucuacguuuuguuaucuccuuaguguucaaccugugggaaaaguuuuucucagucuuccagccugaacaagcacaugagaguccacucuggagacaggccauaccagugcguguacuguacaaagguaggugagacguccuuuggugccagccugacuucaugauugggugacuaauucaucuuggguaacuaguccauuaccaaucagccaauaccuuuuucuaggaauucuggaucagccaggacuacagacugaaaccauguuucaaaaugaaacagaaacuuuuuuuuuuuuuuuuugguuuuucuagacaggguuucucuguauagcccuggcuguccuggagcucacuuuguagaccaggcuggccucuaacucagaaauccgccugccucugccucccgagugcugggauuaaaggcgugcgccaccacgcccuuaaagaaacuuuuuaaaaagagaauuuaagagcacagcccuagccgcuuucagccccggccuuugaugcuaaccuggcuaugugaccuugagcaaauccauuaguuuuuuguaguuuucucuuugguaaaauguggggaauuguaguuguugggcucuaucaguuggucuuuauaaaacuucucauugugucugcugauuguaaccauugaaguauuggcuacuccugcugcugauaaucauucuaaaaggacauuugugaggguggcaucugauucaugcacuguagaacauccaucaacagaggcagaguggaauuaaggcuuuuuugaaaaagacgaugguuuggucauguuuaagaauauucuaggggcuggcgagauggcucagugguuaagagcacugacugcucuuccaaagguccugaguucaaaucucagcaaccacaugguggcucacaaccauccguaaugagaucugacacccucuucuggugcaucugaagacagcuacaguguauuaaugaauaauaauaaauaaaucuuuaaaaaaaaaagaauauucuaagaauauucaagcauuuuacuuuggugauguccagugcuguccgguuuguagcuauuuccauauguggcuguuugagagcacagaagagaaaagacccaggcacagugaagcuuggcugccaugucaccuuguugcuuuuguuuuuugagacaggauuuuuuuuuuuucauauaacccugacugucuuggaacucacucuguaaauuaggcuuagccuugaacucacagagguccacaugccucugccucccaaguguugggcuuaaaaguguguaccacagaugucugucaaaauuagaguuucucaaucaaaacaauaaaagcugauguguccauuacaaugaaaauuaaccccuuugcugaguugcagcccauggaaguuggcuuuuucugcuuucugcccucugcagaaguucacugccuccagcauacuccgaacacacaucagacagcacucaggagagaagcccuucaagugcaagcauugugguaaagccuuugcaucucaugcugcccacgacagccacguccggcgcucacacaaggacaauggccguagcuccugcgauauuugugggaaaggcuuccuggaucaagaggcuuucuaugcccacaugaggcuucauaaaaccugcuaggucuuugaaagcaaagccaguuacaaaccaagaacgcugacucucauuccugcuuugucugugucgcgugggcaugguugaaguguucagugagaaucuggagaauggaguaguugaucugaagcuccaaaccuuauggaauccauucagaccaggagugagaauaaaguccugggucuugugauuaaagaagaaaagguucccccucuccugucugccuugaacaccccguuauacggugucuguagccagcgacuaugugcaugaguguucgccgcgggcauguuucugugcugcaugcguguggaggcccaaggaagacaucagauccucuggggcuguauuuacggauaguuguaagccacuguguggguaccgggaauugaacccagguccucugcuagugcugcuaggacuuaacugcuaaaccaucucaccagcuccugcuuucuauuugguuuugguggugguguuuuggucucucucucuuucucucccacccccaagcuggcuuuaaauuuguccuauagcugaaaaugaccuugaauuacaggauuaaguuaccacagccaagcaauuugcacuaccuagagauuugguauguuauaacuaagucuucugccguguauuaguguuccaucuuaauuugagcucauuucucuccucacugagcaaugaaaaugccagguaauacaccuaguaucagaaagaaucauuuccagggcaggaagacuggcaauucuuguugaugucuaacuuuuaccaacagagaaggaaaauuauaucugaauaaagacaggcugaaaauaaacacuuaugcuacucugguuuua

SEQ ID NO: 69 - RNA, 25220 nt, Mus musculus
uuuuuuuuuuuuuucucgggccgccccggcggcugcguacuggcugugggaugggaagugaagccccagcgagcggcugcggcggggcugugcggagcagccagcgggaggcggcggcgcggcggugagcagccgagagcucggagcggggcggaggaagcaccugcaggcacaggcggcggcuccaccauggcgauucgcaagaagagcaacaagaacccgccgcugcugagccacgaauucuugcugcagaaucacgcggacaucgucuccugccuggcgaugcuuuuccugcuggggcuuauguucgaggugagcccuccuucccggaccccggaccccuggccaggcccgccgacccuagcguacccggccggagcugcgcagccccccgcggcccugcagcccuggcccgguccggcccgccgcccccucccgcgccgcgcaguuccugcuucccgcgaaggguuacguggcagccggcgaggggccggcggggguggcgggcgcggccgugcuggcccugcgcgaugggcggacccggggccggggcagcggggccggaugacuaacagggaccccugcucgaccccgacccacggccucggccgcugccugcgcggagggcgaggaccggguguucgaacccgguggcccccugcccgccgacggccgcucguccaacuuuccgccugggcucuggacucuggguucccggagcaucgggucugaucccgaugcgaggcucgcaacagcuguguugaggaguugagcgauuuccuuucuugaagcagaggcgaugagacugucaggaguguguaaauucucuucccacagaucugaguauuuugaugacuuauuuaacagcuguugaauguggguaauaaaguuugcaaggugaaccuguaacauccuacggguuuuuuuuuuuuuuccaccuuccucaguacuuccgcccacuccccucccccuuccauuuuuuuuuuuuuuaucuguaagccacugagucucauuaaauauauugauauauugaugauuaccauuuugucuccucucucccuggcauguaaccuagugaggauaaauauuuugucauccauuuuuacuagucuuuuuccgcugugaagaaucgagcuuuaaagguuugaguugaaagcaaggaacuaaugaaaugagacagccagugaugaaaagugauuacgauuuuguuuuuuguuuuccauggagccaauuuggugucauuagauaauuuucuauguuauaugauguuuuuucucuuccaaaagucuuuucugaaucuacauguaaguacuucuuguucuugauagugucacagaugguuguagccacuuaacuaaggaggguugcagggugaagggcaaauagaacuagucagaacgcuuacuagauaacccaacucagauacgcuguucauccucccuuacaucgcuuguacaggccucacagcugccguuugaggaaucagguaauucggcuuagagaaguuugacaguauuauaugagugggugguauuuacauaucuaggguuugauuguggcccuguaguaaaugcuugcuuugauuauugguuguagcgugaaucuaggaguuuuauggcugaccuguaccucgagucuuuagugcuuggugcucuauugcuucugcguggcucagaaguauggcucuggguucaguuauaagcaacauacacaauguauguuuguaaucucugaauuugugaaaacuguuuucuugcuauaguauuaaagguaccucauggacguggccaguaggcauuugucaccauaugcaggagaguugugaauucaaauccaguggcaacuacauagugaauucuagcucugaagaccacugcucaccuccgcuucucauccugacagccccugccuucagaggugugcugaucugcugagcauacucacaggcuguaagggaaggaaaauugacagcagaagucuggacacuuagaaaugccacaaccucaguuuuuauauaaacuucugcccuauuuuucuaggauggucacuauuacauuagugacuuuuuuuuuuuuuuuuuuuggagguagagacuuuuuguguuguccuggcuauccugaaauuuauuaauguagaccagguuggccucaaacucacaagaaccaccugccucugccuucugugugccggauuaaagguuucugacaguaaguggaugcuuuaaugcuaacuagaagcuuuuaaaucacuccagaaaggugugcuguuaaaauggugagccgagcagagcagcucgugcaggucacuuauucuccuugaccauaugguaacgacgcacgcucgucguucaggggcaggagaaacugacagcgugggcuuuggugugugacuuugaaaauaauugcuacuuaaucucagucuaacuuagaaguacagcgugccugugugcugaaauaagagcgaggaugguauuuuguggaacuacuaagccuuuuguggacgaauacugaggaaauauuagaggcuuugugguaaauaaauaaauuagguguguuaccagccaaacagucaagcgcuugggaauacucuagaagccugcacucuguagcugauucaaguuagggaauaugcgaacuugaguuuccuucugucuaaauggguuauccaaagacuuuaaguuaacugaucugcauauugccucucucaguuuauggcuaguccuuaguaguucauccagguuggaaaacagaugacaaaaguuuuagugacugugugugugugugucugucugucugucugucucucucucccucucucaagguugaggaagaaguaaucuguuugagggaaauauuugacuuuaaaaacuuuaugauacaaaucuuguaaauaauguuuucuuuucacagucaguguugucuucagaaugcaaaaauacuaauagugguuuuguauuuaaaguaggaaaaauugaacaauaaaaaaagauguaagaguacucuggaagcuugcuaggagggauaauauggaagaguaaaaagagguucacagacuaguucugaaaggagggccugugggagguuggccaggggucugcaggaauacacagggaucuaacuuuauaucuagauuuacgugugcacacuugcacacacagaccuuugcaccauagcacauguguagagaucagagcacuuacgggagucaggucucuucucucaacauauguguucuaggguugaacucagaucagcagguaugacagcagggaccuuucuccacugacccacauguuuuauugcuguuuguuuuuaguuuuuauuuuaaauuuucuacauguauggauguuuuaccugcaugcaugucugugcacagcuugugugccuggugcccuggaggucagaagagggucucagggccucuggacaguuagacaguugggaacugccaugugagugcuaggaaucaaaccuggauccucuggaaaggcagcaaguacucuuaaccacuaaucccgcaaguuuucuuuuuaaacagagcuucucuuaauggcauuucuguaugucuugaaaaaaaauuuauagaaacuaauggaaaaguggaauuugauagaaauucauuuacccuucaugaauccaguguauacaguaaucaugccuaccucuaacaguacagaauaugucucaucuuuauaacaucagacaccaagccuccaaaugauagccacucaaaaaaaaaaaaaaacccacugaaauuuuaugacuuuucauaugaagacuuggaucucucauuaaauguaguaaccuauguaagauauaucuaaauuaauuucacuuuuuucuuucuuaaaaguagauaguagauaaaugucccaaagggcuauuuuugcuuuuuggugcagugagcgucagggugguauguuuagaguaugaaccaaugagcccuacugcuaacuugccgaaugcagcauugcuggaugaaaggugacguuuggggaagugggaagggcaagaagguugauuuccucuauacauucuucugugaguauagguccuauuuuuuucuccucucuuccugccuaaugucacaugcuaagccagcuagaagccagaucuuaauuuuauuuagaagccuugcauaaaaggguaauuuaauuuuuguugugauuagaaguugguacuaucuuuaucuuucaagauuuacauuugcuguguauaaaggaaaacaaaguuuucccuagccauggaugacuucauauuauaaacuggcaguguggauuuggaggcagcagaagagacagagcacaucugcaagcaagcauccauccacauccaucugauagccaccacacacacacacacacacacacacacacacacacgagccugaagccagcucugaggaggcuuuguucauccaguguguucagggaaucaaacuuaaguuggcagccuugaggcaagugcccuuaaccuccaagccuucuugucagccccacaaaucucaccuuaaauccuuuuguaaccuuguauagacagacagacagacagacagacuucucauuagaccguguaugcaugugggggucagaaggcaaccuacaagaguuggcuuucuccuuccagcacaggaaucccagagacugaauuugagugccaggccccccccccuccccaccaaccaaguuuuaaugcaguauccuucuguucaucugaucuucaucucccuguggacuaacucacuguagugaccauauuuuagauauguuuggguuucuuuuuguguuguuuuuuuguuuuguuuuguuuuucaucauaggcccugauuuaucucuagaucgugaauuccaggauagcagaguucaggcccagccuacacaagccuccucccccgacaccucguuucccgcuguucuuuugccaguugucuagcuagccggcauuguuggugaaucuuugccucuuuccuuuccuccaguguauucacuuguugcuucgccuuucuucguaaaaccuuuccuugacuaaaggacaucuacugcgccuuaugcucgggaaccauguucaauaccccaggagugccuccacacauuuuacuacaccacacuguauguucugugaguuugcuauacauaauguccaugcugcuuuaauaaaccaauauuaggaaagacuaacaguaauaacguauaacaguuacacuccgguaccgggucuaugaagccagcuccugcguucagcuuuacgaugaugugaggugagaugaaguaaggcuguaggcagguguuggccuacagugucaagguuaccacgacacaagcacugcccuggcgguucaucugacagccacgcagcuucuaacaguggugccuacagcucgagagcucugaaccgagcugauugauguucuggugagagagagugagacugcacagguuucgucacaugucucccuguaacgcaguguaagccugaccuuccugucacagaguugcccaugcuuucaagggugacugaaggguucugggaaaguagucacccacguguugacagucacacauuacguuuuuuaccucagacaucaucugcagucuuuguacuugucuuggccagcugcuuucccagugaggccuauguaauccuccucaugcagggccccauuacccuuacagggaacacuacauacccccauacacauucgugcucagggaauacauguuuuaucagauauaagcuggcgugggaguucagcccuggaaugcuaggauuucggagucugggggaagaagauuuuagcucuagguuagcuguaacuacuugucacauaccucaaguguguguguguguauguguguaugcgugcgcgugcaugcauguauagaggguggguggauggaucuucauucuuauccauucccccuucauuccuccauauauagauuucuucauucacaugaguaagacaguuccaucauugacucaugacaaauuacagucaaacaaauggauugcaugcuuagagcugagucccaucugcaaagcaucccauggcauauaugcagauacuccagaauuuaaagacaaaacaaaucuuacguguguguguguguauguguguguguguguguauaagggagagcuaaccugugcuacucuuauuggccgaagaggaagcacucgagaccacucuucaauacaucuuuccaugguuuccucuuucuggcuguguauuuaucccccacccccggaacuaucuguuagcccugcacaaacucguucuuccaguccucaaagcagcagcaucgcuaagaggguucaauaccaucucgugacuuuggauuucaguccucacagugugaucucucuccccguuauggacguccauuucacucuccucaucauaccuaugaagacaacuuuguaaacccgccugcauuugaagcauuuccuccuuggcuucggggaugccaggcucuucauuaucuaucaucaccaacauuucuuuuuaguuucagauaccacuggcuuucccagauuuucaguuuggggagucagagcguugugaauuguccccacugcuuuaggucuguggcaaagugaggcugcugauggaacagcagcuguucucgcuaugucacaaacaagcagggaacgugaagaggacagagaguguugucucacaggcucacuugaggccugacccaagugaccagccagcucucacuagguuccaugaaguaaagguuguaguagugcaugggcugggugggggccaacuguggacacugggccuuuaggagaugcuuccccaaagcaugacaggcacuugagcuauggcuucuaucuguccucucugacacugcacacuggcggaaauuucccacaguucaacuugcauccauaaauaguaauucccaagucuuccucuaagcccucccugcuggguucuuuauugaauacaagccaccugcagcccuuuccaaccauguaucuagagaaaucucaacccgugaugagucucuccuuuguggucuugugucucacaguuuuacuagugucugucaccucauugcacaagccugagcaccguaagugaugugggacuccuuucuuuugcuuaucaagccaugcucagccuugaaaguuccucuaguccaccaccacuauccaagugcccuucaugggaugucuugaaagagucuugucuugcguguuugcucuaugguauucuaucuuccacuuauucuguaacacugaugaauuguguaguauuuucuaggugccgugcuggguucgucuuuaaaauuauauugguauucaucaacuguccugcauggaggucagaagacgaccuacaagagucgguucucccucuaccacguagccuccugagauugaacccacgggcccuuguugacugagccaucucgccagcuucccuauacuaggucugggcauacagugacaggaugcuguagcacagccccuccuaagauagcacuuacuucaugauagguaugauaaaggucagugcaguccuaccauaaugugugacuugacgaagaggagcacucuuccuaagguagucugauaaaggaacugcccacucugggaagacagggaagaugcccuugaaagaugugauggaucugagcucuaaacggagaagacuuuccaacaaagaaagacucuggcagggggcagaaaguagaugugaccguuggagauacaagugcagaccacacuauccuaggaagacaagaacccaaggaaagaaucuugggagguagagcagggaacauggccaugcaguuggaagaugauuguggcagcuguguggagacuccaacggaccuauuggguuguaccuggcaggcuuacaaaagaugaaacagccccuccuuaaagccuugcaggcauacugaagcagcucaguacuauuugucugcuucugcugauccugauguguguuauaccugaccuuaaauuuaccuuguuucuaccucugcugccuucuucauccccucgugcaccuugggaacuucaaacuagaucuugcaccccagcuucaagaagcauuuccuaccccaaggaaaagcaaagcacguagagcccuucauccugaggaucugaggguaggccgcccuucauccugaggaucuguaggguaggcuguuggcacagacccugcaguguuugaacaguuugucuaccaguccugacaaaacccagcuucuuaucaaggauuaguuaauucacuuguauuugagccuuucuggugcaucacuguccuugguaccuguaaaugcuuaguaaacauuccaucuuuggguucugaccacuuuacuaugaccaguagccaaguuaaagaaauauuuacugcccgauuaaccagacgugcucgugggagaaagaugaacacacagacacugcaugugauccaucucuuacaccaguucugcuuccuuuuauuaauuuauauagcauuuuccuugcugggaacuucauggugauuguucuguaacagagaauggcuauuuugagaaauuauugcuuacuggaucaacugaagcuaucucuuuuugguggggggauuaacaguacagaugaguuacauggucuaaacuauagaaaacacagaaagacucuucaaugaauuacccaccagacucuacuuaugaucagaagucuccacugugccuacccaaugggccacagaaaaggggaccuucuuaaaacugggggcagacuuuguaaucuuuuugccuuggugcguucauuugggagagagucacaguuaacaucuuucuugcuuucucucuccagguaacagcaaaaggagccaucaucuuuguugcucuucaguauaauguuacccgcccugcaacagguagguguuaguuagaugugcagcugaacggguuuagaaggaucuguggacacuggagucuauauuaauuccuaguguccagacuuuauccuaagcaguguaugaaaccuaguuuucuguguuuauuguuuauuauguauuuugugcauggucuugaaaucccaucagagaauucuucguauugcuccucauuuagguuguuguacaaucaggguuuccacaggggcgguguuucaccgcaggcuuucugcaccaggaauauaagcucgucagacccauucuucucauuuuuguugaacucuaccucuagcaaguauuuugacuagagaacauacuaguaaacucuaggaaauaucagauaauugugucuaaacuauacuuuuauuuuagaaaauuguauuuccaaauuaugcuauguaaaaaguaaguagccaugcaaaguuggcuacggcugacugucauaagcaagagagaagaugcuugcuucaggaaauugggaaugucugacaguaaccugcccugggguccccaccuuggugggagagcagagggacaggcccuauuuguucuauuguuuguaguuuuauaaaugcuugauuuagugacagaaaacagaggggguacuugacaugccaaggugaugguguucuuaccuaaaugucccuaagcaaaccccacacuccaagaacaguugucaacaacucagaaauacuaauauuugcuuugagaaauuaaaucaaauuaaaaaacugcaauaacuuuuaaguaguaguugcaucucucuagugcuuagagaucagagccaagccauauauaaguuaacuuggcuuccaccaagcaucauaauggaugguccaguuugcacauccagccagggccugcagaggcuccagagaagacaagagaguagccuagacaaggcugguagagcguggcuccuuccccuguuuuuugguuucugguggccgugacuaacaugugucaagucuuuuguaaguaaacccugaagcuuuggguuguagaaagccucuuugguugucauuucccuuugacccgagacccucggggagacuugucuaggggaucucuguagaaccuuuacugaguuauucaccucuuguuuguuuccauaacuauguuguaccgagugcuguuuucauacucucacguauauuuuuguguguauguguguguguccuuuuggccuucagaagaacaagcuacugaaucagcaucccuauaucacuaugguaucaaagacuuggcuacaguuuuguucuacaugcuaguggcgauaauuauucaugccauaauucaggaguauguguuggauguaaguauacaaucucagaaaucccuauuuuguaaacacuccuaguucuccaucugcugaucuccauauauuaaguguguuuuguauuuguccauuauuccuaacaacugcuuuuauuuuuagaaaauuaaccgacggaugcacuucuccaaaacgaagcacagcaaguuuaacgagucuggucagcucagugcauucuaccuuuuugccuguguguggggcacguucauucucaucuccguaaguguggccuuggccguuguucuuaccuccuguuugacacuaagaccucugcucaugaacgagcgcgcugacuguuucagaagccucacgucuuuaggcaugggaugccaucacuaugucuugucguggcuuguagaucucucuguucacaaagaggaucucaggucagcaaugagcuugccuagguuagguaagcaugaguguuguuagucauuuccucccugaucgcuccagcuucucccaacuuaaauguauaaauguuuaaguauagcagucaaccuuuaggucuuuuuaaugagaggaaagacaguauccacauuaucauuaaguaacagcacuuuccauucauaucccauugcauggcuuuauacacuuuugagauuguuaagcacauaauucuuuuaagucauuaugguggagaucaauaacagacaaaguaagauggccagaaucuaacuguuaaugucagagauauuaaaacucagcuuuccaguccugugcccaucccaucuuacugauguaagagucaaaagggaaaugucagcuuaguguguguguguguguguguguguguguguguguguguacacuauaaauguuguaugugugcuuuaauguaagaguuagcaguagucuucuuagaggcaucacuuaggguuuggagggaguuuuuguuucguagguugguuuuguuuuuuuuguuuuuuuuuuuuugagauaggguuucucuguguagcccuggcuguccuggaacucacuuuguagaccaggcuggccuccaacucagaaauccaccugccucugccucccgagugcugggauuaaagacaugcgccaccacugcccagcuuggagggaguuuuuccuuuguuucuuguaauguucaccaaacacaucuagauuucugaggagaagauuugcauagcauuguacgaauuugcaucauugugaacuucugucaagaacaguuuucaguucgcuguuagauguaacaaaauguacccuuccagagcuggucugcuccugccaugcucuucugucaggggccuagcguuuguugccugugcugccuugcaccuggacgcagggcuacuguaccauacuggaaagcuggguauuguauuuuacuugguuuuacgucucucgcucauuuucacuuugcuaaccuaagcaagucaaaugacauuggacaaacuaaagcauuugauugccgcaugcucucuggaaccuuuuaugaggagcuauaaauauuugcacgguacucacaaauaauuguccugucuccuaggaaaacuauaucucagacccaacuauccuguggagagccuauccccauaaccugaugacguaaguuauguccccccacaggccuuucuuagcuaaagacuguucauuucacagacagcucgaauccacugugugguucucccucuggacuugaugagguggugcguugccugcagccuaggacaguggcaucacccuguccuaaggaaaaagagaggagugcugcuccugucuaucuccguuaccuuuaccaacuugagacaagugauuuuaacacauuuuuaaagagaguauuuuauaaugugugacuguuuugucugcacauacguauguguaccucugugugccuggugccagagaaagugggagaaggcuucagaucccccugggcuggaguuuggaaugguuguaacccaccaugagggcucaagcccagguccucuguaguugcagugugugcccauaagugcgcagcccccgguucucacgauuuuaauugguguucucuuccccuccugcaccuguauccuuccccguugucggcaugucugcaucuccgugguuucugucuuuucuuuccauauuccuucauuucugcucuguucugucagacuccuaagacagggguucuuuuucuucuugcuugcaaccuggaugucuguacauugcuucugggagcuccuugucagaaggaaacaguucccucguaauccuauuguaagagaaucuuccuugcugcuuugccuugcacccaguguugccuguucgguuuauauuuauguagcaucuaaacgauuucggauguucucuaucgucccaugugugugagcccugcuuugugcucuuacccaucgagacuucuguccuccuaucaacauuggagcugucucuuuuuuuauucuuucugcuugggaagguauggauaccuagauaguacucacugaauacuugguggucuaaaaacaagagaaaaauucacaaaggaagggagucaugugaccauaaacacaccugucuuaaagccagcagugcuauaucaucucccuuucugagucauacuuacaugcagcuguguaccuucuagaaauggugucagcuuggcuuuuccacuuuccacucagagggaagagggaggagaugguaaggcagaagaggcagaggugcaugguguucagaggagacacggagccugacuaagaccgucucccgcgagcccucccugucucagcccugacuucccugccucugccuccauuuguuuguguucucccauguugcagcccagaggaaguaauaucucacuaaagaaaauauugcccauuuccagugaugcauugagccauugcuuugcccuggcuccuccccuuuuaccacguauuccuuguaacacuggguggacuuuuugccccaucucccuguugaugaagccuugucgaucugugggucucuguucagccuuagguaacugacaaacaacguguugugcaugcuguggcucugcccuuuggugcgaugccacuguugacugagugguggggaaaccgggcaaggcuccccuaaagugggcggcacguuguaugaggugacugcaacagcuuggccaccucuucucuccugccuucuggcacugcuuugguuuuugguuguuguugucuuuguuuuguuuucaaugcuauucuuugagagagcuuucccuuucucacucagauuucagacgaaguuuuucuacaucucccagcuggcguacuggcuccaugcauucccugaacucuacuuccagaaaaccaaaaaaguaagccggauuucuauuauugugauuuuuaacuuuaaagaauugucuugucgcugggcagugguggugcaggccuuuaaucccagcacucgggagacagaggcagguggaucucugccuuugaggccagccuggucuacagggugaguuccaguacagccagagcuacacagaaacccugucuugaaaacauaaaaaaaagaaagaaagaaagcaaaagcaaacaaacggucugagugugcaugugcccuuggucugagcucuauuucuguguucucaaccccccucccccuucgaaaccuaaaacucucaacuauuucuuuaaaaaaaaaaaaaaaaaaagcacuucugauucuguuuuagcaugcugauugcucguuuuuaaauuagugguaauuuaaauuaaaacuuaaccaagaucuuuaagaaugguguuaguuuccucuuacugguuuucuucuagcaauuuauuucaccaguaacuaguuggguuucaacuagcaguucaauauauaagucuaaaagaagaaaucuguguugacaaaaaaguagauggcaguuaagauuuuacccuuccugagguggguggguggagcaggcaucuuuuagccugugggagaggccugugcccggagaaguacauaaacuacuggggcgcuccgugcccccuuaagaaucuggccugcccugccgacagcuacuguaacugcuacuguuccuuccccuggcuccucagaagcugcccagcugcgagcgccugccugccugccugcgggggugggggggaggggcguggggggaggggguggggguggauggggggaagauggggggagggcgcacuccccucuguaaucuccccucuccguucuguacacuuugccuuauacuucacgcuuaacuucuucucucaggauuaccucccccaccccgcaauaaauuaaucaaauaucuuuauuuuuguguagcucuaguuuaauaauaguuuaauaauaauuuaggauguacuugaaaguaaugucagggaaggauaaacggcuugggguccagacgagacaguuucugucauugauuaacaacugagcggaaguuacagcugcacacggguucauuuuacuuuuuguugguuguaugcuugcuuauccacguuugccacggguagaagguuuggucuucgagaaguuuuccuaaguggcauuaugacauccauuuacugacagacagauuucucucuucccucccaaagugcacagauagucuuuacaagccuguagugcagauaggcccuuugcccucuguucugccaggcuuagcaaacagcuccgagggagaagccacguacucuggcgcaugccagagagaggaacgcuuuugcaguugaucagauaagguaaggugagggcacucgguuuuggaaugucugaaaauugauuagacccacaguuuccugcagcucuucccugucuggugagcuccuuguguggaaccugggucucgggcugugcugugcaaaauaggagcugccggccacugguaaagacguuaaguaccaacacagucuuacuucguagugacacuggccauguucugugccccuuacccugugacauuaacaacuacucuuuuauauagaagauacacacacacacacacaucuuuaaagaugguuuuucuguguagccccagucuggcuuguagcuccugaucuuccuuccucggucuuuccugacugaggggaagugauaggugugugugcccucauuuguggauaggauaggauuaaaugugugccaccauuuguggauaggauaggauuaccugugugccaccgucuauggauuggacagagauuuagggaacauugguguacuuguuggacaacagucuugagagaaucauaguuucuugaugcucggcuccuggacguggcucagcuacuguaagcuuucuuuaggaauuugcauacccaugggcacaauaccuuuggguuucauuacuaauccaagucuaucccuugugcacugacccuggcgaguguaacgggacuuuucaaagcaguuguucauuuaucuccuaaagcucgcucuuaucaguuccugccagauggcaugucuccacaagugugcucucauuuuuaugggauaauuugcauaacuuagaacuuaaccgaaacuauuuuuaacacuuacacgugacaguugaaaguaacuguuucaaguaauuagcauaauuugaaaguaacagcugcauauguguuaaaucgguucuuaaaauuuacucuaugaaauguauuuuggggagaaaucuuuacugcaagaaacuuagcgcagugacuguuuggcagcagucugacuggcagaggagugaggacgggggaagagcugagcugcgguggaggcaguguuuaguguccugaaugggaauguuuaagucauggaccuucagugucagcacaucuccuuguagcccaggagaagauuggaacugccacuugguagucaggccuugccgugaguaaccacagugccaguacugaagaggcugaggugggagggugguuugggcaaaauaacaugaagcuccaucucagagaggaguccuuccuuagcuaguuugaacuuggcaguuuuaagaaacucuagaaauggucaaauguuuuguugcuggucaucaaauuagcuuugauuacagauaauagaauugauuguuaugucaagugcucagaaauguuuucccauuugugcgccaugugguggggcacaccuuuaaucccagcacccagcgggaggcagaggcaggugaauuucugaguucgaggccagcccgaggccagcccggucuacaaagugaguuccaggauagucagggcuauacacagagaaacccugucucaaaaaaaccaaaaaaaaaagaaagaaaagaaauuuuuucccagcccugcuuguuggcagcuggucaccccucucuagucucggcugcuccccacuacaggcucccuucugauuuccuaaggcuuucugagucuauccuuagaccuggguaaggauuuuaagguggcagugacgcaaguuucuuaagccuugugugccuuucacagacauuuauuaucacucagaguaaucaauguauauuaucccugugcuaugagagcuuuuuaaacucaguuugaguuggacuauaggggaaucuuuacguuucauaggcucacaugucaucauuuguaauaaagcuuguguugucaagaaguguuuucuuaugaaaauagaauuuacaagagcucuuuaauaaaaauauccuggaagaagaaguagaaguuuuggaauucauaauuuaaacauaccaguuagauuuuccacaaaaaugaaaauauccacauuuuaugccaguccacgaauuccuucuuguauaagcuauuauaaguauugagaauauaauagccaggcauggaagcacacacccagaaucacaccacagaacuuucucugaaacacuuauuaaaugacucauuguuauaaguauuuuguguguuaaucguaagcaaaaucucacuguggcuucugguagagaaagguaauacuccuaacaaaaccauagagcaacaggagagaaugugcugagaacacagcacacugcuucucccagcugugucagacuacucugcaguuuccacagcugugaugagccgucuucaggcagguggccuacucgugaguaaccagcaagcugcuucugugagccccuucucagaaagccaguucuacccagcuuucuugguuccuuccuuuuccccacagcagagaccaggggccagacaagagugguugucagccuccucguugagguacucccaaggugacuggggagcccuagggagcuggcccuggugcagugcccugaagcagucauuucccagaugggcuguuucuaauuggccuuauucuuaccugggccacaugcucuccggcuggggguucccuggguucucauaugccuccucgcugcuuuuuuuuuccccccuuggugcuguuuuuaggcuuuugaugcagaguugagcuaacuugucuuguaugaaggccugcugaugcuucguuagcauauuggggaauuaagugcuugagaguguagauuucggcgauggcacuuucucucauuacugucucggucaggugacuaccagaaagggagggccaagaugccaagucaccuggauguaagaaacgcauguggcuuguggcauuaaaagugagagugcuggccguguugcucaccuacgauguguccuuguauuugcaggaagauaucccucgucagcucgucuacauuggccuuuaucucuuucauauugcuggagccuaucuucugaagugaguugauaccuggcucgggucugacuagcagguagcaugcuccuucaucugaguugguaauuacccucucuucuucuuguguucuuucuacagcuugaaccaccugggccuuguccuucuggugcugcacuauuucguugaauuucuuuuccacauuucucgucuauuuuauuuuagugacgagaaguaucagaaaggguaagugcuguccucuccuguuuguucagcggauauuugaagucagugccuagacugucaacgccugugcccuaaagagcucugcaguuuuguuaguaguacauuaaaagaaagcagagccacccuuaacaauagugauacucugggcuggagagaugacucagugguuagagugccuguugcucuugcagaggaccuggguucaauucccagcacccacaugguggcucacagccauccauaacuccaguuccuggggaugcaaugcucuuccuaucuggccuccacaggcaccaggcaucgacaugguucacagacauauauguaggcacaacacccacacauacacauaaauaaauagauaaauaauuuuaaaaacaauguucauagucuauauuuccuuuagaauaguguuucuuagcuggacagauacugcauuggacuuagugcuuguacggcugcaauagcauggcauucuuuugggaaaaugagcgauagagaagaaaacuuuuaggagaaaguaaagggaccggccuggugagaugcucaacagaaaagccugcagaccuagggucguccccagaaucacagaaaggcaugaggagggaaccagaugcacacagcuguccucugaccuccauauggcgugcaugugcccuaccugccccugcagcaugcacaccagaaauaaugaaauugcuuucaaaaggagagaaaauaaagaaauggguaauacaguuuuuuuguuuuuguuuuuucaagacaggguuucucuguauagcccuggcuguccuggaacucagaaauccaguggguaauacagucuuaggauaugaaaagacuuugauagaaaaacucagauggaaaagaaagauuugcaaggugcaaccagccaggcagugguggcacaugccuuuaaucccagcacuugggaggcagaggcaggcggauuucugaguucgaggccaaccuggucuacaaagugaguuccaggacagccagggcuacacagagaaacccugucucgaacaaaaacaaaacaaaacaaaaaagguguaacccguagagagcagugucuguggccucagaaaugggaauggacauuaguuguugauagcagugcuggcuuggccugagcccagccuguuucaguugcuugcauaaguucugaagcccauucccaguacuucacagugagcagaaauaucacaccggugucuacuggaguucuggaaaaccuaaauaggguggccaaugcuguggaccucugacaagaugcuacauuguguaggauuucccaggaauuccaacacagaaauccuuuuugcagaaugagaaaugcuguuuuagggacuagaaagauggcuugguagaaaagugcucacugugcaagcauuagggccuggguucagauaccuagccccauauaaaaagccagguaugggguggcagcaagaguacccuguggcugggcgaaccaggccgccagucggugagcuccaguuucagugacaggcccugucucaguaagguggggauaacugaggaaggcgcccuccaugacccggccuucacaggcucagccacacacaugcacacccguaacacacagcagaagagcuccuugcgugaauacgcauuugcucaggagggaaucuaacuguaauggaaccaucucuucaugguuuucuuacugugacuuugcaugucuuucuuacagguuuucucucugggcaguucuuuuuguuuugggaagacuucugacucuaauucuuucaguucuuacuguugguuuuggucucgcaagagcggagaaucagaagcuggacuuuaguacuggaaacuucaacguguuggccguuagguacgcuuucuuuaccguuccacuguuacucagcaugcuggcagcuucucccugucagcuguaauaagugagggguaacuggggcuggagccuuggugugguuucaugccuguugaugguuucuguccaugugagacaguacuaaagcuuguuuaacuucuaagaugauuuucuuagugaaugauuuuucccuugcauuaagcauuagcgcugggucaucaccaucagaucacaguagaauacuucuacuccgcggcauaaucuaauacagucgaauuuuugugucuguuuuccacgugguuuuuaggaucgcuguucucgcguccauuugcaucacacaagccuucaugauguggaaguucauuaacuuccagcuucggagguggagggaacauucugccuuccaggccccaccugugaaaaggaaaccggccgugaccaaaggcaggucuuccagaaaaggaacagguugguauugacuuaaguccugggagcacagaaguggaggcaugcagaaucuuagcuacggggcuuuugauucccaaagcuuugcuagauaguugcuguacacggagcagugcggugugcagucagccaugacuggcuucaguuggcauaguugaccuuuucuauguauuauguacaugcaucuguauguuguugcccuggggagauuguucuuccaucuuccaugggcuccagggauccaacuugcaaagcagccaauugcugagauagcucgucaaccauagcauaauacuuuuguaaauuacacuuuuauguauggagggugagugagcacaugccaggcugugcauuggacggcagaggacaacgcuugggcagcagcccucucccucgaugggggcggagcucagguugcggcggugccaccgaguaaccagugcucaggcgugugugaacaugccguacuuuaucugcuuggagcacauuuggguggugaagcaagcacacuuuccacaucguugucugcacaccucuuuucuguugucucuuagguauguaucuggugaggaacugcuggguccuuagggagagcacccgacuugcugcugcgugguggcaucguuuuagggagcuacaucuuucucagcuccaugcacaguuguucuugugcuauuugggggaagauuaucuaaccucucugugaugaaguuugagaaaugagucccaacugagcucuggcuucugccagauguauuuaggugccugucacugugcaaauacuguacugccuggcugugguuguguagguagacacucccuugaugugucuguguggcuggguagcucacugccuggcuguuuuucuguggcucuggaagguucuccaguuuucuucuuucucacauuuuggccauuucaggcguggagcguuucugugggagucuugggauccuucuguuagugucugacagaagcaccaagagcucucuuagcucccuuucgucuguaaaugccuugggagcaagagcaugggugucucugcuccuuuauucugcucuuuaaugccuuccaauuaaauuuauauaguuaucagucuaaaugugaguacuuugauuaaauuucucccuaaauauuuuacucuuuuggauucugcugugaaauagaaucauuucuuuaauuucauuuucagauuguacauucauuacaaauguuuauaguguaguugacugugcauagcaaucugguauccugccaucuuugguggacuuagguuuagugaguguggcuucucugggaucuacacaugaaauuagguucugcaccuuccugccaauccagauuuuuuauguugcauugucuugcuaaauuauccugacuugagaaccgguaugggcaugguauaggcguagagacccacaggaauguugggugucuugcucucugccuuucucccuucagacagggucuuuuacugaaucuggagugaaggauggcagccagcaagcccagcauccuccugucccuaccugugggacacaggaguuacagguuccugucuucacagaggcuuccauguggguauggacauaugaacucagucgguccucagguucucacagcaacgacugucugucaccugcagaggcgucacccagcccucucuggauauaaaaugagucucauuccuggcauacacccacauuagggaugggugauauugcaccuuugcuguuuagguuuuugauuauuuaggauuuuuuuuccaucuguguucauauaaaaagauuggccuacaauucgcacuuuuuccccggucuccuugucaguuccaguagcuguauaaaccacauuaaauccgcccacccccuggucagucugcugcuguuugucuguaaguuguuggaggacugaacagugacuccaucucugcagauuuacacugaaagauaaggaaauaagucucaauuuaaucucucccuuucagcaacuugugauuuuuuuuuuucaaggaauuuaugccuguuuuucuugucagucaaaacccuagcguguuagagcuaagauguagcucaggguccaguuuccagcacugagacaaagcaaaagucuuguuaagucuuucuugauuauuuuauuuuuacaucuguuuguuuguuuguuuguuuuugugucuuuacugugucacuuccuacucuugcuuccagccuuaggcuugguuagcucuuuugcaguugggguccccuuguugaggugacuucuggucauggucuucaccauuccuugagaaucagccagaguucaggggaaacuuucucccuuguccugucuuggcuguacuccucgauccuugaguacugcccaauuccaaauauuuguaauuugguuucucuuuggaaccauaacuuuuuugugagucuauuauuugauuuauuagaugucuugucaucuccugcuuguccucugguaucuaaauuacacugggauuuaagacugccuuccgaagaauuccccuucccuaagauuugcugaaaauuacagcucagucuguauccaaguucaaugcaugcuucuuuuguaccccagaggacauaguucucuccuuauggaugugaaacccacaugccccugccuccugagugcugggguugaaggugugugcuacugcagcuggcacccagucauaguucugaggaaugggcugcaggcaccaucagcuguagugguuaccaucccaaauaacuguugcauguuuuaaagaaauaacuuauagggcuuugccaugcaguggaggacagcuccaugucugucgugugagggcugcggugcagucuguauggucuguaagcccuguaaguuggccacaguuccugcccugccccgugcucucuuuuuaauaguacuuacuucccuguaauuugcugcuuaaguccucguucacauuacagaucacaaauuuugccugagaauuuggggcuugguucguaccugcagauauguuguacguaacaguuaguacucccauuugcuuaugccacggacaacaggacaacaccugccuuaucuucucauugcagagaacggugugaacggcacagucacaucaaacggagcagacuccccucggaacaggaaagagaagucuucguaauggaucggaagcugacugauuauuguccccaaagaaucugcuuucugcucuaucuuucagcacuagcaauuuuucuuuucuaaaaauacaguuuaugcucuuugauuucugcuguuguccuguuccugcaucguaaagggcauugaggggaggauaaucacucugagugagaacauuguagcuuagacucagcuaccugccuucagaauaguuuagggaccaccuuucuuuucucuucuuuucuccucuuuucuacccuuuucuuuuuuuuuuucuuuuucuuuuuggguuggguuugguuugguugguuuuguuuuguuuuguuuugcuuugcuuuuuguccuuaaugguuuuuuuuuuuuuuuccuaaugguuuggggagaaaccauuuacaaaccccugcauaaccagugaacauuuuucuugcucucaccaauuuuuuuauaauauuauagcaaggugaccuguucuaagaaggucauauuuuuuaaguugucuucaggguaaaauggaaauacuauaaagucagaugucaaacuuuuaauguuuucaguguucucuaauuuuuaggaauuuuuuguagccuuuacaccugaaaaaaaaauuuguaaaaaucaccaaaauacuugugugcuuuauuuucuaaguuguggcuguacauguuacaucccauucaaaaguacugauggcuacugcaagauuuauugccauccauuggaguaggugucuuauuaacauaaggaagugaaguacuuaggaagugaagugaacuuuuugugcauuuucaacauuuaucaacuggcaaucagaaaauguuuauugugaagaggaauauucaacuuacauagcccuuuuugauauguuaaguaaugauucuuaaugggcuuguuguaaguuugauaugcauagcaucuuaaugagauucuauuuaaccugcaagcccuuuugaaaaguaaugccuacuugauuucuauuaaaaagaaaaagguaccagguaauucuauuugggaaacgaaugcacuaacuuuaaagaaauugaaaauccagguggauagucuuaacagaggcaugcuuuauguuauguuagagcuuuggacccaucuuuaauugagaaacguuuaucuguauaaaacauauuuuuggauaaauauauauauauauauuuguaucuacagaaaggcucugaaaagcauuugaguaaaaucuugguccccuuuucuaugcuuguccucgcacccugcgcuuggucuguccacuguuguucagcacauacaugcuccaucguuucucacucugucaccagcuaaaaaauguccgugccauguugacuauagaagccacaagccucaggccugugguuaaguugccaugcugcuagaaagucaugcuuucucuucuccagccgcuuaccugcuuccugggaaaguagucgcucccuggagcaguaccgacuuucaguggaaccaaauuuccgcccuuaagacuggcauuauauugaacgauacauugagaaaucaaucgaaauaaaaaauuuuuacuuucacaagcuguuuccugaacaauuccuucacuguaauguuuaagcuauuuugaacguauauucucauuaaaguguacuauuaaaagaugag

SEQ ID NO: 70 - RNA, 1096 nt, Mus musculus
acauaucuuuauuauccuacaugggauuagugauguauugcuaucauugcuaaugucuuacugugucuuuuauaaaucaaacuauuauagguauguguuggggccggccugcggcucucauguccggguuugaaccugggaggcaucuuggagcugaaagaaaaggaaucuaggcggaagagagagagaaauggaaccaauacaggauucugaucaaggcucaacuuuaauggcggcagacacacuuuauaaaggagaggggaggcccauucccagucaugccaaguuucuugugaaguugucagaauugccuuuuagcaggaacucacgaaauucacaguuugguguuaacuccggaaaaucuuggagaaaaaucuuggagaaaaucuugguuuggccucaggcagguagcaggcaggggcacaucaaaggaagggaugaaaagcagcacagcggguggcuccgccucagugguugauggucuaaaccagccugucuaggaugaaggagguuacauccccccccuuuaaauaauauuaaacaaaacuggacugaggcauaaaauuuauuuaugcucuauaguccugccugggaguuaugguggcuggcggcucugccugucuuaggaaaucuuagaucuucucgaaucauccuuauccgucauaggaguguacaugcagcuuguguuuauuuuacacaaaacauggcucugugguguauuauuaacagccacggccucuuggcauguaccccugucuuagauugguaugauuccgagaucugggugcccgucauugacugucaggcccucauagcacaccauacucccaauuaagaccaaagccacaauauguacuuagaaugcuucuugauggagauuaauaacugccaccugcgcuguuggaggcaagguuuuacuccugcugcagucaggcugaauguggcugaccugcuugagaaacaaaggugggacagugaaaagcaacaguauaaaagcugcuuugaagaaguccaaguacuccauucaguugcaaauuagcaacaaucaagcucaggcucuggccuccuggugugagggagcuggcuuugagaauua

SEQ ID NO: 71 - RNA, 37219 nt, Mus musculus
ugauuuucucuguuuaggaacacagauacaguuuauuccaaugggaauaauuuuccucauuuaaacaaauacugcauuuccuucuggcuaccacuuucuuuguaagacugagcucacguuucugucagcagccuauuauagaccaccggcuuacacauucuucuuuacucucaacaaacauaacuauauauaucucaucuugauaacaaggacaagagcucgaucaagcccugauguuguuuugcucaccuuuguugcugcaguaucuggcacaguccccaguaaaaagcauuuaauagaugucacagcuuuuauagcucuguugcuaggcuuuuaaaaugacuaauagauuuaguaguuccccauccuuccccuuugagaagaucuacuugcaaugugcacuaucugaaguaugcuguggcaaugugacgacugcauggcuuuuuauuaaaaaaaauuuuuuuuuucaaguuucaaguccugaaauuugcucuguugaccaggccucuaacucaagagauccgccugccucagccucugagugcugggauuaaaggcgugugcugccaccaccuggcuuuucacagauuuuuagcucaaaauguccuuuucaucuucuuccccaacaagagguaacaggcauuucacugguucagaagggaugaugauggcuaggacuaagacuggcuagggguaaugaacucuggagguagaauagggaccacuuggacaugugggaugcacacaaaccaagaaggauuuuuucuuuaaaauuuucuaauuugaucaacugaaugguguuuguauucaacccucugggaaagagcagcuaagagguaagcuaaucuauucauuuaccaaugaaacuaaauucuauaaauuuuauugaugugucaccauuuuuuaguuuuuggugguggcacuguggaaggcaguuauuacugaucacuuuagggacaccacuuggcacugacuaugcuuucagguuuacaguguuuuuguggucagugucaccauucaugcccagaacuuuuuacacucuuacugaaacuugaguaagucugucccuuuuccuccaaaucauucacaauucuuuccuucuauacacuuuccugcuucauguaaguggaauccugauguuugccuuuggugucuuaucucauguagcacugugucuuuggaauucaugcaccaugcaacaucugucaggcaucucuguuuuuaagguguuuuucuuucagcccuguagauaccugcuuaagucaggcuuugggaaugguucucagaagcugaacugcucagacauacugugaguuuguuuuaucuuucagaagcugcucuaucaacugauuguaaaggucccaguuucuuuguaccucaguggcugcucuuuuuauuuucagaaaaaacaaaaaaaaaacaaaacaaaacaacaaaacaguuauccaaaugggcaggaagcuggaaccuguuccaauuuguguuuggcuuuguauugguuaaagaugagaaacaguuuuuuuuuuuguuuuuaaagauuauuuauuuaauuuauguaugugaauccauuguugcucucuucagacacaccagaagagggcaucagaucccauuacagaugguugugagccaccaugugguugcuggaaauugaacucaggaccucuggaagagcagucauugcucucaaccgcggagccaucucucuagcccgagaaacaguuuuucucuuaggcaucuucuuuggagaaacauuuguuguccauuugugaguuaucugggucacuggcuuuuaauucuugaguuuuuaguuauuuuguaguauggaacacuucuggguauaugacauauuuacauggaacaagaaaaaaauguguuuagcuugcauaaaaaugcaucacugaaaagcccacuucagcggguggggugggguggggagguguugccucaggaaaggcaucuuccuggagcucuccucuauuaccuguagacagcucaggaggcuaaagucucuucucuccagcaaucaguauugccgagauaaccuuggggagggaccugcugaauuauuuaaguuucagaaacuuuuuaagacuugugaguuauuuauuuccugagccccauuaaguuucauuuacuucccgagucuuaggagucucccuccaggacggaauguuuuaauuuggaggaaauuacuaugcaguaccacuauucuaaccauuauuugagaauguuauuuauauauuuaaaagacuaucuugccaucuucuaauuaaaagaaaacacuuucuaguauauaauucauauauaaacggauggccauuucuauacuaaaaucuaaaauugcaaagcaugcugucgugggcuggagagaugagauggcucagcaguucugagcaauggcuguucuucuagaggacccaguuugauucuguggacacacauggugacuaacaccuguaacugcaguuccagggaauccagugccccuucuggccucugugcacacugcacacauggagugcacagauacucauguaggcaaaauauucauacacauaaaauaaaauuuuaagaauuacuuauuauuaaucacauaauauuuuaaauuaguauauuuaguauuuguuaaugaucaacuuaugaauugcuuaugggauaccguuacaagaaaauaaacauagcauagaacuguagaaacaauacuuaaaugauauaauugauagaaaagugaaauaaacuugguauguaaaaggcauugacagggcugaagaaaaggaaugcguaugcagauaugugugcuguugauugaaguagcuaaagaaagcaguauuacuggcaaaugcuaacaaauaacuguggugguuugaauagaaacggcccccauagacucauguguuugaaugcuuggcccauagggaguggcacuauuaggagguauggccuuguuggaggaagugugucgcugugggcuugggagagccuccuccaggcugccugcagaagacagucuuguucuggcugccuucagaucaagauguagaacucucagcuccuuuuccagcaccaugucugucugcaggcugccauacuucccaccaugaugauacuggacugaaucucugaacuguaagccagcccuaauuaaaugucuuccuuuauaagagcugccuuagucauuuuuguuuuuuacagcaauagaaacccuaacaaucaaacucuaaaguauuaacugguuugaauuguucaaaaucuauuauucuuaauaaccacuuuacuuaauccauagaaaauugaaaaagugcuagauucugaauuucugguaaaaccuuccaagaccaagguuagaucaguaaccuguccuccagauauaaaauguaauuuacauauuuuacaauuaucacggauuacaaguaucaaggguuauuuucaaaguugugcauuuaauauuuucuauaaauauauaaucuauagcuaaaagaaaauaccaucuucuaaaagcaaaacaagacagaacuucacugaucuguaacuaaaggacggcuuuccauuucuugacaggaguuguuguguagacuagaaaaaaaaaacagaaaguaaaaacaagagauaaguacaucacuggauuccacauuuuuuuauaguaaggaaaagugcaccuuccuuaggcgaaucuuguugaugacuagguaagcaauauggcugaggcuucuacacaaaauucaaccuugggcucacuucuugauuuuaaggacuagacuuuuauaacaaugccugauuugacaagcucaucuaucagcaggaaaaaguuacagaacucccacuuuaccaucucugacuucacuuaaaagcugugccuguucuccacaugccaguacccuugguccccccaggcacugugugucucuauggcagaggacuuggaccuacuucacugaaugggagacuuagggagacuucaggugagcuccugcaaaacuguuuaagugccaggagaaaaggcauuaauauucagaaggauacauacauaucuucccaucuuucucuaguuuucucaaaugaagcaagagauuaugcucugccaucuuauguaaauucucuggaacauccugaaagaaaaacaggauaaaaggagucccauuuuuaaagaauacuuaauuguuuagagccuuuuccagcuuuccuaccacacacaacacccaaguuccccuccagcacacaugaagugggugagcagcacacauggagugggcgagcagcacacauggagugggcgagcagcacacaugaagugggcgagcagcacacaugaagugggcgagcagcacacaggcaaucucaggcucaggaggcgcaggcaggaugugcagacggucaagcucauccuuggccacugcgaguuagaaaccagccugucacaaugagagccugcucagauaagaccaacuucaacaauuucuaccuugcaaauggucuuguuuuagaauacuagucucuuauauuuauauagauaaaauaauuaaaugccacaaauuuuguucacuaucgaauuccuaguguuuagcauacugacacacaguagaaucucauuaauauuuauaaacaagggagcggguauaaagauuucuucucaguuuucaguaaucuuaaauuggcuuuaugcucuuuuggguauuauaaugauaucuuugucucugauucacagcucuccuuuacuuuugcuaaaauaauguaauauugacaugucguuucaauaaagagaaauuuuauuauuuaaauaaggauuauaauucugaaaccaauuuucuugacuaaacucacuuugucuguguccuacuuagcuuuaauugucauggugacacaguccacagacaugugacaggagagcgucaguugaggaacugccuaaaucagacugucccguaggcgugucuguggggauugccuugauuguuaauugaccuagaaggguccagccuacuaugggaggcacggugucuaggcagcuggguucugggcuauauaaaauaagauuguuagcuacagcaguugugccaugguuuccacccuguguucuugcccugauuugccucagugauggacugugacccacagcuauucaccagcuaaguccuucccuacacaaguggcuuucagccagaaugauuuagcacagcaguggauguaaccagaacacugugcuucucagcuuucuggaaauauucugccaggauugucaaguuauaucagucaaaggucaguggauuugucuguuccauuguacaugaagucagcuggcucaauccucuuuuuugaagacccauuuuucuguauuuaucccacuucauuagcauucacaguuuucuugaauauucucccuuagguuuaccuuaaaacauuaauauuugcaaagcgauacugauguuuacaaaggguuguuucauuggcucacgcucucuuuugagacaguucaguccguguuuucacuguuugcaaggcuggccucagacucacucugccuccugaguuccaggacugcaugugucucccuuacacacaugggaauaagcagcggugauuuccaaacuccccugugagcagcacgaccacuguaagguuugagaccucaccacuuaagaucugugagugaccauucccagaccacuggauuccaucuaagauuuuuagccggcagugaggucuccuugugaucugaucacauguccucuuccuaccucacuuccggagacuuucuuccugucuccccucaccuguggcauacacacuccuguuacaugucuucuuuguggauuuccaaacgcaaaggggucuauggcuacuccuagugguugaaugugccucucacugaagauuccuuuuuccuucuacgcuugccuggacagugcguacucccccuuuagagacagcccaucacucucuauccucacuggguaaaacuaacuucaaauuuuguguuaccguaugguguauagaacugaaguucagugugaagaaaauaugacuugaauauuccaaaugccccaacaugugaagacuuuggaguacugggguauuuuggauuaagaguucucaaucuauauaauccauguaguguguguggaggcaacuguuauggcagccugucuucacuaauccuuggaccugcggaaggcaaagggcugcgguuauggcuguauuucugcacccaccuuagcacguggcccauacaguauguaacaagugcugaaugacucauucacugaaggcugucucaugccaguccacgugcaggagguguuucacacacgugcauggugacugccuguuuauguacgugcccagggcccacacugagucuggagucccuccuauagaaagcauucuauucauguucggaugcacauuuccccaguauuaggcuaacauuucccacugccauuacccuugggugcuuuuuguauuauuuugcuuuuuucuuagagggucuaaccaagauggcuagaauagacugugucauuacuuacauugcagaggaaguaaggguuacagaggcucaggauggcuaugauugcucucuguggacacauuuuuuucuuaacguaaacuguuggucucagguguagacaacuggcauuacuuaagagaaugaaaaccccugggcugucuuaaguuuacccuacagcuuaaugaaugcuacuguaauagcgaguggccauguacagagaagugaagucaccuuguaaaucauuguccuaaguuccguuacgguaaaugauuucucaaaguuaucacggaauaaugaaauaaucuguucuucucgguuauuucuaugagaaauauauuccagaauuuuagcuucagcauuauggaugacugggccauguccugaauuaaaagaaaaauacaaauuagugcaaccaaauaagaaacacuaaguacaaacauauucauugcuuggaaagcucacaggucuaagauggaaagccugcacacagggccuucagaaguggccugucaacagucugugaugggaggaggucucuccagaucccugccucucccugaggaucugcugucugucaacaguugcaagagaggaagaggcaguucaucucaguagugcagccacugguaaacugccagggcuccuucugugaacaacuuucacucaugcuccugugagcaaccccgauaaacucacuggcuugccgcagagaggcauuagaguagaaaggggagggguauuugggaagaagaaaaggauuggugggaaugggagggggacaagaaauguauuagguaaaaaucaccaaaauguaauuuuuaaaucucucuccauuccacguguaugugugucugugauguaugugggugcuauggagccacaaguuacacugccucuucuggagauggugccacagguccuugggagccacuggacaugagaacagaacuuccauccucugagagagcagcacacacucuuaaccacugagcccucucucaagccccucaaaguacauuaugaaaaagucauaaggagacugauaguuauauauaauuaauguuugcuaauaaaaagcccuacauuacagauagccuggggggaaaaaauuaagcuuugauggcaacaauaaaacauuguguauaaugccaaaaaccuuuagcaaauucuaucaaaugaaaauauguaaugcuauuauguaccuuaaaauauaagauugauuuuagcaauaacauaugcacuaacauggcagccacaauaauaguagguagcauguaaagugcucuccgggugcucggcauuauuccacacacuugaagugcuuacaaggaccccgugagguagguacuauuacuauccacaggaaaggaacauaagcugcccacagcuauggagcuaacaagggguggggcugagauucccacuaggcaguucuuaaccaguaagggguaagucuuaacugcuacagugagcuuacuaacaaaagacugaaaaagcauacaaaaguaggcuaagaccuacaguagaacuaaaagauuuuagccaauguagcaacucagaacuugugacaagccaaaugcaguuacccugaaauugccugcucuuugaacaauguggcaugggacagaaguccacaaaagggauuuuuaaaaucuuugagaacaaaacacccagaagcaggcuaaccuaggaucacauaaagagcacuggacuuuguuuugugacagguugguccuuuuuagaccugugaggaaaagugagucucucagagccuguuccugcagcuguguagugauaccaaucaccuacuucauagggcuuuguugagcacagacuauauaaaggacccucgaugauagccaaagggacguagucuuuauuauaugguaacuauggugauaaagcuuaauuuacauaaagacaacuuccuugcuaauaauagaagagguucacggaugcaaacacuagaggcccuuuguagguagccucucuuggucuuuagcucgggagugucccagcagcugcuucuugucucacagagagccaucaguaccuacuccacccacgucguggcaauccacacgcccagccagguggugccuuuacuauuuccugagcauggagagcuuaugggagaauguaggugaacugacaggucugcccauggcuguuuuguuaggagcaaguuagaaaauuaaacaauuccccugaacauucuuauuguaaccagcgcagugacaucugacauauaacaguuucuucuucuggagauuggauauguaccauuuuauaguugcuauggaaaccugacauaucaacauugugaguuaaaaaaaaaaaguucagaggacagguguuacccaaguuuugacagcuaaaauguuguuuaugagagaagucagagucaguuaacaaaaacaacagcgacugaggcacuuucgucaauggcuguguggauguugaagaaaacuccuuacagaaaaugcuauggcuaugccuuucagccaggaaagagccagagguggaacuuaaagacauagggugggauggcuauuaggagcgcccucuguugagcuuugugggugagaagagucaggguaauggaucaaacuguccugagggagaagaaagggaggagccugggaaaccagagagagguaaggacuucuaagaagcauggauggacacacacaaaggugacacagaggugggcgcucuugaaaccaucucaguuccaccccaacuccuuaggagagaagcugaugcugcaggcacagggaagggagacggcccugauggccgcagccugguggucucggccggaggaaaggagacccaguuuuggaaggccuuaaaucuaccuuagggaucuggugugaccaagacuucuaugucgcagcggauggagaagcacugaccuuuuagucugcucccacaucuuggagugcuacauacagcccagggcaaucuugagaggggcuuauugcuugagauugagcuauacuggacaugaaaucaagaaauaaccccaaguuagcaagcugggggacaggcugccauggugucuaucugugugggagaagacugaaagaagcaacagugaaggcaggugcaaaccuggauuugccuggacguucagagaauaggaagagacuguuggggugacugguggcccugcucugugcgguugaggaacuuaucgcucauggaaagcuguggucccuuggccuugagagcugcauuugugcguguguccgggcaggacugacagcucuaagccuggaucccucacacgcucucccugcaaggugcuccaguacuuggcagcaucuggaggcacucaaguugcugaguucccuaagguuuucauguccaccgaggaacucuguggauaagucuuggcuuggaaacuugccauugcuggguauaaaaauugggggaccucugaaagaagugagaacccacuuagcugagaccucggggcuagcaguggcuccugaacaucagcagggaagccccaauggaagaagcaacgcuagcagcaaagaacaccaaggccugaagacauugagaaauuauuacauuugaauaucaguaagacugaaaacaaaaaccagaaccacaacacucaaaagucuggaccagaugaagacagcaaaccuaugcauguguaguguugaaagaaacuaagacacauauaaucuaccuuagggguguuacagcagaagaauucccaaguguagggaaagaaaugaacauucaaggacaggagacauuuagaaucccccacccccccaaaaaaagccaaaccaugaccagaaaacagccuuuccaugucauacuauauugaaaaugcccagaguacgaaccaauuaaagaaugcugaaccuguguaggucaugucaagccacaaaggaaaauguuagaauaagagcagacuugucagcagaaacacgaaggccugggaacacaaacugaugcauuucaagccauaagacuaagacacugucgaccaccuggguuaucacacacccagcgcagagauccuuuacagagucggcaucacacugcaagcaugaccuaaaguaauccgaaucucuucaggagacgccacacaagagccaaaguucuacauuaacaaaccagacaggagcugguaagauggcucaguggacaacagcgcuugccauuaagccugaagaccugagugugagcuucagaacccacacagugcaaggagaaccaacuccugagaguguccucugaccuccacaugugugacacacacacacacacacacacacacacacacacgaauguaaauaaacauuaaaaauccagagauuuagaucaaauaagcaaguuaaguaccccgacaucuuaaaauaacucaaacucaagauuaauaaagagaaauaacaguucagaggauaaugauuaagaacuagagacaaagaauacaaaacaucaaccaaagaacugcuuuuuuuuuuaaaggauaagauucccaaacucuuagccaaauuagccaaaaggaggagaaaaaaauuuaacaaaauugaacgugaaaaagaauacugcuggagaaccaugaacuucagaucacugcacaguauucuguaaacccagucuguuaaauuggaacaucaaaaagaaauucuaguauaugcgacauaccacaauuaaaacgagaagauagaaagaagcaaagcucuguagugagaaauaggacugaaguaccacugugggcccuugacaaagaagagcccaggacaaugacucaacaacaaaggcaaaaaggcccauauauguaaugaaugccacaucagaagaaaaaaaaaguugacaaauucagcagcccuccaugauaaaagcccugcaggaagcaggcuaggcgugcuggccuugagaauaauaaagguaauguacgacaaguuuaguggcuaacacacaaacuggggaaagccaaagcacuucuucuacacucaauaacaagacaaggauguccacugucuguacucuaauucaauauuguauugaauucuuuuguuuguuugcuuguuuuuagagagacagggugucucuguguagcuuuggcuguccugauacuccuacuauggaccaggcuggccuugaacucacagagaucuaucagccugccucugcuucucgagugcugggauugaaggcauagcaccaccagcaccuggcuacaguguuugaauucuuagcugggucaauaagcaaagagaaagagaugcaggagugaucugaaugugaccauucccacaggcuuaucuugucugcagcuaguggugcucccuuggccgaacauaggaucuuucagaggugggcuauagagcagaagucagucacuaggagugcaccuuuccaagucauuuaugacuccugguucuuuucaccuuuugcuucccaggugugaauauucucugcuguacugucuggcugccacggacggagcuggaccacuaggucuucccugccaugauggccuaaaacccucuagggcucugagucaaaauaaaucuuuaucuguuguuguuucugugagguacuguggucuccgugcaacaaauaaguauaugaaaggagaugcaaauguaaagaaggacucggcuuacccuuccuugaagacaacauaauccaaugcuaagaccuaaaggagaaagcccggucagauaaacaagaggaaaauaaucucacucaagguaaccucuucccugcucuugaucaacagcagcagcagcagcagcagcagcagcagcagcagcagcaacagcaacaacaaagccaacaaaaccacaccaaaccuuaggaauaaaccuaaugaaagauaugaaagaccucuauaauaaaaacuauaaagcacuguagaaauaaauggaagaagacaugagucuguguuuaugaacuggcagaggugauauugcgaagacagccauauuacccaaaaugguaaacagauucagugcaaaucccuauuaaaauucuggcaacauccuuuaucuaaccagaaagagcaguuaucaaguuuauuaacaaaagaccccaauaaccaaagcacuugagcagggcuggauaguaucauaguauaugauuucaaaccauacuacagagcuacugcagccaaaacaguuugguucuagcacaaaacuugauacccagccugaugaaggaccccaaaguaaaucccauagcuaugcuacugagccaacagaauguuggaaagacaguugcucaguaaacagugagggaaccuggauacacacaugcugaagaauaaaacaaaaguggucuuucacuuuguaccaaaaaaacaaaacaaaaaggcaaaaacacaaaccauaacaccccaaacgggucaagaaucuuguugugcgacauggaucucuggaaccacucgagcuaaaugugggguaaauagucuaaaaggaaaacaugcaaggacuucugagaaggacucuacagcucaaggaaaugggcaagaacuaaugaagaggugcgauuaaagcccucugugccagcugggcagugguggcgcacaccuuuaaucccagcacuugggaggcagaggcagguggaucucugaguuugaggccagccuggucuacagagugaauuccaggacagcuagagcuacagagagaaauccugucuccaaaauaaacucuaugccaagaaggaaacacuuggcagugugaagaaagccuacagacagagaggaacucggccagccacugauccagcacggguuggucaguuucucaaucuuucucucucauauguacacgcacgcacccacaauaacaaaacaccaaaagaacaaauaaugcagucaguaagugggaaaaugaauagacaggaucuuaucacauuguccugcccggcuuaguaucuucuggguuacugaagcuagccuugaauuuauaguaauuuaucguguaucuuccugccuuaaguacuaggguugcagcaugcaucaucauacccaaaauugcuuuaaaggagcaauuuucaaaagagguacaaguagcuaauacuugaaaagaauauguaauaucaucagccaccagagaaaugaaaauccagacuauacugagacuuuacuucauuccagucagaagagcuaucuucagaaaacaagaaauguuaguuaggguauaaggaaaaagaaccuuuaaaugcugcuaaugaaacuguaaauuggugugguaaauacagaaauaagauggucccgugaaaugaaaaauggagcugggguagugcuuggaggcagugugcuugcuuaucaugugcaagucccuggguuccauccucaauacuauaaaaaacaaaaccaaccaacccaaaaaaccaacccaacugaacucaaaccagccaaccaacccaauauaaccaaccaaccaaaaaaguaaauauuugcaacuauuuacuugcaaauaguacuaucacaugauguaguuguaccacuguuggguauauauauauacccaacaaaaccaacaguuucaugccaagagaaauaucuaaauguccauguuaucuuggcacuaauugcaauagcaaguucuggaaucagcauaggugcuugucaguggaugaaagaaguauugauauacaguagaauauuacuauacuauaaagaaugaaaucauauuaucugcugggaaauggguggauugcauuaugucaaucucugaaaguuaaccaucauguuucacucauaugcagaaucuagauuuuaaaaaaaagagcaaugaggagcuggagagauucuuuacaaguuaagaacauacacauacuaccauuauagaagacuuggguucuauuuccugcacccugccugcaguuccagcuccagggcaucugacacccucuuccgacuuccaugggcacugcacuaauaugcacacccaaaacacauauucuuuucuuuuuuguuuuuuuuuuguuuuucaagacagaguuucucuguagcccuggcuguccuggaacucacucuguagaccaggcuggccuugaacucagaaauccgccggucucugccucccaagugcugggauuaaaggcgugcaccaacacauauuauuaaaacauaaaaucuucaaguaaauuaaaguugcagagagggguauagaagagaguaaugcuguccgcuaaagucugcuauauaauacaugcaugaagaugccaucacaaaaccuauuauuuaaacaguuaguauaggcuaauacaaaccuccacguucucucucucugucugucugucugucugucugucugucugucucucucucucucagcuuagagguaagccaaauggacauuccuuagcaugguaaaagaaugguuuucuagaucaaaagacaucacucaccuggauauauaauguuagcuuugauuuuuaguaaguuguuuagggaguucauauaaucauagaggucuucaaauauugucgucccuucuccuaggaugcaguccccagaaaagauggcauucuccuccuccaggaguaaagccaugugaucaucaguguggccaggaguguacaaaacucuagguaagaacacagguuaggaagaacaacaaaucaacaagcaugaauucuuacgcuugcgcaaaauguugagaagugaccaauucugucaccuguagacaagacggcaacacaugcugucaaggaggggauuucauuuuuucccagggguugcuuguaaaaaucugaccccacacaaauaucuccuauucuuagaucauguuucuuauccaaaaguacacauucaauaacauauuuucuucuuauuucauaaguaagaugauuacaacaaauuugaaaaacaugaaaggauaaaaaagaugaaaaucaagauuacucagaaacaguacuuuuagauaagaacauaacuuuucaauuuuguaugguaacaauuaaaaaacaaaacuguguguuuuaaaguuuucauuuacuucauugcauuucucuacauuauuaaauuucuauagguaaaucccgaagcucucuacauaauagcugggacagugcuacauguuccgaaaauaaaauuuuacucuaauaguauuuauauaaaaauuuuagagaaauaagaguacauacauacaugaaaguaaagguaaaacacucaaacagaugaaaaagcaucaacuaaggagccaauuaaugucaagaguauuuguaagccauauaaauauuuaaaacuaugugccucagaagcaaagacaaacaagccuuuagaaucaaauaaaaaccuuaaccaagacuaauuauggacauuaagaacuugauuuaugcuauucuuugguagugcagccacuaauuuaguugcccaaacucuaacuccaccacccaugcuccuguaaacaauccuaaacaccugccugcccgcccgcacacccacacaccccgacggaggggcggcugggauggggagaaaggauguggaaggaggggacuagcuggcagaaggaaaggagcagcagagugggacaguaaaggaaggauagaggauguaagacgguguaaaugucaugaugaaacccaggauggccuaugacuaauacuugcuaucaaaaagcccuuaaacuuaugaacagauuaugguaccuuuacguaacaagaaauaugucuuuaagagcuuuuuauuuauauucacauuaaguuuuauagcuauaccaauaguaaaugaagagcuaagucuaguuuguucugcaaagcaccucuucaugucucagcuggugcacuccucuuguuuuccuggugcacugggagacacacuugcucucuauguggugcaccaugagucacacuugcucuccacguagugcacggugagucacacuuguacuuuacagcuugcacccuguuuuccuguuuacuauucaggcuccugaugagcagggcccuuguuauucuccacugucugcuugcaguucgcagcucuuagugacaucugguuuuacaacccagcuuuccuugucuuggcgcugacccagcugcuuguggguaaugcacaccuaagccugacacggcuccaggguggguucuacuaaccuucccacuguccaugagugaaucacagaagacaucaguaaauucugacuaauacuucucaaacuuaauuuuauuuauaagagacuaacuuaauuaccuuucucugucugauuuacauagacugauuuguauauucuugaaauauuuuaaauaaaacucucaauaaugaccuauuuaggggaauagggcaaauauaacugcauauuuauauuuaauacuuagggacucaauauggguucuugauuagagacaguagagugcauaucuacauauguuuuccuucuaaaacccccagaaaagguguuuguuuugcuuuggguuuuuuuuuuuuuuuugguaaagauguaaucccaacagggaugaaaggaaugggcaggacgagcacagcugaaugagagcaguugacaguauuagcagucaccagaaagcugagggcuaagcgggcagagaaagcuggggaucaccuagcagaggccccugaaagcugagcauuugggguaucaggaaccuggaagaugaggggacauuaggggaaaggugguuaaaaaaauauuggaaaugugcuuaacaaauauucaggccguggcuggagcucagaggcagaacaccugaacacgugcgguccuggauucaauccuccacaccccaaaucccaaacagacaaacaaacaaaccccaagcagaauugaaaccugccacauacacaaguuguauucuucuuugagcugugugacaaguaccuuaagccugcugauggaacaggcucagguggagcagagauaacacaccgagaaauggagauuccuaacacaggccaaugccauuuggacgucauuuuucauguauuguuauugaggucuuuacccuuaccaagaugucaaaaaaagucuuuucuaagguauuuaguaaaaugacuuagaaaauaaccuuagcaaaagccuaaguugucaaaaauggguccccaguaaaguucaccuugauuaugauaccaugaggcucgugccaacaacucuguccucccagucaguucucaggacucacaaauagcucuacagcuuucaucagaagaaaaucaggaaacaugagaggguaauuaagauaauuaaaagaaacaucucucacauugcagaugguggauaagaaaaagcaaagaaaucuagaagcaacaaaccauaaauacguaaaacaaaccucacugaucauaaaaccgucagcaagaaaaaagagaaaugucaaccaaacucccaaacuaggcugguguaggaggaacgcugggacgagugugcggacacagagucugcacacggcccagguguagucacgagaaccacagaugguaacugggagguggaccugagcgaugagcacggcgucugagcaaacaacagagugugagcaaaucaaccaaccguggaacagggagagaaugcgauuacacgcagccucaagacaaguuuuagaauguaaagcccuauuuccagacuaaaauguccuauuugggguugaccaggauccuauggugaaaaccuuggucagggucccaugaauucuuuuucuuuuagaaauuguacuagugccuacagcauucaaaacaaagaguaggauccccuagaacuugaugugcaggugggugagcuauuuugugggugcugggaaccuaaccggggucugcugcaagagcagcgggugcucucaucacugagcuaccuccagcauccugaguagguaaagcagagggcaugagggagaagagaagaagcagggagcuuucucugaccccccacccccaugccuucuccccuuaacucguuuccaaaccuaggaaugcucugccuuuccugaggacaccagcuuuauacucagguaaagguagccucacuucugauggaaagucugaacagacgcugagcagaacucccuaggcggacgcccuagcucacgucuucucuccaguuacacuuccccacgacgacuccaccaaacagcaugaaaacagguaguuucucaguaggcuggaucuuuauuucagaagccuccacugccucauaaaaacauuaauucugucuuugucaauucuauuuuccaaccuagccagggaccuuaagaagauggaggaggacaccucucugcuaugcugacuuggccugacucugaguuuuccugaguccugguggaagcuaaugugaacaagacaggugagaagaaaugcuuugcuguugaugguggaccccuuguaucucaucauugccauuagcaauaauccugucaagcuggguuaguuggaaaucuccuuaugccugguuucuucuuaguuaccucccaugugccgauccuuaggucaugccccacucagccuuacuaagcuguggugaagcccaaucccucuauuccauagugagaccccaacaggaauggucccugcuucuauuuucauggcuuccuucaauuaacauuuguccacauuaacaaaggucaugcgugguuuucucuuuaucaggacauagaacuacaaacucauuaagcauaacugaaauuuuaggaaaagauggauaaaaaggaaaucucccaaccccuauaccccagcacagaaaagacgagguaacacgaaaguucaggauucagaaaggcuuguauuuaucaaguauauguauaacaguuaagauuaaacaucuagccgggaggugguggugcacgccuuuaaucccagcacuugggaggcagaggcaggcggauuucugaguucaaggccagccuggucuacaaagugaguuccaggacagccagggcuauacagagaaacccugucucaaaaaaaaaaaaaaaaaaaaaaaaaaaaaaaaaaaaccgaaagaaaaaaaaaaaaagauuaaacaucuaauuccaucaacaugaucauuuaugguaaaagcguuuaaaauccuuucaaacacacaguacauuacugccuguauccaucuugcugagcaacacagcaaaacuucauacuucuaccuauaaugugggacucaucuagcauuccuuaagccuaauuagguuuuaauuucccaaggccuuaugcauaccagccacaccacuggcaucccagccuagagcugcacuuucaaagccaugcuuagauauggaagggaucaacaauucacucauuuuuagaagucauugagcaugaguuuucuaaaggaagggguacaguaaagucgggggucccaggaaauugaagauccaacacuguuucuagugggccggaagucugcagugaccucgcaggaggccugcaggaaagcuguccagaugacaugaagcauaccagaagucaggaggcucagagggagggcucgucuggaagcuaugacugagggaaucccugacucauuauacacccuggaagaccgguguaaccagaguugaauuacuggaaaguacacagaaaacuacucaagagggaccauggguaagugcagaagaagagaagggcaagucagcauaguuuaucagcuggcucaguuauacucagugccuauucuuguaaugauuuaaccacugaaaaaauagccccucucucccucccucuucugcuucuauuccccaccccgucuuuauuauuuuuuuuuuucaagacaagguuucucuguguagcccuggcuguccuggaacuuacucuguagaccaggcuggccucaaacucaaagauccaaaugugcacucccuucaaccccccucccccaccccaguucaaggauuaaaagcaugccucaccacccccuggcuccucucccuuucuuaaagcaucaggaauuuccucaauuucuuuuuccaggagggccuucugguggccuaccuucuaacaagcucucuccugucuagacuggcucuucccugaucacagucaaccuugcuucuguuacucucacuuggggcuucccucuccacuguugacuuuuaaauaaauuguauucuaacaaauuuuuauuuugucuuuggagaaucuugacuaguauauuacccaacucacuaguucuauuagaaagcaguaacagauagauuagcaaacagaauaagaaacacauugaaccaauaaaauauagaauaguccaacuguguuucaguacuguaaaaaugcagaaacauauugaagcuguggacaaaaccaacaaacuuaucucucuagaauuuguaggacauuugacagauucacuuuuaaauaacaauauuuaagaaaaugaaguaagcuggaauuuccccuuugucaaaaaauaaaaaauaaccaaagcacuaacauuaaauauugaaacuauaaaggcuuuuaaaaagcugggcaugguaguucacaccuuuaaucccagcaugugggaggcacaggcagagggaguuagagggaguuagaggccagccuggucuauagagugagcuccaugacagccauggcuacacugagaaacucugccuccaaaaacaaaaacaagacucagcuaaggagacauacuggcugagccauuucugcuuucuguuugcagaccaggauguaggcucucuguugucccggccucuaugccuuugcucugccaucauggacucuaacccccugaaaacauaagcugaauuacauguuuucuucuacaacuugccuuggucauacuguuugucacagcaagagaaaaagacaauauuuauuucccuuuacuauuaugagaaaauucacucaauuaccuaccuaucuguuauguauuuuguugcuauuguuuuuguuuuuccuuuagcaccaggaauuaaaaccagaggcaucuuagacgaucagcaaauaccaugccgcugaguccacucccugugugugugcauauuuguuauuuuuaagaaaccuaccccaagcuagcugguauauaaauuauagcagugagcuuuaaaacccacuggcaccuuggcacaaagacacaaguuuagaagagugcaguggacacucguuucauuuuccuuucacauucaacagugugccacuuaccuauuuaaagacacuacuuguaggaugcucagugccuuccaugugcuaggaaccucaugaggauacaaaggugaauuuggaauaugccuguucucuuaguuuggguuuuauugcugugaagagacaccauggccaagacaacucuuauaaaggcaaacauuuaauuggggcuggcuuaaagcuucauagguuuaaucuauuauuaucauggugggaagcauggcagaauguaugcagauauggugccggaggagcggaggcuucuauaucuucauccaaaggcagccaagaggacacagucacaccggucacucuugagcauauauaugagaccucaaagcccugccuccauagugauacacuuccucuaacaaggccacacccacuccagaaaggccacacuuccuaauuugugccacuucccaugggccaaggauauucaaaccaccacaccuguguaagaagaugacuagcuaauuaucaauccuauuucuuucuucuuucucuugggcaugaaauuaaacuacacaucccugaaucucuacagucagguaugaaacaugacugacuguauagcuaacguaacagaaagcuuggcccaugaaaccuccuacagaaaacuuucuccuuguucuuuucuacgugcuguacguguguggaccuuggaaaccaagagcagaggaguguagaaucacaagaucaaaguaaccaacaacccacuccuguugagcaccugaaggacacucacaaaucaggacaguuuuguuuuuuugaccuacuaugccugagaaauguuuuugauauuugaaccauuguauuucuuuccuucuuuccuuccuuccuucuuuccuuccuuccuuccuucccucccucccucccuucuuccucccuuccccucucucucucucuuucuuuuuuuuuuuuuuuuuucaagacaggguuucucuguauagcccuggcuguccuggaacucacuuuguagaccaggcuggccuugaacucagaaauucaccugccucugccucccgagugcugggauuaaaggcguguuccaccacgcccaacugaaccacugcauuucuaagcuaucuagcugugacaacuggcauuaacuacuacugugacuugugagagaugagaagauaccuacucacagacacaaagugcuuuaaugaaacagcaagaaugguaagagagcuggagaaaggaggaauucugcucagaaaggguauucaaaguaacuggugaacugggaaaacaguaguuuaccagggagaaaagccuguggaaagggaagauauaaacaaaggaaagucagaacaugccacaggaauuuacauacacuucuucgggucugugagagggguagauggaguuaagaccagaaacgauguuuugggcuagaccauggaacuaaacaucuuguggcuagugggaaucaucacagguucuagugacagggauagagggagacuagaaaggggaaaggcuggagacugccuguuagcgaggauguaacagcaggagacagggaaaggaacagcuccagcaagugcuucauuuuaauuguucauaacuacauguuuauuuauaugugggugcugggugggagcauggugucuguggaggugggaggacaucuucugggaguuggcuccuccuccuauuacguagccagcgugauugaaugccaugucaucaagcuuagcaaacacuuuacccaaugagcaucuugcugcccuugacaaauacuuuuggggcaaagucuacccaaguuuaaugagagaucagggaaaugguaaaggugaaaagcaguuaaaguugaaaaguaauucugaauaacaucccacuucagagcacagugugcgcucugagauugaaggcaagaccggacuaggagacuggggacgcucucaaaaaaucagagcaggaaagacuuucucucugaaacaggucgaccccuagaguauuuacguauuuuuuuuuuucugaagugagaacacugggaaaggcccuacauugagguucagguaguuaguuccuugauucacccaaggaguaacguuaaguuuuaaaauaacuugcuuuuuugagacaggaucuucugcugcgaccaagccaaccuggaacuucauagguaguagagacugaccuugaacucauggcacacgccugacucagccucccaugucuaugagcaaucacaccuguacccagccuucucaagucuguauuucucaauagugguaugaauuuaaacaccaccaagaacaauuaaagagagagcagaaggagugaaggguauuuguuuccugguuugcgcacaagcccuuucguucucuuuccugagagcauuaaaugugucagauuucuucuguauucaugacucuucacacgugcaggcaaacauaccgaccugucuucauccuucuuuauaacacaggcuguaaguuagggcuguuuaguuaccugagaguggcucccucggucuuaaccacgucuccguuuucuauauaaauaaauugcuguucuccauuuccuauaauuucuucucucuggggauuccgucgaaguuuuuuaaugcaguagguggugucuagucauaaaacauguaaauauauuaagucauacucugaaugguuuaucuguuuaagagaccagcccucacacaggugacacccccaauggcugcauaaaacccuagcauccagaugacaggacaacagaauuaaagcacuguaccucugcaauggaacuaguucacauguucccagaguguugucuucuccaugccccuuuaggucacauaaaagcugcugugaauuuuuagucauuucuauucuguguacccugggaggugacgggagacagugugauggagcgcugagcaccuuucucuaggugccugcuuagcagugaacgagucacggcagcaguuaaaacuaaguccaccuggcugguagugcucaaaggacucccagagacucuaacccugacagcugacauacuuaagccugacuccucacugacagagaaacccaaugcuuuaccacuuagcagugucagucguuuaaccaggacaguagcuacuguggauaaaagcagaagucagacauagcuggggaagugaaacuuucacuccaggggcuauuccuggagcugaagagacagcucagcugggaugagaggacuggguguggggcagaagcugagacgugacuggcuggcugacgggaugagcaguggguagguacggugagggcuggcagggagcagagcagcauuacauuaggagaggccugggagugagcgcguguacgcuguggcugugauaaggcaacaucuugccuaaugaaaaugcugucugucugggaagagacacuuggauagguaagaugacuuggcugacaggggaguggguguuaaacuuggccacuguggccucuagacauuuuuuuuuccaauuuuuuauuagguauuuacuucauuuacauuuuaaaugcuaucccgaaaguccccuauacccuccccaccccugcuccccuacccacaacucccacuucuuggcgcugguguuccccuauacuggggcauauaaaguuugcaagaccaaugggccucucuucccaaugauggcugacuaggccaucuucugauacauaugcagcuagagacacgagcucuggggguacugguuaguucauacuguuguuccaccuauaggguuguagaccccuucagcuccuuggguacuuucucuagcuccuccacuggggguccuguguuccauacaauacaugacugugagcauccacuucuguguuugcuaggcccuggcauagucucacaagagacaguuauaucaggguccuuucagcaaaaucuugcuggcguaugcaauacugucugcguuuggaagcugauuaugggauggacccccggguggggcagucucuggaugguccauccuuucgucucagcuccaaacugugucucuguaacuccuuccauggguguuuuguucccacuucuaagaaggggugaagugucuacacuucuagacaguuuuuagcaaaaucggugacaguauuaacaggaccgucgucaauauggcagcuauauguugugggaguagggguggcugggggaagggaugacugccaacaguucguccaacuggacuuuauaaaggcuagggcaguggcacugagaacagagggagaaauaacauuuauccuggccuuuucccuccuccgagacaggcuaguccugacugucuuagaacucccucuguagaccaggcuggccuugaacucugagauccaucugccuuugccuuccgagugcugugauuaaaggcguaguucauccugacuguuuuuaauuuagagauuuuguuuuuucuucuauguuucugugugaauguaugccacauguguguggugcccacaggagcaucugaugcccaagacagcaucugauccuggaaccagaguuacaugugguuaugaacugccugacauaggugccguaaaccaaacuccuguucugugcaaggauaagacacacuuuuaaccacugaguaaaaucuccagaccuaaacugguugguuuugaaaaaagucucuuaucaguugcuucaaauuuacucuguauugccaaagaaacuguauaaauggcaauuauauauuuuaguauaaccuuuaaaauacauguacuuuaaaacaauacagguagccagcacugaauauuacuugagccacgcugcccucgcagcaacuaaauaguaaguacuacaaagcagcacggcuauagugcaacgcaaaggagaagagcgcagcucccgggacuuaggggagaugcgaugcagaagcagagcgccguggaacuggauuccugccaaaccaagucugcaaacagcuuguguggcuucagucaggcccaggacggcagacagcaagagcuuucucaagaaaagcacuaaaauuuuaguagcuauacagagcugugucaaauuucucuucuaauuucuuuguauuaucugaaugguaauuauacaaauauuugcucuuuuguacagaaccuacaacuguuuuucucucgggaaaccccaaagguaauuuuauacuguucuuccaggguguuugugcuuugccugccaucuguagcgcagggucccuucccaccuguggcaucaggcugggggcuuuguuuuagggguguucguguguggaagcuccuggcuaggagcuuccucugcuuuuguucacugcuguugucuuugugccacacccaguaccugacacacugaaggcgccggaaugauuguucaguggcuuucucaaucuagaacugugauggcagaauaaaggauuuaaauuaagaauaggaaagaugucaguacuaaguaggucucagggagagaaacugucgauauacugagacauagcuuggauugucauacgucuuagcaagcugccuuaaaguuaccuuaaggccucagguaaucggcuugggaagagaccccaacaguaucagccuuccagcacccuugggaagugccaggcacagugcuugcaaacaugaaaugcucaacagcuguuaaaggcugaagcugugguggucacagagcauaaagcuuagcuuuaucauggcagaaggaagaaaggauuugaaagaaaaguuucccaugucaccucugcuaaaauugacaguauucauguuguaucaauuaagaaauaucaauauaguugaaagcuuaaauuauaaaugauuucucaagcaugcuaaaugguuuccugcuuaccauuauugauguuuuuacaaaugucuacaaugccuccagaaugaucagaaugccagugugucaccaggauuuccuggauugcugugucaaacucaaccaaggcuugcuuuaaacagcugauauauucuggaacugauggcucaccagugucaaugaggauucuccuacaaacgacagggaagacaaucacaguuagaaccuggaguucacgugagcacaccugaggauucuccuacaaacgacagggaagacaaucacaguuagaaccuggaguucacgugagcacaccugaggauucuccuacaaacgacagggaagacaaucacaguuagaaccuggaguucacgugagcacaccuuacaaagagaacuugcauuaaaguaaaggaaaagcaaacuuugucuuugaacauauuacuccaguuuaaagcauuauuuuacuguaaggaaguucuuggaaagaaauuacaguuaacuguaaaugugaacuauggcuggcgggagaucucaagcaccugagucgcauuaacguuguuaaacacagcaccauuugagacuaucuccaaggcgggccuuucguccuuaugcucagagguuaaauaacuugccuagggucacucugcaguuaaugguaggaucagcaucuacucugauacacugaugccagagugugugcucuuauaugcucugccuuccagauggguuauaaagucaaggaucagaauuuaacacauccacaaaacacucguaaacuuaaggcucagggaacacuguggaagacacagcagaaagacuguaagagccagaggacaugggaguuuccugugagaauugaucuccuaguaacaucagaagcuacacccccacaaagucucacccacauaaccacccaagcacgggcugaacaacagccauaaaaaacuggaugagaaaagcccaugggcuucaacccagcaaaacaacuacaggcaagugaagaaagcugggaacagagagguggucuucuugaggggagaaaacaucaauugguuguccagugccaagcagccugaaaagaaacauacaaguacaauauacaaacugaacaguuauauuuaggaauaccgagguguguauacauacauauaugaaugcugaaacacuuagugaaaaaagaggccacgaauuugaaggauagcaagaacggauguguggaaagguuuaggggaaggaaagggaggggagcaauagaaggaggaaaaggagacggggaaggaaggaggaggaggggauggggggagaaggaggaggagaaggagcagcagcagcagcuacaaagauggcaaaucagagacaagaacggugcucuccuguguccccacaaaucugaaagaaaacaccaagccaugacugaagagcaagaugcaaacuguggaaagccaaaagagggccacaauaaacaguaagaaaacagggaaguccagaaauuauuaaauguuagcuuucuaggggaaaugacaggcucuagugugagaaugaagaccuccccccccccccccagcccccuucacuggcucuagggcugccaacaagaggaaguuaggcuggagaucugcuugugagcagcagacacucugacuggagaucugugcaugcgcagcaggcacuccaagggcuuuacugucacugugccuccugcccuccuaaguugagaugaagaagagcaucuuucauuacucuucaaggggaagcagaaaauuuggcacuauugcauaguucaaguuccagaggugccaccauuuaccagacaagcaaggacaaucuccacaaacuaaggacguucaugacugccacgccagcucugcagaaaauacaaaaagggaauccucaacagaggaggaaggaguuucaauuaugaaagugcagaaaauaaugaacaucacgaguaaaguagaaucuaauaaaacccaaagaaucaucaaaaauaacuuugaaacuugacagaacaacacaaaccaaacuaaaccaaacaaaaaacucccccccaaaacccccaaaacuaaaccuacacuguacuggcugguuugugucaacuuggcacaggcuggaguccucacagagaaaggagcuucaguugaggaaaugccuccaugagauucagcuguguaggggggagagaccucuuguggguggugccauccaugggcugguagucuuggauucuauaagaaagcaagcugagcaacacaggggaagcaagccaguaaggaacaucccuccauggccucugcaucagcuccuguauccugaccugcuugaguuccaguccugacauccuuuggugaugaacagcaauuuggaaguguagguugaauaaacccuuuccuucccaacuuaauucuuggucaugauguuugugcaggaauagaaaccccgacuaagacacacacacacacacacacacacacccaugguuaaucuacaacuacaacaaauagauacauuccuacacaaagaaauuucagucuagcaauggauacauuuacuagcugaauucuacuaaacuuuucaaguacaguuaacaucggugacucucaaacugaaagggaagaaccaaacucauuccaggaaaccacuaucacucuggcaucaaaaucauacaauaaacacauuuucugauguggaaauauagauuuaaauaagaauauaaaugaauaaagaaauauuuaauugggcaugaacguagaugggcaacuaucuagggggcgauagaaaaaugaggggugagccagauagauuaaugggggaacggcacaccuuucacacaccaaugcaccagacccagaugcccacaggugacuacagagugggaaggaacuacguggggagaggaagagaucaucaagaaggccagaggagggauagaugccaaugggggagaaaucaccccacggugcaguaagagccaaggcaaugcagacacugcaguacugggcagcagaccuaacaguaaacuauuacacugugcccuucgaugggaaggacuguagggagcauggaaaaaacacacaagccagucuguaagacacaccuauggcugccauuuuucaguuuuguauugcuagccugugacuguguucuuuugucaucuuucugcagcagcggaaggacugacuuuucucuauguuuucuggaaugaaggaaugaggauaccauuguccucaaggccagcucacaaacuguuugcuuguuguuugcuugcuuguuguuuuuucgaagcuggguuucucuguguagaccaggcugaccuuaaacucagagauccaccugccucagccuccugauugcugggauuaaaggcgugcgccaccaguacccaaccucggacuucuuaacucuugguaccucacuuauuuaggcugaagaagauuagccuuagcuagcaugacccauucauuauucaucuauaacugucucuagauuaccuccuacaugucaugccuuucagucuuuugggaauauaaacaacucugccugcuacccaaugauggguggaagggguagcugugggcgaccaaaacaaagaaacaacauaaaguuagcucaggacguucaaauugaguacauggggagcuggugggagcuucagaggguaccaugcuugguuuucaagcaugaugcccagcacccaagacaaaggcaggcauauggugauuuggccuauaacuccauugcuagaaggaggaaauagggguaaggggaggaggguaggggguggcuguaggaguagauggggaguccguagaugucagauaggaggaucucagauccuagggcucacuggccagcuaggggacagauggaugauggggucuaccucucuaggcagcagagccaaaaagguagguuacagguugugagaggccaugccuuaaaaaaguaagguaaagagcaacagaagaacacagcugccacacuuacauaugugcacgcccccaggagcauagacaacaucauacacacccuaaaaaauuguacagucacugaaugacgauauauuacauucgauggguuugucucuaauaucuauagccaauacaaaaacacaucuuguacugguacaguuagaaaguugggagcaagaaguuccauguguucuuauauagcugagugaguuuuaggaacaacgguauauuauauguaucuuaaaagccaaaaggauuucgaaaguuuucauaagggcuggugagauggcucaguggguaagagcacugacugcucuuacgaagguccugaguucaaaucccacaaccacauguuuacucacaaccaccuguaaugagaucugaugcccuuuucuggugugucugaagacaguuacaguguacuuauuuauaauaauaaauaaaucuuugggugagaguaagcagggacugagcgagcagggcuguguguguguauacauauguguguguauucauguguguguguaucaaaauaugugcuuucuaauuugugugagcuuaauuuguauaauuuuaaaaauaaaauuaaaaaagaucuugggugugcaaaguguuucagcugguaaaagcacuugcaacugagccugagaaccugaguccaauccuuguacucacacgguagaaggggaaacugacuccuuuacguuauccucugacccccacacacaugugguggugcacacucacaccauuacacacaugaacguaauaagcaauuaaauauauuggggaggaggagagugacauugugaugaaucuuuacugaggagacagcuggauagacuucagaaguauacuguaaacuccuccgcaagugggcacacuggcuggagggagcguauggcccuaccaagugaauccuuagggccugcaauggcuuaaaggacuuuuagaaggcauaaguaauaggaccugcaggaaagggaaaaggucaaucacuuggagccuucuagguggagcacuggguaugccauuagacaggagacacgacaggcaguucagaggugagcuugccuugugaauuugacauuccgcauuauuuacacaacauacaggaauacaucaauuuccuuucagcacuauacaaacaugagccccggagggcaggaagcuugcuuguuuggcuuagaggaguucauugauguauuucuacauuuggaaagccuggcccacuguacauuuagucacacuaaaguuaaaacacacagaacuagaucgugaaacacccccuaggccaugauucuaauuauuuguuuauuuauuuuugcugucucuguguuuguguguuuuaaaauguuauuccaaauucuuacugcucuuuaacuagcuuggacuacuuuuggucucugaaggccuuaaggucuuuaaaaggaaucuuuccaugccuuguaucauggucccuuaucaacacauuuaaaccacugccuugcccuccuccuaagaagcagcuuugaaacaucugacacugaauuuaaaauguuauaguccagacuauaucauagugaccaaaaguuauaacaaaaccaacagagcgaauaaacagguuuacacuuuagcugacacagaacacagaucuuuuggaaugccuguguugucucuuugcagaucaaagucugaguaaaaagccucuuggggguugagaaaguggcucccaggccuuugcaguuuuuuguuuguuuguuuucgguagccuaaccaguucuagcaaaggaaggacucuuggauagaggcuaacaggacuucuccaaggccuggcacaaacacagccugcucagaauggagcaguaaccagaggcuauaaauugaaggaaaaaaaagaaagaguuugaacaacuauuaaggaggaaaauauaacacagcauuuuagaacuaaacucauauuuauuauaacuuacucuucauaucaacuccagggaguuuauugcaauauuuuguagagaaacauggcuugagacaggcuaagugauuuaucccaggucuuucaggcuuauacaagguccaacgaugggggacagcacuacuuuagcuagcacugaaaucauuccucauggcauaaugccucagcucuagauuagaaaacuaguucuggucauucgcuguguaauguccaagcacaguuacugugagguucagucaucucugaguguguggaucacuccacuaccuacagucauagacggcagcccuacaucaggaggucucuuugcaaaugcaagcuguauucauaaagagcucaagagaacacuguagauggaucugcagaggccuaggagugauucauuaagcagaacucagugcccggaacaauucagacacaugaucuguuauaugaauagagaaauacucaacugaguuaguagaaucaauuguuuuauaggaauuuuauauuaaugaaauauuauaucaauauucagauaucuauuaacugcccuuuguccauuuugcugucacucacccaaaaccaucggcacuguugaccaccuuacacuaugagccuaguguuaauguaguacaaggaagcagaagcuauaaccaacacuguaaugcgcuuuccucaggauuaaauuuuguuuuuaauacuuuuauugagauuucauugugucugcauaauaucccuaugaaaaagaucuuauauaauucauuguauagauaaaagaccauguuagugagauaauuaucucaccccaagucucacaagcgaggaaacagucaagauucuaaagcaggcaaaggugguugaccagaguguccaacccuaguugaugcaucuacaauacaaccccaacauguaggguuggagaauacugaggaagguggcuggggagacuuguaaaagcaagagaaucaggaugucugcuccaagacaguguuuuccacauacaacacucaugaaauuucaaccauaugaucgcuggcuaaacaagaccugaaaaaugacaauagcagcugacaugcuaacauggauggaagaagucucacaaggcugcagcccuagagaaagagcuacaggcagucaauggugcugggaagaaucagugaauccuccagggagcccccacccacacacacaccauaguaaguggucaguccuaaacagaugcauaggagcaauaaagaaagcacucagcaggugguguuuauauaauuauauauguaaccaugacacuuacauaaaagaguccacgaaucggagagaaguuggaggaaggacagggaggaacaaauccuauaaauacaguacucaaaauacgaaguucucaaaguaauauccacacugaaaauagcuuaaauuauacggcccuuucuucugcuauaguacacaaaaucuguccucaaagucauuuagacagggaagguuagaauuucagccaucaguggcucuugaacagaggaagacuguuauauacccuggaaaagacuauugaguaagggcauuuuaaugucaggguaggucuaccaggguuuuagugaacugugaugucuacaaauugaccagaacaaaggacaaaggacagcuaaagcugucaguacuccaagaagcaaacaaaagcaaaaauuaagagaaaaaaaauguaagcaaauauucaguaaggauucacuaugccacuucugcuguccaaggcuuggggcugggaauaugaaaauaaaccuuggcucaucuuccauuacagugggauaaccaaguagagagagacaguggauuucauacauuacagaccuuaaacuuaaaaccaaaaaccaaaaacuacaguugagauaaacaccacaaaaccuacagugcauuacaauauugucuaagaggucagggcuaacuuccacaaggaacugacauuuuacgugagcucuaaagagugagugaaguggaaaaaaucggaagagaacuuaaagucuggagggcgaaauaugccucaucugggacacuaggaaggcugcauggcugggccagagggugaacaagauggcugccuuugggagaaugggcugagggauaaaagcagaggcagguaacccaguuaggagguuagugcagacaucuaugcaagaacugaauggguuaauagaagucaaaaccacauugccaagauggcuuggaugugugccaggaggagaaaaauguuaaggaguguuuaagcguuuuguuugcucaaauacagugaugguucuguuuauaagaucaacucaggaaggccugugcuucacuuuaguaggguucagucugaagagcacagguaaugggggagaguuaagaaaacacacacacacacacauacacacucacuugcacacacacauacgcaugcaugacacacaacuguaacugaauagcaugaaguuaggauugcauuuagagaaguacaaaacucugauaaagauggagaaugagagaccagcagcuagagaggauguugugucagcaaggagggauuggccaaugagccccaaaguuagcagaaacagaaguguaaaaaugaguucaaugauauagugccaccuaucaucuuagaccuuuuugugaugcggagcaguggacacaagucuugaacaucugcuuuggacccaguuaauauuuguuucuaaucacccuuuaguuugaguagcaucaucugcacguuaauuauuuuaccauuacuuacuaccuaaagagccuauaaaaauaaaacuauuacuuaaguacaauauaugauuccagugaacauuugugcuuagcaacuguucaucuuaguaacuucuucauccaguuugcauagaaaccagccaucuauuuuaacccucgaagaaaagcaggcuguguugaauguccuggaaccauacagcaaacuccagcagggcauucuccaggguuauucagacuauuugcaauuuccggcuuaggugcugacuucagaauggguuuaaaguggcacaucgaagagauuguccugggcucagaccauacucuagagguuaggcacucugcugcuaaaagcaugccggaagccuaaaggucccguacuuuccccuggccugauucacucugggcuaaaccuuuuaugucuacuuuuagaguccgaugcuuguaaauauccuuuacucuagaagaguuaauauaauagagacuuuaaacgcaaacaagauaugcuugucauacacgauuaguagaaaaagcaagaguuaguuucuccuacccacaggcuggguugcucugucggguuuagacuccgguugaacuagaagcaaauucugcccucuacuguaagagacuggauuuaguauagucaauugcuuacaguaaacuuuuaagggccuaguuauaugacccaaccaagccugaaaguggcuauguagccuaggauggccucguacugggggcgaccuccugccucugcguuccaaacacuggauuucaagugugcacuaacacacaggcuacgguaaacucacucggucaccaccugcgggcagcgagacagcaaguaaacugugagucagacuugggaagccugugcuuuucuuacacccucuguccuccgcagagcucggggacgcgcugggggcuagccuggccucucgcugccucccugccacgugacugcgugagcugcgggggcucggggguggcguuuaccugcugccgguccccaccagguacguguuggugccuugcagggucaugggacccggguugcagcccaacacgcgcaccacccgacuggacagcugcucgaugcgcugcagagcggcagccaucucucuaucuaccucggugaccgccggcacccgaauuccaagucacucagcgugcugcgaccucaggcucggagggcagggcggcggucucgugacg

SEQ ID NO: 72 - RNA, 1199 nt, Mus musculus
ggggggugcaacgaaauuuauugaugguauucaagagaguagggagggcuuccuaggccccuccuguuauggggaucugggguggaaauugugagggaguugcucaguguugggggccgaguugggauagggacuccucagcaaccgagggccucucucuugcucucaauguccuugcuggggugggugguccaggguuucuuaguccuuggaggccauguaggccaugagguccaccacccuguugcuguagccguauucauugucauaccagcaaaugagcuugacaaaguugucauugagagcaaugccagccccggcaucgaagguggaagagugggaguugcuguugaagucgcaggagacaaccugguccucaguguagcucaagaugcccuucagugggcccucagaugccugcuucaccaucuucuugaugucaucauacuuggcagguuucuccaggcagcacgucagauccacuacagacacauuggggguaggaacacggaagcccaugccagugagcuucccguucagcucugggaugaccuugcccacagccuuggcagcaccaguggaugcagggaugauguuccgggcagccucauggccaucaugccacagcuuuccagaggggccauccacagucuucuggguggcagugauggcauggaccguggucaugagcccuuccacaaugccaaaguugucauggaugaccuuggccagaggggcuaagcaguugguggugcaggaugcauugcugacaaucuugagugaguugucauauuucucgugguucacacccaucacaaacaugugggcaucggcagaagggauggagaugaugacccuuuuggcuccacccuucaagugggcaccagccuucuucaugguggugaagacaccaguagacuccacaacauacuccgcaccgaccucaccccauuugauguuagcagggucucacuccuggaagauggugaugggcuucucauugaugacaugcuucccauucuuggccguugaacuugccguggguggagucauacuggaacauguagaccauauaguugaggccaaugaaggggucguugauggcaacaaccuccacuuugccauguggagagcagaaggcagcccuggugaccaggcacccaauauggccaaauccauucacaccgaccuucagcauu

SEQ ID NO: 73 - RNA, 630 nt, Mus musculus
ggaacucucuuccacauuccuugcugcuggagagagagcacuccgccagggguaggugaaguaucccaagauggcugggcguaaacuugcucuaaaaaccauugauuggguaucuuuuguggagaucaugccccaaaaccagaaggcaauuggaaaugcccugaaguccuggaaugagaccuuccacaccagguuggcuagucugucugagaaaucaccugugauugauugggcuuacuacaaggccaauguggccaagccuggcuugguggaugauuuugaaaagaaguauaaugcccugaagauuccugugccugaggauaaauacacagcccugguggaccaggaggagaaggagaaugugaagaacggugcugaguuugugucuagaucucagcucaggacccaggaguaugagaagcagcuggagaaagcgaggaacauaauucccuuugacuagaugaccagugaugacuugaauaagaucuucccagaaaccaagcuggacaagaaaaaguacccauacuggccccaccagcccauggagaaccuaugaagcagucugggacggagccccggaugacaugaaauaaaacauuuaaauagugagaaaaaaaaaaaaaaagaaaa

SEQ ID NO: 74 - RNA, 38409 nt, Mus musculus
cagcugaggcacggcgagcgcuuucgguuuaacauggcggagacggucuccucagcggcccgggacgcgccgagccgugagggcuggacagauucggauucuccagagcaggaggaggugggagacgacgcggagcugcuccagugccagcuucagcuggggaccccgagagagauggagaacgcggagcuuguggcugagguggaggccguggcugcgggcuggaugcucgacuuccucugccugucucugugccgagccuuccgugacggccgcuccgaggacuuucgucguacucgugacagcgccgagggugagugcgggcucccgggccggaggcugcgucgcggccgagaccugcuugccccgcacacaccggggcgggaucccaggcgggagacggcgcgaaaccggccgcuuccuguuugcuggaaguccuggcucccgcccccacgccuuccgcguccccuggacagaauguuuguuuguuuguuuuaaagggagccagcccaguugcuaccgcugcuucuggagccaaacucuaacagaugaauauagaaacauuuaagaagggccgggaugcggcugccaagggagguaguacagcuugucaaugcuuaucuugcaagccagggaaccugcguuugauccccagagccuaugccauacacauauacuuacagcgcugggaagaccggugacuagggcucacugaccccuggcccaacccaauuuggcaagcuuuaggccaguggaaggccaaaaacaaaggccuggggaggaaggauuuuuaaacuccaggggaucaaauuuccgucuuuuggccucaacgggcacuguauacacauguuacacagacagacgugcagguaaaauacccauauucauaaaauaaaaauaaaugaaucuuuuguuuaaauguuuaaaaaguuugacagugccugaaaacucagacccaaguuugucuucuggccuguguguuggugagagacauccaggaauaugguuggcuuaccaguguacauauucacugccaaguguaucuuuguguuuguucaaacacgccuuuaaucccagcacuugggaggcagaggcaggcggauuucugaguuccaggccagccuggucuacaaagugaguuccaggacagccaggucuauacagagaaacccugucccgaaaagccaaccaaccaaacaaaaaagaaauaaauguuauaaaguugauuaugaauugaacaaguucaauggaaaccuuuacauauguauacuacuuccuaaaauacaaagaacuucaugguauaaauugcaaaguagugauuugauacauuuuauaauuuagaugugaaucuugguaaaaacaauuuugaguaucuguuucacauuugaguuaugguuuguuagaacaguaauauuacaacuuuuuaaagauuuuuaaaaaauuaauucgaaucuacaguucuaaauuuaugaucaguuuuuguugaguauuauauuaggguucucuugaguaacaacuuuuuaagaauccaguaauguucggucuaugaugcuugauaucgccaguauaugccagaaucccaaagucgacuccacugucagugaaggaauggacuugcuccugagagugggaguaaguggggagagggagagcgucccucuuccauguccucuauaaaggcuuccaccagaaggcgaggcccagauuggaggugaguuguuccuccucaaaagaucuggauuaaacauuugucucccacuccaaagucccaauuagaagcagaauucccacuucaggugauccagguaagcaaaaaauaacucucagauguacccagccauuuuuagguuuuaguuaaaucuauauguagucgagaacuaagaauaaccauuccuguuuauaaacuaauauuuaacacuguauugugucuacacaguagguguacuaguuugugauaauauuuuaauaaaagguuuuuaaauuuuuuuuuuuuuagcuauuauucauggacuacacagacuuacagcuuaccaauugaaaacuguguauauaugucaguuuuugacaagaguugcaucuggaaaggcccuugguaaguauaaauuuuuuauuuuauauuuagaaaucuuuuaacuuauuuauaaauauaacacaugggaaacugauaaucauauuuuccuguuuuaggcguugagaaaguuugcuuaccugcaucugucauacacauaagcauaucuaaagcaagcaaauauaauuuuaucuuucuagaacagugacucucaaacuuuagccugccucagauuauguuuuaaagagugucuuaaaacaguagggucauucugccucacuaugaauuuagcucccaggugauucagauguagcgggaggacuacauuuuauagacugcuggacacucgggggugaaguuuucuuauauagcuuaguaaugacagcaauuacauauacaauguuuacuggcagcuauuuaaacuugaugcugguccuuauacaaaagaacaugguuuguagcuguaaucugucucccuuauuuccaugguucauuuuagauuguaaugagcaacuuuguuuauuuuaucaaucaugacucauguuuacaacauggucauuuaaugggccguuuuguaaaaauaauuccauuguuuuuuauaauuugcaaaauacuuucccaacaauucuugcuggugagcaguacugacaugaaacugcuuaguuauuuaaacucccagaauauuaguaccauacuaaaccauacccuggucauguagccuguuuuauuuggagacugaaauuaggagcuugucugacauuauuccuggaaaaauuaacacucuccucacaauaugggaacccaugacaaaccaaagcacuacugccaccagacucugaguugguguaguuaucuacagggucguggguaacuccaaggcagcugcaugaccaaaagcucacaccagcaugaauggcaacucagcaaagcuggaaccuuggagcuuucuggauaacuugagucuucugaguuguuuauuuccugagucuuuauacacuuccuucuaggauagaauguuggaauuaagaaaaagcuguugcacaacagggcuauguagguuagggccuuuggcugaaaaagauaauaggcugguauguacaucauuagaaaauugaagccauaacuuacaguauuauaguuuauggggugguuuuguaaaugggaacauucuaacuaccuagcaaugcuuuacauaguuacuccuuaugucuuaauuucuuuccaggaaaucuucccuucaaaacaaggauaaaaacagauuaugaguaacccuaugguugauuuguuuuguuuuguuuguuugugcagagacagggauugaacacagggucuuguuacacacauaucuauccuaaacucauggcuuaaucuuuaaauguacuaagauucuguuuuaaauauguaucuuaggaaaaucccuaggaucagcuagaaagaaucaauguuuucacgugauugacuugaaaaagauaguaguuaaaguuuaggggggguuugguuuguuguuuuguuuguuuuacaguguuauguaucuugggcuuugacuugccagguaaaugugcuaucauccagcuauagccccauagaauuucagaauauauaaucuuucugugauugguuuauaguaguauuuccacuagaaauucggucuauguuugaaauuuacaauguuuuaguuguuaaauuaagacaacuaaaaggaaauacaauucauuguaaugauaucuuauuuacuaacucaguaauccaauauuuuuaaaauauaccaaguaauauagaaaagguugagauauuuuuguaguaaguuuaugauaaagcauaucuguuuggauuaguugcauugugacuucuaagugcuuauacguaagcuagugggugccauauugacuucagucuccagccccacagagcuauaaaaugcaacagugacucaagggaaaaauauguuuauaacagguuucucaucucaaaagacuuacuuuuaugugccccaagcugcccagaaucugauaguccuucugccacagccccgaagcacaggggguuuacaggugugugccaccaugcccgacucuuaauuuuguaagaucugagacuaggaauguccaugccuccuacagaacuuaguugauggccuguagggaaaggcgagugaguguuuugaauuucuuuaguuuuccaguccacuaacuuaaugauaaagaaacaucagcuuuucuuauuuuuccauuccccugaaaauaccgccugcuuuaccagaucuugagacgccauccaaaauaagaacaggaaaggagucagguacaaauuagcaguuugccuccaaggaggcucucuucagaauuuuguuuccccuugccuugccuuuguuucaugcuugcuccuuguccuacacaaugugauuugccaccuguuuucuuaauuggagggaagauguuugugugacugaucucuagcacauugcuccuucuguuuacuauugcuuuccuuuugcuuuugcuauuugagggcuuuggcuuuuacacauaaauuuuuccccaguucuaugaaaaaucuaagugguauuuugauugauugcagcgauucuguagaucacuuugauaaaaauaacaauuuuuacaguauucugucaaucccuaaguauaggaaaucuuuucaucuucuagugucuucaacuuuucaaccucuuuugcaucuuaaauuuuuuauuuuauagaucuuuccucugaguuaaguuuauuccuagguacuuuauuuuaucaugaaaagauuuuuguuccuugugucuuucucaacaaacuuauugauauaagggaaaguuacuaaauuuugcacuucaauuuuauauccugcuauuucacuaaauguauuuaucaaaucuuaaguguuucauggugaguuauuagggucuuuguguacaggaucaugcugucuacugagaugaacuuuucuuugagacaaucaguaagugguuuuuaacgguccuggcaucuaccucucccacuuucuagcugugcccuuuucuagguuucugggccugcuuuagagcaaggaugauagccugaugaccuuuaccuauuaguaagaauuuuuguuuuguuuuguuuuuuaagacaggguuucucuguguagcccuggcuguccuagaacucacuuuguagaccaggcuggccuugaacucagaaauccaucugccucucgagugcugggauuaaagacgugugccaccaccacccggcuguaagaauaucuuuuguaaauuguagagaaauuuuaauucagcaacauagcugcucugacaagagaucacauccaaagauguuuuaggucuguaugauugagccauagaauuagaauggcgacacauucugaauuacaguauaauuugagugaaauacagauauauucuuugugcacaccucuauucccaaugaaaguaaguuaguuuguagaaggaagcagccguguuugaaagugaaaucuaauugggggauagacaaagggaugaaucagagaaagauuugacagaaugagucagggauaggauacauccaacucucacgaggacaggaaagagaggcaacuugaaagaaagaaugggagggagggagggagaaggagagacgggaggggaggagaagcaguuuuacuuggacaguuuuacagaaacagauugcauagagaacaagcuagacacaggugaagacaaaaugagccagagaaugagaaagccaagaagaguagagcauacugccaauguuaguuugaggccaagcagagaaauucagucagaagcuagacugcagucaaucacuuggagagcuugagccagaacagcugaguucaacaagccaagaguucagaaagaacuagaaaaguugaguguauucagcagcaagccaucugggaugacaucaggcuaauaaagguacuguaauaauauaccucagcuuucccacacauugucuuucuauccugugugguuuucuuggcuauuuucucauuauccguuuuguuauuuuuuuuuaacagcucuuugcuucauguaugcacacugaguguucuacuucugaacugcaucccuuuggccauauucuaaagcuuaaacaguuuccagauguaucuaguuauccauauguuugaaaauuucagaauaauucugaaguagaauaagcauagagacucacuggcauaauaacauauuucuaagaaaguaccgguuauauugucugaauugcaucauuuauggauauucaaauuccacauggauaggaauugcuuuuauuuauuuuuuguuuguuuugagacaaggucucacccaggcuaggcuugaauuguuggugaugcuccugccucagccucugaagugcugggauuauagacuggagucaccauguauagugguuucucuuuguguuuguauccuaaguacuuacuuagagcagcucagauuauaaaugaguaauuuuuuuuuuaauuugaaagauugaaaaugcccaaagaggccaacagaaaauaaaacuguaaugugcuauuuaguguauggaauuauacccagcuuguuauuucucuugaauauauuuauuuauuguguaguugcauugaaaugaaccaaaacagcucugaaacuagaguuuuagaggaauauaaguaguuaguaguuccugcccaaaaaauguaaaauacaauaagaauauuuuugccuuuagguuaccuaaaaugauagcuagacaugguaguacauaacuguguucccaguacucuggaggccaagaccuugucuuaaaaagauauaaauaaauaaaagauaaaaugguuuguuuguuuguuuguuugccuggcaguaggggcucaugccucuaaugccagcacccagagggcggcaggugaaucucugcauucaagcccagcauaaacuauauaggaagaguuccaagauggccaggacuaugaagagaaacccugucuccaaggaaaaagaaauuucugacuuuuauaauuucaguggguuuuuuuguuuguuuuauuuuagugaaaaaaauaacuuagaaaaaucauuuccggagccgggcgugguggcgcacgccuuuaaucccagcacuagggaggcagaggcaggcggauuucugaguucgaggccagccuggucuacaaagugaguuccaggacagccagggcuauacagagaaacccugucucaaaaaacaaaaaaaaucauuucccuaaacgguuguguauggaaugcagcauaugcuggguaaaauggagacagaauaaacuuuaagguucuacuuaaugcucaguuaacuuacuuuucuguuuuaaaagaugcacaguuugaaguugaugagcguauuacacccuuggaaucagcccugaugauuuggaacucaauugaaaaggaacaugacaaacugcaugacgaaauaaagaauuuaauuaaaauucagguaugaguauuauuuuguguuuauugcuuugcuagaauauuguaucaaugacuuuucucauugaugagacaaaauacugaacaagaagcaacuagggagguugaagggauggcuuagugcuuaagagcauuucugcucuuucagagggccaaaguucaguucagcauccacauuaugaguucacaaccaccuguaacucagcucucuguucuggucucugcaggcagcugcacccagguauacauauaacacagagauuuauguacauaacagaauucugaagaaagaaaugaaaaaaguaaugagaagaagaguuuguuguagccuguaguuugggaaggugcagucugcguuuguggggaaggcauagcuguaggaggaugaagugauugagauguccucagucaggaggaggacacgaaugggaguguccacuuacuccuuuguauucagcccauaacagaacccuugccaauggaauggugugccgauguucaggcugguucucacuucucaguuaaaccauucuggaaauaagcuaagucagguaaacuugaaaauuaauauuaacugucacaacaucuaacacccaaaaaaaguaaccgguuagaguugugcuguaaaccuuaugaaaaucuuaaaaucuuuucuuuuagagcauugccccacgguuuauagucuucaugugagcaccaggccgagaacuuaauguuuauauuuagguauaugccacuuccaugguacaggaaacacuacagcuauuuaaagauuaccaagcaaauuuuaaaaugaaggacucauguucuucucuuuuaccuaaagacuguaaagaugggguggggguggaggugcuuuggccugcuuguuuauugugggguuuugacucugguucuagggauuagacccaaggccucacacaugcagugcauggauuuuugugaauaagagugugcagaauuuuaacaaugcuaagacaguuuuaguagucugcuuaagaagagacaaaacgggcagguaauuguagucaaagcaaauauguacuuagugcaauaaauguuuccucagcuuuagauuuuuguuauuguuaaguugcacaagagagagagagagagacccaaggucaugucuacuuucccuacuguggugguuuagguggcccuguggugaauuaggaccuggagauaagacacauuggguagaaaaaugacugcugcuuguaaaaauucaacuuaggacaaagauuuuuucauguuuucacaaucuaugggucucuaagaaaccugacuuugugccgcagacccucuggaucccuuugucugcguagaacgggucucuggggcaggugggcaaagugucggaggaaaugacagacagagcaacccgagagauuguguagaaucugaauguaaucugucaggucgagcaucaaacuuuuuuuuuuuuuuuuuuuuuuuguuuuucgagacaggguuucucuguauaguccuggcuguccuggaacucacuuuguagaccaggcuggccucgaacucagaaauccgccugccuucaaacuuuuuauaguacagaaaauacaaggguaggaagucacagcaggcaagguacauugaaguuaccagguacaaaacaaaggaaugacuuccaaaggauuuucaggaaccagguaaauguuuaaagauaaagcaguccugccuagggucagcucagugacaggcaaggauuucacacucuagugcuauagcuuugaaccugugaaggcuagcaccaggggguucugcucuuggcagaccuuaggaauaaugcaauaucacaaccccccuaauuuccuaggccuugcuaaauucuuauaugaguguaacuuuuaaguaucuggagaaucuccauuugucuggagaauauaccagcuugcuuuuaauaugcaauguagccuguacugaagauuucuaucucagugagauucccuggcucuuugagcagaccuguugagccacuggcucugucuauuguaaugcuuaauuaguaacugaauagguaacuuccuuucugcauuccugccggauuuuaagcucggauuucaagcuugcaggcuacugggaccuuggaacacuauaacagaauuuaaucuuaaaaggcauuuauaauaaaauauuuaaagagaacucguagauccauacaccagacuaacucgggaauagaguaugaguaugagaaugucaaaacuccaggaggugagcuuccuugaaacuuccucguugagugcuuacagacuuuuucagccugucaagcagacccgaccagagggcguggcaacuuuguuuacuacacuugcugacaguucagaaggugacacuagcauuuaguauauuucugguuuugccacacuauuguacaaguuucacaucaguucuguggcauguggguguacuguuucuaucagagaaauagggaaaugaacagcaggaucaauagucuuucccgauaauaaauugacuuauaauuuauuaacuccugcuuugggauguugaacauguuguauaugugcacagagcuagugaauauuuuuaagacauaauuauuucaucauugaaaaaugacuauguuuuuaucaagugaugcauaaaauguuuuaaaugaagucguuuagacuuaacuuuaugcacuuagucaaauaaugauugaauauuuuaaaaagcaaccuaagguuugucuauaucgucuuuaaggcuguagcuguuuguauggaaauuggcagcuuuaaggaagcagaagaaguauuugaaagaauauuuggugauccagaauuuuacacgguaauuauuuguacuaaaacaauagaauuaauuuuaugacucgauauggggugaagaaaacagaaaauggaaggaggagaggaaagcuugaccuaacaguauauuaaaaagauccauuuuaacacuguaaucaauacaaaaauuuaguauuuuagcuacccuuuuaaaaaccaagucuuuauauuuacaguauguccaacuugauagucaacacauuuugagggcucagaagcuacauagagggcuggcgacugccacauuagacagcguaaauauagaguggccuaacuucuguauuuccuauuuguguguuuguuuauauuauuacuguauuguugagauaaaaucugguucaguagccagugcuaaccucagaacucaagauuauuuugccuuaaccacuguaguacuaggauuguagacauguacuacugggccuguccccauuuuguauacguuuccccuuuuucuuucccuuuccuuuucuuucuuugagauagggaucuugagacugugucaccauacccagcuggaguuugugauaugaucauuuccaguuugugucuguguauauuaauauaaucaacaggccucacguuguuaaaauaguuaaaacacuguuaaaaauaguguuauuggaguaaauuaaacaucuucaaggaaagaaaaaaauauuuguaguuaauuuuuuuacugaguaucuaucuaucuaucuaucuaucuaucuaucuaucuaucuaucuaucuaucuaucuaucuaaaugaauauaguauguccaaaguauguaaguagauauguuugcaccagggaacacaguuguguaagcagccccuacaucaggaaauaacugaacucagaauauagcucuauaggauuugucuaacauauacaaagaucagccaggcaugguaucaugaucaagaucagccaguacaugcccauaauccagcacugaagcaugguggucggggaauguuggaagguaauauccuuaguuaaagacuagcuuggcuauaguaaaaucuuuuuucaaaaccugaaccucaucaaaucuuccuaucacuugaggaaaugguugucuucuccaggguaacuacuaagcagcuuccaccacuaaagauuuguuuauaaugguaucaugccagguguacuuuggaauagaauuccugggugauugacuagaccuaaccauuugugguacuuauuugcuguucacuuuucagguaacauucauugaguuuuagcaggcacugccaggacuuuuccaaaagaguuaacagcacuuguucuguagacuuuacuugugguuuucauuucagcuuuccuggcagauacuuaguucuaucauacuugguuuaccugaaaacuauugaagguagaaugucauuugauauguuaguaaauacaguugaggggguauuuggcuuaaugaauaacugacuuagccuaauugaguagguaaagcauuauccgauuugacccuucucuaaggguauaauucuccccgacccccgaaauuucagcugagagccagaugauuuuguugaguuuucuacccauauauuuucuucuuaguauuaguagauuaaugaaaacucuacuccacuucugucucauaagaggaaaacuuauggccaauaaacauuaaacacuuaggagacaguauucaaauucccuaauauuggcauaaucagugggacuuuaccaacccacucauugagcuauuugccauauucucagaccagcaccaauuucuauugauugggacaucaacaauuggcucaaaagcuggcagagugcuuagacagcuuagacaccugcauaucuuccucucugggguguaaauugauagguuagagagacuagugaaauaugcaugcacacaucccagcaagucucauuucuagguagaagacaagagaaaacacagaucuuauugagacaauuaguuuaagaucaaacuuacagguucuguucaaguucuauaguauuuacugcauauccagcauucagacaacuacuagugaagaaaaaccuauauugagcaaaaaaauauuaagagaaaauguuugagaauugcaguaauagcaacuaaguuuuucaagcagcuaaauaaacaaaugaugauugaucaguauacuagacagugguacgaauaacuuuuuguauauguuaacauaaagaauugccaagaauauagaaaugaggaaaacauagcaaguuuuaggggguggggggagaccacucacacaaaugauaccauuuguauaaaaccaaagcuacaagacuucagggacggugccgcaaaguaaaguucuugccaugcaaaagcaugaggacaugaauuuagguucccaacauacagacacgguggcagaaaccuauaaucccaggguuagugaugcaugcagagaucagcacacauacacccaaaauagcuaaguacaaugaaaacugugguaaacaguacuaucuauugcuuauagacauaaauauacaaguauagagagauuuauuuuuggggagguggcaagacuggaaguggagcccaaggcauuguuuagacuugacaagcacuguuucugacaaacuauauacaucccuucagcccugaagaguuuguaaagauaguaaauucugaauuuugaauaauacuuauaagugagggcaaagaguaggaucagauuacaggcauaaagagacuuuagccauauugauaauguuuugcuuuuaagcuggguaguggacaauuauguuuauaaucuguuucuuccuaugugucugaaacaaaaugucggggcauuaaagaagacaauacgugugucuuuuaaagcauaauuacaauucuuaauuguaucucuauuaguuuauuuuuacaaaauaauuguuuuucaauuaaauauauauuuauaggaaaugagauuuguguuuuauaucaauacauuucuguuguuuuuuagccuuuagaaaggaaguuacuuaagauaaucucucagaaggauguguuccacucccuuuuccaacacuucagcuauagcugcaugauggagaaaauucagaguuaugugggugauguguuaagugaaaaaucaucaacuuuucuaaugaagguacacguguuaucucaaggacaguaauuguuauaacaaacaguacuuaaguguuuuuaagagaaagucuuaaaaucuaauccaaauuuuaaauuaauggguuguuaaagaggcuauuuucauuaauuugaggugauuuuacuucaaaauaauuagguguguacaugaauaaguacacaugugggugugugccaggagggggcaucacauuccuugcaccaguugugagccaccugaugacgggaccugggaacuaaacucugauccucaacaaaaaaagcucuucaccacuaagcccugaauccagccacuaaaauuuuauuuuaaauugccuagagagcauuguaucuaucaaauauauuuacaagagaauaaaaccuccauaaugcuuauaaaccaagcaauaguaauggcguuccaaguauugucaaaaucaugaaaauaauuugguaccuucuguugacccgugaacagaugauucugcugcagcuagacugugugcuacuuguuuaaaaugccuaauucguucuuuuuucccccacccacuucauaaucaaccuuuuuaaggcagcaacaaaaguaguggaaaaugagaaagcgaggacacaagcgucuaaggauaggccagaugccaccaacacuggaauggacacugaaguugguuugaauaaagagaaaagguuuguaugcucuugauguuuggcuuguuuuaggaauauuauguguuuaacauaagugaugcuaguaagccauuauuaaaaguaauaauugaguaacugaugugaucucuaauugaucguuugaauauuugaaaugcuauguaguuuuguuuuuuuuaaauauuuauuuauuuauuuauuuauuauauguaaguacacuguagcugucuucagacacuccagaagagggcaucagauuucguuacagaugguugugagccaccaugugguugcugggauuugaacucaggaccuuuggaagagcagucagcgcucuuaaccacugagccaucucaccagcccugcuauagaguuuuuaugacuuauacgaauuagauguuaauguagggagugagaaacuguuaguuuaauguguauaaauuuauuuacuaauuuuagugaaggugugcauaagaaaugagguugaaauuggaagccugguucauuugccucuuauuugagcucagauuucacuaaguuauuuugguauuuuaagauauuguucuccauauuuucaaucauauuaugcaccacucaaaaaaccaaaacccauuggccccaaugcugcaggaagugcacuaguugguccuaucuguuguaaggcuuaguuaaucucagguugucugaaaaugucacacauuuucaaggcuggcuuuuacuuuuggauuuugcuugaacagcauccuuagcugggaguugagcuuguuugguuuuguuuuauucuuuugaacagcuuuuuauguaacuucaucuggccuuaaucaaacauucacugccacugcggcagacuuuaaagagaucuugaucccccugccuccaccaucuuagugcuacauucauaaguauaugucaccacaccuagcugaggcguagagggaagaggaguguccgagaacaaccugugggcguuggcugccuuuucuaucagagauggaauuuugguagucaaacuuggcagcaaacagaaaccuuuacccacucagccaucucucaguucaccaaggguaaaauguuuacuucugucucauaagcuaacccuauugaagaagauaauaaaauuugaccaugaaaauugguuauuguuuuaaauccuauuuauuaacugguguguacgugagugcaugcuucugugaccauagugcacauguaaagguuagaagaugcuaaguaguuggugcuuccuucaaggauggauucugggaagugaaaagaaaucaucagguuucagagccaucuucucaacucaagauuucuucuguuuaacccgugauagaaucuuuuuguuguuaugcacuuaacgaagacuaggugguuagaaccuuguguucucuggauggauggauuugguggcccacauaauacuuaaaguuccaaggaugcuaucuuaacuauauuuaaagguaguaguuggacccccuaguuagauaaacacacuugauuguaaccccuuaggacucgggcucaauuguuuuagaaucuucccuccuuuuguuccuuuguauccaaggacaguuugcuccucagucaucucaaagguauauugaagucuuguuuuguuauugacaaacaucucauuuugagaauuaaguaucuuauuuuggcuuugguauuuuuuguuugaagccaucuugcucaauguaauagugcuauauaauagaauuaaaacuuggaucaugauucuuagagauaauauuuccuguggucucuccuuauagagcaccacucauguguuuaagaggcucuccuagguacagauacagugcagaguguaaaguagaacccucaaguucccaucugcuucuuuauacugugacucuccuugucuuuauacauccaacugucuuuccauuucugaaaugcuucugaugauuuauauccaagauuauaauaugcuuuguaccacacaaauacauucuuaaaguaaggucuaggauugacuuuugcaaaaguaaauguuuagauuucuucccaacuuaaaacuuuuaguucagaauaguaaagagauugaacacaggacaggacaugaaucauacuuuuuuucuguuauugaaaauagauuguuuuuuaauacaauauguucugauuaugguuuucccuaucccuacuucucuuaggucuuucgcaccuucccuuccauauggauccacaucuugugauuaucacauuagaaaacaaacuggcaucuauggaauaauaauacaaugagaugaaucaaaaacaaaaaaauaugacaaaaccaaacaaaaaaaguacaggaaauauauauaggugcacaggcacauguucccauacuaaagaaucaaaaaaaaaaaaaaaaaaaccccaaccaaccaaacaaacaaacaaacaaagcaagaagucaagauuuaugcccaaaggaccuguaagauacaaaaggcaagagaacguugauuuaauauuaugagauaaagaacauccaaagaugcuguugaauucauuuuguguugggcuaucuacuacuaggccuggggucuacccuucuaaguggcuuagugaugggccaugugucuacuacuccucccaauaccagaaccucaugugguacagacucuaugcaugcugccacagugucugugaguuuauaugugcaccacucugguuuugucuagaaggccuugauuucuugauguccuucaucccuacuggaucuugauauuguuuuuuguuuuuuuuauuuugguuuuucgagacaggguuucucuguacagugguggcuguccuggaacucacuuuguagaccaagcuaaccucgaacucagaaauaccccugccucuggcucccaagugcuggaauuaaaggugugcgccaccaccgcccggcuuuuuuuuuuuguuguuguuguuuuuuuaaagauauuuucuuuauuuacauuugaaaugcuauccugaaaguccccuauacccucccccuccccuaugcuccccuacccacccacucccacuuccugacccugguguuccccuguacuggggcauauaaaguuugcaagacuaaggggucucucuucccaauaauggccgacuagaccaucuucugcuacauaugcagcuagagacacgagcucugaggguacugguuaguucauauuguuguuccaccuauagccuugcagaccccuucagcuccuuggguacuuucucuaacuucuccauuggggacccuguguuccauccaauaaaugacuaugagcauccacuucuguauuuuccaggcacugguauagccucacaagagacagcuauaucaggguccuuucaguaaaaucuugcuggcuuaugcaauauuuucuggauuugguggcugauuaugggauggauccccagguggggcggccucuggaugguccuuucuuccuucucagcuccaaacugucucuguaaauccuuccauggguguuuuguucccuauucuaaggaggaaugaaguauccacacguuggucuuccuucuucaugauuuucuuguguuuugcaaauuguaucuuggguauucuaaguuucugggcuaauauccacuuaucagugaguacauaucuagagacuucuuuugugauuggguuaccucacuaagaaugauauccuccagauauauccauuugcccaagaauuucauaaauucauuguuuuuaauagcugaguaguacuccauuguguaaauguaccauauuaucugaauccauuccucuguugagggacaucugaguucuuuccagcuucuggcuauuauaaauaaggcugcuaugaacauaguggagcaugugcucuuacuaccaguuggaacaucuucuggguauaugcccaggagagguauugcuggauccucugguaguacuauguccauuuuucugagaaaccgccagacuguuuuccagagugguuguacaagcuugcaaucccaccaacaauggaggaguguuccucuuuuuccauauccucaccagcaucugcugucacuugaauuuuugaucuuagccauucugacuagagugagguggaaucucaagguuguuugauuugcauuucccugaugauuaaggauguuggaaauuuuuucaggugcuucucaguccuuccauauuccucacuugagaauuccuuguuuagcucuguaccccauuuuuuuuaaugggguauuugaauuucuggaguacagcuucuugagcucuuuguauacauuggauauucgucuccuaucggauuuaggauugguaaagauccuuucccaaucuguugguggccuuuuugucuuauugacaguaucuuuugccuuacagaagcuuugcaauuucaugaggucccauuugucaauucuugaucuuacagcacaagccauugcuguucuguuuaggaauuuuccccugugcccauauuuucgaauguuuuccuuacuuuuuccucuguacauuucacugucucugguuuuauguggaggucuuugauccacuuagaauuuagcuuuguacaaggagauaagaauggaucaauucccauucuucuaccugauaaccaccaguugugcuagcaccauuuguugaaaaugcuggguuuuuuucacuggauaguucuagcucccuugucaaagaucaagugaccauagguguguggauucauuucugggucuucaauucuauuccauugaucuaccugacuguugcuguaccaguaccaugcaguuuuuaucacaguugcucuguaguacagcuugaggucaggcauggugauuccaccagagguucuuuuauuguugagaauaguuuuugcuauccuaggucuuuuacuauuccagaugaauuugcaaauugccccuucuaacucugaugaauuguguuggaauuuuaauggggauugcauugaaucuguagauugcuuucggcaggauagcuauuuuuacuauauuaauccugccagugcacgagcauuggagaucuuucuaucuucucacaucuucuucaauuucuuugucagagacuugaaguucuuaucauacagaucuuuuacuuccuuagucacaccaagguauuuuauauuguuugugacuguugugaaggguguuuucauaauuucuuucucaguccguuuauccuuuguguagagaaaggucauucauuuuuuuuuuaauuuuuaauuuuuuuaguuaauuuuauaugcagcuacugcacugaagcuguuuaccagguuuaggaguucucugguggaauuuuuggggucacuuauauauacuaucauaucaucugcaaauagugauguuuugacuucuuccuuuccaauuugcauccccuugaucuccuuuuguuuucuaauugcuccggcuagaacuucaaguacuauauugaauagguagagagaaagugggcagccuugucuagacccugauauuacugggaauucuucgaguuucucuccauuuaguuugauguuggcuacugguuugcuguagauugcuuuuaucauguuuagguaugggccuugaauuccugaucuuuucaagacuuuuaucaugaagggguguuggauuuugucaaaugcuuucucagcuucuaacgagaugaccauguguuuuuugucuuugaguuuguuuauauagugaauuacguugauggauuuacauauauuaaaccaucccagcauuccugggaugaagccuacuuggucaugauggaugauuguuugauguauucuucauucaguuugcgaggguuuuauugaguauuuuugcaucgauauucauaagggaaauucauaagggaaauuggucugaaguucucuuucuuaauuggaucuuuguguguuuuagcaaucagaguaauuguggcuucauagaaugaauuggguacaguaccuucuguuccuauuuuguggaauuguuugagaagaguugguauuaggucuucuuugaaggucugauagaacucagcacuaaacccaucugguccugggcucuuuuugguugggagacuauuaaugacugcuucuaguucuuuaggauaaaauguucuguagauauuuguuaaauccauuucuuucauaaccucuguuaguuucaauguaucucuguuuacuuuuuguuuccagaaucuguccagugaugagaguggaguguugaagucucccacuauuauugugugaagugcaaugugugcuuugaacuuuacuaaaguuuccuuaaugaauguggcugcccuugcauuuggagcauagauauucaaaauugagaguucaguucaucuuggcagauuuuaccuuugaugaguaucaagugcccuuucuugucuuuuuuuugauaacuuuggguuggaagucaauuuuauucgauauuagaauggcuccuccagcuuguuucuucggaccauuugcuuggaaaauuguuuucuagccuuucacucugagguagugucuguucuuuucccugaggugggucuccuguaugcagcaaaauguuggguccuguuuguguagccagucuguuagucuaugucuuuuuauuggggaauuaaauccauugauguuaagagaaauuaaagaaaaguaauuguugcuuccuguuauuuuugcuguuaaaguugggauucuguucuugccucuguguucuuuuaggcuuguugaaggauuacuuucuugcuuuuucuaggguguaauauugguguuuucccuuuauuauccuuugaagggcuggauucauggaaagaaauugugugaauuugguuuuaucauggaauacuuugguuucuucaucuaugguaauugagaguuuugcuggguauaguagccugggcuggcauuuguguucucuuagggucuguauaauaucucuccaggaucuucugacuuucauagucucuagugagaagucugguguaauucuaauaggucugccuuuauauguuacuugucuuuuuucccuuauugcuuuuaauauucuaucuuuauuuagugcauuuguuguucugauuauuaugugucgggaagaauuucuuuucugguccagucuauuuggaguucuguaggcuucuuccauguucaugggcaucucuuucuuuagguaugggaaguuuucuucuauaauuuuguugaagauauuugcuggcccuuuaauuugaaaaaccuucauucucaucuacuccuauuaucuguagguuuggucuucucauuguguccuggauuuccuggauguuuugaguuaggaucuuuuugcauuuuguauuuucuaugauuguugugccgauguucucuauggaaucuucugcaccugagauucucucuuccauaucuuguauucuguugcugaugcucgaaucuaugguuccugauuucuuuccuaggguuucuauuuccagcguugucucacuuuggguuuccuuuauuguuucuacuuccauuuuuaagucuuggaugauuuuguucaauuccaucaccuguuugguuguguuuuccugcaauucuuuaaaggauuuuuguguuuccuuuuuaaggacuccuaccuguuuagcaguguucuccuguaauucuuuaaaugaguuauuaaugcccuucuuaaaguccucuaccagcaucaugagauacgauuuugauucugagucuugcuuuucggguguguuaggguauccaggauuggcuuaggugguuuugaugauggugaguggucuugguuucucuuaguaagauucuuacguuugccuuucgccaucugguaaucucuggcguuaauuguuauagcuguuucugguuggagcuuguuccuccugugauucuguuagccucugucaacaguccugggaguccagcucucuucugagucacaguggucagagcacucucugcagguaagcucuccucuugcagggaaggugcacagaggucuggccuucagaccugucuccugcugaaggugaaggcccaaaacagggccugucucagaagauguguugccucugcagucugcacucucaccugcgcagacugauaucagagggacccaggacacaagauggcucccucaccugcucaggcagucagagcccucucagguggauaccucuacucuggcagggaaggugcccggaugucuggauccugaaaugugaucugucccagaagcuguguugcuucugcaguuagcuugcucacccucugcaguccgcacagacuggucuccgagagaucagggagacaagaugguuuucucuuuuuacccucucuucuacauaguucucuuagccccaaugagagggauuugauagagacaucccuuauaaggaugaguguuguaugucuguauaaugucugccugugaaucucuguauuuguucucaucugcuacaggaggaagcuucucaugcuggcuaagagggacacagaucgacaaguauagcagaauguuauugucauuuuguugcuacauuccuuuaggugaacaguaguauugauuuuccuccccucccuucaaggucccugauuuuccaaggacagccucagcuugaaggcaguucuaggaaagggguaucuaggagcauugaaagaacaacuugaagucaaaucacaggguacaugcugauggcuuguguucugcuuaagacaacuuucucuggagauuuccacauagcucagacaaggcccaguuuuuuauuuacauuucaauucaguaauuuacuccaguugccuuuuagauuaucccaccaaucagcauuccaugaccccagcccccugauucuuagggggaaaaaaaaagcaagcacauuuuuuuuaaaaagauuguaagugaauucagaaaucugcuugccuuuguaagcacaggcaauaagcuaacuggaugggaucuugcucugagauaacuagccuuuucuaccagucguaggccuaacuuagcucugucccaggcugaccuugaacuaaagaaucugcuuuguaucucucuagcaagcuggcucacaauauaucugccuuuggucuuuuaggucugugaagcuccuuagacaauucauacugcauccucauauuuugcauaguugagaaauucuauauucuugaacuuauauuuuuauaguucuuccccagccuuaaguccugaaugucacugcuuuuaccaguuugcugagacauuggccauacccuggccucccagacucugucucugauuaucauggagucauuaaccuuggcagagaggacacuccucaaaggaggaacaugaaaauacaaacaaaccuaugcccacaacagcaauggaagcccauguccugcuggcucuauucccugggcagaaaccaugucauucuggcccuugcaugccuaagccagacucagcacuggacuauucuaauuugccaccuaagcagcacuugguaugguuucugucucauggagugggccuuaacucaaagcaauugauuagucacucccacagauuuugagccacuauuacagcagugaaucuugcaggaacucacucuuauagccugaaggguuuguagcuggguuggucuuuacuuuaccuuucuuauugguggcaugcagaauacauucuaguaccauaaacacuuagcaauagaggugaagacuuuaggaaggcaucaacaugacuucuccauguucaaugagauguguagguauuguguucaggauuaggaccuuauugucaguucuuugugaacagcucaauuagacauaacccauucccaguauuggaaguuucguuuggugacgagauguucacuuggggcuuugacugcccuguuauuugacuauuucauuuagauaucuucaugaauguaugaauagaaagcuaguacuguacgagguuuccguaugacuccucaaaauggcucuuaguuuuagcuuucccucaccuaccucccucucccccuccuucaucccuuccaguccuccugccuuguccauucauaacuguguauucuauuuccauuucguagggagaaaauccuuucccacuagucccuuacugucuaccuaaccuuugugguaauaugaauuguagcuugcuuaucaacagcugaacaggugucauccacaugaaaacauaugauauuugucugaaugaauuaccucauucaggaugcuuuuuucuuucuuuucuuuuuuuuuuuuucccuagcuccaucuauuuaccugagaguuucagaauucugguuuuuugguuguuuuguuuuguuuuauuuuugaaagccugucugcugugguugcaaccuucccaacccucauuucagagccaucccaguuaugagcugacauuugcauuauugcagugcuuggauucauguaguucuuauuuuacuuaaugaccacaagcaaaaaugguauuguaucagaggguguccuuggaguucagugugcccacuuugaccucucagguuccagaauuccaggcauacacuacuuuacucagcucgucagaacaguagucugucugugaaguuguauggaaaggaagcauuuccaagggaagcaugaugguccauaccuguaaucccagcacuuggaagagucuugagucagagcuaaccuagcuaccuauaguacaagcuacagcacaaaacccauaacuuauugcuagacuauagauaagguuaagauaggcagagguuuuaguaguuuuguuuuaaaauacauuuucacuagguagcccuaguuggcuuggaauuugcuauauagaccagccuggccucaaacucuuagagauccugagugcugggauuaaaggauauaugugcccagcugauuaagagcuuuauauaugggguguggcucacuugguaaaguacuaaacuaucuuaggaauaaugcccuggauuugauucccaacauaacauaaaaccugaaauggcaacauacaccuaaaacccuggcacuuugcaugugggaacacuaucaaaaguguaacgucuguuuuggcuauauagcaagcuugaagccagcauggcuucacccuugguccugucucaaaaauaaaaaaaaauaaauaaaaaaugaaaaaagauaucagcagauucaagagcaaauaugauuucagaaaagugaaacagcccauuggaggauggaauugaacauggccgugcuguguuucuagaugguauuuuagugccagcaaaggaguuuuuggguuuguuuguuuguuuguuuuaguucaguuggaaauguaguaguucauagcuuuuauaccaggaccugggagacuaaagaagggggggcaugaguuuaauuuuugccuggauuauauaagaccucaucucacuucccaccuaccaccacaaucucccaaaaguucaauuugagacugguuagaaagagaagaaaaucaaauugaaccauuaaauuauguacaugaagcacauguguuuuucauguaucaguuguacucuacuaaagcuggcaaaugccacuucauggaauaggagcuuucuaaagaaaaacaugguaaaugcuugauuguaguguuaacuauguguuugggggaccuguaguguguuuggggaagcuugacuuguaccucauaaacucaucugagcaaaaauugccuaccuguuaaugggcuauauaggucuuaauccaaucaugcuuccauuccagagagguuuuugguggauugaaagaugucuugauuguacuuccccuauauauauaaaauuccauuuguauguauucuuagauuuuuuuuuuucuuccuuucacaguguuaauggccagcagucuacagaaacugaacccuuaguggauacaguauccucaauaagguaaaauaugauacuugucuuuguccuuaaaaucacugauaaaagcaauuuauguauauuuaaauauaauuagcauguaaauacuacgauuuagaaguagcgcuguccuguuuagaucaauagguauucuagacccugaaauuucuugaaauuuuuaucuauaaagacuuugauaugggaucuaggaucauuacauugugucuaauaggugaucagacuaacaaauaagaaacacaugagcuuguucagguauucugucaaaaaaacaaagauucacugcuagaacaggaaaggauucgaagcuacaauuuuugaugagugucccacuuuccaauuauacaguagaucagaaaauuuucugaucuacuauaaaugcaguaagaaacaacuuuaacauguccaaaacccagaaagucuuuguaaaugacugcagaaauagaucaguuggguugcaggcuggguauggguauguggaagagauuacuggauaggacuuuagaauccaagauguuauaugauuuguucacaaaagucucuguauauauaccugggcagaagggggaacagggucucaguauguagcccuggcuaucuggaacuuaccguguaggccaugcuggcuucaaacuugcauugaucauccugccuuaaccugcuaagauuauaagcauguaccaccauaagaaagauaaugagugaugggaaguucuuggaaagacaauugucaaugaagaaugguagaaggagauauagcuaagauuucuguggaaguaggaguggaagucauuugggaaguaaaaacuauuggaguuggugcuagagcuuagugauagagcccuugcuugugugaggaggaccuggguucaguguccagcacuguaaaaacaaacccuguagugaagacccaucauuggaacccugugacuuauggggcuuggaaauuuagcuuuccuuuuggauaaggucagaaggagaggaauauuguccuaagguagaaccugcauagggucaauagacagagaugaagacacuacaauagaguauuuuaggagagaggaaagguaagaaaggauuugcuaguuguagaguauuuuuguggcuaaaagcauagcuaaaauguaaauauauuaggugaggguaacauaccuaccuaaguucaagcacauugauuuuuuuagguucuauuuugcuucuguauaaaauuagaaugaugcaaggcugaagagaaaauugaacgguugagagagaaaacacuggcugcuuuuucagagaacccagauucaauucccagcaaccacauggcagcucacaccugucuaacuucaguuccagggcaucugacauccucauacaucauucugacaaaacacaaaugaacacaaaauaaaaauaaauuauaaaagaaaauuagaauaauguuagcuuugcaggacuguuaaaaaacaugccacauucauuauuuccagcauauaaccuuaacuucaaaaaaaagaaaaaaugucuucaaaucuauaaaguaagggcgcuaacauuagauaaagaaauuuugaaaauuuuucuguagaaaaugauuuagaagccacagaaaaaaagaaaaauaaauguaugugguuuggaaaacugauacaaucuucaucucuaaguagauaagcuguagaaagauaaaacaaauggaaauuucacaauagaauuauuaaacauuaacaugggucacuaaggagagcaauaagagagacgggccaguguagcagauucuguagcaaagaugaagacaguucccacugucccuucacuagucuccagagucagucacaagcucucguguuucaucuaggucucacaagaacgccuuaucgcaguuaaaacacagacgugcuccaucagauuucaguaggaacgaagcaagaacaggaacucuucagugugaguacuguuacuggagcuguccgcccuuccacugcagcacaaaaggcugccuuagaaagcuagcugguuuccauaguccacucuaauuuguugucaugucuuuggcacuguuuuucugcucagcuguauucagcaacuuuagacuuuggagugauaaguguaaucaaagcucauuauucacauugacuaagugaauucugaguuaguacuugaagggaaaauacaaaagguuagguuuuuaucaacuaaucaauacagagucugauuuuauguuuguuucuguuuaaagauacugugguguuggcucauuaauauugucuuguugccagcaccaguauaauaugugucugaauaaaauaauauguaacucuuuaauauugcccucugaucuccacagguacacaugcauaugcccacacauaaauaaaugaauauaauuuuuaaaauuugaauaaagaauaugaagugcuuugaaaauuggcuauacuugugucugcaaauauacauuuaaacuuuagagaugacuuaggcaaaaaaaucuguccucaaaagccagucuucuguuucuccuaguuaccuguuaauggcuuaccaacauaaauuagaauaauuuuguucaguuugaaaucuagcaguguagucuagucuuuuaucauuauuauuauuuauuuuuguuuuuuugagacaggguuucuuucucuguguagcccuggcuguccuggaacucacucaguaggccagacuggucuugaacucagaaauccaccugccucugccucacgagugcugggauuaagggcgugcgugugccaccacugccuggcuggagucuagucuugucucagacuuuugauucucuuauuuagcuucccgaguucuggaguuacuugugcauggcuucaugccuaguucuuagguuguauguagucagggcuuguagcaugcuuuucuugauacagaaucuaccuugcugaguuagauuuauucucuacgaacccuuccaucaggcuuccuguuuccuugcaucuccauuuuccuuacuauuuugucuggauuuuuuuaagucuauaauuucuaaauuucuucaacacgaaagacuauugucuuuuucuuuuuuucuguaaaacuuuuuaucuagggggcuggcgagauggcucagugguuaggagcgccgacugcucuuccaaaggucccgaguucaaaucccagcaaccacaugguggcuccauaaugcaaucugaugcccucuucuggaguaucugaggacagcuacaguguacuuacauauaauaaauaaauaaaucuuaaaaaaaaaaaaacaaaacuuuuuaucuaaguguaauacucuuuagaaauucuuuuugaucacaguuuugcaauuuacaguuggagaagucugacauuaacaugacaccccucuuuucguaugaguuaauuuucucucucacaugaccaggguuuccuaggcuaugcacuucaugcaggaaaucccuccuaauuacugcuuugguuuugguuuuccauuuaauuaaagugauuuuucacuucuuuucagacuuuccuggacuuauggacuauuuguacuugcauauuuaauuuccaaauaauugaaggguauucaaaaauuuuuucuguuacugauuucuaccuuaauucuguuguggucugagacaaaaggguugucuggccaugaacuugcaauagucuauucuccaaagugccaguugucagaggacaacuuucaggagucuauucucuccuuccaccaaaaauugaauggagauaaccaggcugcccacuaagaacuuuuacuugcugagucaucuuaccagcgccuuaaaggauuguuuuaauggcuuauccuacuguuggucugucaugguaauuguuguugauguaugccugggaagaauguauucuuuuauuaaaugggguuuuuuaaaguggucacaggucaaguuguuaauaaugccuuucugguguucuaguucuucuuguuuccuaccuauauguucuaaaaguuacugaggaaaaaaaaguguuaaaaucucaagcuauaaugacaaguuugucuauauuagcucccuuuccaguucuagcccuauuuaaacacuuuuuuccaguacuaagauuuuuguuuauagguaguauguuuccauuuuccugacugaagucuagugaguauaauuaugagauuucuaguguuugggucugggugcauuccuacaacauugcuguuagaucuuaguuacuauauguuuguauggucuaaguguaguugcauugguuuuuaaaucccaaggccaauccagugggcccauguaaaugcuuucaaggcaucaagcuuuauuacagcccuuagccugguguucaguacuuucuggaaaagcuauaaaacauuauaauagcaaauaagccagcacacucccaggagcaggucagugggguccuccugugacuucauccaucuauuuacuugccuaucuaugacuagcucuggaaacuacagugugaggagaugaaugagcuuuguaagaauuuuuuuaaagauuuauuuauuugauguaugugaguacacuguaguuguacagaugguugugagccuucaugugguuguugagaauugaauuuuaggaccucuguuugcuccugucagcccugaucggucagucccuguuuguuccggcccaaagauuuauuuauuauuauaaauagguacacuguugcugucuucagacucaccagaagauuagaucucauuacuggugguugugagccaccauguaguugcugggauuugaacucaggaccuucagaauugcagucuguucauacccacugagccagcccgagcuuuguaagaauuauagggaccauguagacugcuagaaucuuguccaguuauacaaaaaaucugacugaaaguuuuacuauaaauuagaacuauagaucauuaagaugaaaaggggcaauuaugucuuccuauaaauaaaaaguuaucucuuuagcauguaacauuugcuuauaaauacauguuuuuaauuuccauuucauguugaugaauucaguguuggaguuaucacuaggcaggcauggugguacacacuguuaguccaguacuuggaaagcagaaacaggaagaguucuaugaguuugaggucagccuggucuacaaagugaguuccaggucaucguaaacuacauagugaggugcugucucaauuaaaaacaaaguaaagccgggcaggguggcgcacgccuuuaaucccagcacuucggaggcagagacaggcggauuucugaguucgaggccagccuggucuacaaagugaacucuaggacagccagggcuauacagagaaacccugucucgaaaaaccaaaaaaaaaaaaaaaaaaaaaaaaaacccacaaaaaaccaaaaacaaaguaaaagaguaagguaaggguuacgauuggaucaauacccccagcacugucauaaaauaugucagugauucuauacaaaaguacuucugcuuucuuacgcuucucugguagucagguggauuccuaaaguuacacugcuuaccgauuugaagggaaaagaguucauuuucuaaguuuuugggcuaauauccacuuaucagugaguacauauugugugaguuccuuugugaauguguuaccucacucaggaugacgcccuccaggucuauccauuugccuaggaauuucauaaauucauucuuuuuaauagcugaguaguacuccauuguguaaauguaccacauuuucuguauccauuccucuguugaggggcaucuggguucuuuccagcuucuggcuauuauaaauaaggcugcuaugaacauaguggagcauguguccuucuuaccaguuggaacaucuucuggauauacgcccaggagaguuauugcuggauccuccgguaguacuauguccacauaucugcggauccaucccauaaucagccuccaaacgcugacaccauugcauacguuagcaagauuuugcugaaaggacccugauagagcugucucuugugagacuaugccggggccuagcaaacacagaaguggaugcucacagucagcuacugaauggaacacagggcccccaauggaggagcuagagaaaguaaccaaggagcugaagggaucugcaacccuauagguggaacaacaacaggaacuagccaguacccccagagcugguaucucuagcugcauauguaucagaagauggccuagucggccaucaguggaaagagaggcccauugguugugcaaacuuuauaugccccaguacaggggaccgccagggccaagaaguggaagugcgggggauggggaggugggggacuuuugggauagcacuggaaauguaaaugaagaaaauaccuaauuaaaaaaaaaaaaaaaaaaaaaaagaguucauuuucaggccaggcggugguagugcacgccuuuaauccuaguauuuggcaggcagaggcaggcggauuucugaguucaaggccagccucgucuacagaguaaguuccaggacagccagggcuaaacagagaaacccugucucggaagaaaaaaaaaaaagaguucauuuucuuagaauagcuaaaguacaauuuuauagcaacuuuucccuagcaugaaccaguacuuaacguuagugguuucauucauaggugaaacaacgauggaaaggaaccgaagaaccaguggaaggaauagauugugugucucagagaaucagccagacacugaugacaaaaguggacgcaggaaaagacagguacuguucacuacaugugaauagcauguaugaacacuaaguaagccuuuauacgcaaauucuccuaguaggucuaacuuaaauaagauuuuuaagcacuugaaaacuacauacaaaguagaaaauaauacauugaccauuuuuguuguuguuuuggaguuuuguuguugucauuguuuugagacagggauucucuuuguaacccuggcugucguggaauuuaccauguagaccaggcuggccuugaacucaaagauucauguuucuuccucccaagugcugggauuaaaggugugugccauuaaagguguggcuuuaauuaaagucugguaagccucaguguuuacaucauuucgcuuacuuaaauguaaucagaauguuauuuuucuaguaucugaaacuguugauguacuuuaccugaauuccuaacucucagcaacagaccaauaaaucuaguuacuauuuuacuguaucugggauauuuuucuuacucaauuuaagauguguugguggcuuuuuuguuuuguuauguuuuuuucccaaccuguuugcacuuagaucauuucaaguguaggagcuuugagaauuaggccaauaggauuacuuccuauggcucaaaguuguuuugcauagaugucugucuuauuaacauagucaauacaaucaacauguaucuugaugugcuuccugcgucacucugguaaggaugggaccuguaccuccugcacaagugccgcuguaccagugagcuacuucacuaguccauuauucccuugucuuguuuuguuuaauuguugguuuaguuaauugguuuuguuuguuguucuuaugcuguguuauauaagaccacuuccaugcagguuguuauguagucuuaucucuaagccucauuuuuuugugaucauuuguccuggguuguggccuuugugaaugcuucuuagucugcuuacuaccacuacucccugagugagacagaaaaucggggugggguggggcagggggggcagguuaguuagguuaguuagggcaguuaguuaggguuuuguaaaauuagauuauuugaaaacaggcaucaauucgucaaauggaaugcucuaggaguauuuugaacuugggaguauuuugaaauacuauuuuucccuuccccugagagaaguagcaauggacuuuguauaaucuuuacccugaaagugguuuugagaucauggaagucagauuuccauguauuguacaccuagaguuuuucacugugagguucauaaacagugagugccauuagcuuaguuuuaguucauugucccugccaggaaugacucuaacugugaacucucuuccugcacucugcucccaggaauuuuuauuauuauuauuuuaaauauucuauuauguagcauagguuggccucaaagucuuuauguagccagggcuuuccuugaauucuugcuccuccuuucuuugcuuuucuagugcugggauuacagacauucacagccagcuuucaguaaauccuuugauucuccuccucuguuugcccaugacuuauucucucucuaguggauguaagaagucuaguuugcagguuguuccauuuucucuuuagggaugggagugcuuugcuuuugagaccagaacccagaaaucucugccgcacacaaugcucucccacuaggauuugaguauagaucauaggugucauuuguagauaacuagaagaguuaucuucucuuguagggaagguaucaaccauauaaucuauaggauauguggguaugaugaugccauuguuuccuuaccaaaaaaaguuaauauggacacuuucaacauuugguuuuauguuuucaacuguccacuauugacucugagaagaaaauuugucucagaagguggcugacacauuuaauuuuauguuguauuggaacuuucaguuuaauuuuuuuuuuuaauuacucagugccuacuuggauagcuuucuuuucuuuuuuucuuuuuuuuuuucuuuuuuuauauaucuuaaacaaaaguauuugagccugucucauucaaauuuguagagccuuuuauaaacuuacuccauugagggaaaaaguaaaugccuuucagaaguaaacccuucacauacacaaagauuacaaaugugaacaagcuuuucuccuucacacacacaaagauuacaaaugugaacaagcuuuucucuuacuauaaauuaggucauuuugaagguauaaagcagaagaaacaggcuaaugauagcucauacaaaccuccaaagauugcagcuauggucaaugcugguuucucuggcauuuagucaucuguaaaacaauauccuauuuaucuucaugcugcucugaguucuuuuuuaacacuaggauuuucuaacaugagucuuacuuuuuuuuucaauuguauuaaaauauacauaaugugaacugugggaacuaaaagggguggggaagggaggauagcccacauccagccagaguuccuccuaugcucugggcaggcagauaugggagggcugccagacgcuuuccacuuggccucugggugggcaucuaagccacugaccccauguccacuugauggggggggggguggacaacgggcagcccuugcccaggaccccugaggcgacacccuauagccccaggguuaugggagagagguucccaugcaggugagaguaagcccagugggccuugaugacagucuaugguuuuagagcuuuauuauagaaaggcagggggaaagagaaaagguagaaagagaaagagaggccagccauggccaagaggagagaaggaggaaaggagagagagaagaaagguugaagagagagagagagaggagaaaggcuagagaguaagagggagagaaagggagaggagaggagagaagagaguaaggggaguaagaggaauaagagagugaggaggggccaagcagcccuucuucuggugugcuguuaucuuuaccguugcuagguaacugggaggagucuagccugaaggucagaagcuugguacauugccuaugagauuaaaagccaugcuucuccuguggggggcugugggagugguaacuucgaccggagccagaguuccaggagccaugagagaacuccuucagccccauguaggugaauuaucaucaucgggucccaggguuuaacaucuagccuaaacuggaaaccaggcuguuugugcauagcccagugccccacagugaacuuuaucuucuugagauuuuuaagacuuccuauuuggauaucuacuucuggauuuggggcuaugugaguaaggugcucaaaguguuggguuccugggagcuggaguuacaggcauuugugagccagccuucacaguucugggaaccaaacucggauccuuuuccuuugcaagagcagaaugugcucuuagcugaugaacuuucuuuccaucguuuuuaaguguaccguguaguagcauuaaauauauucguauuuucauaucaucaccacuguuuguccacauuuuucaaaacaaacucaagacccauuaaaauaauccuuccuuucccuuuucucuuccgugcuugguaacugccauuuuuacugccugucucagaauuugacaauucuaggaaccucauugaugaaauuauacaguucuuauguuauuuuuuuaucugauuuauuuauuuagugaguguuuacuacaaacguaccuggugcccaaaagaucaaaagagagcauuggauccccuagaacuugaguuacagauaguuguaaauuaccaugaggaugcugggagcugaacccaggucuucuggaagggcaacaagugcuuguaaccacccuggccccaguucuugucuuguccuuucaaaucugucauuucacuuagcguaguauucuuaaguauguugucagaauuuccccuuuaaggauaaauaauauuuucuauauacuauaugcugcaaauucauucauugauugaugggugccagacuucuuuucucacuuuagugcuguggauaauacagcugggagugcuagaggauaaguaguguguuacacucaaaccccuauaguuggucaccuauaccaaauagaaauguuaauacuuucucugugcaaagcaugagauuucauuuaagguuuguuuuuuuuuuucagcauuuucucccaacuuaauuguacauuuuaauuaauaauaguuguuuuucaugaaagucugucuuacagaacuucugugcguguguacaccucacccaucacagguacacagcauuuucacugaguucaugagugagggaguguacaguuaugaguucuauuuagaaauaugaucuguuaagaguuaccugaaagcuucuuaagauauuguaaugagccuaaagucaggcugugacuuuauagauaucccauuguagauggcugagauucuguaaaacuacccuaaaauauauacaugguaaugguaaauaugaucuugcaaaaccauauauauguguauguguucauauauacaaaaauauauuuuaaaaaaucauuucaauuuuaagaaacuaauaaucauugcucugauuuuuaaaagauguacuuucuuuaaagaauguuucuuugaauaacuuuuauguucuuucaacagacauggcuuugggaagaagacagaauuuugaagugugguguaaagaaauauggagagggaaauugggcuaaaauacuaucccauuauaaguucaacaaccgaacaagugucauguuaaaagauagauggagaacaaugaagagacugaaacugauuagcugagacacuggaggcuggauggguuugauucagcuuaauacaaggauaaauacuuggaucacuacacuuuguuuacaauuuccuggucaguaaugauaaagcauuaugguggugguggggcagugaggagggggaagagaaagagaguuuuuguuuuuuugguuuuuguuuguuuguuuguuuguuuguuuuuuagaggagauuugugcuuuaaaucuaugucaucauuauuuucugaaucuuuauuuuuguaaaauauagauauguugaacccuaccaaauucaguaccccaucccauauucuguuuuaauacaaaagagucuaauaagauuaaaugaauauaugacuauuuacgguuuguucuauuccaugucuauaaacuaaccucacaaaaugccaccuagcauugaguuuucugaagaacuuaauuggaauaauccuugaugugacuuuacugcuggaucuauggcuaauguacuacuuacuaaagaucuauuacuagagagguauucaaaacaacucaugaguucuaacaagccuagcuuggcuucucucaaaaguuucauuuaaaggaaguugaguuuucaccaaaaauguauucauugcaauauuuaaucaaagacuaauuaauaauuagcauuugaguuuuaugugccauauuuaacaaguaaaaaauaagucucggccgggugugguggcgcaggccuuuaaucccagcacucgggaggcagaggcagguagauuucugaguuugaggccagccuggucuucagagugaguuccaggacagccagggcuacacagagaaaccuugucucaaaaaccaaaaaaaaaaaaagucucaaccuauugaaauauuuaugagaaagucagcauuguguauuuccuucaaaguguugugcauugcuuuccuguucucuugaauuugcugccuuauauauauaauaaacagaagcauuagugguugcuguag

SEQ ID NO: 75 - RNA, 1646 nt, Mus musculus
ccaauuuuuuauuagguauuuucuucauuuacauuucaaaugcuaucccaaaaguccccucuacacuucccccagccccccgcuccccuaccuacccacucccacuucuuggcccugguguuccccuguaauguggcauauaaaguuugcaagaccaaggggccacucuucccagugauggccgacuaggccaucuucugcuacauaugcagcuagagacagcucuggggguacugguuaguucauauuguuguuccaccuauaggguugcagaccccuucagcucuuggguacuuuaucuagcuccuccauugggggcccuguguuccauccuauagaugauugugagcauccacuucuguguuugccaggcacuggcauagccucacaagagauagcuauaucaggguccuuucagcaaaaucuugcugguguaugcaauagugucuguguuugguggcugauuuugggauggaucccuggguggggcagucucuggaugguccaucguuucgucucagcuccaaacuuugucucuguaacuccuucuacagguguuuuguucccaauucuaagaaggggcaaaguguccacauguuggucuucguucuucuugaguuucauguguuucgcaaauuguaucuuauaucuuggguauucuaaguuucugggcuaauauccacuuaucagugaguacauaucaugugaguucuuuugugauuggguuaccucacucaggacgauauccuccagaucuauccguuugauuucauaaauuucauaaauucauuguuuuuaauagcugaguaguacuccauuguguaaauguaccacauuuucuguauccauuccucugaugagggacaucuggguucuuuccagcuucuggcuauuauaaauaagggugcuaugaacauaguggagcauguguucuuauuaccaguuagaacaucuucuggauauacgcccaggagagguauugugggauccuccgguaguacuauguccaguuuucugagaaaccaccagacugauuuccagagugguuguacaagccugcaauccuaccaacaauggaagaguguucaucuuucuccacauccucaccaacaucuguugucaccugaauuuuuggucuuagccauucugacugcugugagguggaaucucaggguuguuuugauuugcauuucccugaugauuaaggaccacaagguauuucugaaucugaaaacuguauauccaagagcagccaucugaugagaauuugggcuucuaaucuacaggaugcuaacuagacacagcuucuugggcccacuaaacugggauuggauuuugacugacauucucgcugaagaagagaagacaguagagaggggccuucuuuccuccaacacuaagcaaacccuaagaugagcuauccaaggcuagaaagcagccuacaaguggugauaaaacugccugcagaguguaggugguaccagugugugauggcaauccauuuuuguggaccauauggaauaaauggaacacaucuccaccucaugacaucacccaugcuagaucaaaauaccagaagacaaucacaauuuuagcuuaacagauaagaagucaagagaugauuaacagaguguagagucugaucu

SEQ ID NO: 76 - RNA, 3171 nt, Mus musculus
aagauguuguguguguaguucugaggccugucugucggaaaggcugucuuuccuucauacauacccaguggcagcuggaauagaaaguuggcuucaaguuuaguuccuuugggggcacacagguuuugcucuguuugauuuuaaauaacccacugaugcugagagagucugccucuucaggaucuuuguuccucucuaggugaccuaguuuucucuuagcgaacaaggguuaucuucaaagugucccccugcucugagagagaccuugccuuucagaagaaagauccgccgugcuaauuucaucuuaucugaaugacagaaaaugaagcuccuuccaccucagcucacucuugcuuagccaucaggagagucucauuuucguucacucuuuaaaacgugucccaguugcuagagugcuuucuuagcauacauaaugcccuaggaucacucuucaguaccaaaaaaugagggugaaggugcacaccuguaacccuagcaccuugagaggcagaggcagaggaauuagaaguucaaguucaaguaaacaguggguuugaggacaauuacaugagaaaaaaaugauacauuuaaagucgcuaagcugagacugccccuccccccuucucaucuauguuacccacauaauuuaugagggaaggaagauaaguaagcuuauaucucucaccuaaaccuaaaaguugcauaccucuuuccauucacuuaagugguuacuuaugccucagagugcccgaccaaacauccuggagcuaccgguaguugugagcuaccgguaguucccugggugcugagaacuaaaccccaguccucuguaagaguaaugagcacacuuaacugcuaagccaacuuuccagcccccaaauuaaagguuuuuguuaaaauuaauuuucuaugaaaauaccuuuggcaguuaaauaaaaauaaaaucagaaauacuaucaggagacauuugcuaccccuuuaagcuucuuguuggccacaguaguuaaaugaucggcaccaaaaagucugcauuuuaguuagcuauguuagugagugauuagucacaccaaaggauuuauaccauuuaaguauugauucaauucuucaaagaaacuauccucaauuuuaagccugcuucaaaacaaagccaggcugagguccuauaauggagucuugggcauagucaggaugaucuucacugaagucgagucccagaugaggaagcuggaccagaugacugcagaugcugagaaacagcuugccauccuaggccugugagcacaccaugccacuuagccacaaacucaguuaucucccaaccaaggguaaagcuaauauucucugaguaggaaggagaucauaacguuugcaggaaaaucuguguuuucuacccucugugccauagggagaaaacuagcgagcaccuuuaacuaagcaugaagucagacauuaaaagauaugucuuauucugcuucagccucuauacuuugagaaaucuuauauaugaaugaugauagaaugcuaauaauugaagcaguuggcuaauuuggugccaaaaugucaugaaaauuguaacuuuuuaagaaaguccuauugaucuagcaugaauauuugaucuuuucaucuaaaccaaauuuuuuuuacuuccuuaaaaauguuuauagcuuuucauuauaaaacaucuuuugaaauuuugacaacuuucccuguggaaaauuauuuaugaugauuuacuugaagcuaguuuagaauuuauaaggguaauaaauaguauaggaacuuuaugggugaaaguucacauauauguuuuuuuuuuuuaaagugagaagcucuuaaguauagguggcccugaauacuagaaguugggaggcagaaacaggagaucucugaguuagaggucagccugaucuacagaacaaguuccaggauggcaaaggcuacacaaagaaacucugucuugaccuguucuucccacaaaagcagacagaugucuauuaauuagaggccagccuggcuacguagugaacuucaggcuauauaaugagaaccuuuaauuuuuaaaagagggagggugagagaaagagaaaacauaggugccuuaaacaacaauuugccccaaacuggagcacaugguagugauucuaguauagacauguaugcugugaccaaauguaagguaaaagucuacaggccauaggagcuuuuaguacgaguccuuaacucauuaaaaauaaaaaccaagagacuguggucuaccuugagaacuaucccuaaauguucuuucucaguggcaaagcguagcaaugcgagaguccaggucccuggcgcagcuuuuggaggccucggaagcuuugaaugcagcuugucaauacucggcccauucacacgcaugcucggaagucgcucccaggugcucuauauaaaaaugaagcggugcacaucuggacaugagcacuguucuacucgacgcacuuuuuuccagguucccugacaucgaggauugccaauggcuugccagcgaagagucugauuucugaaacgauauuggagaaauguagguucuacuaaaaucaagccagaggaaauucgauucuauguaaaucaaacuuauuuaaagaguuaguguuuuuaauuuguguguaugaguguuuugucugugcauauguaaguaugcuauaugauuaucugguaaagagggugcuugguccccuggagcuggguuguuagccucuauguggaugcugggaacugaaucuagguccucugcaaaagcagcaagaggccuuaauuacugagccaucucucuaaccauuguugucuuuaaaacuaauuugcuggcugguguuaugccaaccuaauacaggcuagagccauucaggaagagagaaccucaacuaagaaaaugauccccccagauuggccugugggcaagccuaugguacauuuuuuuuuuaaauugaugcuugauaggagagggaucagcucacugugggcagugccauccuuaggaugauguaccuggguguugugagaaagacuaauaagucaaaaggagcaaacaaguaagcuaugcuccuccguggucucugcuccagucccugccuccaugguccugcccugacuucccucaaugaugaacuuaauaagguuaaauaaacccuucacuuccca

SEQ ID NO: 77 - RNA, 611 nt, Mus musculus
aaacuuuaucugcauuuauuuuaugcugaauuuauuccucagccaugaguuuuuguucuucaguuucuucugggauaucuuuuucuucugugcagccuccucuucuggcuuuggaacaaucuguuccuucucagcgaggaucaucucacuguggcagggggagcucauguauggguuaaucugguuaugagcucuguaguuuagucggcucaucuuaggggcuuuguucacuuggauguguucaaugacuagagaauccacgucuaaacccucaaguucaguguuacucucugcaauuuuaagcaugugcagcaaaaauucagcacucuuuuuuuuggccaccuucccugugaccagcccuacuguuuggccugagcacaccuaccuaauccaccauuauacuucuggaaugguacacauugcuucuuuaaagugacauccuucagauacuugguggcuuugcggauaugcauacccuugauggccugggcagugucccggguguucuuaaagugaacacgaagguuugaaccucuugauuugcaugauuuuguaggguuuucugggucaagagaguagcgaaccaucuucacaggugaccucuggccgcu

SEQ ID NO: 78 - RNA, 3265 nt, Mus musculus
acauuucaauuugccaagcugugacuguuuauuaacugaccagauuacaaaaauacaaugggugacaccugaaagggaaaaaacacacgaguuagagacugucuuccaagccgcacaucagcacccccccguaaaggagcacacuuccauuaaagacacauuuccccaaaguaaaauguaaugucuggucgggcgugggggcacacgcacgccuuuaaucccagcacuuggaaggcagaggcaggcggauuugaguuauacagacaaacccccucucaaaaaacacaaaacaaaaaacacuuaacaauauacccaauccgcacucaacagaaaagccgucaaucaaguuuugaauucaaaacuaggugagucuacacauaguuuugcgauugccagaaauagauucugucucaaaaaacaacacuaacuucuuaccuuaguucauccgucuaauaagccuguuuaucuggucuucccuguugccagcaucuccaccuucuacaaagugaguugucuuuuucuucaucccaccucguggggaagauaacuugaagggccacaggaaguuauuugcuuccuugaagcguuucccgacuguauagaucucaugaauuagauccuccaugcagaugaugccaaacuuaccugaaaaaaaauugaguccaagaucaaguuuuuaaaaguauuccaaacacaauuaugggcagaaccaucaaacaaagacaagccaggugugguagcacaugccuuuaaucuaucaggugggagccagaugaaggcaaucugaauuccagauuacagacaaaccuugucucaaaauuaaggaugcagagccuuuaaggauguaugucaagauuuguccgaagugaagccaggcugggagaaauggcucaggagagggaagugcuugcugcuuaagaaugacaggaguucagauccaaugacccaagcuccaaccuaaaggcuuguuuguaaucccagcauauaaacagaagggacagucagcuaggcuggaaugcaacucuggguucuggggagaaccuagccaccgugugguggggucauuaaggaagacacaugacauuugggccaccacccacacguauacaaaauaaaaguaaaaaaauaaauuuaaagucuggccagaaaacaugaccuuggacuaguaucaaucccucccugaaaaaucauuaccuaccaagagaccgagcaaucaaggaauuaucugucaaggcaauccgcuucuuguugauuuugccguagccucgcuuguagaugagcucguuuacugacuucagguugggguaccugcaccaggaaaaccagguaaguuagaauacagcccaagugucuaacauucaucucaucauaaaagccaaccgacuagacagaaaacucacccccaugcaauguauggcuccacaauccgcagcauguuaauugaagccuuguugagcuuaacaaaggugccauugaagaucugucgaagacgaaggagcugcagaaccuuacgaaccuuugggcuuacuccauugauacugccagagaaaaaaaauagauccauacagcuuuuauuguaauuuuaaguaauacaaaacuuagucaccacauaguauguguguguaaucucaacacgcuaucacuacuagcuugccuucucuugauuccuguuuuaucauaaaagaugacugaaugauacuaaguaaacuguuuuuaagcucuuagacaacuacaggacacugaaaugcagucagagcaagcagcuuaggcacagguuucacaaacaacuucccgccccccguaauucucggcccccuuccuaagggcaggcacaauacagccauugcugccagaacacgaugcaaagugaacucacccucgaauucugaugacaaaggccagcuuugguucugcgggcacauagaaguugccagcuuuccuugccauccuggccauccgaaucucagugcgguacaucugccuguacuccuugugauagugcuuugccuucucauagaugagcuuccuccuugccuuucgaagcugaaaaaccaauggccagucagucauaauucuuggcucugaaacagagcacagcaucaguuuuauacaaggaugacuugagaauaucaaaccaggaagaucucucuucaaucucaccccacgcucagucccaauaagcucccuggcccacuaaagaccuccaaaguuuacuuacugucuucagggcaaacuucuuccucaggcgcuucaccuucaacucugcgaaauuccuucgcuuuuucuugaggguuucuggcacagcgggaaccuuuuucuugagaguuuuuggcccagcaggaaccuuuuucuuaaggguuccuggcacaguggcaaccuucuuuuucuucucucuguuguuuguagagaauuacuaguaggucaaaaaacuuccuggugauguaucacacacacuaggugcucagaacuacguuaaaacugucacccacucaaaccggcagcaucuagcaucuccgucguucccgaaagcucuacuggagaugcagcguucaugcccacaaccuucacguuauacacaccuuacuuaaagguaaacauguaugacauuaaagagauuuaugccuaaccccagccaucaguccuggccugugaauuguuacaaguugucaagucacacugaaaaaacuguacugcacacuuuuuggguuccaggacucacugauccucgaucaagucucaagcuccauaugcaggaggcugccgguaagcagccggcuaagauaacuuuagcuacaaaggaucucguuccaugauuccgcggaauacauucuaccgaagaacggaccuccgcccaaguagccggauccgcagucugcccucaguuugcuccugguacugccaaggccuccgcgcggaggccccccgcacucccuccuaguaccacacggcgucacaaacacccagacaggcaggcagugguuccaggcuacacucagauacaggaaaagugagacaaaaugccucuaguuugggggauggagaaggauucugggggagagaagaaucgacuuacggaacagccuccaugguuccagccggaaaagaagagagaaagguggcgcaugcgcacugucuccuuaaaggucucagggcgcgaagccccacgccuuauagcuguccugagauaagccggaaaauaaucuagaauugagauuuuugcacuuugcuggcgcaaaaugaacagcuuggcuuagucacggccagc

SEQ ID NO: 79 - RNA, 18249 nt, Mus musculus
cucagcuuuucucggcagaaauuggauccggauggcgcugcauucugggaaccaagaaguccuagcaucucauugguugggauuugguagcgaugucucuuaaaugggccuguuuuacugcccacaacgcacuuccuccagacgcaaguuaccggcagaucgcgucucggccuugccagguaccagucucccgcgcguuacagaaagcggcugugacgcgacggaaguaauuccuuucugugccccggaacccacagggguaggccgcugggggugggaggggggcggcccugaauaggggcuguggcgguacgugggguuacggcugcgguagcugcgggacuggcuagugagugucgggcuauggugggaaucgggaucugauuucgcuaggagaguuagugcggcugggacuggaugcuuuaguuaucccucugcucaccccuucccgucugggcggggaaggaacggaagcucugagucucuccggccuccccagcuccuggcuugggggaggggagaggaguuuggcgggaccuuaacuagcucagcucggugggucuggaaaggggagaggacaggaggugcgggcuggcugggccuccuccaggcugagcgcggggaggguggaguuaagagcauggcagccggaucgcuuuuccguuuugccuaccucaugugcgcuuguauuuguuuuacuguuaaaaucagucgcuagacccaggagagagcccucgccgcuuuaagcuauaggacccugaaagaaaguuuaccuucuggacaacuuggguaauuucugccuggcuggguacauuggcucauuugugcaucuaucuaccucucauuuuugccugaaaggaguuaucuagugccagguacagugcccauuuauuuaguuucccuuaaggaacucuucaguuuugugagcaugaaaguuuugucauuuagugcaagcaugccuacucugcacuuucuaguguagaaagcaauugaaauaguuuuacaacuugguccauacuaccagaucugcuucuuagucccaaauugaauuuuauuuucuguuaaguggucuaagaugguaaauacuugaucucguuuauauuauguguuauuaagccgucgaaguucacaaguggauuuaaucuucagugaugaguaaacuguugugguuuuauaucauggauguuuguuaauuuauaguaauuugggguuucuauauuucuauuuaucaauuuuuugaguacucuuggaugacauggaaguuguacucaguaacucgucuggucuaaauguguggcccaccaggccuaucucccaguuguuaguuuuaaagguguagccgccaugcuggcucuuaucuuuucaacuugcuuggauuaaccuuggaccucaacuacacugaguccgcacucuugugugccacuacuccauaucuucaucccccuauuuaauuuauaaauggcuucucauccuucauaugauauuucucuaauuaccagacugggucgguaauuugauguagcauguuugccuaauguccagagacccugggcugguucuccagcaucacacacacacacacaagaaauguugguuuauuaccucauaaugcuauuuuuuaaaaaaauccauuucuuuuuugagacuuguagcccuugcuagccugaaacucgaccauguauacuugcauggcccguaugccucuggcuuccaagcacugggauugaaggaguagaucaccacacccagaugguaucuauuucaaauggagaaaaucugcuucauugcuagauaagauaggaaugcugcaguguacauaggcaaugguauagaagcaaggugauaguuuacuucucuguauacuaaguucuuaagaaauugcgcagaucuucgucuuauugcuucagggaaagauugggguuuugugcagggguguaugucagauuggaauguaauaggaaagucuuugcauguaugcuuugauauguuaauagacuccaaaugcuuugauaguuuacuaaguacaguaagacaaagacauccaauacuugaaaauuuacacacacaguuuuugguguagaaauaggcaugaugucagaaaccuguaaaccuuuauucagaauauucaggaagcucaaacaagcaaaggauugacaagaguuccaggucaaccaagagguccaguaaagcccuguugacucucccucaauaaaaaagaaaguggggggaggggauacaucaauaagaccuuggacagggaaagacccuugggauuugauguuugagcuagaaacaucauagggagguuuaaaggaagagcuucccacagcagucacugcaaacgcaagggccuuaaagugugagugaacuugaccuagucaggaaauuccaaggacacaaaugcuuggaacauaugccagauaagguuauagccagcccugccugaccuggcacucacuuuguggaccuggcuggcccagaacucagauccaacuaccucugcuucuugagugcugggguuuaagguguacaccaccaugcucagguguaguagcuuaaaaaaauaguccauuuaaaauacaguuagcuugaucuaaagauguagaguucaaaucgguagaacgucaucugauuugaaauauaaauuaaaaccaaaucuugucuuucauuccuagaacaggaaaaaaaaagcuuuugccuuugcuaaucaccuugugaacaguagugccauuuacugaagucagaagacagaagggagggaacauugguuucugacagguuuaucaggaguucucugugggacuuagcuugauaacucaguaagacaggaucugcagagcaugcccacaucuuaaucacagagguggaucugugaguuugaggccagccugaucuaagaagacaaauuagauguuucugacuggcacucagaguagguauagaacuagggaggacaaaaugggaacuguaucuuuuagaugauauuuaaauauuuaaacuggaaaauaucaaauggguaguguuagauugaucaaagaaagcaggugaaauuuaauguacugcuuugauuuuuauguuuggggcagagucucaccuugguagaccaggcaggucuuugaccugguucucuuuucucagcuuucccguguuaggaucuuagaccugugucuugcuugauuaugagccucuuccaaagccuuaaacacuuuucaucccagcagagauaggaagaauaucuugaguuuagggcuguuugcuugaucuacauagugcaaggacagccaagaccuagcucagaauugggagggguuucuugaagauuggugauagaauagggaugaagcagacagauuuuagaacaugcaaggcucugggaccuuuaacuuauugaacauuuacuuuuauuuuauguguaugaguguuuugccugcagauauguguuugcuuaauguccacagaagcuagaagagcguguuaacucuccuggaaugggaguuaggacaguugugaaccaccauguaggugcuuggaaccauucuagugggucccucuucuggcucuucaaugcacaugguacauauguauaauucaggcaaaauacuaguuuguaauguggucuuuguaaagucugcuucuauaagguuuuacaggaacauagccacauucacuaguuucuaucuugucugugacugacuuaacaguaguuguggagauguagucguaacagacuuuagagacugauaagcauauguuuacugucugacccucacagugugcugcucccagcagcgcagcgcagcacaaggauacuggaggaugguauagugauguuuauuuuguuccugacuucugccacugaaaccaggaugacuuguucacucccaucaugacacauagacuuccaauuaggauauaggaucauaaaaguuuaauguauucauucacuguguacuaggcaucauucuaaguguuuuguauaucaauucauucuccaaaauucuuuuagguuucuuuaaguuguuguguguacgucugugugagugcaagugccugcugaggucaggggauaucugacccaucuggaacuggaguugcacauggcugugaagccagcugcugugcauacuaagaaccagacucagguccuguaaaugcuguaugugccgagccaucucuccagcucuaccaggauuuuauuuuuuuuuuaagauuuaguuauuuuauguaugugaguacacuguagcugugagccuucauuugguuaugugguuguugggaauugaauuuuuaggaccucugcuugcucgggucacuccgcccacuugcuccaacccaaagauuuauuuaucauaaguacacuguagcugucuucugacacaccagaaggaggagucagauaucauuacgggugguugugagccaccaugugguugcugggauuugaacucaggaccuucggaagagcuaucucgccagccuacuuuuuaaaaaucuauuuuauguguaguuacuaacaauuuuaagcugcucugugggugcuagaaaucgauucagguucuggggaagaccagucacugcuccugucucuacaugugcuccuugucaaucacucuugugccugauaagacccuggugccuaaucucuggccuccucuucccgcuucucuccuggaugugcuguucucccucugaaaggguucuuggaccauauaucccugccucacugccuucagacuucuguccaguguuagugagacuucucuucacaaccuugaaauacaaccucuuucuccucucuucauucccugcccacuuuccuguacuuauuuccccauagaacuucuuccauuauacacaauuugguuuucugaucgauacacaccuccuuuugggugggggugguaguugacguaauaacucucaguguacucuuagcagaccuuaaacucuugguaauucugccuccaucucaagagcuaggguuucauuaaugcuccaugaagcugggcuugucacugucauuuuuuuuuccaugagguuaaaaucuuuguuguguuuuguccccuguacauaggauagcauguggcauaauacucuagaguaguguuugugaggugaguggauuucuaaacugguuuucaaccacacucaguuguugugcaccccccccccccccccagacaggguuucucuguguagcccuggcuguccuggaacucacucuuuagaccaggcuggccucgaacucaaggagauccaccugccuccgccucucaagugcugggauuaaaggcauugccagcacuuccuaagugacuugguggaaucgauuguuccuuucaacuuaguaaaauaauuucaucacucagucauccaggucaaacacagucuuuucacacauacauuuuuuguugaagguuuguagccacccauuuacuuucuuggaacagcuaaucugcuucuuuuuguguaacaucuacuuauccaaagaauuucagcuaguuuuauugacagucuaucuaguguucuuguugauucugguuuggcuuugguguacugagacuggguuggccucaaaccccauucucugcuuuagcagccugaaugggauuacagguguauaccaccacacccugcuuugacuguuacuauuaagauuuuaaguaaagccgggcggugguggcgcacaucuuuaauccagcacuugggaggcagaggcaggcggauuucugaauucaaggccagccuggucuacagagugaguucuaggacagccaaggugacacugagaaaccccgucucgaaaaaccaaaacuaaguaaagcguugucauauguauuagugcuguagacucagcacuuccuaaaggcaaaaguccaggcacaugaggaaguguguguucaaacugagauuugucuccaaauaugagucucuggauguuugaguuucacacuuaaccaugucauauuuugucaugucauauauauaucaugucauauaugucaugucauaacuauggugguaggaguccuuuacuccuuucaacuucaugucgcuggcaugcuggcccugauuuacuacauuaagucuuuagagaaauuguugcuucccaaaggccuucugaaaugggucuuugcaugguugcuuagcuacaacuaguuuauaaacaaccuaguguuuuuacuauggguauuaucuaaauagaaaaguugacacuugaaggacgucaaggauuuuuaauuuuucauuuuuaaaaugaaaagaggauaucaacacaaaaugaugguuuggguggaauuuuuaacugccuuuuauuacaaagagacauggaguacaguuuuuaaaguuuuagagaaccuuucaagaauuuauaucaacaacuuaagaaaaaacaaaguugauucauguggagcuaguuuaaaacaaaaccaaagccauuuaaggccagguuagggcuggguguggugaugcucaccuuuaaucccagccagggcagggcaguugaaucaaggcagcugaggucaaggacauguucuacagagcaaguucaaguucaggacuaccagaacuugcucuguacguauagagaaagcugucuuugagaaaaaaaaaaaaguuuuaaauucggggcuggagagauggaucagugcuuuaagagcacuggccacuauuccagaggaccuggguucaauuccaugcauccacauggcaacucacaacugucuguaauuuuagucccaggggaucugacaccccuacaccuauaccuguaggcaaaaauauuccaccaagucacuuaggaagugcuggcgcaugccuuuaaucccagcacuugagaggaggaggcagguggauauccgugaguucgaggccagccuggucuacagaguugaguuccaggacagccagggcuacacagagaaauccugugucaauagggaaagaaagaagguuauuaaaaaaaaaaaaaggagccaaaagcugggccauaauggcacccuacaugcccuuuuuuguuuuguuuuuucauaacaggguuuuucuguauagcccuggcuguccuggaacucacucuguaggccagccuggccucgaacucagaaauccaccugccucugccuccccaagugcugggauuaaaggcgugugccaccaccacugcccaccucccuauaugccuuuaaucccaacauuagggaggcagagacaggcaaaucugaguuugaggccauccugguuuauaagcaaguugcaggaggcagggcuacacagagaagaccuaccaugaaaaacugaagagaaaaaaaaaagugaaaucuaucaggcuuuaaaucuacuccuaaugcagucacuuuagaggaaugauacucucuugggaaacuuacuuuuacagaagauguuuaucugaaagguaagggaauuacugcaguggucaccaguaaguaagcccacaagguauuaaguaagggcuuugccaggguagcccuuuucucuccuuuaucucauauuagaagugguacaaguuauugaaauuacugaaaaaaaauugacuuuguaggaaucauuuuauuuuguaaauuuaagauuucccaaaauaggagcuugagagaugacucagugguaauacuagcaacuguuccuuaggaccugagcuagauuccaaagucacgcccaucuuguaacuucaguucuaggggacccaauacccucuuccggucucuaaagacacuaggcauaggaaugaaugguacccagacauacauguagacaaaacaucugcauauguaaaaauauaaaaauuuuagaagcauuuuucacauaaauuuuuuaguaauuacacauuuuuaauuacauuuuguguacauauguuuuguuugucggggucaaaaggguuuggagccuauguaauuggaauaacaggugugagcccucauugugggugacuugaaccuggguccuguggaagaacagcagauguuccuguucaucaucucucaccuaccccaaagguuuuaguauuuaacccuuccuuguuaaauucagaacuuuaguuccuuguguacagaaugaauagaagacuaaaaaaugcaugugcagugcacacuuuuguaauagagcaaacaaaccuuaccuucuuugcauggaacauaauucgccauguugcauaaucauucauccaggcaagcgcuugcuugguguacgggcaggauggaguuuuguuuuguuuuaauccccacuccacugaaggaagccuucgaagcucacugacaugaagaaggcacauggaacuauuaauuuuagaagcuaacaugacuucauuguccauuauuaaacauugaaaugcuaauuaauaagauuuaagucagccuuguaccugauucuaucuaaaguucacucuguugucaaugccuaggaaaagcccucccuuccaucuuuggucuucuagcaagcuuaacguagcuagaggcucacugucagcugcuuggacaacuauaggaguauaacaugauaaaagaauuuaaaagccaccauuuagaaacgggguggggggcgggggacuuguuucugaugacaauaagacccacagguuucuucagauucucagcaggaaaagcagugaucuagaacguuuugaaacagugguuuuugguucuuggguuuaaguuuagguagggauuuuaguuguuuguguuugugguuuacgugugcauuuuugaugagcagagcuuuuugacaugcauucuugacaugucacuuuacagcugcucagcacuagcaccaucagucagucagcuuguguguguuaacucugggauggaaguuaaggugggaccuuguacauaacaagcagaugcaggagcucagccacagaccugagccuccacauaagcuucgcguuugcuuggguuugguuugauguugaaaguuucccucuauaaacuggccugucuaauaaacuagcaaucuuccugcuacuuagucauuacuuuuaaauaaucuuccaggaaugccccuacugaaguucugagagcguguuggaauuaugaccuucuacaaggagggagaguccugaaaugacuagcaucaguaacauauaguaaauagaaauguguggggaaaugcaaaugcaacauuaauuuuuguaugcuuuuuuuuuuuccaggaaaauacuaaaguuccucugggcucagauagaauuuuaucagaacauaauggguaaguuauacagagguaauuuuguguuuaauuccugggagaugguuuuuccucucaacuaggccugugggccuacacacaugacuuuauugcacagaugagcacuugaacaccaagggauggcuuuuaaagucaucacaagaaaauagcuaaagugaaauuaauguucauaugaauaguuuauuauuccguaucucaguaacaauauacaguaacuauuacuaaaaaauuaguaaugucaauaccuuaaggaugagacauuuacaccagauugugauaguacacuccuucaaucccaacacucacaaggcagaggcaagcacauuucugugucuaagaucagccugaucuacacaguaaguucuaggacacacaggacuacacaaagaaacccugucuugaguucuaccaccccccccccugccaaagaauaauaaugagacuuuuaauaauaaaaugcagaauaguuguauuugguuuuuccauguaugaucagauaaauaccugcaaaaacuugaaagggucguauugcuccuaauuucagguauuucauucaucauaacaaggagagugcaugucgagcagagcugcucaacugcuagucugcauuauuaagggagaggacaagguagagcucccaaguacauuugccugguugauccuuuucaguggcuuaagcuauucagagccuucuugauccacaggugguucauagaugugacauacauuucauuaggcauuucucaagccagucaaguugauaaucacaaucaaguaucacagaaugcaaaaauaggagaaacauaaaaugaacuucuuagcagauagauaguguugagccaggcuggccucaguguguuaauccuacauuagccuuuucuucuucuucuuuuuuaaucagacucccuggaacuggaggaggaagaggaggaggguggugguaguggucgucguggucgucgucauggucaucuucuuccuuccuuuuucuuccuccuccuuccuuccuuuuucuuccucuucuuucucccuuucuuuuucucuuucucuuuuuuucaacagggucucuguguagcccuggcuguccuggaacucacucuguagaccaggcugaccucaaacucaaagaucuaucagccucugccuccuaagugcugagacuaaaggcaugugccaccaacuggaugauuuuucuucuuguuccuccuccuccucuauuucuaucuuaguaggaaccauuaaaaaucuauaagcuugaguaguuuagaaauugcuuacauuuuuaugaauucccaugcuuuuauuguaauaauuacaagagcuguauagugucaaacccuuuucagggaccuggagagaucgauaucucaguggauaaagggcauggugugaaaacaccaggacuccaagccccuguaaccuuugaaaaggucuugcauuugggagcuagcuacuuguucaaagacuggaauuugucuuguauggguuuagauucagaugaaacaucuuugacagaaauggugauuuuaauccuaaucuuuguguagggauuucugaguguggauguuuauagaugaacagaacaaucaucuugauucuuccacauugucgagcuuccuaagauuucagaauaagauuuuaaaugcuuuuauauaaugguaauuacaaaagacacaagaaaaaaccuugagguauauaaaagcauguauuuuuuuuuuuuuaaagauuuauuuauuuauuauauguaaguacacuguaguugucuucagauacaccagaagagggcaccagaucucauuacgggugguugugagccaccaugugguugcugggauuugaacuucagaccuucggaagagcagucgggugcccuuacccacugagccaucucaccagccccaaaagcauguauuuuguuauuauauuaucccuagcagaaaauuguagugaagcuagcacaguggcaaugguggcaucaguagaacaacaacuacacaccuguccucaccucuaaugugauuuuuuuuucccuuuuccaugcugagcaaucaaacuugugugcuaagaacaugcucugcugcuaagcauggaccaugacuacauuaauuuuacugcuuuaucucagauggagaggagaagaccuaugguggcugugaaggcccugaugcuauguaugugaaauuaauaucuucugauggccaugaauuuauuguaaaaagagaacaugcacuaacaucaggaacaauaaaggcuauguugagugguccagguagguaaauacggugacguuuccuucauauauauccuuuuaaugucuaaugaauguauuucaaguuagcuaugcauggcgagagagagagagagagagagagagagagagagagagagagaguaguugcagugguccaagccuguagucucagcuuugcaaggauugcuucugaccuaagcgucuuaggccagccuggacagcaugaugagacauuucuccaaaaaggaaaaaaaaaaaggacuggauacauaagguagccagaggcauguggaccuaaguuaggcuuuccagaauccauguaaaaaaaccaacaaaaauaaccagguaccuuauaauuuuagcauuggacaaagaggaagaaggcaaaccagacgcacacaaaccacuuggcucugaucuuuuagcauucuuuaaaguaaauauuuucgaacguccaaaauaauucaaagcauacaaacccagcagcaauuauuacaucuguaucauguacagccaucacuaguaucuaguucuaaaaauuuuuuuuauuuauuucuccagaaaaaaggaaacucuguaucuauucauucagcuuuaucugugcccaaucuguuuucuguugucccuacucuggauccauacaguauuugaccuucuguuaggaauacgcuacauuguguuucucugcucaucacaguugauagaacauucugugucuauccuaaacagugcuguuguagauauaugugugagugccuauuuaaaacaccagcauucaguucuguucuguugcucugaagaacugguugccauauguucauuguguuuuggaggagccacugaaguguaucugaagaggugcaauuguuuucuuuuuuguuguuugaccgcauacuagucuuccauuuuauaaaacacccugacuaggauuugucuuuuuuuucuuguaguuuauuauaucuauagaauguaucuguaucaguuuauauguaucacauguauauaagagcuuguagagccagaagagagcaucagauccccuagaaccagagucaugggugcuugggccaguggagugcugggaaccaaacccacacucugcaacaacagugcacgcugaugcugagcugucuuuuugcucauuacugucuuuuaaauuuuguauuuguauuuuuuuuuuguaacuacucauaucgaacgccaauucaugcauuugcugaccauuugcauguauucaagauucuuguacgugcacacuaauuaucuuuuuccucccuccaccuuugaaguagcacacaccuguagucucagcacccaggagacagaggcaggcagaucucuguuccaggauagucagagcuacgcaggggaauaaagugcuuaauggugcuggcucuucuauagcaugaugagauaucuuggaacuagauggggugggguggggugggggucacacaauuaugaaaacuaaaugcaaguuuaaggccagguuagucuacagagugaguucuagggcaggcaaggcuacacaguagugaaacccuguuuaagaaaagaauauugucucuauuuguguuaaggccaauguucuaaauauguagauugccaagacauuuugaggcacuacuggaaacugcuucauaaagcauuaguucagaauuaggugucuuacaaagaaaucacauuauggugaauuguuugguuuuauuuuuuugagccuagauuuagcuaaacugucugagucagccuccggucagucauccugccuagccuuaacuguugagguuacaggcgugugccacuauaccuagcugcuguuuuaguuuuaaagauuuggguagauaaucaauuguccuuuuaacauuagcuuucugccucacaaagugccauccuguauguacugcauagcuuaagaguggagaacuuuuccuacaucuaaagugucaaacuuuagauauuuggcaguguugguuugucuccuuugaauaauggucucuuucuuugucuuuucacauccucuucucuccgcucugucuagucuucugaugaggaugccaguuguauuguacuacuguccuagauagagacuuuguuuuaacauaauuuaaaugaaauaucccaccuucaaguacaaucacauucugagggaguuggacuuauguugaccuugaauaauaaaaggcacugugcagcccuaacauauauaaaacucuucuguuuugcaggucaguuugcugagaaugaaaccaacgaggucaauuuuagagagauccccucacaugugcuaucaaaagugugcauguauuuuaccuacaagguccgcuauacuaacagcuccacugaaauuccugaauucccaauugcaccugaaauugcacuggaacugcugauggcugcaaacuuccuagauuguuaaauaaaauaaauuauaauaaacuguuaauuuuuuucaguauuuaauaccuguaguucaguuaguaauuuuuucacauauagcauguugccuguaugaaauugagcuguaaagcuaauugccgagcagauuccuucugucauuugcauagcagaguugaaauuuguuugcuacaucaacaaauuaaggacauuucacaagucaaaaaauaaauaaauaaugccaguuuauagaugguuugcuuucuccuggauaugaccuuuaaaauuauaacugauagagcaaauccuggaauauaaacguaaaugaauauauucuacagguaaauacaggggcuuuuuauguuucuaguguuuuuuuaagaaccaguucugaucuuaugccacugagcauuacuagaguuaugcaaauaauuacauggaaaacauguuuauaacuuagccaaaccuugauuuuuguaacucaaagaauaagaguugaaauuucuuauguguuuuuuuauaaacugcaguauuguuuaagugcaucuuguguuuuguuuauugccacaacucaaguuauuuaaaagcaauuuuggaagcuaaccagguauaucuuuuaagaguaguaacugaacuguagcuaucuagucaagugaaugacuuaaaaguuaugugcauuguguuugaauaaucugaaacaugauucugcuagccuuaggauuucucaaguuuccguucuucauggucucuugggguagcacuuaugguguugaaaugugucuacaacacuucaugagcuugaucuaaacuuugagucuagaugugcugagcucuucuaucuagucuuccugcauuacaggaaugcuauaaaaauaguaguggaaggauguggucagagcccuguagugcucucagacauagcaccagaagauaccucccagcauaucuucuagccaaccacgcuaaaagccaugagucuucugaagucacacucaugagguaauucagccuuuaagccgagcacacagaacaucugaaucuggccagaucucugccuuggcauggagagcacugaagugaaugagauggugagauaugguugcccccaguggcugucccaggucugucugcaagccuucaaagcuacagaagucauaacuuuuccucuuaaaaaagugcacauuguacuuuacagcauacaggaaauggaaauugguguaaauugguuauuuuuaguaauguuucaagacaugcuggccauagcuuagugcaauugugaugaguguacaggaauuguguuucaggcugcaaguauuuggagcucagugguagugccacuaugacaaggcccucugguugguuaggcucuaugaaacuuauauuugcccuuucuacaagcuccaaagguccaaaggcaauagcuagcaaggaaaguuagcuugagccaguuuuuguagguuacucuguuagauccaaaaauaaccuuaacuucaggacaugaaaauugcagcacacuaggcaaauuuguauaugguacagaaaauggugcauuguguuaauaaaggcuguauugacugaaaagguacgaucagcacuuggucuuuacucuuuagcauugucuccuuuacaugaaagccggauacugcugcagggugucuugccaugaaauuaguuugguucaguuuaaggugguuuuauaaaacaucaagaugucaauaguuuucugauacuuaguaauuauuauuuauaaauuacauguaaucuucccauuuuuuuaaauagaaacuaauagcauaaaauuauauuuucuucaguaauucauuuuggagccuggagguuaguggaccagcacuuggcccaaauauucaaggccccucaguucaguccccagcacacacacacacauacacacacacacacacacacacacacacacaaaccaauuucuuugcacugaauuaaguuaugcuuuucaaguuggauguuuuucauuuuauuauggguacaccguugcucucuucagacaucagaagagggcaucagaucgcauuacaggugauugagucaccacgugguugcugggaauugaacucaggaccucuggaagagcagucaguacucuuaaccacugagccaucucuccagccccuggauguuuuucuuguauucaaucaaauuccuuacuuuuauauauucuuguugauacuaaauucagguacaugaaacucacaaaaacaggaagaacucuucuguggaugauuugugguagaucuuuauuauaaauagagaguggacauaugcugaggugugagauuaaacugcaguuaaagacucauuguguuucagucaaguaauuaacuguuucaacaggaaauuuacaaauauacaaggcuugaauauauccacauuuagcaguagggguggagaaggcucaacaguuaggagcacuagcucuuguacaggacccacaccaugcaacucgcaagagccuguagauccaguucuaaggauucuaauauccucuccugaccucuggcaccugcacacacauguugcaaggaggcacacaauaagcauuugucauuuguugauuauauuuagcaaacacgagcucugguacucaagauaccauugauuuucuguauaguuaaugcuacaagucuggugugauacuaagcugaucauauuuauguguauguaucuuccuauuagugcagaaagguauuuugguuauaguacagcaacauccucagaguuugaguuuaucuuguguuaaugccaugaaacauugaacaaauauguugggggagggaacgucaacaaaccuaagccuugaguguacacguaugucuuugcuuucauguauguguacuaccugugugccugguguccaaguucagaagugugugucagagccccuggaacuggaguuguggaugguucugagccaccauaugugugcugggaauagaacaagaguauccuguucacuuuaccacugaaccaucuuuccagccccaaauauguguguucuauaacuaagcuggaucuauggcaccaggcucauuucacaggaaacaggcucuguuguuuaggcuaucuuggaacuaaccccagcccuauuccaagccuuccaaguagcucagaugugugcacuacugugcccagucuugccaugcuauuucucuacugagggaaacuacaguuaccaucucaagauuauaacauaauaggugacuagauuguguacuagcagaaaaugucucugucucuuguucauuuuccuagauuagguacuacguguucuguggaaauacuauacauucaggcuuuguagugcuggggauugaacuugggcucaagcaugcuagggaagagcuaaaccaccaaggacuugcaccauccccaucccuaaugcaaagucuuugguggcuguuuguaucaccacuauauagagaucuuguucaguucuagcucugguucucaguaacuuaguacaaacagaaauguauguugugugacuuuguagcaguaugcuuaauaugaagcuaauccagaauuuauuuuucauauguguacugauuuuuccugaguuaaguauguuuuugauuucuauauguauguccaucuagcuaaaacaaaaggucaaauuuuggggguuuuccccuaaggugcugguuaucaaacuuagggagggccuuggauauuccagccacuaccugcuacauuucuugucccuaaaagauacaacuuuuaaaagaaguuuguguguguguuugucuuugugaaugcucucaggugaacucagaggccugaaguggguguugaaucuccaagagcuggaguuugugucagugcuggaguuaaaacugauccucaugaucaugcagccaguccucauagcugccagaccaucucaccagcuccuucaagacccugcauaugugucuccaccaugugcauaccuggugcccacgaagaugguguuaagagacaguuguaaacuaucaugugggugcuugaaauugaaucuugggggaaaauuuuuuuaacuguccuauaaaaaugucaguuuacucuguucacauucucugguuugaguuucuuucuguaccccuuuucuugugcugcuuugaucaagucccaggcuuuauagcaggcaagcacucugccaccaagcucuaaguauauuuauuguggucgguaaaaaguguguguagcuuagagggcagcacaugguucucaccuuccaugacauggguucuguaaauugaacuaaaaucaccaggcuugcaugacaaauguuuuuacaugcugagccaucuuacugauuaccaaagguuugguuugguuugguuugguuugguuugguuugguuugguuuaaaa

SEQ ID NO: 80 - RNA, 1280 nt, Mus musculus
aagcacuguggguuagccuccucaagaggaaccaguuugugucggggcugguacucagaagcaaacuagaacuaagaagaaccugaaaccgagcuccgaguggagagagcuuaaccacaagacagcaacagagguaaaaagcaauucagagguccuggggaaacgcggggggggggggggggguugggagagggaaaggaugauccgcacccggaaguggucggcauugcuccacccccaccccacaccgcagcgggcucacugcuggagcagcguuccugccagcccuccagcuucagguucaguggaaacuuucucucgaaauaguuggcgccgcagcucuuuguugccgggccacuuaccacaauaacuguaggaaauaauugcaucggaggaguugcagaaccacuguugcuucucagauucagucaauaugggagaaagcagcgucgaaaagagaauaaauggcaacaugauuuaauaucuccgauacuuuaaacucgccaggaagaccaucggacucgacaguaaggaggacagauuuaacuuagucagcagucaugugauuuggaagcucccauccaacugcuuccucuuuuuauuugcaugugugacugugcauuuguuuucauaucugagcacuuccuguaaggcaagagaagaaaaaaaugacuuagaauauacuguuucuuaauacucaguguaaacuaaaguauccagcacuuuaaaacagcacauuuucagggagacaauuagcugccuuacaggaaacccuuacuuaaaaggaaguccacuagccguaguacacacacccaguacuugacaggcggaucucugugaguuccagguuagccuucuccagauagugaguuccaggacagccagagcuauaaggugagauccugucucaagaaagaaaguccaccgguauacuacuuuucugugugcuggccacucccucccacacacuccuccucauacaacgguuucuccugaccuagaaagcugcaucuagcuaucuaagcugauuucucuccccuacccccucucaauuucuacucaaguacaaacagguucagccacaaaacagacaggcaagaugaccccuacacggggucaguagcaauucccagcugggaccucaccaguuuugagaaugcacucaaaaggaagguugaacuugaggcaauaguguugaguugggggugggguuggugcuggacucuagagcucuuccacagaguagcaucuugagguaaaagugugaguuccaguaauua

SEQ ID NO: 81 - RNA, 833 nt, Mus musculus
caugccuaaaggacugaaagaaaaaaugguaggacgggaaaaaaaaaaagucauccauccauacaguaaaacggcagcucagauuacaagagagucacacaaaaaaagacaagaaggaaagauugaagauugagagggccuugcgucucaaccuuauuggugacaaacuucagugguuucagucaucuggauacaaaaaaaaaaaaaaggagauauucaaagaaagaugccugugaauuaauugaaagguacuuggaucgguucagcagugagcuggaguagauugaguuacacagcagcaucaaggacaggcagggaaggcggcaccauucccggggaggccgucaucaagcagaccauggagugggaguggcagcaguacgaaggcuauggcuuugagaucccagacauuuuagacucuaauacucugcagacguuccgggaaugggauuuugaucugaagagauugccaaacaucaaaaugaggaaacuuugugcugauaaugcaguuccuaagaagcgcaaacagaaaaauauuuuaaauauagaaaaggauuuagaagaauuagaaccuucagggcaaacuggagacacuacggaugggaaacuggaaccagcaagugaaucaagugacacgggugaagaaaugacuccagugccugucagcccucauugaaauaccugagacccucauguucuacucagugacuauggcacauagccauuuauaugugggcuggugaaauggcuuagcaggagggggcuugcagccaagucugacuacuggagcuugaaucugagaauccauggguuaaagagaaaggaugcuacaa

SEQ ID NO: 82 - RNA, 1307 nt, Mus musculus
aucaacaguggcucucacagccauugcaguacauugagcuccauagagacagcgccggggcaagcgcgagccggacgggcacugggcgacucugugccucgcggaggaaaaucaauuaaacaugggcaaaggagauccuaagaagccgagaggcaaaauguccucauaugcauucuuugugcaaacuugccgggaggagcacaagaagaagcacccggaugcuucugucaacuucucagaguucuccaagaagugcucagagagguggaagaccaugucugcuaaagaaaaggggaaauuugaagauauggcaaaggcugacaaggcucguuaugaaagagaaaugaaaaccuacauccccccccccccaaaggggagaccaaaaagaaguucaaggaccccaaugcacccaagaggccuccuuccgccuucuucuuguucuguucugaguaccgccccaaaaucaaaggcgagcauccuggcuuauccauuggugauguugcaaagaaacuaggagagauguggaacaacacugcagcagaugacaagcagcccuaugagaagaaagcugccaagcugaaggagaaguaugagaaggauauugcugccuacagagcuaaaggaaaaccugaugcagcgaaaaaggggguggguggucaaggcugaaaagagcaagaaaaagaaggaagaggaagaugaugaggaggaugaagaggaugaggaagaggaggaagaagaggaagacgaagaugaagaagaagaugaugaucaugaauaaguugguucuagcgcaguuuuuuuuucuugucuauaaagcauuuaaccccccuguacacaacucacuccuuuuaaagaaaaaaauugaaauguaaggcuguguaagauuuguuuuuaaacuguacagugucuuuuuuuguauaguuaacacacuaccgaaugugucuuuagauagcccuguccuggugguauuuucaauagccacuaaccuugccugguacagucuggggguuguaaauuggcauggaaauuuaaagcagguucuuguuggugcacagcacaaauuaguuauauauggggacaguaguuugguuuuuuuuuuucuuuugguuuucuuuuuggguuuuauuuuuuucaucuucaguugucucugaugcagcuuauacgaagauaauuguuguucuguuaacugaauaccacucuguaauugcaaaaaaaaaaaaaaaauugcggcuguuuuguugacauucugaaugcuucuaaguaaauacaauuuuuuuauuaaaaaaaaaucaacaguaaguguugga

SEQ ID NO: 83 - RNA, 3227 nt, Mus musculus
acaaaguuaagucuuaauuuuauuaccagauauuugauguugggugcagguauuuaacccuugaaaaucuucgaucccuuuauagaaaguaaauauaguaaugggaaguuucaggaacauguguucaguaacuugcauauauguuaagacgauggacuguuagauguagagagcucauugugacgaggguauggagauggguucucagcuaaaguucuugcugccuagauacagaagggucauacaggaagaugcgcugaaucucucuagagaaucucuucuaaguacuaccugucaagaaaaaagcugaugagcaaugagcugaggcaggaaauaggaggugggacauuggcaggaagucagaggauucugggaaauagugcaagaauaaauagaguauaaaagagagauucaggagagccaugggggacagauggagggagauaaacugaggagacagacagacauaaaccagcagggagacacugagaggacuagaagaaagaaccagggcaggaaugaaggagaaguaacuaacuacauggcagacacagaauaauuuaaauggguuaaauaaguuaugagcuagucagggaaugagccaaaggcuuauggucuaggcauuuauuaauaaauauuuagucucaguugucauuccaggagcagaacugggaaaggaaaaaaaauggauacauaauuuuuuaacaggcagguuaaguuauggugagaguaauuuuucaaagacuucagaguguguuuacaauagugagucugacagcuucaaauuguauuguauaagacaacaaagguuugauucucccccgcuguguuagcucaguuucucugggaaaccuuucuacaugugaauaggcaugcaagggaugcguugaaagcagacacagcaaaggagguuucaagucuguggcagagagucaaagcagcaggccugcauaggcggcauccuggcugucaacacagugaagagacauucuuccgggccaacagagaauucaucacgagccaaggucacuugcuggaaaaauccucugcuuuacaagaauaggcugaaugggagcccucagcauccugcuagucauuacuggaagaguucaugggaaacacagccuuggacgggauacacugguugaugccggggggcuagguguuguacaguccaccaucgcaggauacagagaaggagaccaucuuuagugagucaacaaaagccaguuggacuuucaagcccaaagcucaggcagggaaucuggugugucauaacccagaugucguuaaaacuacgaauaauccucagauaaaaucacaaaauggaagggcuaagaguacaguuccagcaacaucagaauguaaggaaguacaugguaaaguauagauuucacgcucuuuguuagggugucuauagcauacugaaaagcucagguggacguguagucagguguccaagggucugacaauuacacuggcaauuacacucacauaaggcucccauucagggcugaauaagucaggugauggaaggcaauaaaggcaggauggauucccuaggcggguauuguugggaacuaagagggugugggggaaggagcggggagggaggauagccugcaucgggccagaguuccuccuuugcucugggcaggcagacgcuuuccacucggacccggguggccaucuaagccacugacaacacucgaugggggggaggggacuguggacaaggggcagcccccaauagggggccccagggauacaggagagagggcagaaggaaagagauucccacucaggcgagaguccuuagucugggccuugacuggagcauaagauggucuuccaucgggagauuacaaaaggcucauuagaggaaagccuaucccaucguccaaacacagcgggccuugaugaaccgagacagucuaugguuuuagagcuuugcuguagaaaggcagggagaaaggagagaaaguggagagagagagagagagagagagagagagagagagagagagaggcaggccauggccaagaggagagaagggggaaaggagagagagaagaaauagagaguaagagagagagagagugagaggagaguaugaggagaggagaggguaagaggagaguggagaguaaaaagaguaaggggaguaagagaguuggggcuaaacagccccucuuaugguaggcuguuaucuuuacuguugcuagguaacuggggaggaguguaaccugaaggucagaagcuuggaacauugucuaugugacugcuagccauacuucaccuguggggacuguggggggugguaacuucgacaggagccuugaguccaggagauaugagggaacucuuucugucccaaguaggugacaccaccaguucccaggguuccacaccucaacucgacuagagaccaaacugugcauagcccaaugccccacaggguauacaacacaauuucaaaacuguccuggugggcaguuuugaagucauguccucaccaggaaguacuucuuaguuguggcugaagcagcuacaccguugacaaguucauucugaguguggcuuuuuuccugguaacuccaucggagucuauucuuuuucucccugaauccacaagccagugauauaccuggggguauccuugucugcuuaaaccagcuaugaguauuugaaacaugaccaguuauaacuaaaggagccacuaaccaaagaguguaggugggcuggacagagagcccugacacauauguagcagaugugcagcucagucucagugugggccuccaacaacuggagcaggggcugucccuaaagcuguucccugucuguggaauccauaccccaacugggcuaucuuuucaggccucagugggagaggaugagccuaacccuacauagacuugaugugcaggguggggauggaggggguggagggagggaaucugugauggagggacagggaagguagcagugacugggauguaagaugaauuaguaaauuaaggggggaguagcuuguucucucucucucucucucucucucucucucucucucucuccagcuacucacacacucccauaugugaguggugaguuuggugugguaaaaaugagggaggugccuagggaauagacauccuugauaccuccaugccuucuguacaggaagcacaaugggagaugcacaagauugggauuuggccuucac

SEQ ID NO: 84 - RNA, 1779 nt, Mus musculus
gagaacaucaaugccaggcuuuugaaaacauccguagaacccuucuccagcccguggugagcgugaggaggaugcuggcaccgacuucucgcccuuucccugccuuuuaauacaaguguuagcuccauuacaucugcuuucaaagcuuugcagaugagaagaaaagucacgccgaguggccucugugaaacuuuuguucuuguccuaagcagguccuuguccugucacucuaaaaagugccuuauauugccuuguggccuucacugguacuguauggccuggccccccaacugccaaggcucuagggcugacuggcauacaaagccaaugacagcauaccucaguacagcuccaggggaaagggacauggguugacaguaugugucauuuguuaugacccucuucucccucacacauagcgugagaccuugcuuguucucuuuuuuuuuuuuuuuuuuuuuucuagucucccauugucuguaccuucuggcuguggaagcuugugagguaacccagcugcagacacccaugccuccugucuaauaagggaagcuuggggguugggaaaaaggucaccucuguguaccucuggcccuguguggcgagcccugcucuuccaguuuccucauucccaccccagguuagaaacagcacccucuuccuaucuguuuuaguuccauguagcccagagucuguaugaggaauguguuuacuugugcucccuuguuccaagucuuagcucauugguaaccuguuuggcagugccugugaucugguagcugcaaagcuccuggauuccugucaggguuaucuuguguuccuaguaccacaccaauccccucccugacccuagccugcuugccugccuguucccgccugccauuccggguugugcaauaacccucccagccgguggucuugucccuuacugcauccauccugcaauaucuggagagaggggacccacaggagaggucgucaucaucccuuacagaagugucagucccuuccuauugcugucauucgcacggcccugcguggguuucuguggcaaucuuacagaauguguugugacgucuucgagaucuuuacguuguuuuaaaaaauaaaauaaauguguugaagaaaacaaaaacaaaagcauccucagaccgggacauugucagugucuggggauaagaucagucuggagucgcugacaucacuaucaucaccaaaggcauuccaggguuucuuguuccugugcaaacaaugggccauguuuccaagaaucagccacaguggugagcccuguccgccccgcuacugcucgcccacccccaugauggggccuggcugugguggugagugcugcauucuuugggguacagauucaugugugauuaaaccucacuuuucaguuacucuguuuaacacacacuugaaggaugagcggaggagcuggugccccugcgcaacucacaaugcaaauguggacacuuugacuguuuuucuacauuagccuguucauguuauggaccaaauucaacaaggaacucaaggaaaauguguaccugccauauuuaugcuuucuuauuaaaggguugggggaggggcgucuuacuuuuggugaagucuuuuuuuuuuuuuuuuccagaguccuuuuuccacuguuucugucugguuuuagaaacaagcuacaguuuuguauggauuuuuuaaauguacauuuugaaacaaaugaucaaauauuuucugaaauacaugaauaaagggcacagaauuauuggucauaacaau

SEQ ID NO: 85 - RNA, 3441 nt, Mus musculus
uguugagcacacccagagccugacaccaggaugccucaggguuacucuucugguugcaugagcugacacagccauguccacaggagucugugacccccuucccuucgguguucuuuccucucucuucuaccugaagacggggucaucagguccuuaugguaccuugugaggacuuuuagaauggauuuaggcuuuaaaggguccccaaacucugagcuagaguauaggggagcaguucuugguaacacaagacauuaauguuaccuaauauucugccuggccuuccuuugacaccauaucugagaccagagcuugaguguuuacccauaaagagggagcugggucuucagcaagagcucccuuccaagccacugacgauggauguaaaaucuaguuuacccacaacugaggaauuugguuccaaacaccaacguggcauucuuuuucucuguguccagcuuacacauagacaugcuggauguguugagcauacagaauagagaugagauccccuuggcuucuugugugugagcuuaggaaacaagacagaauuuugaaaacucauuccucuauucucucccucuucuuuccuggcccuucucugggcauccccaaagaauugaucuggcaccuuucagccaguguagcccaccuauccggguagggauuuuaauugaguuuaugcuuugaaaugccuucuguugcuguguggaagcucagccgguggcucccaagcucaccuuaccccaucagucuaggugaccuccuggaccaucuccaagcuaagagccugccucccuaaguugcuggcaggcccuugccagcucacugcaggaacuucgucucuaggcugaacuacuuaguuacuccuuaaguaaauacuugugacaagcaugagacaugugaaggucuuggaggaacagggguauaaagagcagcugucuuggauccagggguccugucccucuggagggguuuguuauucccgguacacuuagaugccugagaugauauggauucauuccuuagaagucuugcaagcguccucuguugcugguuuguugggauugaucuaggcucuucuagaacauaaggucaguaguaggaguuugggguguucauuuccagaaaagccugagaccaagggcagcagcucgccagccuugacuucugggcuguuagcaggcuugggagaacuauggggugcuuucucacccacccagccucucuggcauugauguuauaggaaagccaagacuuugugaaguuggcacaaaccuuguugccagaauuacagaaacuaaguuccacaccauccuucaaacaugcaggcuagcauguaaucugggugcucuggccccauucuuuguuuuuaugcaggcucuccuguccccaaaguaccacacccuuagugaaggaccugccauacuccgccaaguuugagauguucaguaccaucuaccaggaccagaagauucuaaucacuaccucagcagccacugccugucucucaacaucccuggaauuccaguaggugccaguggcaggacugguggaccgagaacccccuguugcuaguugcccuccccagagguguggugacucaggggacaguuacuucuacaagcuccucaggcuugggugccuacacuaugaauuagcuccuugucuuccuccuauggucagaggugguccuggggaagaagaagcaggcuaaagccagggaaggaggcuuucugcuauucuggucaguccuagcccugugucccuaacugguucacagcagcggcagcagcagcagcauguggcuagccuaagggugaacuuuagucacuucuauuuagaugacuaugcucuggcuacucacacaguacuuuugaagagugccugggacuguaagagccccugaagguuuauuccccuguuuaguccccuccggcauuuuuuuuuuaaaguaggaacagaaagagugcauuuuccaaaagucuacaaagcucacuuagauuccacacauccucaaagaaacuugcugacuucuugcagcgagggaaggccuucauuugcauuugucuuuaauggcuuucagccuuccugguuggguuugcugaagucuggagugggaggagguauaggguccgggcuuagggaacuuucucugcuugagggccucugugucuacagcacauucuucucucuggcucuguucuggugcggcauggaccgacaggcagugagucagaacagugagcugcucuuccaccucccucggcguccugagugcagccucuucccucagaacaggaugcuagggagaacaucaaugccaggcuuuugaaaacauccguagaacccuucuccagcccguggugagcgugaggaggaugcuggcaccgacuucucgcccuuucccugccuuuuaauacaaguguuagcuccauuacaucugcuuucaaagcuuugcagaugagaagaaaagucacgccgaguggccucugugaaacuuuuguucuuguccuaagcagguccuuguccugucacucuaaaaagugccuuauauugccuuguggccuucacugguacuguauggccuggccccccaacugccaaggcucuagggcugacuggcauacaaagccaaugacagcauaccucaguacagcuccaggggaaagggacauggguugacaguaugugucauuuguuaugacccucuucucccucacacauagcgugagaccuugcuuguucucuuuuuuuuuuuuuuuuuuuuuucuagucucccauugucuguaccuucuggcuguggaagcuugugagguaacccagcugcagacacccaugccuccugucuaauaagggaagcuuggggguugggaaaaaggucaccucuguguaccucuggcccuguguggcgagcccugcucuuccaguuuccucauucccaccccagguuagaaacagcacccucuuccuaucuguuuuaguuccauguagcccagagucuguaugaggaauguguuuacuugugcucccuuguuccaagucuuagcucauugguaaccuguuuggcagugccugugaucugguagcugcaaagcuccuggauuccugucaggguuaucuuguguuccuaguaccacaccaauccccucccugacccuagccugcuugccugccuguucccgccugccauuccggguugugcaauaacccucccagccgguggucuugucccuuacugcauccauccugcaauaucuggagagaggggacccacaggagaggucgucaucaucccuuacagaagugucagucccuuccuauugcugucauucgcacggcccugcguggguuucuguggcaaucuuacagaauguguugugacgucuucgagaucuuuacguuguuuuaaaaaauaaaauaaauguguugaagaaaaca

SEQ ID NO: 86 - RNA, 763 nt, Mus musculus
ugccgggagcaaacgcgcgcccuggaggggagagcggcuguugcgcgggcgcgggcaggggcgcagggaggggauauggcauccagccagcgcauaacuuuagaccaauggaagaaaaaagcagcaaaaguugaacugaaugacacccagaagcaagaaauuaaagaggccuuugacuuauucgauauugauggaucuggaaccauagaucugaaagaacugaagauugcaaugcgggccuuaggcuuugagccaaagaaagaagaaguaaaacaacugaucgcugaaaucgacaaggaagggacuggcaccauuuguuuugaagauuuuuuugccaucaugagcguaaaaaugagugaaaaagaugaaaaagaagaaauacugaaggcauuuaaauuauuugaugacgaugcuacgggaagcauaucacuaaauaacaucaagaggguugccaaggagcuaggggaaaacuuaaccgaagaugaauuacaggaaaugcuugaugaagcugauccugacggggauggagagauuaaugaggaagaauucuugaagaugaugaagaagaccagccuuuauuagcugcuugguaccuuccaagagguuuggaccuccuguuaacagcuuuccuguuaagcaguucaaugauguaauaccugaguguauccauuuccacuuuuaguuuagguuagucccuuggugucuaaucugugccagaaguuauaugucccuaccaaugucauuaaaucuguaguaguaagaa

SEQ ID NO: 87 - RNA, 2632 nt, Mus musculus
aucauguacccaccuguaucuuuauuagaacaaauaguaacagauuaaucuucaagaaguuacaaguaucagcaagaauuccuagaagacaacuuucucuguaaaggacuuaaaugaacuccuauuaaauccgaguuaguugaaauuaugucuucuggacauaaucugggcuaauaggcagcccaacagagucacauuugcuacauccaaauguuuaaacuguuguggguccuaaguuuaugaucuggagacccagcauugccuauaccagagagaacuacuggaauauugauuguggaacaaaaaaaugaaagcugaguauuagagauggacaaaaucgaaagucaauguccauugcugauaggaacauggauaugucaagcaccuaaaagccugagacacauuguaaaggaaagaucuuccucugagcaagagaauggauguuccaucugcaaaaagugucaagcauucuuuucuucacuaguacuauuguaguuugagcgugucauaauaggggcaccuuuccaugagaagauugucccccuuuguuaagugcauaauaaauguuuugacuuugaaaaaaaaauugugugccaaguaaauacuaccaugaaccaguuugauuuaaaaacuaacuauggcaggucacccuggcaguagucuagccaggcccuccugcgauuuuaaauacaacuugcuuuaaucagacacucccaguaacacagccuaaggugcuuccaugugagagaagcaauuuacaucuuguuuccacucccaccucccagauuguaauucuugggagaaauuguagccuucccagaccuuggaaucugccuugcccagaaauucuaccacuaggucggauuaguguagacaaaagagaccaacaucaaaggcauugccugucacagauaccuuugccagaaucuuacaccagcaagaguguaaucuuaugccuuacaauucuagagauugccaauaugguccacaauucaaaguuccuugacuaucuuuuauuaauuuuuaaaggccgaugaaacaccugucccccacccacccaccaccaccaccaacacugcuuuuccaaacugcugcuuucccaaagcauuuaccaauggaggucugcgaaguuaugaauaccaagaauucucacaaaaccacaaaacaaccaagcaacugucaaaggaaaccucaagaagugaggaacuuccacaaaagucguaucauucauugugguaauccaaagacugcucccugauuccggaugaagcuccaggucucgaucccucagaggaugaucccggaucugcaguagcaucaucuugccugagaagggaauguaagaggaacaagacauucaggaggacauugcaggggggagggggcaucaucccacccaaauccccccauauaauccauccugucuucccacacccucacugacaucaucccaugaaccuauaugacuuuauacuguccuagucuauacugcacucuguguaaucucugguuuaccagaugacccagaggcccuucaggagguauggugcuuuacagcuacuccuaaagaggcaucaaagcacuggauuuccuccagaaguccaaauuucaauucccagcaaccacuugguggcucaugagaccauaugcccucuacucgcaggcaguuguacaugcagauagaggacucauauacauaaaguaaaucuucaaacaaagaggcaccauggccuccaccaggauccugucaaagaugccuaccuuuaauuugauccaaauuguucuuacuccccacuuuucugaucauguccaucacccacagccuugccuuaaguggccccaccacagugacucggguuuggccugugggugugaaccaucuuuccagcuggaugaggguguugcuguggaccuccagggugugaagguauucaucaugagggccuguucacagaagagguaauagcacaugugaaacaccaguacuugguugggggugggguggguaaacaggaggccuugaaguuuagauucuaucuaaggugauagaaggaaauuaagaugaagauaacagccaccuaccaaauauguagucuuccuuguccucuuccaugucaaacaccagugggcuguggaaguagucaggcacauuccaccaucccuuccugcggaggucacucauuccugucuucugaaggauccuacuugccuuagaacaaagcaauuccagacagcuuguugcuccguagaaaggcaguucuggcuuuaggagcuauauauguaugcucacucccaaggaacaagcuuugacccaccuuagggaggagacucaaaugccucuaaguucucccuucgaaacucccugugauuacucuuagauaaucugauuagucuucacuugaauguccaaacaccuaaaauuuucuucuuuauaaugucaaaauuucuggagcagaucuacagaccauggaguagagaagucgcuggaggcuggggaggaaugaaagagcuggaggaggaagaucucuacaugguuuucccuccuugagacaggaccucauguagcccuggcugcccagaaccucauuaaauagaccaggcugcuggaucucuccaggugcugagaugaaag

SEQ ID NO: 88 - RNA, 1273 nt, Mus musculus
gguaacccuguacggcaccgcucccuuuuccggucggcguguuucugcaucggaucgucuuccgcagcccggccuucaccaugagcgucccggccuucaucauaucagcgaggaagaccaggccgcugaacuucgagcuuaucugaaaucaaaaggagcugagcucucacaagaaaacucggaagguggacuucauguagauuuagcucagauuauugaagccugugaugugugucugaaagaagaugauaaagauguugaaagugugaugaacaguguggugucccuccuguugauucuggaaccagacaagcaagaagcauugauugaaagucugugugaaaagcuggucaaguuucgggaaggcgaacgcccaucucugagacuacaguugcucagcauccuuuuccaugggauggacaagaauacuccugugagguacacaguguacugcagccucaucaaaguggcggcaucauguggagccauccaguacaucccaacggagcuggaucaagugagaaaguggaucucugacuggaagcucaccacugaaaagaaacacacccuccuaagacugcucuacgaggcguuuguggauuguaagaaaagugaugcugcaucaaaggucaugguggaauugcucgggaguuacacagaggacaaugcuucccaggcucgaguugaugcccacagguguauugugcgggcacuaaaggauccaaaugccuuucuuuuugaccaucuucuuauucuaaagccagucaaauuuuuggaaggcgagcuuauccaugauuuauuaaccauuuuugugagugcuaaauuggcaucguaugucaaguucuaucagaauaacaaagacaucauagauucacuuggcuuguuacaugagcaaaauaugucgaaaaugagacuccucaccuuuaugggaauggcaguggaaaacaaagagauuucuuuugacacaaugcagcaagagcuacagauuggagcugaugauauuaaagcauuuguuauugaugcuguaagaacuaaaauggucuacugcaaaaucgaucagacccaaagaaaaguaguugucagucacagcacacaucggacauuuggaaaacagcaguggcaacaacuguaugacacucuuaaugccuggaaacagaacuugaacaaagugaaaaauagccuuuugagucuuucagauaccugaauuuuuaugaaaaugauuuuguucguugagaaaaaaaaguucuaaguaaaacauuaucaacugaaauuu

SEQ ID NO: 89 - RNA, 74582 nt, Mus musculus
ugccacuaauggucuggauuuuuauuagaacagaaacuagcagguuugagauaccuggugcucuggcuaauucuuuaagaacacagauguccaagaccgcagaaaaagcaauuugagugcugucugcuuaugcauuccguuuucuaaugcgagacgccuuacuuaacuuuaaaaauuaauaacguugauuaauaauguuccaaccuaugugugcagcucucuugcaugagagcagucuggguuugagggcggagaucuugcugaaccucacaagcacacgucaccugccuacaaugagggcagucaggcuccagaccugcccaggccuacucccucgcgacgcugcccggcccgacuggacuugcucugggcggcaggaucaggucccaccucugggcucugagcgguucgcucuucgaggaucagggcggguguguagccggagucgcuuccuauuggccgacuugccgggcguccggacaucugauuggacggccccgccuccccacgggcugagcucauuggacggcgccagccgagggggcggggcgcguuccccccggguucuugagcgagcgcgccgggccgcugagccgggcugaggcgcgggagcggggcugcgcggcgggcugcggagguagggagcgcggcgggcggcgcggguggugagggcggcgggcccgcggcuggcugcucgugccccgcgagcgccccgggcaagaagagcucgccgcaguccuuggcgggcggggacggagcugcgggcgcgcccagcccuccacuguccugucagccgcggccaccacacacacgcacacacagacacacacauucacacacgcgcgcgcacacacacacacacacacacacacacacacauacacacacacacacaaagagcgcggcggcggugcggggaggcucgcccgggcccgcagcgcucaggccgcggagacaaugcggcgggccggacuccgcgacgugcgagccgggaaaaguuugaggcuucuccucaggcugggccgagccgggccgcggcuuuggggagccggcuucgggacggggcccgcgagcucgagcgccugcgcggcccgaggcgugaggagagccuuuaauacuuuuuuuuggagcgggcggggagaacaaauacaagugcggucgggcgagaggcgcuggcgugccgcugacgcggggacgguauccgugggaaccucucgggggcgaaggcuguccggggccuggcgggggcgggguggagagguuagaaggucgcagagcugcgcugcuugcgacuggcucugcuugaccuuggaccaaugauuuaaccgcuuagaucaccucgugggugaucucggaggcgacagccgcucgagucuuguagcuuugaaaugugucuccgauggagauuuuuuuuuuucuuuucuuuucuuuuuucuccaagccucguuguggugcgggaguugugaaaugguaggccgggauauauuuauaugcacccgggacucacccuucagccuuucucagaaguaacuuuuaagucggguggcuuaaacacaccgauccuuccagagugcaaaauaagguauccauuacuuuauuugcaauucuuaagacuggucuagauacccuguucgaaguccuugaaguccuagggccaggacagaaccaauccugagggugaaguggcaggugcccccagcaagcccuucuccaggcauuuuggagaagcgugaaguauuuauuaugcaaaggagagcauaaaccagggcaggcguuuguguuuauggcguugguuucuguaucacugguuucuacugaaaaguuuuguugaagggugagguguugguggggaggggucuccggugacaagagaaggagaagaaaacuuuauuuguaauccaaguaaaucuuaaaaguaauguuaagucucccuugcgggcaggcacgguagcaaugcuaguacaucuugaucuaauuuuaaugaaggauugaaaauagccaccguguucauaucacugacgccaagucagcucacuuacauaaucaucuuuguugagauguguuagugcuguguauaauuucaaagaauaauuacaaaguuuguucugacacugucguugaacuauuaucauuugagauauguaaaauaaugaaaucuuaacuuuugguuaucagauaaccuacauuuuuccaucaaaguaaaaccaaaccuugcuaugaacagaacucauguaaauacugcauauauauguuauggcaauguauaaagaauguauuggcucuguauguacauguucaaguaccacaguuuucucacuuugugagagugccgcuuuuauagcaggugcuccgcuggcuauuuucuccccaccauggagcuuagaagcuuauaaacaaugcaaguuuguaaguuagauauucagcauauauuugcucacaaaaaauauccagugcccagauaaaaauaauaaaaaguccacuccacccauucuuaaaaagaauuauuaccaugcuuuucuggaaagaagggagagauagcaaagaaaaaauuuacagaaaaauucuuguaucuagccugaaaguuuauggcuuaaaauaggaaugcauauuuaaagacaaagacaacuggcaguguuucuaggagaaugauaacaacguugaauuaacauaauacacuucaugaccuaguuuuauuugaacaugagccauugaagagguguguuucuuaaauaaucaguggcuguuugcauugauuggaugucuaauuaaauguuguaaucauaacuauaauauuucacuugagugcugccucauuuuuaaauucauuuagaaaauaacaggaaagcuuucaauuuauuuguaagaaggaauauuuuuaaaaucaaguaaauacucagugagaaaaaaaaucucaaaucuuauaccaaauguaaauuaaacaucaaaaauagcaucuugccaaagucugugcccuagacaagcacuggauguggaaaagauccauuguggacuauaguugagacuugcuuuguagcaucaggagaauacuaaggucuuaacacugggagcuggaacacuuacuguagaauuuguguucuuuagucagguuuccuaguugugcagcagugucagaguugggaacaguauaucucagggugugcucuuuauagacagguuucaaggugcacuugcagaacuuguaaaacaucacacuauugaguaucucaaauuagauuguuugugaauggaaccugaaucuguauucagaaacuccuuucaguuugagagcuggucacauaaaauuguaagaauuaguguuuuaagauaguuucucagaugcacagugcuuaaccauuucccuugacuccagacauggucucaucccucaucuacugucuuugcaagucaaccaaguuaaagccuguuagagaauaacuagagcucccaugcuuccuuucaguccuguuugugggaauaaccuagugcuuaccauguuagcuaaauuccagguuagagauugagaauagccccugggauggcagccugagagaccaugaugaggaugcucaauggagagcugcccauuuaaccuuuuaacacucaacauuagaugauuuggguaaaaaugcugauacuuuggcagacaaguauguggcugcauccauguauccugccuucuacugucacagauauuuguugacaaauuucuguaagggcuucuguaagcucuauauuacaaauguccccugacuugugaggauuuuuguguuuauugaaaaaaaaauuagggugugaaagagaaguugaaagaauaggcugaauacucuaccagaccugaucccaaucaugacauuuacuggcaggugaugucagaugcauccuugccugaccuccugugccuuagcugcuuuaccacaaagauggggauaauagugccugucucauaggaguuguuuugaaaauuaugcaagauuauacaucaaaauaccaugugcaaauaaaugagcacauuguaucuauucaguagauguaauuuuuaauuguaauccuuuuaauuuucccuuuuagcccuggaaagucauugaagaaggaaaagaggaagcacacuggaugaguuaaguagagcugagcacauggaaggucacauuaggaaguaggaaauuguugagcagcgggcaaaugguuaggaggaagauggagguugcagugccagcuauuaacuuggguuucaugguagcuuccuggcucaggugcuuucucuauccucaucccccuuuguaccaucguauuuuagcacuuaauuauauacuuucuugaaucccuuugcaaagcacugauuauguggucugucucagucuuugaauccuggcuuuauauuuuaauuuaguauuacugauucugaacuuucugggcuuagggguagcagcuguuuuucuucucauggggagguggagagggucuagcucuuagaauuauugaaaggauuagguuucugccuaugaugcuaggaauggauacagaauucagcuucagauuugcuuucucauacaggcauuugucaguaaagaacaggaguucuggccaaagagguuccuacuuagagacuuaugacacuaccugugcuuaguauuuagauuugucaaaguacuuucucuagcaucaguucauuugcuccuuacagcagcucauuagagaaugcuguuagcauaagugaaccaauuccaaugcagcacuucaaauccuuucucuucaucucucuucucuuugcuugucaagaaaaggagucccauccugcucuaaaaacuaucucuucauagguuuaggaacaaccaaucauuguggcuuagcucaauggccaugucuuuguguugaacuacacagaaucugaccauuuucuaguccuagauaguucaaagagucccaacaucuuuaaaacucucacccuacuugaauucauaugguagcuacaaccauuuggccaauuauuaccuaguuauaaagucuuaaugagaacauuaugaaaaaagaaagcacuggaccaaaugaguuuuaagacuucccagaguuugugugagccaagucaguuugcucuacuuuccccauccuugaaugaagaugaucuuacuauaagcaucuucccauuuugagggauugaguauaccuggaugcaaauguuuuuauaagaccugaaugccuuaggaccuguucuaucccagagauuuauaaaugaaaaguauucacuuuaaaauuccacauaccuuuucugauaaauggaauaucaaaaaaauuaccugggggacaaauuaaguuccuguugauagauauuaaaaagcaaaaacaacaaaaaaaaaguguguaugugugugugggggguaaauuuguuccaggacccaccccucuguagauacuaaaaucugugaguauaaagccuuuauagaaaguagcuuaguauaugaacauaaccuccacauauuuugucucaucuaaagcaaucucuggaugacuuagaccuaauauaacaugauccauguaaguaguugcuauauuguguuguucagggaguagcgacaagcuaaaguuuauacaugcuuaauauuaaauuaauauauuuguuuguuuuauguauugagacaagguauugcauuaacccaauguggacuagaacuuacuguguagucuaugcugucccugaauugauaauucucgaguucagcuuuacaaauucuggaauucugaggcauguggcauggagcuuggcauacuuuuacacacacacacacacacacacacacacacacacaugauccauagaaacuagaaugucauaugugaaaaccaaaguuauuuuacauuucauuuuuauugacuaaugcuguguaauacuuggcuguguguucuuuuuugaaucauuguguaacaaagucauagauggaaaaaaacucuagguuagauacaagauggacaguccacuaaucuggcuggugaguauuguauaaaacuguguguguguguguguguguguguguauguguguguguguguaucucacgugcacauuaugccuaaguuaaggaugcccugaaauuauaagaugcuguuauccauugaccagacuuuagggauaucucuuuaaaguguguugacauuuaauugacauuugaagguucauucuguuaaucauacucaaagugcuaaagcuaugguugacugcuuuggaauuuuuacguucagucgugcuuagcauauaaagucucuggcauaauugcugcuuauuuagagaaaguuuccuucucucagaaaaugugaauuaugcuuguguuguuuuguuuuuaaaacuuugcuucaggcuagguaaugauagagguuugaauuuaagucuuuuccuguuaguuguauggcgguauuguuuuuucuuacauaaguaauggaaauuguuuggauaaaugaagaguacuuuuauucauguaagaacuagagcucuucacagcacaguguuaaaauuuaaacaaguauaacucuuaaaguuguguauuuuucaacaaacuuuugagagccuuucaauuguauuaugguggauugaaacuauaaaugcaauuuuuuuuuacugaauaagaguucaaaagaacuauuuucauaguaaacuauauugacuuauugucaguauaauuuuauuauaaacacacuguaaaaauacaaaaaacccaauuauuucuuuuuaaaaugcuaacauuuuauugcuuuauccagagaauaucugaugaaauguuuuaagauuuaugggacuuaaauuuaugaaaauggacuuugggaguauuuuugauauaguuaguucaauggacuucuaaauuggugaauuuuuuuuucuuucuuucuuuugguuaguuuacuuaauauuguccaugguaaaaugguaacaauucuuacauagcuuagauuggccuugaaaucaugacccuccacccuccaaaauauuaauuuuuuuucaauuuuuaauuuuagguguauguacauucugccugaauauuuaucuguaccauaugugugccugauacccauggagauuggaaaagggugucaaauacccugagacuagaguuacagccaguuauaagucuccauguggaugauaggacuagaacuugcggucucuggaagauuaucacuaacucuucagcccccaaauuauuauuuuuaauauuuauggaaauaacuuuuuucuaaauuaugauugaaaaaauaacguuuugaccauuuuuaaugauuaaucuuucaaguaccauauguaauuuuuaauguuuuuaccuuaaaacagcuauuaaguaggaaaauuuaaauugaaguuuaaaccagaauuuuuacuuccaugagaaauuuuagacuuugcauacauauauggccuucaugcuuaaaugcauucugcuguaaauuuugagauaucauuuacgcauucauauaauucaaguaaagcaaacaucucucuuggcacaaaauuugauauuucuuauuaauuuucuauauugucuuuucuauucuucccuguccuccauuagaacuguucuuuuuauuuuaugaugaacccuccuucaaaugaaaggucauuuucuuuuagacauuuaacuucagacuaucuuauugugggcauagaggauauaccgugagacacaauauuauuucaguaaaaccuaaagaauacaagucaaugcaguucauaugcacaauacucagaccaaggaugacaucucaaacuuuguacacucugguuucggugcauuuucaucaauagcuaguauuuuaaaaucagauauaacuauacuuaauuuuaauauaaagacugauauccacaggaagcuuuuuuuuaguuuuagucuguugaauggauaauacauuaacaaaaauaaauacuugcuauuauucuuuuauuuaauauucugucguucagaucuggagauggccacaggucauuuauuuaacgcauuuaugaguuuucacauacuaaauuuuggccuaaacacuucgcaagugucaguuuauuuaauauugccuauguuuuucauuuugcaaaugagaaaguuaugauacaaguauuuauggcagugucuuuaguuggguagaccggcuguaagaaaaguagguaacagucuugguacuaaauaugugcaggaucuggggagcuauggauguguuuauuaggaaaagaugggacucaagcgugcccaguauaaagagcagcaugugguucuagaagcacaagucagaugcucucagguugcaccagcccaccagguggagaggaggcuccugcccuagugcugaggagcccucaugucucaugucuuccuccuccuccaggcauuuucggcugacucaggcaguuuugccccaggaggguuuuccuucucccucacuuggaagcccgggcuuuguaaauaauaggagaauuuuuuuuuucucccggguuuaauuucaggccaguuuauccuccccuugcccuucauauauuucuuugaaaauagugcucaauaguguguuacaauuguauauaacuaugagacugauagugaguaacagaauuaaagggcaaagcaaucuuuuguuugaauucaggagagaagaugagagcgguuaaauguagaaaaugaggagaaaagaaacauuguggaaaugaagagauaaauugggauugggaggcugauggaaacugagaggaggauugcugcuuugcuucucacccacaccuccuccccacauucacaguaacaggcaaugucacugucuuuugccugacaugcugagccagggaguugagacucgugggaguggaaauuuucuuccuuuugcauuuugagacuugggugugcugcuuuaagaugccacugguaucucaguaauguuuguuuauaccggauauuuucuggguagccauuguggauagggcuuauaauacaaacaguacuguuaggaagacugcagaaucuccgcugcuauguuuaucuuacuaguuaaaaaccugcuagcacuucugagcacguuuagaaaacuccagaggcaauguuaagaauagcuuuaguagaaagaaagaaagagagagagagagagagagagagagagagagagagagagagagagagaaaagaaagaaaggaggaagggaggaaggaaggaagggaggaaggaaauaaauuaagauuugguguugaccaacaugcaaguuuuucuuuagacaguauaaguuaggguugagcauuuuuuaaaacaagugcaaagguaggguuuguuuuuuuaaaaauauuguuuucuuaaucaucuagauaaaagugcagcacuuucaugucacagaauauaaaauuaaggugagaaagaauuuggagggauucuagucuuauauuuaaauuccauuuuggugacuuauaaagauccuuauucagaucaugggucucaaaguauuucuuccugauuuaugauuguaauagaacacaguaauuaaaauugugaucaucucaaaaaaggcacauugcuagucuuauuuuaaacuuucugguaacuaauuuuacaccucuccuucacuuuuuaucuuauguguauaauagguagauuacgcauucacauuuaugaaaaauagucacuuuaaauaacaauguugagguauaugguaaaacuauugauuuggagaaaguaauuuccaagugauuguuuccuaggcaucugauaggguuuguucagauccccauauaugaaauaaagagaauuaacagugccuuucccagccgugacauggcccuggaauucuguucaaacauucguggacucuaggaaacagaaagggauucccuuguauuuaaucuuguacuuauauauuuuuuccuauugucaugaaaacauuucuccuccucugacacuguucucauuagacucuaaauuaccucugugcccacuuuuccauguuagacagacauggaaccugggccuagaagcuuguagaguuguucccaagcugccuugcucucucaucccagacccaugagcuucacaacugccgcuuguuuauugcugcuuuuccugugcuugugcuguucaccuggccugagcugucuuuuaacuucacucguaaugcuuaacuuuacaagugaaauuugagccagucacauuggaaaugucagccauuccuagugguucauuucacauucagcaaauccacugagugcuuauugacuguuuaacuguuauuugaauaaaaguguuuuuguugugucuuuuuuucuugcagauuuauaguuauuucaugaaaaucuaaaaaaauaaaaucuuauuugagccacugaacuuuagauaacucaaaacacuuuaagucaaauauuaacuugccauaaaacucuccugaaaguguuuaauuuucagauuaagcaagcuauuuucagcuaaauugccauucucuuaugaaaugguauaaaguugugaaagcugauugaaagguuggauugugaauaagacuuuuguccugauuuuuauacgcuuuauugcuauggaccuuuuuuguucccugcuuguauuccauauuucuuaccaaacaguucuguagacaaguucuucuacagaaagcuuuauaaguuagcuucuaacugcuaugucuguaacgauacuuucaaacaguuguguaaugaaugcuucuauuuaaaaagauguggguguggaaagugauggugaaugaguucaggguaauuggugacucuguauuagaaauaucauuaguuaagggaaaccugcuuccaugauuuauauaucuuuaauuuuaaaaaucuuucuaccuccuuuaugcaguucccacuguaucucauaaauuaaaaaaaauuaaggaauuagaaucauagugcuuuauagcuguaaggauucuuuagagauuuuaauuaacccucuuauagagaaaauugacauugugugaucuaaugaaaucagguagcuauuggguuuaaaaacccaaauaacauuuuaauauuuuguuuccauuaguauauaugcuguucuacuuaagcuacccuaacugcugauaaucagaaaaugguaaugaggggacauaacuaauagggacauuggucccuugucuuuuuacacauaccuuggucauuucuccagggaguucuaugaagggcagguauugcuguuuccuuucauagaaaaaguagcccagacucaaaauuauagaucacccuuagcccccaggucugccagguaauucuauguuccuugucuuucuguuauuuaagaaucaccagcuggucuuggagaauucucacacgacagaggguggggaguaacaucuuccuauugacuuuggcugucuuuguugaguuguaaguucccccaaaaggcuguauaauuguaaauauggugcauuuuaagaugaugucuuagagauucagccagcauauaacaaguacccacuuucugcagggcaucucuugggcacuucaguagaugcagagguagaaucuuaaccacagguagagagaaacuaaagguagucucuccuuuccaaagacuugcuuucaugggaauaugugaaauauacuggucccuaugucugaaaucagucguucuuucuaaauauguguauuaaaguucauaugaaaguaauguacacuguauagaaaagcaggaaagugagauuuuaacauaguaacugacuucuuuuuugucuugacuuuuuuuuuuuaacuugauagucuaauacuuaaagcauaacacucugccaaggcauagcuuugaaagcauaguuauaauugcuuucagaaugagucaguuuggaaauaugguauucuggacauuuuaugacaauuuauuauuaaagacucuaaaauagaugcuuuauaaaugcuuucuaaaauuaaaaaaauggguaaguaguagauuacucuauacuuagcaauacuagauaacucaauuuacuaucuaucuaucuaucuaucuaaguuaaaagugguguuuuucaguuagugauauugguaaacagacuuuuuucuuuugaaauagucuuacucuucuuauucauacuagccuugaacuccuggucucaaguaauccuucuaaaacuacaaguauguagcagccccaccucaaauaaugguuuugagacaguuucccuauauagcccugccugaucugaagcacccuuauauauuguguagccaggcuagccucagcuucugccuccugagugcugugauuacaaguaugcuucaccaugccuguuaaaaaaauauuuuaaaaggcaacauuuguuauaaaaguguucacaucugaagcaauauauuaccuucaagguauaguacugaccaugcugaguuuuuacuguaugugaauuaaagcuuuaguuuuguuucuuuuuuaaagcauuucagcauaugagcucauuucuguccugugauuguuacaguaaaacuuaauauuugugauauuucuuuagaaacaugcuauguuucagcagaaacaggaggguuuuucuguucucuggaaggagucuaauggagcacuaguccagagggaagagcugagccagcagacuguggucugagggagguugccugggaacugcugacugugaggucaauaaagggagggagcugaaguggauagaauggagugggaaaguccccuauuaaccuggaggcugggaggcccugaccuucuggaaucucccaccuuaguggaaauacuagggaaaguaagaaaggacaacuacuagcuaaugggggugaguggaaagugagugauaaacccaagguccuaauguccuugagaauaucugaauuugaccuaaagagcaaccaguucuaccucaucauaaagggugauuucaacucuuuaauuuuuugguuaacauuuuuguuaauuucauaauaaaauauaauuauuaaugagauguuaauugucucuuauuuuucuaaugcaugccuucucauacucuacaaaugguccagaauaccagaauagaguacucaacaaugagccauggcugugacuuuagugcugcaagccugaugucauuaccagcauuauguuguugauguaguugucuugguauuggcuucauuaugcugugacagggauaagaagaaaguggcauaguagauaucaauugauaugcaauaaauccuuagguaugccucaguugaacugagguuauaaauguguacaagaccaagcaugaugauacaugccuauauucucaaaauuuggucaguggggaggcaagaauaucagggaaucaagguuaaccucuuuuacauacuucagggggcuacaugaaaacccccauaaauacccaccuaaaguacaaaagucuucagaaaugaauacaugcauuuuacccuuuuaaaauuuauuuuuucugccguuuugaggaaugcuaauugaauaaaauaauuauguucauucuagaccaggagaagauuuagacuucauaaauuuaaucuuuacuauacaagauauuaucuuguagauaauuuuuuuguagaauuugaguuuuaaauaguuguuuguaugaacaaacuccaugggaaguuccuccaaauaauuuucauagcuucuguuaauuuucacaaaacaagguauauagcagguagauuuuuauuuauauuacuuucaauaacaacaaagaaaguuaugagcagauucauugaugucaucauuagcaagaaaugcagugaagaugacacacaaacucgaagccuagccaaagcuaggaagaaaacuaggccuggaagaaugagucagagaaggugcacauugguuuugaaguguagaauuguguuuguacauuuaguuauucucuguuucagaugaguucuaugcaugcuuucuacaauaggagagaaagaccgguugccauuuguucuuuacaggugugucaaaaucaaaacaggaggugugaugccaguacuguucacgaagcugcccuaggguuccaggagucccuggaguaaagaaggauucagaaccugggcacuggacccugugcugacaaggagccucccauucguggaccgaccaccacuauaaacaugcaaaugggaaguuggccgucuacauggauaggaaggagcaagguagaaggaggaagaagcaacuuuuucuggagaggcaaagcaccguguacuuuuucauuucuaugacuagcuaaguaaaaguuuugcuagauuuuaggaccagucuuaaagucuucuccauuagaaugaguuaauccuucaaauaguuaaaacaaaaaggaugugaggaagauauacaaccuuucaaugacaccagagcugcacuguugggcugaccaacugagggacuuugacuuguagagugcucacaguuuagaaguugaaguuuguuuucuauguucaaggguuguauaagggagaucagggauugauauacugaacaaaauugaaucuuauucuuccauauuugcuaacauauguuuuuaaagaacagauauuauucauuuuccagauaaugggaagacauuuuuagucagaaggaaacuuaauuaguucagauauuuuaggucagugguucucagcugaaaagguauaguagaaacuuugacugcuuuucccagguauacauacuagcaacuucccaucauuugaacaagaguugcagaaucaaugagggaaaaugaaauucagauauguaggguuagaagacaccaacuaaauaaucuuaucuuuucucaacccucuagcuuugaaaauuaugcucaacagcaaaaagaaaauccuaacucauuaaaauaaauauguuacacagaaccucaccuaaaggggcaaaguuauccagcauccauuugacuaaaucgauuuucucuuucauaugauuucuugcugugccugugucuugcugaaauacccuguagguauagacugugacguacuggacugauacuuguuaaauguucuuguguuuuugagcucuugaucuuagucuuucauguuuuggaauuuuuuuuuucauguuuauuuguaaaguguugugcaaaagacuagaguggugcuaaaguuugauuacuccacauaggauuguuauugcaagcuuuuuguguaguauauaccaagaaauuaccauuuauuauuuuuaauuuaagguuauuacucaaaaguggacugauucuaaggcaacuaggagacccuucacuuugagaaaaauguaugagugaaaauacuuucuuuuuguaaacagcuccugauauacaauauccucuggggugccaguucugguauuuauguuuuaauuaaagagccccugccucucuauuugugggccacuuaaacaagugggugucuuggugagaaguucaggagguuggugguuguagcugaguuuaggauugacucaacucugggcagcagugguauaugaaugccaagugcuaagaauguuuggaauguagacuugccagcacugauaaaguuugcuuuguuccccugugugacuugacccauugagaaauugugguucccuaggaaguuuuaauaguucaaaauguuuaguuaauaaagaaaauggccacaacauaauucagcuuguuuucaccugcugccucaaagauuaacuuucuuaaccauaacgggauagaacugucccuugcuuugaaaaagaaauuuauggagcucaucacauuuguuaguuuccacaaacaugaagcucucuguggggauuuuuuuuuuuaaucauaaaaucccuaaggcguuggcaacuaaaauugugguaacuucaucuaaaaccaaaucucaggggaaggcacacccacuucucuguaccagcuuaaucuuucacuagacucagaaggguuuugaauuacuucaggaaaaguagugacugauagagcuuaaccuuccguuuuccucauuuauuuucauuagagaaugggaguggaauucagaacauucagauguggaguuaaugugcgucacugcugccagccccugcugccagcgauagguucuguguuuuuccagugggaaacucugauccgcagagaugcaugcaaaccugcaccuccuugcucuuuucugcuuuccuccugauuguugcuuacucuuuggaacaucagcugacuguacagagccucuguggaagcagauuucagaacaaaggugaucuguaaaagcagcacguaagucuugguucugucuguuuccuguucuuauuugauaguuuuaagcuucccuacuuugguguuuauguugaaugcucuguacauaauagaagcauuuuccuuguuaaauuuucucaaaggauuucgauaaacuuacucauguucuaguccuaguaagucacuugcaugauuguuucuuauggccaacaguaaugggugaaagcuauuuauucguguuuucauaaauguguuugacacuuaguagaugaauaauaaauguuucugaaacauauaaacuauaucuuacauaaacuuuaguuauauuucuagggcaucgaggcuuugcaguuuacagaauguugccuguacauuucagaaacucccgcagagcacuucucaggucaguaagacagaaugcugaagaaggcauaucaacguugacagugagcgacuguaaacauccucgacuggaagcugugaagccacaaaugggcuuucagucggauguuugcagcugccuacugccuccaacuucaaggaguaauuaucuuguuggcugaaaccaauaccuugcuuucucuuugauuuauuuuuacaaagcuuggguggaaaagauaaauuaaacaacuucaaaaccacagaaguguucuuccugugcauagaauaugcaauauauguacucaaaaaauauaacaguauuuuuaagcuaagcaaagaaauauauuauguauuuuuuuuaaacaaauaagacagugcuucaaaaauuauuuuaaaaaguaggcucuuuaaucuacuuuuauuuaucaaaucucagaguagguuuuuuuuuuuuuaggucaauucacacacaccaaaaacaucguguuaauguaacuaaauuauuugaaaagagaggaaguaaaauccaaaguagagcauuaauucauguuucauagugcuugaauuaaaccaccuaccccuucuugguuuaguauuucaugaaguaaugauuuucaccuuaauauaguaucuaaaacauugccucagguaacuugaaaaguauauuugcuuucuuuugcuugaucuacuauaaagucuugauugagauuuuccuuuuaacuaaacugauaaaguaacucaucucccuuuaaaauaguacaccaaauucuauucuuuaugaagacaauuucagaaugggaagccuagcacagaucccugaaagacauaguuucuaauuugccuuuuuuguuagucuguauuuuucuuauggcuuaaugugaauguucauuuaaauuauaggaaugagacaccuuaaaaagagaaauagacagcaucuuuaccuuguaaagcacacucuuugaaacagcaguuucauuacuguagaaaugacagcuucuauucucccaguuaauaucauuagucuuacuaacaggaguucauacugaaagaguauuccauuccauaugugcuggccaugcugauggcuggaaagauaggugacuagaagucaguuuuucucauacauaaagacaccaagugagaaaacucaauuagucaugccaggcaugaggaguugguugacuaacacugaagccccagggucuggaacugagcaacauugcuuuaauagguaaacugaaaacauuuaguguaaguaacccagcugugucccagggaaacuagcaguauuucccagggaacggcuauaaguuugaagaaauuauuugaccuucacuuccuuuauauuuaccccuauguugucucacacuucuuuccuugguuuguugacuucuaaauuuuccacuguccacuaacuacucuuugguuauuucuuuuacauacuuacuggaauuuuuuuaacuuguaaaauuugcuucauucuuagauguaaaccucuauuaauuauuuugguuaguuuugaaauuaauaccuguuaugucuugugcuccucaauuccacaguaauaaucuaaaauacuguuuuacaauaacaauaaugugcuauuuauagcugaaauacgaucuggauuuuuuacccccauuuuauuaaaaauaaacuucaguguaaaacagcaguauuacauuauaaaauuauauugucaaaguauuguguacuuaagauugaguaucauuuuauauaaaucaacuauuacucauuauuuuuacauguauuuucuuuaauuuaaaaucacauccauaucugcacaauaaagcaccuuacaugaacuacaacauaaaacuguuccucuucuugcucccccuuuuccuuucauguugggcccugugcuugcucggcaaugguucuuaaacuaaguacaugcccagaguuuucaaguggccugcagcaggucaguuacugaaaauaaaacacguccucggugcuggagaaauaaaccuaaguguucauuucuucaaaaccaguaauguuuuaaaagugagcagcauaccuaaauagccuuaaguaguguaaauauaguuuuuuauuuguaauuguccaaaauagaaauugcgacagccuuugaaaggagauuucugaaggagguauauaagaucugaaaguggcauuggugauugauuuaaaugauacauuuuuccugaccuuagaacucuagcuugaaccugaacuuaaguuuauggugaugucgucauaaauagcauacauguguaaguccuuugcucucugagaagacagcugcaagcugugaggguugugauggcuagcaaacagauuucuuaucuagaccuguggacaccaucucugccugcuuugauaguagauuguguuguuuucuuuugcgaagguauuaccuaaauguuaccaucaagaaauaaguauuuucuaaguauuaccagguuuugaugguuuauuaacacuaauuugaaguugcuaguuguucuuaucuauugggagaguuaauaugacauuaauuauuuguuuuaacuuuugaagugauuuaaugaaaucuuaaagauaauugauagugaacuaucuuaagagacuugcuaaaggaacugaaaauuuucuuuacauggcucucuaagaaguacagaauaaguacuggauauucuaaauaauugggaagcuaggcuuguuaguuuauauuauaguuguuuauaugcacgacuaagcaaauuuaggacugagccauuugaaauugagguuuuuaugauuguuauuuuucuucuccauuuuuaauccucuugaugccagaaauucaguaaauaagaguauuuuguuggugguacauuuuuguuuguuuuuauaaguccacuaaauguggagcagcuaaugaaauggcucauuggguaaaggugauugacuuuaagacugauugaugucuuuuaaugcacugacugcuagucuugcaauuaaauauucuuuaauagacuuccuuggugguuauucauaacagguaaucuuucacuaauauauacuuaaaaucaggcacugugacuguggugagcaaguugguauugccaagugauauuuaaucugccuuucuaaucuguagauuuaauuguuauaucaacuuaaugaugcaguaugcauuagaaugaaaguuucuugauggaaaaugaaaauuaaaguagacuggggguucauccaucacaaauacuaaauaugaacuuacugucuguuuaauaggcaugauuagagagauuagugaagaaugcccauuucccuuucauuuaugaaucuuucuugcuagagaacagaaaauagugugauacuguaucauaaguuguuacauucggauuucuugcaaggcugaucauaauaucuaaauuuuggauuugugauuuuuuuagccccugcuccauuguuuuaguccauuguguucuuccucuuguuccuuccucuacacagauaaauguucucuuuccacccaugucuacaugcagacacauaaugucuuugcauacuugcacacauacauaugcauguauacucauacuuuguuuuuugguucuaaaugggauuuccuuagggaaggauuccuuuauucccuuuaguucaugcuguagccucuuuugucaggagucacaaguuuuaccauuugacaugcacagaggacagcaaguaagugaucagaaguucucucaguaacaacuaggaccuuacagugaguaaggcagucccagagaggcuaagcagaguucugcccgguaauccuuacagcaaauaguggcuacuuuaaagaauacuagucaacauuagauuuguauuuguuucuaugaaacauacuuuggauuuugaauuuaguuuaaugauacaaccuuauacauagaauuugauucuuccagaauaugauuuuuaaaaaaaagauaauggcuauuauuuauuuauuagcuuuaauaaauaccucacuuauaggaaggcuagugaggauauacauaaagaaaaaaaucuuugcucccuguaguacuaauagguggagauaugcaauguuagguggaccagugaccagcaucgccugaaucugaccugagaccagucuucucaggaaagguccugcaagaacuccaugauaagaagaggagaaacaaacaauaaaaugucacuaagcagggcauuuuuccaacccaauauaauaugcaaauaagcuaggcuagaauaauuuguuuuacauuccuuuacucugauugggcuauuaaagaacaaaagaguuuuaaauaaugagaggaaauaaaagccaagaauuggucacaccaugugauuuaaaacuuaggcaggaaagcauccuugaggaagucuguacagaagggauaaggaccauguucaugagcuuucagugaucauuuacugggccaaguguggacacauucuucugguuguuuuggcagaagaguguggacagaaagggaaggagagaaagaaaggcaaggaacgauacuuauguacgccuuuccuuucccugggugccacagcuugcuuuucagcaguuuucccugugguggcauuuaaaugauuaugagaaaaauauguugcugcuuggugcuuuuaguaauggugccauugguaaaauuguagaugucauuugccaagcacuuuucagagugcucuauuguaucugucacagcugaacugucacagucuuaucuuuacaaauaaggaaacuaaggcagguuggguuacauagagcuucuaagcaaaugggagagaauguaaauuccuuaggcucgcacgcuaaagaccaaccaauuugaggugaaagggcuauggaaggcauaugaaauauacucucaacaaguggagaaaaugaaauacaaggaagguguggagagaaauguuggagugcggggugggugcaugcccucagagauggccuggauuggcugguccgcugaauggaaagggugucugggagcaguauggugggaaaauaaguagaauauuugggaaguuugaaagugcaaaaauagcucuccaaacauaaucgcaaugguaagcuacacuuugaaagagaguugaauuauagguuaaacuuauuaugcaggcuuguuuuaugucucuucaaaacuucaaaauaaggacagaaaccagacucuugcugcaucucuaaauaggcugcuguuuuccuuucuuuuuguaguuuuaaagaaucauucaugccagcacaguuaaugagcuuuagcuguugaaugaaauuauauauucuguucaguaaggcccuucuaaaucugccauugucuccugcuugccuuggugucuuuagcaccaggcuucuucuaagucauaauagccaaguucuccagagaaucuggcucugggucauacuggaccuguagaggagagguccuuugggcaaaguuagucagaugggaugucauuuuucuauaccaugacuucucuucaccaagccugcugaaaaauucuagggggaagccauucaguuuucuaaaguuuuuuuuugaaacagaaucuugaucuaucaaguuauauaggaacuucaguuuccuagaacacaccugcauauauuguugaguaaaaaacaugaaugagacuuaguuuuuuccuccaagauguuuuucuguugcaucccugucuuggaguuucuuguguaggcucguuauugcaugggauuuaaacuucucucuuuaguacuucaauucuaugagaauugaaacuuggaccuugggcaugguugacuaauguuguuuaucacaauucuaucuaauccaagcccuaaaucuaaaccauuuagucuuccuuaaauauuuuucugagacgaccacuuuucucuacuucuuauaaagguaaaccgauuagcugggugucacuaugaaguaacuucucauuuuccucuguccugagggcugagcucugugagauuugucuccuugauauacuugguggcagcuauagacagugcuuugugcuagaaagaaaagaacucgauguuggucuaaccaguucaagcucuguccaagcacagcaguuagcaaagcugggggauucuucaugugcugaaucccccucugcaaggaaagcaucuacucuuugacugaaaaagcacuaagguuuuuuccacaaacauuucuccacucauuuaacauaagaaaaauauuugguuaacauauuuaagugccugcuguguaaaaacagaucuguuauuuuuuuucuuaaacccuggugaaguguuaauuuaaccaaucaaguuauauuucagacuuaaauguaagaaaaucagaagaaacgcacaugaagcaaaggcauuguaugaacagauacacacacaacuacaauuuuucagucuuugauuuucuauuuauuuacaucucugauucuauaugggucuucuauaacuggccaguuguuuauuacuuaaacauuuuagcuguuggcaagauuaaguugugagcaauccaagagugcuuuucugauuauucagucaccauauuaguuauuuucauccuugcugugauuaaauuccagacaagggccaaaugaaggccuaaguuugggucagaguuugaguacgugguccaucauuaugguggcaguagcaugaggcacuuggucacauuaugccugcagugagaaaggggagaaaggggagagagacaugaauccuagaccuucacuuagcucacuucuuuccuuuugcucaguucacuacuccagcccaugguacacugccacauacauucagaaugaggucuuccaucuuacuucuacagaauuaggugcagaauuagguaaagaauuagcuaaaaggaaaaaaaaaaaaaacccuuacagaaaugcauagagguuugguuccauggcuauuuuaaauuucaucaaguugacagucaaaaaucugcuuucagaaagaacuauggcaguauaugaauaccuuugcaaucuuuucccuugacauaucuuuugauggggaacuaaucucaauuagugacaagaaaaauaucgauaaugagugaaacacccagucaaaagggauaccaugcaagcuuucuguaguuuacucuuauauuuuuaaggguauguuaaaauuaaagucugugaggcucuccuguacucuguagugagaccgucugcugauacacuggccacuuggaauuacugcuuaacauguacaauggcuaucuuagccauuucugaauuaauaagacucccuaugcuuuacagaucucagauauguaaugcaguauauucaaggacugcuucagaaguaguauuuauguagguauacacauuuguucuucuaacauguagacauuaaagacuauccuuggcacuggauagcacagaauacuagcucgcugacuaaaacaaauggcugccagaguguauuauuaaauuucaacugucuuacguguuagaaaacuauacuccuguuuuuguacacaacuuuguaccuuuuuauuaacauuuucaacucuagcaaauagcucuguuuuucuugucauuauuauguuuccaaccauucauauguuuuuaaacuaauacuugguaaugcucauauaaaaugacauuaguuaaagucucagugucuggaaugugcaaggccccggguaucauaauaaguaucacagagacuccauuucuagcucuaccugcuguaccugagucaccacugugagacagucacaucaucaagccacucuacauuacuaaguaguggugacuucauuuccguguuuccuuucggcuacuauuugggagacucccuucaaauagaggaagugggcugaugaaggccaguguuuucauuucagauccuucacaucucuggaaagcugcauccucuguagaaaauaguguuguaugugugccagaguauaacccugacauuuaucagggagagggaggaggucacauaaugccuugugucuuucagcaguaauccucccauuuggcaagaguuagacaggaaguguuuaacaaugggauuuuauaaaauucaauauaguaaugaguguuuuuauauuugaauggaucaaaggaaguuuucuuucuuucuuucuuuuuucucccccuaacaggaugggcgcuuagagugaagguaucuauggacuugggagcguuugcuuacuuuauuaaacuuuguguaauauuuucccauuuuaucauguccaugaagggagaaagguaagaaagcugugguagucucuauauugauuucaaauaguuugcuuaaggagaguuagugaggaaguagcugucuuuuaggaagaugauuuuaucagcgacagaggccuuagaaugucuucaacuagacuauaaacaaugaaguuauuuucuuucacauuugcaccaugagaccugguagucuuaagcuuuauacacaaauagcuuuguaucaagaacuaaauuuacaggaacuagaggaaaagauacuccuguuugaccccagucgcacaggcucuccaaggcagcuacugauacaaguuucuuagggcuacuacuaaaggguugguuaguaguacacaggggacaucgaaacugaacaaagugaauccuuuuccucagauuuuaaacauaacaauguaggucuucacuagccaguaacccuugucaguaacauaggaaguuaggcagguuacagcgaaaggggauaaagagaaggagaggcagagauucagaaaggcauaaaccuggcuaugaaagacacucggcuucacugaggaccagcuacaaggucacaaaauuugggguggcauauauucauuuuguggcauguuucgauaguauuuggauacagccuaauaaagacaucaaaaaagaauauuauaaacuggaaacaucacuuaagaagagaacucaauguaggauugcauagcuauuaacuauaauaggauguuuuuugaugacagauaaucuguuuuaucugugauccuguuuuaccucuccagagucauugguuggacuaugaacuucaaguacucagagcccacggagaucuagaauaccuuuuaucucugacccauuauucacauuacucucuuuucucaaaccuuauagauugugcacuuuagcuuguagagagggugcuuuuaugaaagaauuaauucccauaauuuaacuuuccagauaagugaaucauaugccauuuaaaacuaaaagaagcauuuugguaaguugaggcuaugacuacagaccgaacuugugcugugccuguugagugcauugaggccucugauguuugggcgugggacuguaauugugccuuuaaaauguggggacugugcuuguuaccucucuauccccacagcacuagaacagcgucaaaaaagguuuuauaaauacuugguuaauuucuaaggauaguaucauucucucuuaauguugccuuuuucagucaguauuacucagcuuggccuuaauggcaaugaaaacaucuuuuuucacuugcucuguugccuaguugguccuuuccuguccuuucuuuaccugaauuugauagauacuuaaaauuauccuuaagcuucacaagagcuaugucaccuauacgacauauggaauuucuuagacagauggccuaauagugacauuaauuugguucauugugcuaaucugucccauuccaugugggccccaagucauacaucuaacauaauuuugcuuuuuaagguauaugucuguacuggcuaguuuugugucaacuugacacagcuggaguuaucacagagaaaggagcuucaguugaggaaaugccuccaugagauccagcuguaaggcauuuucucaauuagugaucaaggggaaaaggccccuuguggguagaaucaucucggggcugguaauaagagagcaggcugagcaagccaggggagcaagccaguaaggaacaucccuccauggccucugcaucagcuccugcuuccugaccugcuugaguuccaguccugaauuccuuuggugaugaacaucaguauggaaguguaagcugaauaaacccuuuccucuccaacuugcuucuuggucaugauguuugugcaggaauagaaacccugacuaagacaauguccaauugagaaaaccuuuauucucaaguuuaacuugucaucuuaacauaaauugccauuuuacgcaggaacuguucaggcgaagugcaguuagugaggccuggacuuuuaucacuugaguuucuguuaguaucccucccuuuaggguacaugugugcagcacuuagggcuuucccuguguuaggauucuaauuaaacuucuccacaaggauaucuugagagacuuaugcauuguauaacacauuuccuccacuaaucauauucaaagggaggaaauagaaacacccaaauuauuuaaauguccuucuaccuucucuuauaccuuuaaaaaauuaaggaaugguugcucuaaggcaggauuucagauauguguucacucauuuuuaaaauacuugucuaccuguuacaauaaggaggacucugauaaggguuggugacacagcugugaacaaggccagagcugucccugccaucccuuaucuauuacugacagacacugaguucugggaaggagugagugagacacaguugcugaauaggugcugcauagaacagagcuuagaaauugugucugcugaaguagggauuccucaaguuguugagagucuaaaucuagacagauugggaaacugguagaauugggaaagaaagcccaagaaacuggaauuuggaucagcuugcuuuuuaaagcauugauuaguaauauuaauagaugucucaugccaguaauucaggugaauaauagugauagcucucacuuucuggccuauguguucuaaaaguggcagcgucaugcgaaguaaauccuugaacuuagaacugccguauaagaauuuuaauccuuuuacuaaagggaaaacccuaauagagcaaugaguccgucuuuuacuacauugcccaagucugaugcacuucagagaguuuucagagaauugcuuaugcaguccuauuuguccacuguugccucaggguucauauucaucagcuccugaggcucuuugcuaugguguacacuauaccugagcugacuucugacuuaaucaguccugcucacaggucucaaaggggcuguaggggagaagccacaagguaauuggcacaggacuccuauuuaaccuaccucaguccacucucccuucuccagugcagcuuauuccuuagucugaaaacucuaacccuuuaaaaaacuggagaaaaggguuagauagccuuuggucgcuuggagauuacugcuugcaggaaccugguuccacgugcccaccucuccugucaccuucuagagaugcuaggcuagaauauuuuugaucagauuuagaaggucugugugugacccaguugcucaaaggaaaaauaaauguuuucuuuucuuaacacugcuaucugcuguccuucuuccuuaguuucuuaauaguuguuugcuucuggguaucuuucaauuucuucuuaauaacacauguauguauaucacacagagguguggacaugucuauauacaauuaggcagauaagucaaaaugccagauaaacauuugcuucauuuauuuuccuggucaauuaucacuuuaguaagaauggacuuacaugaccucauacaucuaaaauaggauuucucaacugauaccuugacaucacuuaucuucacuguaaaauuauauauuuaauaauuauauuugucucuguauauguaucauaaugauagcaacucagaucucuaguacuuagaacaaugccauauauauugauaccuuuuacauuuugaaacuugagguauaucguagugaaagcugauuauaaugugucuuuuuuuuuuuaagcugaguaucugcuacauuuuuuguuucccaaugugacacaaauaguaaauuagccaagauccaaacucagucucuggacaguuuauauuacaucucagcacaggaagauaauaucuguacuuacuaguuaguaagucuuuacagaggaaguaaaaugaacauagaggacuguguacuaggguuuuucacaagcaacucuuacugaagugugucagccuuauaucagaguaaagaaagcuaggauaacaaaccaacugauccuggaggaaucugaaguuucauggcaguuuggcagucuucuuuguccccugcaccucuaauaucaaccaguuaaagaauugaccaauuugguuuuaauuuuccugucuuuggccuaauuuuaagguaacugcucauucgugaagauguaauuaguguugcuuuauuuuuccuucccugugggaaaagaggcagaaacacauagcuugcauauucuuucagccucucagcugucucuagccacccaaggacacuucagcacugggcuuaagcaauuagauuuggagccagucaggguuuuguguacauauuugaacuucuguguguguguuguguguguguauguguuguguuuguaaugaaaaggaaaaaggaaaaauaaugaacugaguuagaaguuuugauguuuagaugaaaagauguuccuuugccacagugcuuuuccucauaaguuaauuuuucuaguggaaauaaguuucuaccuuuaauguaaugaaaaagguaaagugguagaucuaaugugugucauaugacgaaaaaaacauuccucacuaagacagugcccaaaguaugccagugcucgguuguuguauaagcuuagcacaguucucuucccuuagcuccccuagguucuguuuuucaucagaagaaaacacugucauguuaauauacaauagccacaaaaauccugcccuagccuacugcccuuggugcugugcugagagaucacugucagauuuccuaaaaugcaagguggccucuguucuguuuucaucaaauauaguagguuacccgagaaauauuugcauugcugcugcugcuuuuaaaacaacugcuuacuggguagcagcaaacaccuuauguuuaucucuucaaaaagaauacuuacuuaucauagaacucagcaucaugaggcugugagaucucaguccuucuuugucauaaaaaguuacauugagaaauaagaaaaaauccacaaaggaagcaugcuuuaccacacuacuguucaaacauaaauguuuuagguuuuuaccuauguccuuucuguaccuauguccuuucaguacugguccauuuuuguagcccugaaauuguauuauauugaaaguaacaguauauuuaagcagugucauaaauagguaucauauaaacaacuuaagugaaucuauuauauugacacuagauauuaugucaaauuacucuugaaauugcauuuauuuugauuaauauuauguugaguuuuuucuaucacuuugcuauccugauaaguuaucuuaaaaauauuaaugagucaaaaguagagguuuuuuuguuguuguuguuguuauuguuguuugguugcuuaagcauaacagauuugugagccaugccggauuguguguguguguguguuuguguguaaaaauauuagcuacaaaaugcuaacucaaaauguuuauugaucucaguuuuggucacuacaaaaccuaaugaucuuugcauuuuguuauuugacuucauauagcucuagcagcaagcauucuugacuugacaaugaccuguuuuaauacugauugacagcaguuuauaaagacauugcaugaucuccuaagagguacacacaauggcuacacauguagaagauuauacaaucuaaugcagcaaauaagguuugauuguuacucacuaugaccuuaaaauuuaaaagccaguacagugcagugauaguuguuuugucauucacaaguugauaagagcuaacuggguauaauggaaaaagaagcugaauagauuaaagcuuaaacaaaagaaaauauagcagccaugaaucagaggaaccauauagguugagucuagcuuuauacagucacauucauacuuuuggguuagacuugcucuacguagugguguuguugaguuuaggucugugacuuugguauuuguuugcauuucuuuagccuuucuuuuuucugcucuuuauguaauuauuauuacucuugcgggggguaagggaguaggcaugccugcuacacaugugugugagacuuuaugaaauggguucuugcucccuucaucuuuccaugagauccaaggauuagacugaggucauacggauugcacaagaaacacuuuccugggcccucuuuccagcucugcccccuuuuaaaucuuagauaacuuuuagcauagcauuuuaauucuguugccuuuuuuaaugcuguauuuccuggcauuuuuauaauauucacuaaaguuauuauaauaugcuucuuuaauuuguuauaaucaguuuaagaucauuauuaauguaacacggauuaaacgaguacugaaugaucacuugggcgccuucacuuugaaucugucuccaagaagcaucgccauagugugaccccucaggcuugccuacuaaaagucaaaacugaacauacaaauugaacagcucuugaccuccaaagaagauuuaaucauuuauagcaucuacuccuguuuacugugcaguucuuuaagcugagguuugcauauucuuuccugguuagauuaggcagccacuguguggcagugucagccaccaacacugcaaacugugcuugagcucacuccugcaacgugaaacucccauuucugccccgucgggcagagaagcaguagugcuuuggguucuagugacaccugcugguacuuugucuuuuuuauuuucucuagacuacuuuuugagaaagaaucauuuaauccauuaggaugucauaaaaggccuccuuuuucugugacuauuaagcuuugcuaugguugcuagaagcagcaacaaacgcuuggacuuuacauuuggcuuaagagaaagaucuguccucuuccuacaggaaggauuagaccaaaagaaugaagacauuguugagugguaaauuuagaauguuuguauaauaguaucacagaaagugcuuauaaggauagguacucuaagagaacaugccuggggcaucauaggauguuacuauguuauuuaaucauuuuauaacaccugagguacucaaaggcuaguuuagcaguuuuacuccauuucuggugauguuacaguuucagaugaaugcugaaugaugagagaauuccagucacagagcacugauguaauuuuuauacuuguauaaauauugcaggaauagauucucuuuuuaaaaauuaguacugacaacaagguuaaaaaucuuugagccaggcgugguggcgcacaccuuuaaucccagcacucgggaggcagaggcaggcggauuucugaguucaaggccagccugaucuacaaagugaguuccagaacaaccagggcuacacagagaaacccugucucaaaaaaaaaaaaaaaaaaaaaaaaacuucuuuguuacucagccccuccuuuguccuuucucuggucacauuacagcuuucacuuuccugugcuuuccagguaaccauucccaaagcaccugcacauaguugguugauggauuauagacuugaaacaaaauagcuaguauuuaucaaagcuacuguuuguuauacugaagccuucacugaagagacagaauaguuucagcauccuaagucaugccauuagccauuugcuauucuaucagagcaacaguucuuucuaaaguuguuccaguagcaacuauaguaaaugcacaagauuuaccuaaaacauugauaggacuacaauuuuccaauuaaauuaaaaaacagugauuaaguuuuauaguugucuaauaaguguuccaauuuggcaacacugaucaaaauaccuucuguuuggcuacugccauaccccccugucccuauggccauagucagaacuagcuaacuuuucaacauaaaaauccacauuuguuuauugugacuaacaaugucaaagugaccuguguuuacaguucauguggaaagaggauuaaaauugggugugacaauuuuauuugaacauuuuccauuuacaccauugaaaaaauacauauaucaucauucaaaccuuaggguuucauaauguuugauuauuuuuuggauguguuuguuuuuaacuugagauuucccacuuaaaacagcaauaguauuuuuuaaauauaagauucaauuauauuaaauucauguguuuuuucuucuacgaacaauagcuuaaguaaaacaagcauagaagagaagguggugggaaugaagaucccaacguuuaaggaaaauguaaucagauauauuacaugaggauaguggccuccugacuuuaaucuguucacagaguuucccagaagauugucuauucuguacacuauagaauuugcuaugucuugguuuaaacaguaugauuucaguuauaccaagaaucuagacagaaaaucccaucaagcaguucuggaugggagaagggaaccuuuucuuugagaugaacuuaagaaguuaaugaaacaguggacuuuuucuuuuuuuuuuuuuuuuuuugaacaaagaauauuuucauuaagcuagagaacucuugcgugagauaaagcuccacauuuugugaggauaguguuuuacugacuccacaagaacauauugcugguuaugcacauauuguaacaaugcagugagguacugaaacugcaguuagcauccagggaagagcaacacaauagaauaggaaaggugaaguugugauacaugaaaguuacuguuagguuuuguugugacuucuucauaguuccuuagaaauucccauguaauucauuguuccucacagauuuauuuacuacauuguagauauuuggauuuggggguuauaacuaggggcuaaugauccccuacucuuagaaaauaaaauguauguaguaugcauggcugguguaugccaagccacacaugaggaggccagagcacagcuuaguagaguugguucucuccuuccauuuugguugggaguuauacccagguuuucagguuuggcagcaagcacuuuuguaugccuuaaaccaugcugccagaccaugugcucuucuacauggaugggcaagaugaaagugacaugaaaaguuauaggcaacuuagccuaaaugaaguauaugcaaaggagagggcagaaggugcaguaaccgggagauaaucagaaaauaggagguaucugaugcaaagacgucacuaccugccuagaugaaggauucuucaggaauuagaaaugcucauggcuaaguccugguauacaagauaagucaagcuucaaaggguuaaccaugguugucucuguauuguuuauaauuacuuuaauucugguacauuugggguuuuuuaaaugaggauuaggaaagacuaguauauaucuugaaauguuagauguaguguguucuagggauuuuaaaaaucagguaauggccaaaaaaaaugauuuuaugggggggagacaguaugccagguuuauagcuuaaaaaccucaaucuaguuguuggcacaggguaggguggaggaaaguggugaggugauuuaaauacagagccuuaccaacugccacugggcucagauacacacuucgggggcuuuauuauuauuauuauuauuauuauuauuuagaacugaaaaugaccaaguuuucuuuuccaggaagcuuuggugaugcuuaaagaccagaacuaaaguuauguucaagauuauguuuaguucuuacagacuguuugacaguuuaaauccuuaaaugauugugauuaaggcaguuuccuuucauuccuguccauuuuuaaacuguuuacauggaugucucugaaguuauuuuucacccugacuuuucuuuauuuggaauccaucagagaaauaaaauuuaaaaaucaggugguucucagggaggguuaacuuucccuaagaucuugcugucacuuaagaaaagguuggcuaauguaaucacuucuccuccuagccaugaaugccauagaaaaguauagcagcuguacuuugaauuacuaggcaauuacaaagacuguuucuggaaugguuguuccuuuucuucuuguuuuaagaaauuuauauucuugaagugauuagauugccagauauuagauagcaucauucauauauuuauucuuuaaauacuguuuauacccaauaaacccugguuccauguuauggauuuucaucaaauagaaugaaauugaguaaaacuaaacuaaacuucccaggaaacuugguuuuauagagagauaggaaauagcaauacuaacaacaaugaacuaugaguugguuauagauaaacauucaagacauaaugauggagaaaggacagaauagguaguuccuauggggugacagggcccagauuuuaccagagaucaguggaggcugcuuuggaagagagaugcuagauuugagauuugagacaguaugggacuaguuagucucaauuaccauuuauuuuagggcugauucuugacccacuacugcaguaccuccuacacuacgauugaugcaucuauccugcagauuagguuguuuugaggauugagauugguaguauucauuucuccuuacccagcauuuuacaucacugcugguauguggcaaguacauacaaauguuuaucuaaugcaugaaugagugauuuguguucacacugguucacaggugguagucucaucauguaggcuuguuuuguaauguuuuauauaagcgaugacuuucuucuuugcuauccaauagaucaauuuaguaaaucaacucuauuccaggaacuguuugaaucauucauuaucagaaaagaacuuaggaauugacuggcuccauuuauguguaugccuccaguuauauauuucuuuccacauacaacauuuuaaauuuucuaagauuaugcuauauuuaguguaccagcuuaaugcauuauuuuauaucccaaccaacauguuuacucugcucauuggauugauuuaugacuucauaacccaccaauaagauaaauggcugucagugauuaaacuuuuguauagucuuaugucugcagauauaauugaacaguuguucucaguucuguuaggagugaagcagaacaaaaaucauauagcugagacagcgagaagguagacuuguuuuccuaaaguuagagagcaggguaguaauucgaaaggaaauuccucagaccauuuugggaaagcauagaaaugccuggguauuagggccaaaccaggaaaucccaggagaauccuggcaugugcaaaacagaaauugauuaggcaucaagaagguaagcauccugcagccuucuuaccggcuccagaccuagaagcugaaauuuagucccaaguacacucuguuuucuagccccuguucuaacacgucacgggaucuccagauguuccacggcauccugaugcuugugcugcucaccgccaaccugcucuagagagcacugagugacagauauuguaaacauccuacacucucagcugugaaaaguaagaaagcugggagaaggcuguuuacucucucugccuuggaaaucagcuaagagaaaugaauuuuagauggccuauaggugauccuaucaaagaucuguuaugcggucaacucuaaaagguaaaagggugagcuaaucugugcuaagaaguacaagacacuuugggagauugguuauuuuuaacuguuuaagaagaccaaguaugguggugugugccuauaaucccacuacucaggagacugagacuguugacuaguuuaaaccagguuggguuaccauguaagauucugggcuacaucaagaaagcugucucauaaaaaguuuguaugagacuauuauuucauagauugcugugguagccuguuauaugaagccaauaauacacuaaaugccugcauuuuagcucaccaauuuuucuauuaacuuggcuagcauuuuauauacuguguuuguauuuugauggugucugggacuuguuacuuuaccagggaugagaugcaguuuaaauccuuauaugacaaaaacuugcuauuuaaggugggauuguuuggugcaguugggggauauacaugaagagaauuuuaagcaaaaucuaugguacuaccuuccaaguucaacuuuuuucuuuuuacaguaaaucaucuauauuaaauguuuuuugaacaccucaucuagaauuugggguugugcaaaaugugaguucuuuuugcauugggcaaucuaacaagcaucuaccacuaaccuacaucuccaaccccaacaauuagauauuguuuuaaucaauaucaaacgucuucuuuucagagauacugaagauaaaaguauauucuuacacaacaaacucuuaggauauuaaaauacuuaaugcauauauuaaauuauauauauauauacacauauacaaacuuggcauacuagcaugccucagucauuuaaaccaaaagacauuauauugccuuaaguauauuagagaagcauuuuguuucuucagagcuccaaauguagcauauaagauagcauguaggucuaguuuaaaaaauauauauauaaauacagugaguucagcaugugaguucaagaaaguauuuggacaaacugguuuuauaucagauaaagauacuguugaaguacuagcugagcaacucagcuuggaugagucauuaaccuuucuagauuugccuucaggcuuaaagaaaccuucaagacaaugcucuauauucuccugaaaagaacaguuacuauugauugaacuugcacuuucugccagggauacaggcugcucuggacaaggacagcucugcuggaaguagguggaguccgacaccacaugugcucucacugcuuuuuauugagaaauuaacaagaaagacaccuggauauuccauaucaaaacuggcauugaguuuuagcucuucaacacuuacugaaaaguaugaaauuaaguguauuauuaaacaaauauuuaucgacugagccacuucuuggguauagaaauguggcagagacuuagaaauaaauaauaugucaugagagaucuguguauucuauguauuuauguaaaauaauccagcuuuauucagugauauuuuugcccuuucaguucuuugauaccaaauaaauuuuaguauuucagaauacuauagaacacuugcagacauaaaccacuuucuuccucauaugucuuaauaacaauagugaaugugacauggcuaacucguauaaguaaacaugcuuaagaggucaguguuuucuugauacauuuuauguacaugucacaugucuuuguugaaaagauauugaacaacaauaugaacuaaccauuauccccagaacucguggcucuagcugcacauguagcagaagauggccuagucggccaucgugggaggagaggcccuuggucuugcgaagauucuaugcccccauaugggggaaugccagggccaaaaagugggaguggguggguuggggagcagggggaggggggaggggauaggggauuuuuggagaggaaacuuggaaaguuugaaauguaaaugaagaaaacaucuaauuaaaaaaaaagguuguuaacaaguuauaaaaaaguuguauguuuauuuacugucuguuauauaaaugcaaauaucauugucauuauacaaguaaaccuaauuacuuugaaaccuuuguucaaauuuauagcuuuaucuucacauauuuguauaauuaccgaugcuguaaacacuuuaaaagaauaugaguaaauaucaguguucuauuggaaaaauaaaaaagcuuuaaucaacuuauuguaaacuuaauaaaaauagaaauuuugccuauuucaucuuugaauuauuuucuugucuuaauauauuaauuuuaugucuagugaucgcuuucuauaaaacuaacuuagauuucccaauuugaauauacuuauacucuucauuuugaaacuauagaaagcagguuauuaauuacaguaucagucauugaaaaguuaaaaaucaguuaucgcuauauaaguaacaaaugaaaaugaagaagaguuggcauauuucgacaccauagagaaaagugaagauagggcagacugauucaccuugucauaaggaggcuuucaacucugggagguaugaaagagacaacuguuagcugcugucugggauuucuggagguuuccauagccacauaugaguccuugggucuuugaugggccugagugaguaaagguuucugccaccaagccugauguuuaaucccuaagaucuacuuauugaaaggagagaaccaccucccaugaguuguuuucugaaaaccacaugcuagcuuauguguacauauacagcaaaacacucaugaguaaauaaauguaguaacaaauuaaauaucagcccuccaucauguuaagguuuugaagugagauuuccauaaagacagggauauaaauagauuguacauuauagauuguacauuuagugcucucaguuuuaaauuuuggagugguuauuauaguugagauuuuuuuuauaauuuuaagggguaggagaauuuaugauuuuuauuuuuaaaauuuucauaaaggaaaauuuucuuuuuucuuuaauuuuaaacacuacuuuuuguuuuuuaguccuauacuuaaccaaaagaaaagagauuuugaccccuuuaucgaucaaauuccagcuguuaacaugcuucacagaauacugcucuggggacaguacaacuccauguauagguuauugggauguuagaguagcugaaaaaugucacucaaaaugcuuuggacagugccauccaacaauacauuucagcccaaaucauagugguaucaagaugcacaaccaaacagauaaucuaauuccagaagaauuggaacuauuaacacuuaucuguaguguacuccuggaacacuauaggccugaaaaagacaucuaaaacuaaucaaaacuaaagauuaaaaauuagcugaauagaaugugugccuuuagaguaacuguaaacaucuuguugacuuuuucaaaggcuuugucaguaaaaugucagcuauggggauuuuuuuuuuuguuguuuguguuaauuuuuaauaguaaccuucaguuaaggggcagggaaaggaaaggacagauguugguuuuaaaagcaugaacuccugauguguugauuucuaugacacgggaauacaaagcauagcuuuuuagcagaagcuugcuaagagaauaaaagaaauuucgaaaauugagauauuuaaguuucaacuguuaaagaguugcuccuguuuggugugugugucgggggguggaggagggaauguuauuuuaaauuccaagguuuaugggguaaacccagauauuggguaguuugaucaugccuggcaguugagaguuugacaacacucaggacuugacaguguuguucaguucuuuaagaccuguugaguuuucuaaacagcacuaaaaagcuuucaacacgaagcgugggugcuucuuuuuuuuuuuuuuuccauuuuuuauuagguauuuagcucauuuacauuuccaaugcuauaccaaaagucccccuuacccacccacccccacuccccuacccacccacucccccccuuuggcccuggcguuccccuguaccggggcacacaaagucugcauguccaaugggccucucuuuccagugauggccgacuaggccaucuuuugauacauaugcagcuagagucaagagcucagggguacugguuaguucauaauguuguuccaccuauaggguugaagaucccuuuagcuccuuggguacuuucucuagcuccuccauugggagcccugugauccauccauuagcugacugugagcauccacuucuguguuugcuaggccccggcauagucucacaagagacagcuacaucuggguccuuucaguaaaaucuugcuaguguaugcaauggugucagcauuuggaagcugauuaugggguggaucccuggauauggcagucucuacaugguccauccuuucaucucagcuccauacuuuguuucuguaacuccuuccauggguguuuuguucccacuucuaaggaggggcauaguguccacacuucagucuucauuuuucuugaguuucauguguuuaggaaauuguaucuuauaucguggguauccuagguuuugggcuaguauccacuuaucagugaguacauauugugugaguuccuuugugauuguguuaccucacucaggaugaugcucuccagguccauacauuuggcuaggaauuucauaaauucauucuuuuuaauagcugaguaguacuccauuguguagauguaccacauuuucuguauccauuccucuguugaggggcaucuggguucuuuccaguuucuggcuauuauaaauaaggcugcuaugaacauaguggagcauguguccuucuuaccaguuggggcuucuucuggauauaugcccaggagagguauugcuggauccuccgguaguacuauguccaauuuucugaggaaccgccagacugauuuccagagugguuguacaagccugcaaucccaccaacaauggaggaguguuccucuuucuccacauccucgccagcaucugcugucaccugaauuuuugaucuuagccauucucacuggugugagguggaaucucaggguuguuuugauuugcauuucccugaugauuaaggauguugaacauuuuuucaggugcuucucugccauucgguauuccucaggugagaauucuuuguucaguucugagccccauuuuuuaaggggguuauuugauuuucugagguccaccuucuugaguucuuuauauauguuggauauuaguccccuaucugauuuaggauagguaaagauccuuucccagucuguugguggucuuuuugucuuauagacagugucuuuugccuugcagaaacuuuggaguuucauuaggucccauuugucaauucucgaucuuacagcacaagccauugcuguucuguucaggaauuuuuccccugugcccauaucuucaaggcuuuuccccacuuucuccucuauaaguuucagugucucugguuuuaugugaaguuccuugauccacuuagauuugacuuuaguacaaggagauaaguauggaucgauucgcauucuucuacaugauaacaaccaguugugccagcaccaauuguugaaaaugcugucuuucuuccacuggaugguuuuggcucccuugucgaagaucaagugaccauagguguguggguucauuucugggucuucaauucuauuccauugguccacuugucugucucuauaccaguaccaugcaguuuuuaucacaauugcucuguaguaaagcuuuaggucaggcauggugauuccaccagagguucuuuuauccuugagaagaguuuuugcuauccucgguuuuuuguuauuccagaugaauuugcaaauugcuccuucuaauucguugaagaauugaguuggaauuuuaauggggauugcauugaaucuguagauugcuuuuggcaagauagccauuuuuacaauguugguccugccaauccaugagcaugggagaucuuuccaucuucugagaucuucuuuaauuucuuucuucagggacuugaaguuuuuaucauacagaucuuucacuuccuucguuagagucacaccgagauauuuuauauuauuuguggcuauugagaaggguguuguuucccuaauuucuuucucagccuguuuauucuuuguguagagaaaggccauugacuuguuugaguuaauuuuauauccagcuacuucaccgaagcuguuuaucagguuuaggaguucucuguuggaauuuuuagggucacuuauauauacuaucauaucaucugcaaaaagugauauuuugacuuccucuuuuccaauuuguauccccuugaucuccuuuuguugucgaauugcucuggcuaauacuucaaguacuauguugaaaagguagggagaaagugggcagccuugucuagucccugauuuuagugggauugcuuccagcuucucuccauuuacuuugauguuggcuacugguuugcuguagauugcuuuuaucauguuuagguauuggccuugaauuccugaucuuuccagaacuuuuaucaugaauggguguuggaucuugucaaaugcuuuuucugcaucuaacgagaugaucaugugguuuuugucuuugaguuuguuuauauaauggauuacauugauggauuuucguauauuaaaccaucccugcaucccuggaauaaaaccuacuuggucaggauggaugauugcuuuaauguguucuuggauucgauuagcgagaauuuuguuaaggauuuuugcaucgauguucauaagagaaauuggucugaaguucucuaucuuuguuggaucuuucugugguuuagguaucagaguaauaguggcuucauaaaaugaguuggguagaauaccuucuacuucuaucuugugaaaaaguuugugcagaacuggaguuagaucuucuuugaaggucugauagaacucugcacuaaacccgucugguccugggcuuuuuuuggcugggagacuauuaauaacugcuucuauuucuuuaggggauaugggacuguuuagaaggucaacuugauccugauucaacuuugguaccugguaucuguccagaaauuuguccauuucguccagguuuuccaguuuuguugaguauagccuuuuguagaaggaucugaugguguuuuggauuucuucaggaucuguuguuaugucucccuuuucauuucugauuuuguuaauuaggauuuugucccugugcccuuuagugagucuagcuaaggguuuaucuaucuuguugauuuucucaaagaaccaacuccuccuuugguuaauucuuugaauaguucuucuuguuuccacuugguugauuucaccccugaguuugauuauuuccugccgucuacuccucuugggugaauuugcuuccuuuuuuucuagagcuuuuagauguguugucaagcugcuaguaugugcucucucccguuuuuucuugaaggcacucauagcuaugaguuucccucuuagaaaugcuuucauugugucccaaagguuuggguacguuguggcuucauuuucauuaaacucuaaaaagucuuuaauuucuuucuuuauuccuuccuugaccaauguaucauugagaagaguguuguucaguuuccaugugaauguuggcuuucuguuauuuauuuuguuauugaagaucagccuuagugcauggugaucugauaggauacaugggacaauuucaauauuuuugaaucuguugaggccugauuugugaccuauuauguggucaauuuuggagaagguaccaugaggugcugagaagaagguauauccuuuuguuuuaggauaaaauguucuguagauaucugucagauccauuuguuucaucacuucuguuaguuucagugugucccuguuuaguuucuguuuccaugaucuguccauuggugaaagugguguguugaagucucccacuauuauugugugaggcgcaaugugugcuuugagcuuuacuaaaguuucuuuagugaauguggcugcucuuguauuuggagcauagauauucagaauugagaguuccucuuggaggauuuuaccuuugaugagaaugaagugucccuccuugucuuuuuugaugacuuuggguuggaagucaaucuuaucagauauuaggauggcuacuccugcuuguuucuucauaccauuugcuuggaaaauuguuuuccagccuuucauucugagguagugucuaucuuuuucucugagaugaguuuccuguaagcagcaaaauguugggucuuguuuguguagccaguuuguuagucuaugucuuuuuauuggcgaguugagaccauugauguuaagagauauuaaggaaaaguaauuguugcuuccuguuauuuuaguuguuaaagguggcauucuguucuuguggcugucuucuuuuagguuuguugagggauuaccuucuuguuuuuucuagggcguuguucccguucuuguauugguuuuuuucuguuauuauccuuugaagggcuggauucguggagagauaaugcgugaauuugguuuugucguggaauacuuugguuucucccucuaugauaauugagaguuuggcuggguauaguagccugggcugcaguuuguguucucuuagugucuguauaacaucuguccaggcucuucuggcuuucauagucucuggugaaaaaucugguguaauucugauaggcuugccuuuauauguuacuugaccuuuuucccuuacugcuuuuaguauucuaucuuuauuuagugcauuugauguucugauuauuaugugucgggaggaauuucuuuucugguccagucuauuuggaguucuguaggcuucuuguauguucauaugcaucucauucuuuagauuugggaaguuuucuucaauaauuuuguugaagauguuugcuggaccuuugaguugaaaaucuucauucucauccacuccuauuauccguacguuuggucuucuuauuguguccuggauuuccuggauauuuugaguuaggaucuuuuugcauuuuccauuuucuuugauuguugugccaauguucucuauggaaucuucugcaccugagauucucucuuccaucucuuguauucuguugcugaugcucaaaucuaugguuccagauuucuuuccuaggguuucuaucucuaguguugccucgcuuugaguuuucuuuauugugucuacuucccuuuuuaggucuaguaugguuuuguucauuuccaucaccuguuugugugggaagccgcccccacauucgccgucacaagauggcgcugacauccuguguucuaaguugguaaacaaauaaucuacgcaugugccaaggguauuuacgaccacuuguacucuguuuuucccgugaacgucagcucggccaugggcugcagccaaucagggagugaugcgcccuaggcaaugguuguucucuuuaaaauagaagggguuucguuuuucucucucucuugcuucccucucuugcuucuuacacucuggcccgauaaagauauaagcaauaaagcuuugccguagaagauucugguuguuguguucuuccuggccggucgugagaacgcgucuaauaacaauuggugccgaauuccgggacgagaaaaaacuccggacuggcgcaggagggauacuucauuucagaagcagaacuacggaucacguuuauaaagguucccguaacacagacuguugagaaggauucaacugccgaauucagaacucaucagcuggggaacgacggugauaaagguucccguaaagcagacuguuaagaaggauucaacuguaugaauucagaacuuuucagcuggggaacgagaguaccagugaguauguuuggccuugaauuuuuucugguguuaggagcccuuuuguucuuuuucacaugcuaucaagugauuaagauagggcugaaaauucuagaggaaauucaggacaagcuaucagaaguaaagcgggaagaaagaguaggaacaaagaggaaguaugguacacaaaauaaguauacaggccuuuccaagggucuugaacccgaggaaaaguuuaggucagguaagaauaccuggagagagauuagaagaaaaagaggaaaaagggaaaagaagaaagaucgauuagcggaggucucuaggagauacucgucacuagaugagcucaggaagccagcucuuaguagcucugaagcaagugaagaauccuccucugaggaaacagacugggaggaagaagcagcccauuaccagccagcuaauuggucaagaaaaaagccaaaagcggcuggcgaaagucagcguacuguucaaccucccggcagucgguuucaagguccgcccuaugcggagcccccgcccugcguagugcgucagcaaugcgcagagaggcaaugcgcagagaggugcgcagagaggcagugcgcagacaggugcgcagagaggcagugcgcagagaggcagugcgcagacucauucauuccccgagaggaacaaaagaaaauacaacaggcauuuccagucuuugaaggagccgagggugggcguguccacgcuccgguagaauacguacagauuaaggaaauugccgagucgguucguaaauacggaaccaaugcuaauuuuaccuuggcgcaguuagacaggcucgcugguauggcacuaacgccugcugauuggcagacgguuguaaaagccgcucucccuaauaugggcaaauauuuggaauggagaucucuguggcgagaggcugcacaggcgcaggcccgagcaaacgcugcugcuuuaacuccagagcagagagauuggacuuuugacuuguuaacgggucagagagcuuauucugcuaaaccugauaagagguaucaauggaaggucuuaccacaggggagguccaauaguccuacaaugugccagcuuuaugugcaaaaagcucuuuugccaaugaggaaacaguuccccucuuuaauuuugcuccuuuacauggaugacauccuccugugccauaaagaccuuaccaugcuacaaaaggcauauccuuuucuacuuaaaacuuuaagucaguggggucuacagauagccacagaaaagguccaaauuucugauacaggacaauucuugggcucugugguguccccagauaagauugugccccaaaagguagagauaagaagagaucaccuccauaccuuaaaugauuuucaaaagcuguugggagauauuaauuggcucagacccuuuuuaaagauuccuuccgcugaguuaaggccuuuguuuaguauuuuagaaggagauccucauaucuccuccccuaggacucuuacucuagcugcuaaccaggccuuacaaaaaguggaaaaggccuuacagaaugcacaauuacaacguauugaggauucgcagccuuucaguuugugugucuuuaagacagcacaauugccaacugcaguuuuguggcaaaaugggccauuguuguggauccauccaaacguauccccagcuaaaauaauagauugguauccugaugcaauugcacagcuugcccuuaaaggccuaaaagcagcaaucacccacuuugggcaaaguccauaucuuuuaauuguaccuuauaccgcugcacagguucaaaccuuggcagccgcaucuaaugauugggcaguuuuaguuaccuccuuuucaggaaaaauagauaaccauuauccaaaacauccaaucuuacaguuugcccaaaaucaaucuguuguguuuccacaaauaacaguaagaaacccacuuaaaaaugggauugugguauauacugauggaucaaaaacuggcauaggugccuauguggcuaaugguaaagugguauccaaacaauauaaugaaaauucaccucaagugguagaauguuuaguggucuuagaaguuuuaaaaaccuuuuuagaaccccuuaauauugugucagauuccuguuaugugguaaaugcaguaaaucuuuuagaaguggcuggagugauuaagccuuccaguagaguugccaauauuuuucagcagauacaauuaguuuuguuaucuagaagaucuccuguuuauauuacucauguuagagcccauucaggccuaccuggccccauggcucugggaaaugauuuggcagauaaggccacuaaagugguggcugcugcccuaucauccccgguagaggcugcaagaaauuuucauaauaauuuucaugugacggcugaaacauuacgcagucguuucuccuugacaagaaaagaagcccgugacauuguuacucaaugucaaagcugcugugaguucuugccaguuccucaugugggaauuaacccacgcgguauucgaccucuacaggucuggcaaauggauguuacacauguuucuuccuuuggaaaacuucaauaucuccauguguccauugacacauguucuggcaucauguuugcuucuccguuaacuggagaaaaagccucacaugugauucaacauugucuugaggcauggagugcuugggggaaacccagacuccuuaagacugauaauggaccagcuuauacgucccaaaaauuucaacaguucugccgucagauggacgugacccaccugacuggacuuccauacaacccucaaggacaggguauuguugagcgugcgcaucgcacccucaaagccuaucuuauaaaacagaagaggggaacuuuugaggagacuguaccccgagcaccaagagugucggugucuuuggcacucuuuacacucaauuuuuuaaauauugaugcucauggccauacugcggcugaacgucauuguucagagccagauaggcccaaugagaugguuaaauggaaaaauguccuugauaauaaaugguauggcccggauccuaucuugauaagauccaggggagcuaucuguguuuucccacagaaugaagacaacccauuuuggguaccagaaagacucacccgaaaaauccagacugaccaagggaauacuaaugucccucgucuuggugauguccagggcgucaauaauaaaaagagagcagcguugggggauaaugucgacauuuccacucccaaugacggugauguauaauguucaaguauucuccugccuuuuuaccacuaacugggaacuggguuuggccuuaauucagacagccuuggcucugucuggacagguccagaugacugacaccauuaacacuuugucagccucagugacuacagucauagaugaacaggccucagcuaaugucaagauacagagaggucucaugcugguuaaucaacucauagaucuuguccagauacaacuagauguauuaugacaaauaacucagcugggaugugaacaaaaguuuccgggauuguguguuauuuccauucaguauguuaaauuuacuagggcagcuaauuugucaaaaagucuuuuucaguauauguuacagaauuggacggcugaauuugaacagaucccuucgagaauugagacuucaggucaacuccacgcgcuuggaccugucgcugaccaaaggauuacccaauuggaucuccucagcauuuucuuucuuuaaaaaauugggugggauuaauauuauuuggagauacacguugcuguggauuaguguugcuucuuugauuggucuguaagcuuaaggcccaaacuaggagagacaaggugguuauugcccaggcgcuugcaggacuagaacauggagcucccccugauauaugguuaucuaugcuuaagcaauaggucgcuggccacucagcucuuauaucucacgaggcuagucucauugcacgagauagagugagugugcuucagcagcccgagagaguugcaaggcuaagcacugcaauggaaaggcucugcggcauauaugagccuauucuagggagacaugucaucuuucaugaagguucaguguccuaguucccuucccccaggcaaaacgacacgggagcaggucaggguugcucuggguaaaagccugugagccuaagagcuaauccuguacaugguuccuuuaccuacacacuggggauuugaccucuaucuccacucucauuaauauggguggccuauuugcucuuauuaauagaaaagggggaacugugggaagccgcccccacauucgccgucacaagauggcgcugacauccuguguucuaaguugguaaacaaauaaucuacgcaugugccaaggguauuuacgaccacuuguacucuguuuuucccgugaacgucagcucggccaugggcugcagccaaucagggagugaugcgcccuaggcaaugguuguucucuuuaaaauagaagggguuucguuuuucucucucucuugcuucccucucuugcuucuuacacucuggcccgauaaagauauaagcaauaaagcuuugccguagaagauucugguuguuguguucuuccuggccggucgugagaacgcgucuaauaacauguuuguauguuuuuuccucuuuuucuguaaggacuucuaccuguuugauuguguuuuccuguuuuucuuuaaggacuuguaacucuuuagcaguguucuccuguauuucuuuaagugauuuauuaaaguccuucuugauguccucuaccaucaucaugagauaugcuuuuaaaucuaggucuagguucucagguguguugggguucccuggacugggcgaagugggugugcuggguucuggugauggugaguggucuugguuccuguuaguaagauuccuccguuuaccuuucgccaucugguaaucucuggaguuaguaguuauaguugacucuguuuagagauuguucuucuggugauucuguuaccgucuaucagcagaccugggagacagauucucuccucugaguuucagugcucagagcacucucugcuggcaagcucucuuacagggaaggugcacagauaucuuguauuuggaccuccuccuggccgaagaagaaggcccaaaacaggaccuuucucagacacuguguugcuuuggcaguucccaggugguacagacucucaccuaagcagacuaaauuccuaaguuccuuggagucccgggaccaagauggcgaccgcugcugcuguggcuuaggccgccuccccagccgggugggcaccuguccuccgguccggaagguggccggcuguccccggcccacacagggugcugccucagcgccucugugcuucugccuguuccagaagcugucagguucucuggcgcacccucucaccuguucagacuaauuuccuaaguucggcgggucucggaccaagauggcgaccgcugcugcuguggcuuaggucgccuccccagccgggcgggcaccuguccuccgguccggacgguggcuggcuguccccggcccacacagggugcugccucagccccucugugcuucugccuguuccagaggcugucagguucucuggcgcacccucucaccuguucagacuaauuuccuaaguucggcgggucccugaacaagauggcgaccgcugcugcucgcgugggugcuucuuuaaaaguaccuuuagugaaugacaaggaagcucagucauccgaucaugcaaacuuauagugguuaugacaguguaaaugggaacuacaugccaagucaccaaaucccagcauaagauuggggaguuggccaugaaauuucaaccucaaacauggagcaugguaaaaaaaaaaaaaaauuuuuuuugcaucuaagguuuuuauuagcaauauauaauaaugaauuucauuaaagcuuuauuuuuuaaauguuaauuuuuuaauuagauauuuucuucauuuacauuucaaaugcuaucccuuuuccuaguuuacucuccaaaaguccccuauacccucuccucacccugcuccccaacccacccacuccaagugcauguaguuccugguaagucaaaucacacuuuguguaggcuuccacuaaagaauauuuggucuugauugggggaggcaugcacaguagauaaggaaguggagugguuggguggaccuggggagaguuacagguuugcaguugguaaauaagauaaaaauaaauuguaugaaauucccaaggaacuaaucgaauuucuuggaaaccuuauuuaauuuuuuauuggaugauugauugauugauuuaauuucagaugcuauccccucuccaggucuccccuucagaaaugcccuaucucauccuccuucccccuaccucuaugggggugcucacucacccacccacucccuccuucccacauuggcauuccccuacacuggggcaucgaccacccucaggcccaagggccucuccucccacugauggccaacaaggccaucuucugccacauaugcagccagagccauggaucccuccauguguauucuuuaguuauugguccagucccugggagcuuggagguggggagggucuguccuguugacacuguugcucccuccauggagcugcaaacucccucagcuccuucagucccuucuccaacuucugcauuggggaccccacacucaguucaugguuggcugagagcauccaccucuauauuugucaggcucuggcagagccucucaggagacagcuguaucaggcuccugugagcaagcacuuucuggcauccacaauagcauccugauuugguggcuguauaugggaugaucccuagguagggcagucucuagauggucguuccuucugucucuacuucacacuuugucuccauauuuccucuugggaguauuuuguccccccuucuaagaagcacugaagcauccacauuuuggucuuccuucuugagcuucauauggucugugaauuguuucuuggguauuccaaacuuuugggcuaauagacacuuaucaaucaguacauaccuuauguguccuuuuuugacuaagcuuccucacucaggaugauauuuucaaguucaucccucacucaggaugauauuuucaaguucauccauuugccugcgaauuucauaaagucauuguuuuuaauagcugaguaguauuccauuguauaaauguaacacauucucuguaucccuuccucuguugagggacaccuggguucuuuccagcuucuggauauuauaaauaaggcugcuaugaacauaguggagcacguguucuugauacauguuggaguaucuucuggguauauacccaagaguggguccuuaguacuaugcccaauuuucugaggaacugccagacucauuuccagagugguuguaccaguuugcaaucccagcagcaauggaggaguguuccucuucacauccucgccagcaucugcugucaccugaauuuuugaucuuaggcauucugacugguguuagguggaaucucaggguuguuuugauuugcauuucccugaugacuaaggauguugcacauuucuuuagguguuucucagccauucgguauuccucaguugagaauuauuugcuuagcucuguaccccauuuuuuuuuaauuggguuauuugauucucuggagucgauacagcuguaucccugaacgacccuaucucaaccagucuuuuauccuacaaauuuuaucuaacuugcaaccuugauguggcagcccaacuauucaccucggaacaugaucagaucuaugguacugguauacuaccuaucauucaaccucauuuaauuuuaaaauagguuuaaugcaguugcaagccagucauguacauacauagagaccaguugaugccuauuauguaguaccucugguaaggcaugguuaguugcuuugcagucugaauuuauccuagaauaaauucccaaucuauuccacaauuuuaaguuugacugagcuauggcaucugccacauugcuaguauggugcauacuaagggcugcagguaacugcacuugaccccaucagagcuucuggaauauaacuucucugacuagugguuacagugaugacuguuaaugucaauaguagagauuagacuugcauugacuugacauucaaauuuuaacucauggggcuagagagauggcuuauacuggugaaucauuugcuuuacaugcuugaagaccugaguucaaauucccagaacucacaguaaagccaggugcaguagucaguaucuauagucccuguguaccuguguuaagagagggagggcagagacaaggcucaccagccagucaugccagcuggccuaauacacacagcagccaauaagagacccugucucaaacaagauggaaagugaugucuaacagucaauuucauccucuaacugaacacacaugcaugugcauacacauguacccagaucacaaaugaaucuaaucagauucugauaaggguauagauagauacugauaagguaguuuuagggacaaggaccucaauucuuguuuuugcccagagccaaguuaguauucauaaagaauuugaucugauucacuuuagcauauauuuggcaauaaccacaggaguuucuuucgccaaacuagaagcuuacugaagguggaaaucuacuuauauuugaauauuugaguucaaaaaagacuaugcagaaaugcaucauuguaugaauauaccacuguuuaugagaccuguugcccaacauuuuguaauuuggagcuaguaugaauauuguuccuguaaguauucuuuuuuuuuuaauuagauauuuucuucauuuacauuuccuaguuuccucuccaaaaguccccuauacccuccuccugcccugcuccccaacccagccacuucuacuuccuggcccuggcauucccguguaauggggcauauagucuuugcaagacugcuauauauacaccuagagacacgagcucuggggguucugguuaguuaauauuguuguuccuccuauaggguugcagaacccuuuagcuccuugguacuuucucuagccccuucacugggggcuguguguucuauccaauagaugacugggagcauucaccucuguauuugccaggcacuggcauagccucaaaagagauuaucuauaucacgguccugucagcaaaaucuuucuggcauaugcaauaaugucuagguuuggugguuguuuaugggauagaucccuggguggagcagucucucgaugguccuuccuucugaaucagcucuuaauuuuguaacuccuuucauggguauuuaagaaggauugaaguauccacacuuuggucuuccuucuuccuucuugaguuucauauguuuugcaaauugaaucuuguauauucuaaguuucuggacuaauauccacauauuagugagugcauaucauauguguucuuuugugauuggaugaccucagucaggaugauauccuccagaucuauccauuuggcuaagaauuucaucaacuccgggucucucagagaccaauccacacaggagagcacgugggccacagagucaacauagcuucuuagacagagucccuuugggccuucauccucagccaggaggcagagcugagauccagaccucugggcaccuucccugccagagaagaguuggccuccagggaaggcuaucaccccaggacucaggcaagaucaccaucuucuauaccaggucuuucagagaacagucugcacaggagagcaugugggccacagagucaacagagcuucuuaggcagggucccuuugggccuucauccucagccaggaggcagagcugauccucagaccucugugcacuuucccugccagaggagaauuggccuccagggagggcucugaccccuggaacucaagagagaguuggacucccaggagugcugacagaggcuaacagaaucacaggaggaacaagcuccagacagagacagcuagcacgucuaacaccagagauuaccagauggugaaaggcaaacuuaagaaucuuacuaacagaaaccaagaccacuuggcaucaugagaaaccaguacacccaccacagcaaguccuggauaccccaacacacccaaaaagcaagauucggaauuuaaaucauaucucaugauguugguagagaauuuuaagaaggacauuaauaacucaaagaaauacaggagaacauugcuaaacagggagaaguccuuaaagaggaaucacaaaaaaaccuuagagaauuaaaggaaaacacaaccaaacaggugauggaauugaacaaaaccauccaagaucuaaaaauggaaguagaaacaauaaagaaaacccaaagggagacaacucuggagauagagauccuaggaaagaaaucaggagucauagaugugagcaucagcaacagaauacaagagauggaagagagaaucucaggugcagaggauuccguagaaaacauggacacaacaaauaaugauaaugcaaaaggcaaaaagauccuaacucaaaaccuucaggaaauccaggacacaaugagaagaccaaaccuaaggauaauagguauagaugagaaugaagauuuucaacuuaaagggccaguaaguaucuuccacaaaauuauaaguagaaaauuucccuaaccuaaagaaagagaugcccaugaaaauacaagaagacuacagaacuccaaauagacugaaccagaaaagaaauuccuccugacacauaguaaucagaacaauaagugcacuaaauaaagauagaauacuaaaagcaguaugggaaaaaggucaaguaacauauaaaggcagaccuauuagaauuacacuagacuucucaccagagacuaugaaagccuggacagauauuauacagacccuaagagaacacaaaugccagcccaggcuacuauacccagcaaaacucucaauuaccauagauggagaaaccaaaguauuccaugacaaaaccaaauacacacaauaccuuuccacgaauccagcccuucaaaggauaauaaagggaaaacuccaacacaaggagggaaacuaugcccuagaaaaagcaagaaaauaauccuucaacauaccuaaaagaagauagccacaagaacagaaucucuacucuaacaacaaaaauaacagaaagcaacaauuacuuuuccuuaauaccucuuaauaucaauggacucaacuccccaauaaaaagacauagacuaacagccuggcuacauaaacaguacccaacauuuuucugcauacaggaagcccaccucaagaacaaggauagacacuaccucagagugaaagacuggaaaacaaauuuccaagcaauuggucugaagaaacaagcuggaguagccauucuaauaucgaauaacauugauuuccuacccaaaguuaucaaaaaagacaaggagggggcacuucauacucaucaaagguaaaaucuaccaggaugaacucuuaauuuugaccuucuaugcuccaaaugcaaggguaacaacauucauuaaagaaacuauaguaaagcucaaagcacacaauugcaccucacacaauaauagugggagucuacucucaucaauggacaaauccuggaaacagaaacuaaacagagacacagugaaacuacuagaaguuaugaaccaaauggauuuagcagauaucgacagaacauuuuauccuaaaacaaaaggauauaccuucuuuucagcaccucauuuuaccuucuccaaaauugacgauaaaauuggucacaaaacaggccgcaacagaucagauccaaaaauacugaaauuauacaaugcauccuaucagaucaccaaggacuaaggcugaucuucaauaacaauauaaauaauagaaagucaacauucauguggaagcugauaaaacauucuacucaaugguaacuuggucaaggaagaaauaaagaaauuaaagacuuuuuagagauuaaugaaagugaagccacaacauacccaaacuuaugggacacaaugaaagcaguccuaagaagaaaacucauagcucugaguacuggcaaaaagaaacuagagagagcauauauuagcagcuuaacagcacaccuaaaagcucuagaacaagaugaagcaaguucacacaacaggaguagauggcaggaaauaaucaaacucagagcugaaaucaaccaaguggaaacaaaaauaacuuuauaaagaaucaaccaaaccaggagcucgcucuuucuuucuuucuuucuuucuuucuuucuuucuuucuuucuuucuuucuuucuuucuuucuuucuuucuuucuuucuuucuuccuuuuuuuuuuuuuugagaaaaucaauaagauagauaaacccuuagccagacuaacuaaagggcacaaggacaguauccuaauuaacaaaaucagaaaugaaaagggucucagcucugccuccuggcugaggaugaaagcuggaagggacccuguacaagaagcucuguuguuucugcagacugugaacucucuugcggggacuggucucugagagaccugggauacaagauggugaucucaccugaauuccagagucagacccuccuguaaugcuuauucucauuguuugggguguagaaaacauuguacaagguucucuaugagaauuaacaauugacuuacuguaccagaguuaaauaauuuuaaaagaucaaauguggaauauucuuauuauuuggagugagaagcaaacuuuccaaguauuagaguuuuuaaaaauauacaggagucauguuagcauagaagaauggacuacaucucaagauaaaauaugaagacaaauaggaauuuaugacacuuaagagaaaauuuauucacauguaaauuucuuaccacaauauagacauaacaaaugcaugaaguaauaauucacaaaagaaggcauucugauggcuauuaaauguuuaaaacucugcaguggaaauuuugcaguucucaagacaaugccucuugacucagagguuaagucuucaagagacaguucauugacuucuagguuggcaugacauauuugaacugcauuuaaacacaaggaaugugccaguggaguccacaauucuauugauuauucuuuaugcucaucauugugauuaugaaacuagucagaaucaaugaggaaaauuucucuggauuuuaugaaaccuuauugcaaaaauaaguuuuaaaacguuaauaucugcuaggaaaagaaagguguaucugucaugauaaacaaacgaucaccaguguagucaggaggcuucuuucuuaucuuucagugcuggcaaccaaaccuggggcccaaccaagggagcaaaagacuuucuuuuuuuuuuuuuuuuuccauuuuuuauuagguauuuagcucauuuacauuuccaaugcuauaccaaaagucccccuuacccacccacccccacuccccuacccacccacucccccccuuuggcccuggcauuccccuguaccggggcacacaaagucugcguguccaaugggacaccuauggucacuugaucuucgacaagggagccaaaaccauccaguggaagaaagacagcauuuucaacaauuggugcuggcacaacugguuguuaucauguagaagaaugcgaaucgauccauacuuaucuccuuguacuaaggucaaaucuaaguggaucaaggaacuucacauaaaaccagagacacugaaacuuauagaggagaaaguggggaaaagccuugaagauaugggcacaggggaaaaauuccugaacagaacagcaauggcuugugcuguaagaucgagaauugacaaaugggaccuaaugaaacuccaaaguuucugcaaggcaaaagacacugucuauaagacaaaaagaccaccaacagacugggaaaggaucuuuaccuauccuaaaucagauaggggacuaauauccaacauauauaaagaacucaagaagguggaccucagaaaaucaaauaacccccuuaaaaaauggggcucagaacugaacaaagaauucucaccugaggaauaccgaauggcagagaagcaccugaaaaaauguucaacauccuuaaucaucagggaaaugcaaaucaaaacaacccugagauuccaccucacaccagugagaauggcuaagaucaaaaauucaggugacagcagaugcuggcgaggauguggagaaagaggaacacuccuccauuguuggugggauugcaggcuuguacaaccacucuggaaaucagucuggcgguuccucagaaaauuggacauaguacuaccggaggauccagcaauaccucuccugggcauauauccagaagaagccccaacugguaagaaggacacaugcuccacuauguucauagcagccuuauuuauaauagccagaaacuggaaagaacccagaugccccucaacagaggaauggauacagaaaaugugguacaucuacacaauggaguacuacucagcuauuaaaaagaaugaauuuaugaaauuccuagccaaauggauggaccuggagagcaucauccugagugagguaacacaaucacaaaggaacucacacaauauguacucacugauaaguggauauuagcccaaaaccuagcaaaagacuuucuuauccuaauuuaaacugacaugaaucaccauaauguaguugggguuggucccuuucccuucagccuucuguaagagguaggagcccuuuagucuauagccacccgcaaggcagaaacagagggcacaguugucuuuucuuuuuuuaauuauaaacuuuauuguaaaaaaaaugucuugcaaauacauuacacacccaaauuaaccaaagucuauauucuauauaacuucuugaacguacauaguuagaacugguguuuaggauugaagaugugaaacuucacacuuuucacuauugcauguauucuauggacuuagcccccaccagcaauuaaaaaguccauaacaaaaccagaacuggaggaacuauucacuuugugucuucauucacaauuuaugucauuacuuacauucauuacuuucucauuaccuuauaguuugguuuucuuguuuuucuuucaaauugucuuccuuagacuuauauauuuaaauuuuuuuuccuuuauuuuaaacugaaaauagauuuuuuucauacaacauauucugaucaugguuuuuucucccuuaaaucuucccacaucccccuggcuauaguuguuuuaaguuaaugauacaguuaugaguauauacuucuaggauauauaguaacccaaagaguguugguaaagcagguuguuuuggcugcuaauuuuauggcaauguuguguuuuccccuucuugguaucugggguaggaacagauaaaggugcagcuggaaguggcaauagcagucaaaugaugucucuucaaggcuguauuaaagugcaaucacgcucagugacuucauaguccacaguuuguauggagauuaaauagcuuuucacaaucaggaauuaaagaguuaccaagcucauauuuaaauaaaagacaagucuuacaauucagauuuauaauaacaauaauaauacauuaaaaugcaucuuuguguuagcuaaacauauaguuuuauuaaaaacuagagacucaacagguaaagacaagcacagaaaagaaauuacuaagacccuacagaggccacucaauugaaccacacagaagaauucacuagaacaguaagaguauaaucaugaguccuaagaacaaagauauccuguuaaaugcaauguguggagugcuggaguagaucuguuccuuccaucacaccaagaacaaacaagcugagcagagguacuuacagcacguaucaccaacaaaccauuacucuuuaacuuagcgaguucuaaaauuacauagaagggcauaaagaaauuuuaugguaauaugaacagacuuggacaaauagcuugagcaaacaacuaaaaaauauaaaaaaauguuccuuagucagaugaaaagauuagcaauuauauccacaccaaaauaaauaaugaaaaccacaacgaaagucuacuuuccacccaucaaacuagaaagaaaaacauccaaaagcuuuacaacccauucuguaagugaggcagagaaacagcuacauggccacaagacaugggaaagguaucuacaaagaagaaaguguuagucuuuaacccauuacaucuaacugugcgcuacuuacuugagaagauagcaacaucaucaaacgucauuaaucccugagagggagccaaccauagaccaaagaaacaauuuugcccaagucuauugugaaccaauugccucaugagccuuucuccuucccacaagggaaaguuaguaggcucaacccuguaaaggucuugugcagguaaccccauggcucugguuucaagauggcaauggccaugugguaccuaaaggacagacuucugcaucucaacacacauaucuaugaacuugaacacauuuucccaguaacaugauaagaaaauaccuuuguacaaaauuauucauaaaauaauauuugugauugucaagcaaauggaauaguauacagcucuucagcagaauacuaaagaacucuauaaggauagggaaugacuuacaagauauauaauuaaguugaaaaguugggaaaacauucauaauauauuaauuguagugcauaaaguaaaaauucuuaacacacacaauggcuuaacauaccuaaaaguaacacaagaaacaugaacuaggggauaauccaguuggcugcuuuaaggaauggggauauuggacaaaaagaauacaagaugaagggacucugauuauacuacaucauauaguuuguuuugaacacauuaauauucuauguauuccagaaauaaaaucagugaaaagaaggaggaaguacaauugaaaugcauauaccuagcugauuuuccaaugaacaccaggucacaagacaggggcuaaaggaaugaaccaauaaacaauuuauagacaacauuuaacuauauauccuuauucuugggagaaagguggagagcugucaacaacauauauuauuaucauaguggcacaugggacaucauuccuacccuauuuuaaguacacuagacagucgaauaaaugaguaaauguagugaagucauuugaguccucacuauggaaaaagcacauaacuauggaauuauaacaagacaagccacaggauggauuagaaccaggcacgcuguuccgaacugugcauccguguaugccauucuguguacacauaugcauggauuuguauucuguugguagguuuacauuugcagucuucccuucucucuuuaguuaaagggccaagaagcaaagaccagaguagcuaugagcaagccuagcaacuaggcuuuaauucuugguuaaagaaagguugaugccuagaaaugagacuccauaacucaggguagcucacaaaagugcccagccuauagcuccuaauauuggcauugccuucauaucccagaagccagcuauaaugacuucaauuuauuucuaaccaguacaugaaaauggucuauauucaugcgguaugugaugacaugaucauguguauacugcaucauguuuaaaucuaccugcucaggaaacaaaauuugucaacgcuuuccuugaguuuauauggacccuugauauauuacagagcuucaguugucauuugcuuguauccuguuuguccacaaacagauugucaaaggccauguaaaaguaggauuuuaauacucaugaugacagcucuccuuauguucaguugucucugcauuuccacuccuaaguguguacgucauccacuccaaauuuggauguugucaugguuaguauuugugaacuugauggaacuuagugugaccaugaaaacaaaccuucaggcauagccgugagggacuuucuacacuggguuaauugggauuggaaaagcuuccaguucuaggaagcaccuccugccacugagguccuggacuggauaaaaaggaacagcgucaccucucucugcuuccugacugggcacaauucuucaagccccugccccugugccuuccaaaccacagugggcccuacccucaaacuuggaaccaaaacaaagccguccugccuugcauuacuuuuguuaauauuuaguaacaggcgaaauaacucauauaaaaguuuugcuagaacacaagaugucagagaccccacagcagaauaaguuacugucuuagucaggauuucuauuccuguacaaacaucaugaccaagaagcaguuggggaggaaaggguuuauucaucuuacacuuccauacugcuguucaucaccaaggaagucaugacuggaacucaagcaggucaggaagcaggagcugaugcagaagccauggagggauguucuuacugacuugcuuccccuggcuugcucagccugcucucuuauagaaccaagacuaccagcccagagauggucccacccacaaggggccuuuccccauugaucacuaauugagaaaaugccuuacaguuggaucucauggaggcauuuccucaacugaagcuccuuucucugugauaacuccagcugugucaaguugacacaaaacuagccaguacaguuacccaucuuggagaaaacacccaauguggaucacuggaaaguucaagaugaucugugcuguggaugugcugagacuugccuuccaaguugaaaacagagcugaaauacuguucucgauugcuuuuuguggcugugauaaacagugaccaaaaucagcuuuggaagggcagaguugauuucaacuuagacuuccaggucacauucuauuacugagggaagucagggcagaaacuggggucgaacugaaagagaaacuguagagagaugacccuuacugacuggcuuucuggcucaugcucagcuuucugacacagcacagucucuucagucuaggauggugccaaccacagugggcaggccuuucuauaucaaucgccaagccaucgcucaugggcaugggccaaucugauccagacaguucuuugacugauauucccuccucccaggcgacuagguugugucacaauaaaaacgaaacaggacaaggaaauguauccgaaaaacuguguuacaguaaauuacccuugugugaugacaucucagcuauccaccugauguuuugauuaccaauggcuuugagugaggacuauagauuagaucaguagcaagaacagcauguccuggucucugagcaaccuaccuguaagggaguuacccagauuuacagccacacaaggccuguggccuugaugccuuuccguggggcuaaacucugauccagauggauugaacuauggaacaaaagcccaaagcagucacccagcagcuagguggccagcgcuucauccccuggagaagagucagcggggcagaagagaggaccuaaaagcauuuccccugggcuugggaggaucgggcgucaagggugaauuuugaguucugcgguuuugcuaugugugaacucccugcucucuggaagacaccuuccugcugcuucugugcacugcuaagccauccccucuugccugugaacugucauggcugcuucugcggcguaacuggcacaaggaaagaggcuccugugaccacauuauaagaugaaggcucucugacagcaggcuugucagaugcucuuugucacuagcgguucaaauggguuugcuuuccgguuuccuggauacguuggaaacagagacucagaaagccaaggagggggaggcagguuuccuucucuucucugacccuaagcugccucuuacgguacuuucaaguggcguaugaaagaaagagauuaaaagcaaagggugcaaaagacaaauagacagacgcuguuucuauugucaacuucugaaguuccaggaacagacugaaaguucaggcuaggucuaugaaaauauucacagaugccaaaaaggccagcagccaagacucgucucuuuguggacgaacuaaaaagcucccaacagcuagagggaaaaaaaaaauuuuuuuaaggcuuggcaaugaugcgaguccuaugaaaaagagugagaaagagaaaaugcccccgaauuaauuagauuuaugaccuucucaagacuauuuucucccaaucccggaccuuuaaguguuagcuggcugaaauguaacgaccaggaaauauugauucacuccccacaaggugcugcuaguacaguguagagcaaagaaaucugagauaacucgggauccuuuagaaagggagcuaauauuacugguaaauaauaauaauaacaauaaacuuuacaauaaaccaauguggaaccuuguaaaacuauuucaaguuauucagaaugucaaucacaugacauacuuuugaaacuuuuuuugagauuguaauauaauuacauuauuuccccuucuucccuccaaaauauuuacccucacuuccuucuuuaaaauucaugaccuuuuucauucauuguuguauacauacauacauacauaucccuauauguauaugcauauaugcauauaugcauguuccuaaauguguaagagcagccugcucagucuguaguguuacgugugcauaugguuuggaauuggagagacaguuggugcgcuggugugcucgucccugggaagacucuaucucccauucucacaguccucaccuuucuguaguuuuugaaccacaugacauuguaaaaaaauuuuuucaauacguuuaaugaauuguauugagaaaaucuuaauuggcccuucacaauuugucuucagaaauuuaaauuggaaacaccuggguuuuuuuuuucauuuuuuaaaaaauaaauuaaguagcaugggaagaaaacaggucauaauaaggugaauugaaaccaaugguaaaagcugaaaguguuugcaaacaccguagugugcauuuggaaaauaaaauacacgguugaaaaucacuaaggcaaauaguugaguuuuauuuagugaccaaauuauaagacauguaaauaccgugaagaauuugaguuagaaguuuccuuuaucaugaauauccaguuuauuagaaauaaguuuauugcuuuuauuucucuuuuuuuuccaaguuugacaaaauuucuuguaauuuuagugaaggcauucagcucagucgucucucuccucaucuugaccucagguuaauuugugauuugagucaaguaaagacuauguaggagagcuguuauuucuauaaacaggaaaacggacaaguaugcacuuccauuguuuuauguagagcuuauuaaacaaacuaaaagguauugaacaaaguuuuaggacuaucgguaggcugcuucuuggaagucauuacacacacacacacacacacacacacacacacacacacacaaaaugcccaggaaauaaucaccuccaauaaaacucacugaagcugccuccaaauuuaacauuguaauuuucaaggaaauuucaucauuucuuuugucugugacuauuaaagaugcaguuagcugucacaucgaaaaaucccguauauaauccccaaguacaaacaccccgcagugcacacaucugagagaauauguaacaagagacgcauaaugggagcgaaguugugagcaguuccacucccaacuuccgcauaaccucagugggcuggcuccccagcgcagcgcugaggagaccggauacuggacugggaaaacaaugucgcuggaauauugacugaaaguaauuugaauagaauuaagaugaaucuuuuccuaaagccacuucauucucuuuuggguuguuugcaucgcugucagcagguacagaugccuggcucuuucaaaaaagaauccuuaugugaaguauugagugguagaacuauccccagucucuuuaauggcgcucaucuccauuggggauucugcaaaggacacuguuugcuaccaaaguaaaucaguauuucgaacguuucuuuugguuuuuaauucuaguuccuauaaacauuuccaccauaacuugaggcaaauuauacggaagcuguuucuuuuuuucuuuuuugauuuuuuguuuuucgagacaggguuucucuguauagcccuggcuauccuggaacucacucuguagaccaggcuggccucgaacucagaaauucgccugccucugccucccaauugcugggauuaaaggcgugcgccaccacgcccggcugcuucucuuaaaguacaaaccaccccaaaaauaucagugugccuacugcuguaaguauuucgcuggcuuuuauuuuuaaaagguuuaaauauccauccacccaccccaagaugguauaacauuacauaaagacagaugaggcaaugcguguucugugaccuuugaagcauuuaaguuacugacauauuagacccaauuugaauugaauucacaagguuucuuauuuguacaacuccauggcuuauuuuaaguauauagauacuggcuggugguuucaaaagcacauuuugaugacugaaacaggacaggaaugcuucuucaaacauauuuucguuauugcuuuuauuucuaaagagcaucuaaaauguuaccagauauucggcuguaaugaccgaaaauaaacaguagagggcacuuugguucucuaagaaaauaaauuguuccaaaaucuuuuguaaaucggcaaaauaacggaugcaguuuggacuacaugagaagcuuaaacaaaaauguaaaaauaaaauaaaauaaaauaaaauaaaauaaaauaaaauaaaauaaaauaaaauaaaauaaaauaaaauaaaauaaaauaaaauaaaauaaaaaucucugcuugcugugaacaaagcaaagcugucuuggguuaacugaagcaucuuuguuuagucagccuauaaggaaaaagacugcccugcagaagaaaaaucaaaaccauucugugggcuacaaauugaggcuccaucauaucgagaauauuucauuuaagcaaauaaacaaaaaaacucacauucaguuugaaauggccugacauacuaaauguuucugacuuaaaucaguagucguugcuuugucuugcuuuaauaaaaugcuaggcaaaaaacaacuugugaguggaagguuuuauuuggcuuguaguuugugaccuaccgucagggcaaaccaaggcuguagcuccagacgagagcuggaagcagaagccgcuggaugcuuacugcccugcuccucugguuuguugggcuaccuuuaugauacagccuugucccaccuaccuaggaaugccaacucgcauaacagacugagacauucuauaccacuaggaagcaaucaaggaaaugucccacaggccaauccaauagaaccgauaauccaauagaauagauucccuccuuguaaguguaccuacauuuucaugaaguugacaaaaacgcaccaaaacauucaccuuaucuaggcuuucuagacauaaagcgaauguucucacugccuaagaaguagugguaagugacaguguaugcuucuucuauauugguugacacuccuaacaguuggccuauggauuaugcaauauuuaguuuccucuagaaucgucuuuauuaccauccuugucauucugcucauaagucauuuuguggcacaacggcuuccuugugcuacguacaaauuuauccuaguuuuauauauacacaaggaacacuaaauggacuccugagguuguguuuauauauuuaugcauauauguaacgauaauaauuaaagaaaaauaaggccaugaauuugugggggagagggagcaaagaggagacacagggaaggccagaaagacaagagggaaguugaaaugauguaauuguauuuuaacuuaaaacuuaaaguugaaaaugaaaaugugagagagaacacgccaaguaagguaauagacaauuaaaucuaaguuauauuaguccuugugcuaaugaccuugagaaaaucauuuauaauuuccuggaccuuaguuuuaacauucauaaaugaauuucuguauuuauuaggaacucugcgauagugucauccgcucuuacucugaauaguuuucgagcaaauuccaugacuuauguccuaguuguuagcagauuuaucaagaaucugauucaagcagguugaaagauccacuugaauuuugauaaacagauacggagcuaaugcuaaaauguacaucuuacucaauaugagcauccaccacaggaggccugaggaccuucagaaaccaaucaguauacgccacacaccccgugucaagaauaucuggcagagguuaaaaucauacaaugacuacauaucucgaggcagauuacagagagucugcaugauacucuugagccaaagugagcaauaaguuguaaaauggaaaagaacacuucaaaaccaaugaaagcuuguucuacaauucugggaacauucuacccauuuccaccugagacaggagguacagcaaccuugcacuuacacucaugugaaguacuucaauggacuaaggagcugcgcucgcgcgcgcgcgcgcacacacacacacacacacacacacacacacacacaccugaguucaguggugacuguuccaucuauuuccauuauauuccuuagggggaaaaugaucuaucacucaugauauuacccaaggcaggucccaucuggagaugccuuaucacugcuaguagcgaaacuaaaacagcaaacaagcaaaaggucuggacauggagauuuauggaggauuugcuaaaaauaaaaaagaaauguucauauucauagauuauuuucuaacauguuugugcacaucuuacauuguaauguauuuaacaaucuuauugaucucuaaaaaagguaagagauaauuaaaugauauaggugagauagaaccauguuuuuucuuauaaagacuuuggcuacaggacuccaauaccagagccagaaauaaagcaagaucaaugaaauuguggacaaugaacuucagcauuaguuucuugagucuacacagacauuaguauuuacccaauguaggagcugaaguugacaucccaacuccauagaacucagcaggcuuguuuuguuaaacacuucacuauccagccacauucuacccuccugucuacuaucugcuuuauguccaugaucaauaggcagcugagcauugcacaaaucuuagugucugggucauguaguauacccugaaacaaaaagccuuuugacaucacucuaccugggaaacccucccuagcccuaacccuuagccucuaaaccaccuucuccgcuuucacucaccuccugcaaaccagggaaaccacugcucccuuuggaccaugugucuaauguucaccauagcgcacacaggugaauuaaguuccuaugcuucuugcccauggcacugcuuuccuagaagagaccacucggacucccuuuacuccucagccccuaccgcaaugucagcauacagaaacagaucaacaucuccaagauauaagauacaauuugcuaaacacaugaaacucaagaagaacgaagaccaaaguguggacacuuugccccuucuuagaauuggaaacaaaacacccauggaaggaguuacagauacacaguuuggagcugagacgaaaggauggaccaucuagagacugccauauccggggauucaucccauaaucagccuccaaacacugacaccacugcauauacuagcaagauuuugcugaaaggacccugauauagcugucucuugugaggcuaugccggggccuagcaaacacagaaguggaugcucacagucagcuauuggauggaucacaggguccccaauggaggagcuagagaaaguaaccaaggagcuaaagggaucugcaacccuauagguggaacaacaauaugaacuaaccaguacccccagagcuugugucucuagcugcauauguaucagaagauggccuaguuggccaucaguggaaagagaggcccauuggucaugcaaacuuuauaugccucaguacaggggaaggccagggccaagaagugggagugggugggugggggagucgugggggaggguauaggggacuuugguauagcauuggaaauguaaaugaaauaaauaccuaauuuaaaaaaaaaaagaaugcaaagaugggauuuuagcugacaggcuaucgugauaguccagucuuccuaauucagaagguggaacuaaggaggggugaaaauuuaaaaucauuaaucuacaauagguucaauuauaugaguggcuaauuguaggacagagagauaauaagaacuggaugaugacuauagccauauuuuccaguuaaaaaggcagaauagaaaggcuaucacaaacaugaaaagaacagaaguaaaaagagcaugaauuuggcuucaggcuuuuaaacaugauaggcagaggauauccauuagcagaagguuagcagauaguuguuuauucagagcugaagcccgcaaaaaggcugcagacuuuaagggcacagacguggaaagcacacacuggaggaucuugaagagauacugagaagucuagcaacgacuagacucgggguaccaucugauguaaauuaugauggucuggggauaaggaagagaaaagauaugcuaagaaaccagaugacaggcuccaagaacgugaccugccacaggagcccacaaaggaccaaaguuguaugagguugaguccaaaccagagaaggaccucgucaugaugaccuccaugaacacggcuuucccagccaauggggaagaaugcagaagagccacagagcaggugaagacacugaaggugguccucccucagugucaguuguaaccaacaugggcaguguggcuguaaguuaccugacuugucaccucuacucucuccucauugagaaucaucgguacagucuagcuuuauuuuaagcuccuacugaucagagcuauuaguuuuuccuucguuaagaaguuaacagugggagcuggagagauggcucagcaguuaagaguaccaacugcucuuccagagguccugaguucaauucccagcaaccaugugguggcucacaaccaucuguaaugggaucugaugcccucuucuaguguaucuaaagucagcaacuguguacucacacacauaaaacacaaacacacaggaucuauguauccucuugagauugagcuggggaaauagcuugagaguucaucuuuuuaaguaugucgcaguuauuaagaguuuacucuuuuuaaguaugucacaguucuuaugaaucaaggacacuagcaucuguuaguguuuuguuuuguuuuuccuagaaaggccauaaaaagaagaucuuaaaagaucccuuccaaaaauacauagacaaagacuaucacuaaaccuuauaaagccuguaugugccuacugcucagagcugggaucagggucugacugugacucuuuacacuugaagucauuauuuccuaugacuuucuccugucaaugaagaucaugggcuguugaccagugugguaaguggaggauugacaugucuccauauuuauccacaaauacauuuuaugaugucauucacuauuuaugagcaaagagaucuguggcuuuuagaucuugccaaugaagucucauggcucuuuuuaccuggugacauaucuaucuuggcagacucauuccauuaaguuuaccacugaggacuuguauguuuugauuuggcaauaguugauuaugucaucuuaaguuuaucucugauuauguuauuuuaaacaucuccuccaaagcagguuuaggaagguaaaguaacauccaauuaaaugugggcuuuauuggagaaaaaguauauuaacgaaauaaaauauccagugucauuucaaucugucagugacuuccuagaaauuacagaugaugaauuucugcauaggaggugaguccuucuggguggaaacaauaggaaacucgggaaaaaccuuagagaaccuaaaggagccggagacagguuuggcucacaguaaucacacacgaggugacuauugccaaaaagcaaaaguagugguccucgugaaaccuacuuagaugggucacuuauguggccuuuuuccauauugcuuuguaugcuuguuagcuagcaucucccugcuaaaacguaagcugcaggagggaccucugcuuuguuuccugccaugucugaagcacccacaauacucucgggcauuccaacugacccacaaguauuuguuacgugagugagugguucuucuaagcacucccauuuucuaggaguuuuacauuuuccuaccuggaagacacucuuuagaacuuccuguucuugccacugucacccucucagaacuugucccucugcguccgugcagugcaucuguucuucgucucccugacuuccggagaucguaguccaucuucuguucuccugcuucaggaggagaguucuccaug

SEQ ID NO: 90 - RNA, 2525 nt, Mus musculus
uuuugagagccuuucaauuguauuaugguggauugaaacuauaaaugcaauuuuuuuuuacugaauaagaguucaaaagaacuauuuucauaguaaacuauauugacuuauugucaguauaauuuuauuauaaacacacuguaaaaauacaaaaaacccaauuauuucuuuuuaaaaugcuaacauuuuauugcuuuauccagagaauaucugaugaaauguuuuaagauuuaugggacuuaaauuuaugaaaauggacuuugggaguauuuuugauauaguuaguucaauggacuucuaaauuggugaauuuuuuuuucuuucuuucuuuugguuaguuuacuuaauauuguccaugguaaaaugguaacaauucuuacauagcuuagauuggccuugaaaucaugacccuccacccuccaaaauauuaauuuuuuuucaauuuuuaauuuuagguguauguacauucugccugaauauuuaucuguaccauaugugugccugauacccauggagauuggaaaagggugucaaauacccugagacuagaguuacagccaguuauaagucuccauguggaugauaggacuagaacuugcggucucuggaagauuaucacuaacucuucagcccccaaauuauuauuuuuaauauuuauggaaauaacuuuuuucuaaauuaugauugaaaaaauaacguuuugaccauuuuuaaugauuaaucuuucaaguaccauauguaauuuuuaauguuuuuaccuuaaaacagcuauuaaguaggaaaauuuaaauugaaguuuaaaccagaauuuuuacuuccaugagaaauuuuagacuuugcauacauauauggccuucaugcuuaaaugcauucugcuguaaauuuugagauaucauuuacgcauucauauaauucaaguaaagcaaacaucucucuuggcacaaaauuugauauuucuuauuaauuuucuauauugucuuuucuauucuucccuguccuccauuagaacuguucuuuuuauuuuaugaugaacccuccuucaaaugaaaggucauuuucuuuuagacauuuaacuucagacuaucuuauugugggcauagaggauauaccgugagacacaauauuauuucaguaaaaccuaaagaauacaagucaaugcaguucauaugcacaauacucagaccaaggaugacaucucaaacuuuguacacucugguuucggugcauuuucaucaauagcuaguauuuuaaaaucagauauaacuauacuuaauuuuaauauaaagacugauauccacaggaagcuuuuuuuuaguuuuagucuguugaauggauaauacauuaacaaaaauaaauacuugcuauuauucuuuuauuuaauauucugucguucagaucuggagauggccacaggucauuuauuuaacgcauuuaugaguuuucacauacuaaauuuuggccuaaacacuucgcaagugucaguuuauuuaauauugccuauguuuuucauuuugcaaaugagaaaguuaugauacaaguauuuauggcagugucuuuaguuggguagaccggcuguaagaaaaguagguaacagucuugguacuaaauaugugcaggaucuggggagcuauggauguguuuauuaggaaaagaugggacucaagcgugcccaguauaaagagcagcaugugguucuagaagcacaagucagaugcucucagguugcaccagcccaccagguggagaggaggcuccugcccuagugcugaggagcccucaugucucaugucuuccuccuccuccaggcauuuucggcugacucaggcaguuuugccccaggaggguuuuccuucucccucacuuggaagcccgggcuuuguaaauaauaggagaauuuuuuuuuucucccggguuuaauuucaggccaguuuauccuccccuugcccuucauauauuucuuugaaaauagugcucaauaguguguuacaauuguauauaacuaugagacugauagugaguaacagaauuaaagggcaaagcaaucuuuuguuugaauucaggagagaagaugagagcgguuaaauguagaaaaugaggagaaaagaaacauuguggaaaugaagagauaaauugggauugggaggcugauggaaacugagaggaggauugcugcuuugcuucucacccacaccuccuccccacauucacaguaacaggcaaugucacugucuuuugccugacaugcugagccagggaguugagacucgugggaguggaaauuuucuuccuuuugcauuuugagacuugggugugcugcuuuaagaugccacugguaucucaguaauguuuguuuauaccggauauuuucuggguagccauuguggauagggcuuauaauacaaacaguacuguuaggaagacugcagaaucuccgcugcuauguuuaucuuacuaguuaaaaaccugcuagcacuucugagcacguuuagaaaacuccagaggcaauguuaagaauagcuuuagua

SEQ ID NO: 91 - RNA, 1189 nt, Mus musculus
cuguugcaucccugucuuggaguuucuuguguaggcucguuauugcaugggauuuaaacuucucucuuuaguacuucaauucuaugagaauugaaacuuggaccuugggcaugguugacuaauguuguuuaucacaauucuaucuaauccaagcccuaaaucuaaaccauuuagucuuccuuaaauauuuuucugagacgaccacuuuucucuacuucuuauaaagguaaaccgauuagcugggugucacuaugaaguaacuucucauuuuccucuguccugagggcugagcucugugagauuugucuccuugauauacuugguggcagcuauagacagugcuuugugcuagaaagaaaagaacucgauguuggucuaaccaguucaagcucuguccaagcacagcaguuagcaaagcugggggauucuucaugugcugaaucccccucugcaaggaaagcaucuacucuuugacugaaaaagcacuaagguuuuuuccacaaacauuucuccacucauuuaacauaagaaaaauauuugguuaacauauuuaagugccugcuguguaaaaacagaucuguuauuuuuuuucuuaaacccuggugaaguguuaauuuaaccaaucaaguuauauuucagacuuaaauguaagaaaaucagaagaaacgcacaugaagcaaaggcauuguaugaacagauacacacacaacuacaauuuuucagucuuugauuuucuauuuauuuacaucucugauucuauaugggucuucuauaacuggccaguuguuuauuacuuaaacauuuuagcuguuggcaagauuaaguugugagcaauccaagagugcuuuucugauuauucagucaccauauuaguuauuuucauccuugcugugauuaaauuccagacaagggccaaaugaaggccuaaguuugggucagaguuugaguacgugguccaucauuaugguggcaguagcaugaggcacuuggucacauuaugccugcagugagaaaggggagaaaggggagagagacaugaauccuagaccuucacuuagcucacuucuuuccuuuugcucaguucacuacuccagcccaugguacacugccacauacauucagaaugaggucuuccaucuuacuucuacagaauuaggugcagaauuagguaaagaauuagcuaaaagga

SEQ ID NO: 92 - RNA, 2802 nt, Mus musculus
gaugcgaaaggacaguugaagacugaggagauuucucucgaagucaucuacgucuucucuccuugcugccauggcuagagccgacccucgcgccucugccagggcagugggucggugcugccccagcagucgcuaauggggccauccaugguguggccaugcgugcagcugaucuauuagugucuugauugaugacaucuuaaauagaagcuuucaggucuuaaauuccauuaacggaagcccauagucuuucauugauuaacuucauuuucuucuuucccgcuguccgaacagaacauuuuuuaaagauuuauuuacuuuacauccugcucgguucccccuuccagauccccuccccucccacaguccuucccccacucccccuucccuucucugagucugugaggcuggcacuuccuaucccacugaggcaggacaaggcagcccagcuaauaaaacauaucccacauaaauggagcugcuuuggggauaguagcuccccucccccucccguuguugaagacccacaugaagaccaagccacacaucagccacacaugcuggaggaagugggguuagguccagcccguguauacucuuugguuggggguucagucucugagagccccaaggguccugguuaguuggucuuccuguggaguuccuauccccuucaggacugcaaucuuuccuccuauucuuccauaagaggccccucgcuccauccacuauuuggcugugggugucugcuucgguuugaaucaucuccuggguggagccuacagaguauccuuauaauagugucaggguuuggugcuugcccauggaugggucucaaguugggccaccagcaggacauuuuauagcucguuaaagcuucugugugugacucaagcaagguugggaauuucagcaacagcugaaaauuucccucagagcuguaacacuuucacacagcucaagauaaaaugaauggggagaacagaacacagcuugugauaaaaaugaauuaggaggagagaguggugucucuuagauauaaugugagggaacaugaugccacugauaaucugcuugaagaugguuaaaaauggcaaauauuguguauauuugcuagaauaaacaugaaugaaaccuuucuguccacuuggcaguggugauguggccuuguaccuuaggccguuugaaaccaaguguuaaaugugauuuaaccacuggcuuuucuucaguuuuugggcaaaauuugaacaggauuggaaugcccgugucaccuuaugauaauguuugcauaaaugauccuucugguacaguuacucuuguuuuuuacagacagagucauaucuacuacgauggguguccacaaugcacaaugguaagguauuuuugggaaguuauauuucuuuaacaccaaauaugagacugaggcaagcgaagucuaaguuuagcacuuccuuuauggguacaacagcuucggguuuaaagggcgaauauauuaguucaucauguugugauguuacuucauggcuuaauggcuguggucucucugggaaaagaaugguauaagacagugaccaugccaauccuccaguuaaaaagaaagcacucagcuguguuucaggcuucucaccuguaauugcugcacuggacaggcugagagcagccugagcuacaaugugaucccuuuucucaauaaguauaugagagaauuucuuuuuaagcuaguggcaugacuugcaucucguuguugaauggagauaaugaggacugagaagacuuugcuacuuagugaacgcaguaaaggagaagauuggaaucuauagacaauaaaugcacuuuuauaaucuauguggcauagucuuuaauaaugcauugccaggagaaccuugagacugcacaacugauuggacuacagagugcuuuuuacagcacgguauggaaaggcucaagcaguuacgucuggauugcaacucagaugauauggguuuuccaaguggcaaagcauuugcucggaucagaagcugucagacaggagacgccccuccuaccgccacacuucugagucacuccuguagaguguaauuacauaguaucgagugacagcaaugacuugacuucauggcuuauucuccucucagugugccuagagcuuaccaugguguucuguaaugugguguuuaugcuaauuacuaccagcuuugccauagcaaacgcaccagagagacuaacucauaugucuuaugauucaaacccuaucacuaguccugaccuucuagcucauuccagccacggcucuguggcucacaucagagcuuuucauaggaagagugaugaaccgccuucuucaccauagcugaaacagaccucugcccacuuccccuuucccuggguacagagaucugucucucgaaucuggguucucaggauggacucaccaagccuagaaucccccaguccuacuggaugcuuucuugugucucccguagaguucauguccaugugccgauuggguuuccaaauacuucucuauuucaaaaugauuuccaacuccaaggaaaagucagacauggacaaaaagaagcauuacuucuagugagacuagagaaagggaucaaaacauacuacgaauggaauaaaggagggcugucaacuuuagauuauuugaugcaugacagucuuugcaaauauuauauaaaauagucaugcaacaaauuuaaaguuauuuaaacacuaauuuacuaugaauuaaagccugcauaaaagaaaacauucuuaccuguaucaaauaaaacuauugccguuugu

SEQ ID NO: 93 - RNA, 1244 nt, Mus musculus
uuucucuagcuaacugaggaguaggcgauuagugauuuuaaaucuguuuggcguaagcagauugagcuaguuauaauuauuccucauagggagagaaggaugaagggguaugcuauauauuuuguuagugggucuagaauaauggagaugcgaauuauuccguaacuaccuaauuuuagaagaauagcugcuagaauuauugacccagcaauuggagcuucaacaugggcuuuugguagucauaggugaacuccauauaaugguauuuuaauaagaaaugcuauuaugcaugccaaccauaguaaguuguuagaucaugaagcgucuaagguguguguugugaaugauaaaauuaugagguuuaggguuccuacaugguuuuggauuaagaugagggcaauuagcaguggaauagaaccgauuaggguauaaaauaggaaauaaaucccugcguuuaggcguucaguuugguucccucaucggguaauaauaauaaguguugggauuaagguugcuucaaauaaaauauaaaauauaauuaguucaguugcugaaaagguuaugauuaggagaauuuguaagcugauuaguauugagauguagaguuuuuguaguacguuauuaucuuuuuuuaggugguuuuggcuagcuauuaauauuaguggcaguaaucaggcuguuaaaauaauuaaugguguggauagggggucugaggagaauauauuugaaaaguuuuuauaauuuucgucgguuugucauagaaguguuaggcugguuaaacuaauuagaaaacuauaugagguuacguuuguucagguuuuuuuagggcuugauagucagguuagugguaguagcauuagugagggaagaauaauuuuuagcauuguaguagguugagauuuuggacguaaucuguuccguacguguuugaaacuuuuacuaguagggcuaguccuacagcugcuucgcaggcugcgaaaacuaagauggugauggggauugguauggagcuuauggaguuggaguuuagggaaguuacugaaguuauaauaaauaaggauaauacuaugccuuccaggcauaguaauguggauauuaggugagagcgaaauauaagugucccuagaagugauagugagaaggcuauggugagguugaagaagguagauggcauauugguaauuaugaacaucaucauaaucuaaugagucgaaaucauuaauuuuuuuuuaaacuaauuacca

SEQ ID NO: 94 - RNA, 1244 nt, Mus musculus
ugguaauuaguuuaaaaaaaaauuaaugauuucgacucauuagauuaugaugauguucauaauuaccaauaugccaucuaccuucuucaaccucaccauagccuucucacuaucacuucuagggacacuuauauuucgcucucaccuaauauccacauuacuaugccuggaaggcauaguauuauccuuauuuauuauaacuucaguaacuucccuaaacuccaacuccauaagcuccauaccaauccccaucaccaucuuaguuuucgcagccugcgaagcagcuguaggacuagcccuacuaguaaaaguuucaaacacguacggaacagauuacguccaaaaucucaaccuacuacaaugcuaaaaauuauucuucccucacuaaugcuacuaccacuaaccugacuaucaagcccuaaaaaaaccugaacaaacguaaccucauauaguuuucuaauuaguuuaaccagccuaacacuucuaugacaaaccgacgaaaauuauaaaaacuuuucaaauauauucuccucagacccccuauccacaccauuaauuauuuuaacagccugauuacugccacuaauauuaauagcuagccaaaaccaccuaaaaaaagauaauaacguacuacaaaaacucuacaucucaauacuaaucagcuuacaaauucuccuaaucauaaccuuuucagcaacugaacuaauuauauuuuauauuuuauuugaagcaaccuuaaucccaacacuuauuauuauuacccgaugagggaaccaaacugaacgccuaaacgcagggauuuauuuccuauuuuauacccuaaucgguucuauuccacugcuaauugcccucaucuuaauccaaaaccauguaggaacccuaaaccucauaauuuuaucauucacaacacacaccuuagacgcuucaugaucuaacaacuuacuaugguuggcaugcauaauagcauuucuuauuaaaauaccauuauauggaguucaccuaugacuaccaaaagcccauguugaagcuccaauugcugggucaauaauucuagcagcuauucuucuaaaauuagguaguuacggaauaauucgcaucuccauuauucuagacccacuaacaaaauauauagcauaccccuucauccuucucucccuaugaggaauaauuauaacuagcucaaucugcuuacgccaaacagauuuaaaaucacuaaucgccuacuccucaguuagcuagagaaa

SEQ ID NO: 95 - RNA, 2474 nt, Mus musculus
uggggggggggcaggaauuacuuuuuuucuuguaaguuuaaguguuuuagaccuagccucuaauauuacuagaaaagcuuugaaguaguggucuggcuguauaucacauaaugaccuugaacuucugauuguccuccaccuccugaaucccggagucauagaccuguucugcuauuccuaguuauaagugaugcuggaauuaaacuuggcuuccugcauucuaggcacuuuaucaacugagucacaucucaagccagagaacucugauaauaaucuuguucauguuacucgauccccaaacauaauguccuugucaagaacacuguucugugaugcuaugaugauacauugcauuuuuauagaacuagacuuuuuguuuuguuuucauuuuguuuuguucuuuuuggauggauguuugguugguugaucuggauuuggaacauuuugcuuuugguuuuguuuuuaaaauaggaccucagacaauggcugagguuaccucaaacucaauggguaaccuaggcuggccucaaacuuauggccuuccucuuuccuuaugcucauauguuuugauuacaagcaugagcuauaauaccaaguucauuuucauuauuuuuaauaaugcuugacacauagagcuauuaaauaaacgauuagcaaggguauuccuccuguugaguuucuagacuacaaauuccucuaugauaaauacaauaugcaagguucuaguugguagcagggaugugauucccaguuaggcagggaaucacgugcuggguagcagcauccaguggcacagaugaaauuagaaaacaaguuucccaaugucacaguuguaaauuaaaaaaaaaaacagauaaaaaaaugagcuuuaugcuggaggaagacauuuauuguccuauagacucugcagaugcuggcacagcagaaaugaauaugagaaaugaauacuaugcuuuugacggggaccauaagaacaucuuaagcaugacuucaaagagaaggaaaaaguaagaguugugucugguauuuccugaaaccauuguuagaaaucuccacuggacgguugaacauauuucuauuauggaguaaguaaaaaacauuucccuccuggcuuguauugaaagagcuuuuucacacugaacacugcaaugcugggauauugauucguuuugaaagaauucaaugcuugcaaaugagggauauuaggauuaauauaaaauuaaugugcuaguuauagauacaugauuaugaggcacuccccuugccuggccuauuacuuucuuaguuaauguuuuacuuuguuuuauuucuaugcguucaugaauaauauuaccaugcucagcuuuccgacucaucucuguccucucugcacuacaacccagguucccaaaauggacccaacagugugagcacagacacaucucuuuaauacuuggcaugccuucucaguucaaagaaccccacugccuucauuaucacuucaauaaaaugaguguccaaugaacauucuuuugccuuuuuuauaggcaauaauuagucauacuuuuaaaguaugauugucucaauaucuaaaauccccaccucuucuuaaagaaauucugcuagaacaacugcauuugugugacucaacacuacaaacuuaauuagccccucuauucuuugucuuaggaacgaauuauuuagaacuaaaacuccucuuccagauuagggugaguucuacaggcaugugcacacauauguaaugaacacagggcaucugaaauuccugugaagugcuucugcugauuucuugauauaaaguuuuaacuccuaccagcaucauagauagaacuuuugcugcucuguuaaaaggauuucaaagugucuuugguaguuaaugguucacaguggguugaauugccauagaauugauagaaauugugugaaaugaugcaccuuuguaaucuuuuuccaagauaugcagcauggacuuuugggaaaaacaaucgaccauacuuacacaucucaaauuauauagucuguuuaaacagguaucuuuaguagacauucaaaauaacauucauauuuuaaagaugucuguuugccuuauuacaaauggggaaagauuauuuguguaacuuaagcauauuacuuucugaugauaugacaucucauauaaucaaugguaaugaaauauaaaucaugaucugugaaccaaacuaugauuguaucacuucaacacaccauaacauuaauguaguauaaaauaaaauagcuacauacuacaaagugacuuaauacuugagaguaaaagagaagcccuauuuaauacugaaacacgcauauccccaauccacauaaagauauguaugcuuugaaagauauauuuauauuuucuuuuaguguucuuaugagggaacaauuugguuuaaaucauaaaaauuuuaagaaggaaucuauuuucuacaaaugcacacguuuacucagacaguagc

SEQ ID NO: 96 - RNA, 1224 nt, Mus musculus
cauucagagcggaccugccgcagcgggagagcugucauuucagcaccgggauuuagccuugauccagucugcagcugaggggccacaacucagcucccacugcucuuugccucaggcuggaggcuggaacuauaguuguucaguuuuuuuguuuuguuuuguuuuguuuuuuguuuuuaaaaucacagccagacugcaauuaacagcuuauuuguucugucacgaaagaggcuuugccaggaccacugagcaggcuaccgaggucaggcguccugagcugcucucagcauggcguugggacaauagugcggguucuaaacuuuugauucguucuggcuucuuaaugcauuuauuccuugucaaguuuccccucguaggaaguucggguaagugaugggaagaaaugaagaaaagcuaccuuuguuguccguugagaagggggauaaggaagauaaauuucuacacgacuccaccguuuuauuuacuuauuguuuauuuugccucuuguacagacgucugaagaugcaucagauagacuucacaugcacaugcaggucacucgccagcuaguuuggucucuacuuguguacgcgguuggugguuugcaaaacaaguguuugaauagugugcuuauguggugggaggagacauaauggguaaugcauuugggcagaguccuccuaagggugaguugccugagcagcaggugaaguugaaugaagcaauuuuccaucauuugcucuacucccucauuugcauuuuuuguuccucuucuuguuccucuccccuggggcaauugcauagccaagaacaggauuuucaaaggaaggcuaucaugaaaacaggaagguacugaugaucuuuuauguaccagaauuguuugaaauauuaaaauuggcucuuuggcuccuugcaucuuacugcauauuaauagaaugacccucuucaaggcuuuucucuuuuaggacaagcauugaaguaacaaccgguaagggaaacaguuaaucacuuuccagcaggcuucaacaauguucccaggaacaaaucaccagggaaagcagccuggguggcauuuugguuuugugucauuucugguucauuacaaugcuuuuauucauuuaggggaaugugaaaagaaaaugcucucauaugucaaaugcaaaaucccaaacgcuguguauauagugagcauauuuucuuauuuaaaaaagacuauucugcagu

SEQ ID NO: 97 - RNA, 5662 nt, Mus musculus
caguagauccugagaucugcccugugauucugaagauggagaauauuuuccuucugaugaauagcauuauucacuuauggaagauccccugcuccauguccauaguaguggacauaagcuuugccauuaugugugguguggggcucuuuuaccuacuaauaccauuccugaaggaguauccagagucaccaccaccagggagagaaaagaacaccccaaaggugagaaaagcccugacugaaauacaauggaggaguaguccaagaaccuuaaucucacauucccuagaaggacaggugugaaauauggauuuuuuuaaauacagaaauauaagaauaugucuugcuguaaucucagguguaggauaugguaugguuucagauuguccacaguagcagccuaugauuugccuuaagcucuaacagggauaggauacuucaagcagcagauagugucuguguuugugugauguuuggaauucuggggacuuuucagaggguauaaaaacgcuaguaccuugagaggcaugcuggguuguugguuuguugcuauuggggucugguguuuguaguuuguuaaguagaguugugaagagaaggaagaagaagaggaggaagaaggaggaggaggaggaggaggaggaggagaaggaagaagaagaggaggaagaaagaggaggaggaggagguguaggaggaguaggaggaggaggaggaggaggagaaauucauauccugaagaucaagauuaaacauaccuaaaaggaacuaacccugcccccacaacuaguagaauguuguaaaacaagaacaucuccucuucugcccucuauucucuuuccucucccaccuaguguuagggaauggaaaagguagaagaaaaguggugguuaagggugaaauagagaaccuaaaaucuagcuacagacaugugagcagaaaucuccaggaguagccucacauuagucuguagggaggucagaggugagaguagccugagcugucuaccugaagcucucagaccacauguacagauuguaugaggggacaauaaggaccacugugccuccauagacagacugccugugggaauuguggggacacaggacaagcucuaagaaaguucaccuaccuucagcucaggcacuugcuuuuguuuguauuuagcuaaugugaagcagguguugagaccaaggccuucaguucagggcuugugucuuuuauggucugaggaagcagauaucaccugacaguccccaggcagcuacagaucucagcuuuagguaggauccugucugagggauccugucugagguacacugacugaggacauccaugauaagugugacauagacagcuccuucugcuguuucucccaaugagucaaaaaggaaauguguuuaugcacaguaugaaugagugaaggacagaagagagaggguucucugggaaauguggauuucaugucauccaugagcauacagagcaggaagcuugucuacuaaugggaugaagggaccccagcucauauguauuguuucuaauuggcaggugguacugagggagcagaacauggccaggaagaaaacugcuaccauaaaagcuuucagaagcugccaaaagaauucgcaggauacucagaauguaccacaaccuauggaaaggcccauucauuguccuuuacuggacucuucuccccacccacuuugguacucuaaggagaaacugaauccgcuuccccucccucagcuguuuucuuaucucaaguuuuuagaaguucuuauacagcagaaauuuaaccaacuuuuauggggcauauccucugugaucucugaggcaguuguggcuacugccugggcguccaggaaauccuccucagggcauaaaucugucagguuuacugaugcaugugacccuguucaagcucuaccucuggcuaaagaaccuccacagcuuuuccaggaccagcacuugccccaccaacuucugacaccaagcuugguagguguaacaggaguucagaaacuagaaaaccucccaagcucaauaccaaaccaaucacguccuucaucccagagaagagccaauagaagggcacauccuacugcugagguagggauacagacaucccuuccaaauguaaaagaaugcucaacacacagacuagauuggaaagacauugcagguuguaauguccaaaauugucaagcagccauuagccagcccacugacaacucguccaggggcacccugccuguuaaaacuaucacaucagccuucauccuuccugagcauuaucaaaugauccaccaucauaagaagagacaaccugaagagaaggcaauuaaugagggaaaacaaaaaggaacccaugucagauucuguccaucuagugaacugacacagcuucagggaacuuuccaaccaaauggugaugguuauugcaagaaccugccugaacccaaccagccuggccagcccucuauccucaacuccaaaagcuacaaguugagccagauggcggggucugugcccacagggguucccuuaaagagggccuuagcuaauucugauaugcuuagcacauucaagaagaaucccaguguuggggccaaagaucugccuuguacuucaagcugcacuccugggaacaguuuggaauccaggaacucugugcugaggacagaugaucugcuuuccauaaacaccagcaaggaucuuuccuuccuugauucaaacacuaaaaugaagcuggaauucagcaucaugcggcauuuugagaaauguagaaggagauuacucgguguuuccaaggcugaauauuaucccaaagcugccuugauccuggaaaaauugcaucaccaagauccaggagggauaaggguagaaacuguaucaucuuccagguuggaacguccucuguuugaacauucaccucaggagacccaaaaagccccuccaacugcugccaaccauggacccuuaacaucccaucuagaucaacagcagagaaaccagaauguucagccccauacuuucuguuuccaugcaaaaccccagcagaacagaacaauucaaggaacugggagaggcuaccugcaaucagacaccagcccaggaaugggcaagcaugcacccuggaagcagucugaagauguacccucaggacauuccugcuugagugcaacaacugugggcccugaauacagagucccaccuucaauggccaaacuaaccaacacauuggagguaaaagaagaccuaccuccugcauggagggugagucugggauccagugagauucccaaugggcaagccaucaauauuacucucaaggacuuugagucuuuagaugccaaaagaagcccaggccaucuccaaaaaccuacugcucaaaacucaggggacuugguucuaaaaauaaaauuagauaauaacauugacuuaaaaccaaaugagcauccacagucuuggccugugagucaucacccagaugcccccaauacaguacacccugccaaggucagcuuaccuucacagaacucacugcccaacuuucagaauggauggcaaaaccucaagacuucacagggauuagguaaucucaugaguagugaucagaguguggagacuagggaguucagauuccacaaggauaggauugaagcaaagaaugacaauguauuuccuccccuugaagugaggaccacuguuuugaaaucugagagcauaagccagggagaaaggcuugggagaguaaguccuucuaucccgagcuccauccagcucaaggauacagccaagcuugagagucaguccucccuuaauauagcaggaaaaagggaggcuccugcuauaaguuccucgaagaauaucaccagaaauauugcacaauaugaaagccucagcaaaacauacaaggggcagggggacucuuugaggaaugaaauuccccgaccaguuacagggcuacaggagguaguagauagagaaaaucucuucuacaguacagcaguugaacuacaaguccucauuaauucucugcuccagaaccuggagaaaaauguagaugacacauccaaacuccccauagauccugugacccaaggacaagaggauaaaguggaaucauuggcauuucaaaugggugacuccaccuacacuucugagugucucuaugacccaaaccacagcagaccagcaagaagaaugagcaguggccacaccagcucugagaaacacaaccacacuuucucauucaguggaaucggagucaaagcacagucaggcauugaugcccagagacccugugacaaacaucugaaaaaagcaaaaagaagaauggacuuuguccagcugccuacucccaugggaaaugauuauccauguuguuacaggggagauggaaacaagcaggagucaggucuugcuaaccagagaucgugugaccuaggccaaaguagaagaaaaauuggaaugggagacucuccacauggaggcuccaaggggcacaagcacucauucagauacacaggaauuagagacaaacaggagccaguuguugaccagaaaaucuuugauccacaucaaaauacaaacaaaggaguggacugugauccacuaaugauucucaaagauaaccuuccagucaaggacaggggagcuggaguccaggagcagucagcucuugcugcccagggacccuauaacccagaugaaaugagagcaaagagaggaaaggaguguucuccacauauaagcccugagaugcauaaccauucacucagauacagagaaaucagagaugaaucacagcccaauguuaaugcccagagagccugugaccaacaucugaacagccagaagagaagaauggccuuugacaaccuccucacuccuaagaacaaccauucaugucagcacaggguaacuagagacaagcagcaguuagggcuugaugaccauaaauucugugacccagaacaaauuagaaugaguggaaugggacccuguccacaaagaagcccuaaggagcacagccuuucauucagauacaaagaauuugaagaaaaagugccgucuuguguuaauacccagggaacccaugaugaacauccaaacagugugaagagaagaggcuuugaccacguccccacugccacggggaacaaccauucacacaauuacaaaguaaucagaggcaagcagcagucaggucgggcugaccugagagccugugacccaggucgaauuaaaaagaaaaguggaauggcuggcuguacacauacauguccugauggguacaacuuuuuauucagguacagaauaauuggaaauaaugagcaaccaggcauuguccuuagagccugugacccacaucagaauacagaagaaagaaugugccauggucaaccugugagucccaaugugaaccauuuggucaagcacaggaaaaauggaggccaacaccagucagguguuacugcccagggagccucugacaugagguaggccuuaccagcaaaggccaaagaauggguaccucaagccauucagaagaugucccaucuccccagucauuguuuuccccuauugguacuuggcaauaaauguuggcauuuuuccugaaauacauugcaauaaauacugacaagaauccagac

SEQ ID NO: 98 - RNA, 511 nt, Mus musculus
gccuuuuauuuauuuauuuauuuauuuuuuuaaccaaaaacaucuuuauuuuuuuuagucuuuaaaaaaaaaaagaagacaaaacaaaacucuucuuuucccaaaauaaccaugauuagcuuagaaaaauggauguauaucuucaaagaguuucccuuuaacggaaacuucauuuauagacucuaaauguuaaagguuugaaaacaacgucgaggaaauccauucauacuucaggcccuucuccucugggaaccagcauuguuauauuauuuccauuuaguagaauuugaucuaauuuuguaauucuucuuccuucugguguaauuucaaauucugugacaucuuccaacaccauauugacaaagucaucaaauccuagaagugucccgacaauuucuuuaucacucuucaucacaaugugaauucuugacccuauacauuuguccacaagcucuaguggcaggaguuggguucguggucgcguuagccgccauggccacgccagaagucu

SEQ ID NO: 99 - RNA, 511 nt, Mus musculus
agacuucuggcguggccauggcggcuaacgcgaccacgaacccaacuccugccacuagagcuuguggacaaauguauagggucaagaauucacauugugaugaagagugauaaagaaauugucgggacacuucuaggauuugaugacuuugucaauaugguguuggaagaugucacagaauuugaaauuacaccagaaggaagaagaauuacaaaauuagaucaaauucuacuaaauggaaauaauauaacaaugcugguucccagaggagaagggccugaaguaugaauggauuuccucgacguuguuuucaaaccuuuaacauuuagagucuauaaaugaaguuuccguuaaagggaaacucuuugaagauauacauccauuuuucuaagcuaaucaugguuauuuugggaaaagaagaguuuuguuuugucuucuuuuuuuuuuuaaagacuaaaaaaaauaaagauguuuuugguuaaaaaaauaaauaaauaaauaaauaaaaggc

SEQ ID NO: 100 - RNA, 4138 nt, Mus musculus
caguggcuugagauccugccuaugauucagaagauggagaauaauuuuccuucugaugaauagcauuauugacuuauggaggauccccagcuccaugucuaugguacuggacaugaccuuugccauuauacuuggaguggggaucuuuuaccuacuaaucccuuuccugaaggaguauccagagucaccaccaucugggagcaaaacaaacauccgaaaggugaggaaagcccggacuaacauacaauggagagacauagaaaguaaccagaguuguuacuuucacauucacuagaaagcauguuuagcuaaaauuuugggcacuuuuuuuuuuaacacagaaauauaaaaacauguuuuguuuuaaucucagguguggggauugggguuguuucagauuguccagaguagaugacauugauaagccucaagcucucucaggggcauguuuuuugucagcaguccauaauuucugcauuugugugaagauugauuggaauucugugaacuuuucaaagguucauaaagauuagagccuucagagccaugguggguuauugguuguuugcuaccuguugcugguguuugugguuugcuaaguggacaugugcaaagaagagagaacaacgaggaaauuagauaucccaaugguaaagaucaaaugugccccaaaggaacucagccucccuaaucaguaggaaaugccuaucaauaacaucuccuuuccccucuaucccuuuugucucucuuaacuaguguuaggggacugaaagaauggaagaaaagggguagggaagguuggaagaaagaagacccuacacauuugcuaaagacuagguauagacacaugaacagaaaucucuagaaggaauauccacacaucagucugcaggaagaacagaggugagaguagccugagcugucugccugaagcucccagaccauaugaacaggguggcagaggugucauuaaggaccacuggggcuccauggacagauugcauuccugaaaugguggggacacaggacaaguucugagaaaagucaucugcccucacuuaggcacuugcuuuuguuuguguuuggcuggggcuugaguccacuuugcucuaaggaaguggguaccaccugacaguccagaggcagcugcagagcucgguguugggcaggauccugucugaggaacacuaacugagcacaucugugguaaguguggcauagacagccacuugugcuguuuucccaacaagaccaaaaggaaaugguuuauauaugguaugaauaagucaaggaugagagagagagagagagagagagagagagagagagagagagagagagagagagagaccgaacucucugggauauggggauuuuaugucauccaugagcacacagagcaggaggcaacuugucuuccagagggacgaagggacccccagcucauuugugucguuucuaauuggcagguggugaagauggggcagaggaaggccaguaaggaaacugcuacuuuaacagguuacagaaacuuccaaaagaaugcacaggaugcccagaaugcaauauggccuguggaaagcccaacucaguaucauuuacuggacuccucuccucauuccucuugucauucuaauaagaaacugaaacaacuuucccuccuucagcuguuuucuaaacucaagguauuagaaaaccgcauacagcaacuuuuaggaaguauacguucugaguucacugauucaacugugccuacugucugcaacuccagaaaauccccaagcgaaaguaaaacagugagguuuaguaguaaacuugacagugcccaagcucuagguuuagcuaaagaaccuccacaguuuugucaggaccagacauuguccuaccaaccugugccaccaagcuugguaggugugacagagguucaggaacaagaaaaccucccaagcucuauaccaaaacaaacaccuccuucuuuucaguguaggguccguagaaaaguccuucgcaacacugauauagggauacagacaucccuuccauacauaaaugaaccaggucaaccugagcugaauuggaaauauauuacugguugugauguccaaaaaugccaaauagccuuugaccaacccauugacaacuuguccaagggcacccugcccauuaaagcuauccagucagucuucauccuuccugagcauuaucaaauagucuaccaucaugaggacccacagcaggaagagaagguaauuaacaugggagaacaacaagaaaaacaugucagauuccucccaucugaggaacagccacagcuucagggagcuuuccaaacaaacagcggugguuauugcaagaaccugccugaacucaaccagccugcccagcccuccauccacaaucccgaaaaauacaaguggagcaagauggugggguccgaacucacagggaugcucuuaaacaaggccaaaacaaaguuuggcacaccuaacaccaucaagaagguccucaguguuagugucgaagaccugacucaggcuucaagcaacaccccugggaagggucuggaacuugaaaaccuucccaugaagagagacaugcuguccacuaagaacacaacugaagaccuuuccuuccuugauccaaagacucaaaugaagcuggaauugaacagcaugcaguuucccgagaaacacagaauauugcccaguguuucuaaggcggaauauuauucaaaggcugccaggauccuggaaaaauuacaucaccaggauccaggagggacaaggauagaaacugugcauucugccagacugcgacacucuuuuccagagguucaggagauccaaagaaccccuucaccugcugccagccaugggcccucaaagucccauucagaucaaggggagagauauuuuaauguucagccaaaugcuuucuggucccaggaaaaaccccagcagugcaggaguauuguaggaacugggagaggcauccugaaaggaaguaccagccccaaaaugucgaaacaugcaccauggaagaugucugagcaugugguuucaggacaucucagcuggaaugcaacaagaccaggcccagaauacugugcccccucuucacaggccaaggaaaccuacacauugaaaguaaaagaaaagacacacgaagagaggccagggauuuugaaacguggaggcauaaacucuuugaaagaagaaaguccccuaccaguuacugaacagacaggcaagguaguagauggaguaaaccuugucuaugguaguacauuugaauuacaagcccucauuaaugcucuggcucagaaccuggagaaaaguguagacaacccaucaaaacucaucauaguuccugugacccagguacaagaggauaagacagaaucaguggaggcauuccagcuaguuggcucuucucacuacucugagguccuccaugaaccaaaccauagcacacuaggaaguggaaugagcaguagccacaggaguccugaggagcacagucaacauuucaaguacaacagaacugaacauaagcugcacucaggcaucaaugcccagagagccucggaacaagaucagaucaaagugaagggaggauuaggcuuuuuccagcuccccacucccauggggaaugacuauccuuguaguuacagaggagaugguaacaagcagcaguccggucuuucugaccagaaauccagugacccaggucaaaguggaauaaaaauuggaaugggagacucuccacauggaagccccaaguggcacaagcacucauucagauacacaggaauuauagacaaacaggagucaguuguugaccauaaaguuuuugauccacaucaaaauacaaagaaaggagugggccgugguccacuaaugauucccaaagauaaccauccagucaaguacaggggaacuggaguccaggagcaguuugcucuuguugcccagggagccuaugaccggagguagaccuaccagcaaaagccaaagaacaaguaccucaggccaaacggaagaugucccaucuccacagucauuguuuucccuuauuguuucuugguaauaaaugcuggcauuuuuccugaaaauaaaaaugaaaaauugcauaaaua

SEQ ID NO: 101 - RNA, 1431 nt, Mus musculus
auuauuuuuuuuuucaauguucaguuuccuuuaaugauccccaucucccuugaaggguaggugcaggcagcuaggcgacuggcaagacuuguucacuugaagaucuugccuugauugacggcuuugcccacaugcuagaagguccccucccaggaaaaguacucucgaaccagggucuggguuuccuuuuucccaggauccaguuuccgccauguauacgacucauaguccaccugccaaucuggacucagcagaaaggcaagcucuuggccucggaagacccaaacaccagaaauggagcugcuguuguugguuccaaagaggauaacacuagcaaaggcauccuuccucaguuuguccaaucgcugaaacaucccagugaugagguugcaacucauuaaggucuggguaagcucuucagggaagcgguacucagcauaccacagggaccagccaucuuuaccgaagugcucccaaaaauauggcagcgccacagagaggcuguccucauuggaguacuuacgcuuaaacucauccaacacaaagguacucuugggcaggugagcgaaaggguccuuggccuugggcucagcagccagugccugcucacacucauccaucucuuccucaggagcuggggcagcugccuuuuuuuccuccuuccgcucagccugggguuucuguuucuccucucgugaacccuuaucuuuccuugggguaucuuuuuuaggcuggcucucugcaaacuucuuagcaucaaacugagccaucuucucgcacagcuucaccucccccaagauagcccugaacugggacugguuaaugcagguaaggaaccaccaguugguauuggggaaggccuggcgaaaagaaggcucuaagaccuguuuauagagccacaacaggguacagacaacuguaauaucagccagugucacucgcucgcccaccaguaaaguucgagucuucaagugaguguccagcagccccaggauucgcuucaccuccucuuucgcauuuucaguggccugguuguuguggugcauaaugcccaagguggggaacacccagguacuagcuggaggaacgaugucacugucagcaaaacugacccacugcaccaccugagcugcugccucuggcguacuuccucgaagcuccucauugcuuacauaacaggcaauggcauugcucucaaacacacagaauccaucagcacccucaaaugcuggaaccuugcccgcaggaaauuuucggagaaauucaggggugcgguugguuuggccaaaguggaagugggguggugcggagagcacgcggaccugagccccgcuguacugagcagcgaugagggccuugaaggcccuccaauuuucaggguauguguacagggucccagccgccauggugauuccgcagagaaagccaauc

SEQ ID NO: 102 - RNA, 1416 nt, Mus musculus
ucaauguucaguuuccuuuaaugauccccaucucccuugaaggguaggugcaggcagcuaggcgacuggcaagacuuguucacuugaagaucuugccuugauugacggcuuugcccacaugcuagaagguccccucccaggaaaaguacucucgaaccagggucuggguuuccuuuuucccaggauccaguuuccgccauguauacgacucauaguccaccugccaaucuggacucagcagaaaggcaagcucuuggccucggaagacccaaacaccagaaauggagcugcuguuguugguuccaaagaggauaacacuagcaaaggcauccuuccucaguuuguccaaucgcugaaacaucccagugaugagguugcaacucauuaaggucuggguaagcucuucagggaagcgguacucagcauaccacagggaccagccaucuuuaccgaagugcucccaaaaauauggcagcgccacagagaggcuguccucauuggaguacuuacgcuuaaacucauccaacacaaagguacucuugggcaggugagcgaaaggguccuuggccuugggcucagcagccagugccugcucacacucauccaucucuuccucaggagcuggggcagcugccuuuuuuuccuccuuccgcucagccugggguuucuguuucuccucucgugaacccuuaucuuuccuugggguaucuuuuuuaggcuggcucucugcaaacuucuuagcaucaaacugagccaucuucucgcacagcuucaccucccccaagauagcccugaacugggacugguuaaugcagguaaggaaccaccaguugguauuggggaaggccuggcgaaaagaaggcucuaagaccuguuuauagagccacaacaggguacagacaacuguaauaucagccagugucacucgcucgcccaccaguaaaguucgagucuucaagugaguguccagcagccccaggauucgcuucaccuccucuuucgcauuuucaguggccugguuguuguggugcauaaugcccaagguggggaacacccagguacuagcuggaggaacgaugucacugucagcaaaacugacccacugcaccaccugagcugcugccucuggcguacuuccucgaagcuccucauugcuuacauaacaggcaauggcauugcucucaaacacacagaauccaucagcacccucaaaugcuggaaccuugcccgcaggaaauuuucggagaaauucaggggugcgguugguuuggccaaaguggaagugggguggugcggagagcacgcggaccugagccccgcuguacugagcagcgaugagggccuugaaggcccuccaauuuucaggguauguguacagggucccagccgccauggugauuccgcagagaaagccaa

SEQ ID NO: 103 - RNA, 388 nt, Mus musculus
agaggaggcggcggcggcggcgguggcggcggcggugguucccgcgcgcuccgggucucugaggcugaggguacugcggggcugacuagaacagagacaauguuucgagcagcggcgccugggcagcucuggcgggcggccucauugcuccguuuucagaguaccuugguaauagcugagcaugcaaaugauucccuagcacccauuacucuaaauacuaucacugcagcuggacaucuuggaggugaaguguccugcuuaguagcuggaaccaagugugacaaggugguacaggaucuauguaaaguagcuggcauagcaaagguucugguggcucagcaugaugcauacaaaggccuucuuccagaggaacucacacuucaauaac

SEQ ID NO: 104 - RNA, 388 nt, Mus musculus
guuauugaagugugaguuccucuggaagaaggccuuuguaugcaucaugcugagccaccagaaccuuugcuaugccagcuacuuuacauagauccuguaccaccuugucacacuugguuccagcuacuaagcaggacacuucaccuccaagauguccagcugcagugauaguauuuagaguaaugggugcuagggaaucauuugcaugcucagcuauuaccaagguacucugaaaacggagcaaugaggccgcccgccagagcugcccaggcgccgcugcucgaaacauugucucuguucuagucagccccgcaguacccucagccucagagacccggagcgcgcgggaaccaccgccgccgccaccgccgccgccgccgccuccucu

SEQ ID NO: 105 - RNA, 71585 nt, Mus musculus
cagcccccggaacgguaaacaguggcgucacgugacgcggccccgcuccugcucccgcgccgccgccgccgcaagccgauggcugcgggcucucgcggcgccgcacaggcuccacgaggcgagcgacccccgggcucagggaagcagcgacugcagcucggacggggagggcggagcgcaggccggccguagugucgucaccgcggcggcgcgggccggggagccccgagcccaggcagcaacgccgacgcccugcgcgcacccccuccgcggcccccuccuccgcggccccgcggccuccaucuuccucuggcugccgguggcagcgcucgucugcggagcgggugaguggcggcgcccgccgcgacgggcacucgguggccucccuccccccacgcgggcggcccggguccuuuccccgcacccccaccucgcgcagcggccgccugauauucccgggccguucggccuccccggcucgccccgccccgccccagccugccccgccguuuggaccgcgagcccgaagcggcggugacggcgcggccuccgcgcgaucgccgggccucggcucucgcccgcgagcgugccgggucucugucgccgccgcgcgggcaggcgucgcggacuacuccggguuccaaggccccgggucuccggcgcgguggccgcagcccgcucgcggagccuggcagccggccaggguccccgccgaggccgacccgcgcccgaggccgguccccguccccgcauccggggugucugaggcugcggaucgcgcgcuuuugugcuggggaccgggacugugggccggcuccuuuugacuaguuugaaaugggaagcccgaagaguccugcuugccgacaggacguguaauuuaaugaaccacuagucgauaaguacguguuaauggugcuaaauaacugaucaucugacaccgggcgggggugggguacccagggagaggagagaguguuguagcucgcuccagccagaggcucugucccccaggugccucuucucccugucucuggguagcuaaaugagguuuccuaguuguuacaauuugaauguguguuuauuauugcuauugaguaaccauuaguagagcgccguugcgguuugagggagguagcagugcuuuaaugucggcccgauguuagucuucauucuuccgacaggucuuuuuaaaaaaggaucgaacaaucuagacuugccccacauuaugaauuuuguuaccuuauuuuacacuaaaaaaaaaaacaaaaacugaucacagcaaauuguacugcuguauuuaguucguauuuugccaucaaacuuugucuuguguuuucaauuuccaaaccaacaucucgguuccugccuucuuaaaaauucuuguguuuggcauuuugaaaacguagguuacauuuaguuguuaaaaagacagaugaaacaggaaguguucuguuguagcauccuuauguuuuuaauuuauagugcuauuucagagcacagaagauguugagagaaaaaccaguuauuucaaacagcaguccuuagcaucugacauacuuaggugguaguuuuucuucccacuguuuucuuugcccgccauuuguauucacaauaauucuuaacuccucuuugucauuucaugaccacuuacuugcaugugagaacucuaguuuucaaugacaacagaauugaggaaccuuugcucugaugaagccacagagauaauucauuagcagcagaaagacuuguugcauaggcgaaaugcgccauuuaaaaugaauuaagaccggaaauuuuaaguuuuauuuuuauaguugugccagugaccugucaagaggacaaguggcucguugguagggcugaaguuuucuccugccuguuguacacuuuauugguguuuccugaagagcgugugugguguaauugguuagagugcucaugcuuccuaguggaagaacagugugcuuaccuaaugcaccacauuaguuauauauggguaagcuucuuagguacauuuguaugcuguauauuuucauaugccauaagaaaaaacuggccuauaaauguagguaggaauuaaguuagauuaagaauuuuaggccagagaaguugaaacuauuuuagcuaaagcuacauuauuaaaauuuuaaacuuauauucuguuuuagaaucagcgaagugaagaaaaguuugagagcuuuuggucuguauauuauuggcaaaaguuggaaggcagcaagugacaguucauuauccaaucauaaaauccuauuaagaguuuagauuuuuggagaaucauacauauacacagguguauacauagggagacacagacacucacacaaacaugcacauguacacaaauguacacauugaauuugaugucagaaaguuugaaagcauuauauuggagggcucugcugugagccuuuaucauuggggagagcagcugccuugguccaggggagaaagugaacuugcaaacaaacaaacaaaaaaacaaaagcaacaacaacaaaaagcaaaaauaaaauggagaagaggaaggccaguuuucagguaggaaaauaauaacucacacuugugcagacagcauuguauuuacacugcuauguucauauauauggcugaggauagcuauaaaugggauccagcacagauacaaacugagagagagagagaaagagagagagagagagagagagagagagagauaguuuagauguuuauuuuuauugagauauuuagaaaacuucuuuauuaauuaaaagcaggccuacauuuuuguuucaggugucaaaauagguaauaacuggauuccuuggcaaggucauacaguguuucuuuucugaugcauuuugcuuucuuuucuuuuuucuuuuuguuuguucuuuucuuuuucuuuuuguuacaguguuuuucuuuguagcuguggagguccuggaacucugcagaccaggcugacaucacagagauccaccugccucuauugagcacgcugggaguaauuguugcuugauuacauguacuaggggauagcagagcacugguuugauuaaaaguaucugaaaccaagcagcucugaccaaaaaacaggauuuaaagacauuagagaagcaaucaguguauuaaaauuuaaggaggcaagucaaguguuaggaaaacauuguaugaauugccaaguaccauacauuauguuuagacaauuuuuuuuuguuagagauaaguauuauuuaaaacaguaucucacuacauagccuuggcuggccugaaguacaguguauagaguggugggcucaaacucagagaucugccuguauuggugggcaccuccauacuucaggaauuacauuuuugaucauuugcacugugaagaaaagcucuaagaaaauaguugagacuuaaauauugcccagaaguuuucaucuguugacauaaucacauauaucagacaguuuugaauggcaugauagaugacauagacaggcuaagcauaauacuguaauugguauuaguguggguggacaugugaaaccaaggaguagggagaaaauacauucagaacuucagcugggaaguuuacuuuccuccagacgaugugugcauaugcacugaguguagccauacuacuuuuuauguguauaguguggcaaaguacauacuuccugcuuuauuuuuaaagaaaagugggguauuugcuuagcaauuuuacagauuuuguuguguuauuaaaguuauagaaacaauguuuuauguaaggagagugcauaaaauaaaauguagaagugcuggcucagaaaucaugcugccuguauuguauuuugaggauauuggguaugugagcuuuggaaaauuacauaaccauuugaguuugaauugcucuucuauagaagagacauacuaauuguacccacuuuacagacucugauauuuaagugcuaaguguauguuggucuggcuguuaguacccauucuaugacgguacuucugcacuuaauucaaacuuguacugcuguugaaugcuauguaaaagaugaaaugaugguaaaauuuaaaaagaacuuuuuccuuuuacugcuuuugacugguccaguucugauuuugccagguucggcuucugccugcuaguucuuucucuaaguucauaggucugcuuuagucuuugggguccucauaggcagaguggcauuuaucuguuuuuuuggguaaauucacacagacuuaaucgucauguuucccuuuaugagguuuugcugguagauucuaauucauauaacugaaacagaauuugaaguuuguagagcaguuacuuauaggauuguaccuaaauauuucaguuuucuuugacuauucuagaaggauaaccuaguauuuaucuauagauuuuuuaaaaauuuaaaauaauuuaaauuugugugggugcuuugucugcauaugugccugcuuccuacagaggccaaaagagagucucaguuccccugggacuugaguuacaguucuaagcaaggaugugggugcugggaauuggacguggguccuguguaaggaauagcagccaacucuaccuccuuauccaugauguuuuuauaucacuccuuaagaaaugaccuuaaugucauucaagugaguuuaaaacucuucugugcuuacacugaagacuagguguaacuuggaggcuguagcgccuuucuuauaaagcgauaauaaugacaguaguuccugccuaauagugugauugugaggaguagauagcaccgugccauggacgacuucuuccagcucucuggauaguaaauaguuggcaguaggauagauaggucaguguaguaaaucuugaaugggcuauuucucaaggcucaguuuuuugcuccaauguuuacucuagcaagcacuuuuaucuuugcuaauaaauugggauuauaauauauugcuguaaaugaacggcuuuagaggagcauuucguggcucauauugucuguuggcccccagcccuugcaauguggacuugugugagggcauuauaguguauuuauuagauacuuguggaacccuuucuaacuguuaugacaguaaagguaucugagcauggccaaauguucuuuggguggguauaauugagaauuaagaauaauuaagaauaauuuguuccuuaugacccauaccuggaguaccuaguguagggaggcagaggcagaaggguuaacugaggccagccugggcuucaagagccugucuccuacucacagugugggaagaggucugaagccugugcggcuugacaguaaauuaggauacaguacaguuuauagucugcuaaggccauaguacuuuuucuacagcugccugguagaaauuuguucucacuaagcaugccugaucaaauugcuugauuucaaguuuaaaucaaauuuaaauaguuaaaacuauuaugucagagcuggaaagcaucaaggaugaucccuuucuaggguuuugcuuuauucuaagucuuugccuggaucacccuuauacagaauuggucacuacuucucuuuagguuugcaguaaaauguuauuuucauaguaagaccuucacuaucauauauauaaaaugcuccuuuccaauuaguauuaccauguuuaaauuuuuucaaaaguucuauaauguccuugugguuuacuuuucuauugcuaugauaaaauaccgugaccauagcaacuuauaacagaaaacaauugacgggucuuaugaguccaugauggcagaaaaagacaugacugcaggagcccugagagcugacagcuugauccaaaagcaggaggcaggacaggacuggagagugagagggaauaacuaggaauggcuugagcuuuuggaaccugagcgcccaccaccagugaccccuccuucagcgaggccacaccuaaucacgaucuaacagaggaccaaguauucaagcacuccauucagugggggccauucucauuuaaacagccgcugaauggaguggauaguuuuuguuuguucaugcuaccucuuacaugugugcauggacauguguagucugcaugagacugcugaagcucauucuguagucucuagucucucuuuuugaggcuuuuuuuguuuuaauagaugggucucuucccaggcuggcuagccaaagcuagccuugagcucugcccuucuacuucccuucagugcuggaauuacagucauauccccaaacccagcucuuggucucucaacuuugauacugguguggauuuauugaaaggcuuuaaaaaaguaauagaggaugaaauauauuuuacauagguuugcuuuagagauuuuuguuugagacuuuugauauauuugguauugguauagaacucaaccauugaccuguauuuccagacagucucacugaguugccuggguuggccuugaacacaaauguauucuguagcucagguaggguuugacuuugaaauuauguagcgcuugccugccugccaaagccaauaggcccagcuaaaaguaagacauuuaaaaugaaaucuuaaagucaguuuuuuaagguaauuauuuugauacuuuguaauuuuuuuaccuauucucuucauaccugaagcagagaaaaaaauaacauuuugauuuuacuuaauguaauuuaauuuaacugcagucuaauccucagagcauuuuaaaauuggaaguaucgcugggcguagaguaaauuuuacuuacuacguuaguacucacgauuuuaauuguguuaugagucugagugguucaguagaauggaacucagcuauugguaaugagcagcauuuuucuucucuugaucuccccucugagcuuucagaauucaggucagauauugucuacuuacuaccugaguguucaccugugauccuguguuuuguuuuuuuuuuuuuuuguuguuguuuuuuuuuuagauuuuuuuuuauuauauguaaguacacuguagcugucuucagacacaccagagaagggcaucagaucucauuacggauggucgugagccaccaugugguugcugggauuugaacucaggaccuucagaagaucaguuagaguucuuaaucgcugagccauuucuccagucccucaccugggauccuauuagcagcccuccaauauugacagucugcugauauuuauauuuuauuacauuugucuguaaucuggcuuggacugugagugcagacauugcuugguuuuccuuuguagucaguaauaaauuugugugugagugagugaauaaaugaaggaaugguuugaauuaugauuauccaauucugugacaacuauguguauuuuauuguuuguaaauaaugguugggacucugaacccagaaaucacuucagauuuuagcauguauaaucucgacuuacugaugauuuaacaguaugcauuccaugagccauuuuaaaaagacgauaaauuguguguuuugcuuaaauuaccaaugaaaggaaguauuuaaguaaaaccuugguguaagagacagaaauuuguuuguaucaagcagcuauauaauuacuaaagauucugaaaauaccuuuuuuuuuuuuaauaaaaccugccuuucuuuuacauuacuugcuauuccaauguucucuuuuguuugcaagcugucuuaauuuggaguacuuuuagauuuauaggcaagcugcaaagcaggcugagaguccuacauacccuguauauagcuuuaaugcaugcaugccacugcuuucagauguaguauuagugccucuccgagcaaacagcagccucuuagcugaagcacacuuuacucagauuuuaccggccuuuccagaacuguacuuuuucucuucugcugucaguccacauugcacauagauuaaugcaucuauuuuaaguuaguuaauauuugguaguuaacauugguuuucuaauuagcaggaauuauuuuuuaaugugcauuuugaauuuuguguuagucuugggcugcacguggagagcaccaucuccuuggagaugcuggacaaggugcugggaacucgugcgagagcagugcgugcuuuagccaagcccuaaaggcucuuccugcgcuucagcccgagcaugaguuauaguugguacugcuacuuaagagcuuuuacacuugggaugaauguucuuuucaacauagcuugaguguugcuuugcuguccacuguuuugcuauuuuuuucuuuauugugugcaaaucuaauaagacccacuuaguuaguuagccucguuaguuuauaucaauuucccuuaaaauauauuccauagaguacuaguauaguucuauggaaauugugguuuuuggacccauaaauaugggcaucuuuuuguuuucugccugaaaagauucucaucugacuggucugccaaggugucucauggagugguagcugcauaguaaacaguugaugaaaaaagaaaaaauauuguuaaagaaacgcaaccuuauuuauuauacacagucuuucuuaguguuggaucauaggaucuugacaguguuuccgaagucuagugaagaaccguacuggaaaauuaaggaguuuagugugcuuaauccuucuguuccucuguaucucucucucucucucucucucucaaaucgcucacuuuugacaugggaaauauguuguuaaaacagggucuuauugacccaggcugccuucaggaucuuuuuuuuuggggggggggggguguuuccagacaggauuucucuguguagcccugguuguccuggagcucacuuuguagaccaggcuggccuugaacucagaaauccgccugccucugccucccgaguccuaggauuaaaggcgugagccaccacacccggccaggaucuuuauguagccaaggcuagcccugaauucguggucuucuuccauuugaagaaugauaggcuauuucuaaacuauuacaauaauuaagauuuaggacauuucugucauuccuuuaacuuugcauuuauucuucagucuuucguccuuaucuucagccccagucacuaauuggcugagaaauuguuuuucaacagccuucagugagucaagucuuuguagcgccuaagcucaguauaaagugugaguagguauuuagguauggacuauggaacuggaugacuuugaggaaggccuuucaauuauuuaacuacauuuuccuuguuaaacgaguauauuaucgaauucuuuuuaucauugaggauuaaguuauacacaugcagaugaaaugcuuaccaaaguauugcauauaauauguauucaguagcuuucuaugggaacuccacagcaccucccuuuuuuagacaguaauuuagcucgugggccaggcuggccucaggugccugacccugccgacucccgggcuuacaggugugcagcaucucacccagcuuuuccucucauuuuuuuuuuuccauuuuuuauuagguauuuagcucauuuacauuuccaaugcuauaccaaaagucccccuuacccacccacccccacuccccuacccacccacucccccccuuuggcccuggcguuccccuguaccggggcacacaaagucugcguguccaaugggccucucuuuccagugauggccgacuaggccaucuuuugauacauaugcagcuagagucaagagcucagggguacugguuaguucauaauguuguuccaccuauaggguugaagaucccuuuagcuccuuggguacuuucucuauuccucucauuuuuaagcagggagauuuuaagccagguuaagaaaguuuugguagauuuagaguuauuguaaaaagcuuugaaaauguagagcacaagauauuguaggugaucagugugauuuucuaacugguuuaauuuuaucuaaaaucauucauaaaaaugauuguuuuugauaauugaggcuccuugaaauauccuuggaauaacuuugacugaaugcuuguguguugguaaaauuguguguugguagacuaauuggacauguguguaagucccacauaacucacuaaaauaaauuucaguauaugaugugauuguuuucuugucauuuaucuuguuuucuccuacaagaagacccauggagaaagugugugcacagcuuugugcauguguauauaaacuugugcuuucuuggguuuaguuaauauuucuuuaauuccacgggggggggggggggaauugucucucuguguuauuugugaauaauuuuaaugcuuuguaaauaaaacaaggcuacucuaugguuuuuaauaguuguggaccauaauuuaaguaauugaauuuuagcuauuuuauguggacucacuguaaaagcauuguuuuauucuuuaugaaaauguuaugguuaaaacacagucuuaugguugaaacaauucuuucagauaugucaaaacaaugaacuauauaauucuaaaaauaaaaaauuuaguaagacauuuaguaggauuucugguaagauauuauccuauaugcaugguaaagaaaggucauucaguaaaaauuugauccauguuuccaaauguauguucuaaaaaacagugaggguuuuuuugaacaacaaauucagaaguguguucuuagauucaaaauuauuaagauaauuugguauuaggugauuauuuucaauugauagcuuuauuucuuaugguauuuuuuuugucuuucuauaggguugaaagacacacagaagucuucauggauauaguugauacauuuaaucauuuaauuccuacugaacacuuagaugaugcccuauuucuaggauccaaccuggagaaugaagucugugaggauuuuaguacaagucaaaaugucuuagaggacucgcugaagaacaugcucagcgauaaggauccuaugcuaggaucugcaaguaaccaguucuguuugccuguuuuggauagcaaugaucccaauuuccagaugccuuguucaacagguaauucuuacuuuuuuuuuuuuuuuaagucugcaauuuaaaauaaagacuuuucagcagcaucuuuuuuccuuuucuuuuuuaagaaugaguguagugcauuuaggguucuuuccuuuaaauuuagagucucuuuucuaggcaucaguuuagagaauuucaacuacauuuucuucuaaacaguguacagaguuauugucaaggauguuauagauguagguagagugaccagguaacuuggcacaucagagugggauauuugugaggaggaaagggguugcuauuaauaauuaugucuuuagaacaugugaaaauugggacucaugcuggaaaaagagguugucuggcaaaugggacagugccauacagggccugcuagagugaggaaugaaagcugaggugacacgucuucagcuuucaucguuuucuugguucuaaucacagagacuuugauacuuuguaugucuauugcaaagccagacccaaaacuauguuguucuguacaguaacuacuagccauguguaauauuaccgugaauuaauuuaguuucaguugagaugugcuguaaagugcacauuaaauuuuggauauuugauaugaaagauugcaaaguaucuuauuaacuucuucauuaugugguaaaugauuuuaaauaauuaaaauaauuuagaauaauuuuaaagcuauuugguuaaaugaaugaugaaaacuaauuugccuauuuuauacaaaauucuuuguaugaggcugucugggucucaggcguugccucaggcuagccuccacuuccugggcucauacaacccuucugccugaguagauuacugugugccuggcuuaccuuuucuacugggauuuaccuauuuguuuacuugcuugagauugaacccaaggccuugcacaugccaggcaaauaacccaucaggucugagccuagccuguaguuuauguaagugacuucucagacauugaaacacucaugugcuuugaacaguuagaaggcagugcucuagucuguaguugaagcagcugaaagaguaaggaguaacuuucugucaggcucaaguauuuuuaaugaagugucuuuagaauuggguauaauggugaauggccauaaucccagcacuugggaagcugaggcaggaggauuuuaagaucauggccagccugaguuccauauuaagacccuaucucaaagucaagagaaccccugacuccuucccagaguaguucacagguuuaugugguacugguuugugcuaaugacuuuagacuacuccugaaauauguuuucagugucuuugcuauuuguuuuuaauauuuuuguccaguauuuuaaauuuauauaguaacugaauuuuucgaaugucuggauugccauugacucagaucaugcugccugaagaccucaacacugguuacuaggacacauuucagucacuccuuaauacucaaguguuuugaauugacauguuguuacugguguaucucugaaaugauuuguauuguguuguuaucgcauaggucauuuuguuacuuguauuauaaguguuuuaacacuuuacaauuauuuuguuuauguggcuaugcaacuuuuauuuuaaacuuugaugccugugucuguggguaguuacauaucuuuacuguuaaguacuuugauaaccuuuguuuuuccauauacaauugucugguuuaguccacaaucaggaaaaccauuucauaccugugcacauguuggaauuacagucaccacugauaauguuuggaaggaucuggaaucaguaugguuagcauuuuacuugacaguuguacuuacaaaacucugacucauuaguaaucuuaguauuucuguugacucuaugagauaucuuuuuaaaugauaauuucuguugauguaaaauuuuuuacugauguaaaaaggcuucaguuuuagggaauguuucuuuucuaguuaaagugauaaaauuccuuucuugaaauauguauuuuugaagauuguauuauacuuguuaauaaugcuuagucaaaauauucucauuaaauuguuggcuguauuuaccuuaggucuauagaaugaacuuucauauucauauguguaugauacauacuuuuuaagucaugcaggagaaucggaaagacauuacagaaacaguaaagccccuuuuaggauuguuuaaauuucacuauuugccaagcaguuaggggauuugguucauggcucuuuuuguccuuugagcuuguugguuuagucaaaaacccacugguuuucuaaugauuccaaaauggaaaacauuuuuuaauuuuuauuuuggaauaauacuaaauuuaggagaguuucaaagaagaacucuuaacuagaaucuaaugaaaaugccuuauggagaguaacuuuuccaccucuuuauaaauuacuuugaguuuuuuguuaugagcgugacuuauggucuugcugggagguaagcaggcacagaaaugcucugucuguauuucucaggacagugacgacuguagacugguuauuuuauagcuuuccaguuuuuuaagugcuguaaaaauagcaaguggagaaaguggaauaucuuuuucucugcucuacugaaccugguugucucuguggcucuuuagagauuucuuguguuguugacagaguuuggugguuuguauuuuugcugucuauagaaacucaugccuguaaucucaguguuugagaggcugagguaggaggaucgucaggaguuccacgcuagacuggcguagaugguaauuccaguccacuuagguacacagagaaagauccugucgcaccaaaaucuuugcuugugcuaauuuacuucugagcagggugcuggguuuauagugacuuggaaguuucuuagcaguaguaugauuuaguaccacuuuuggcaguuucuuuguaagauuagcauauuuaugcauauucauagauuaaugugguuucaguacuuauacacagugugugaugaucgaacacauccucuuggagacagacuuguguugacaaauuucucauuacuuuauucuuuuuuuuuuuuuuuuuuuccauuuuuuauuagguauuuagcucauuuacauuuccaaugcuauaccaaaagucccccuuacccacccacccccacuccccuacccacccacucccccccuuuggcccuggcguuccccuguaccggggcacacaaagucugcguguccaaugggccucucuuuccagugauggccgacuaggccaucuuuugauacauaugcagcuagagucaagagcucagggguacugguuaguucauaauguuuuuccaccuauaggguugaagaucccuuuagcuccuuggauacuuucucuagcuccuccauugggagcccugugauccauccauuagcugacugugagcauccacuucuguguuugcuaggccccgggauagucucacaagagacagcuacaucuggguccuuucgauaaaaucuugcuaguauaugcaauggugucagcguuuggaugcugauuaugggguggaucccuggauauggcagucucuacaugguccauccuuucaucucagcuccaaacuuuguuucuguaacuccuuccauggguguuuuguucccacuucuaaggaggggcauaguguccacacuucagucuucauuuuucuugaguuucauguguuuaggaaauuguaucuucuaucguggguauccuagguuuugggcuaguauccacuuaucagugaguacauauugugugaguuccuuugugguugugguuguguuaccucacucaggaugaugcucuccagguccauccauuuggcuaggaauuucauaaauucauucuuuuuaauagcugaguaguacuccauuguguagauguaccacauuuucuguauccauuccucuguugaggggcaucuggguucuuuccaguuucuggcuauuauaaauaaggcugcuaugaacauaguggagcauguguccuucuuaccaguuggggcuucuucuggauauaugcccaggagagguauugcuggauccuccgguaguacuauguccaauuuucugaggaaccgccagacugauuuccagagugguuguacaagccugcaaucccaccaacaauggaggaguguuccucuuucuccacauccucgccagcaucugcugucaccugaauuuuugaucuuagccauucugacuggugugagguggaaucucaggguuguuuugauuugcauuucccugaugauuaaggauguugaacauuuuuucaggugcuucucugccauucgguauuccucaggugagaauucuuuguucaguucugagccccauuuuuuaaggggguuauuugauuuucugagguccaccuucuugaguucuuuauauauguuggauauuaguccccuaucugauuuaggauagguaaagauccuuucccagucuguugguggucuuuuugucuuauagacagugucuuuugccuugcagaaacuuuggaguuucauuaggucccauuugucaauucucgaucuuacagcacaagccauugcuguucuguucaggaauuuuuccccugugcccauaucuucaaggcuuuuccccacuuucuccucuauaaguuucagugucucugguuuuaugugaaguuccuugauccacuuagauuugaccuuaguacaaggagauaaguauggaucgauucgcauucuucuacaugauaacaaccaguugugccagcaccaauuguugaaaaugcugucuuucuuccacuggaugguuuuggcucccuugucgaagaucaagugaccauagguguguggguucauuucugggucuucaauucuauuccauugguccacuugucugucucuauaccaguaccaugcaguuuuuaucacaauugcucuguaguaaagcuuuaggucaggcauggugauuccaccagagguucuuuuauccuugagaagaguuuuugcuauccucgguuuuuuguuauuccagaugaauuugcaaauugcuccuucuaauucguugaagaauugaguuggaauuuuaauggggauugcauugaaucuguagauugcuuuuggcaagauagccauuuuuacaauguugguccugccaauccaugagcaugggagaucuuuccaucuucugagaucuucuuuaauuucuuucuucagggacuugaaguuuuuaucauacagaucuuucacuuccuucguuagagucacgccgagauauuuuauauuauuuguggcuauugagaaggguguuguuucccuaauuucuuucucagccuguuuauucuuuguguagagaaaggccauugacuuguuugaguuaauuuuauauccagcuacuucaccgaagcuguuuaucagguuuaggaguucucuguuggaauuuuuagggucacuuauauauacuaucauaucaucugcaaaaagugauauuuugacuuccucuuuuccaauuuguauccccuugaucuccuuuuguugucgaauugcucuggcuaauacuucaaguacuauguugaaaagguagggagaaagugggcagccuugucuagucccugauuuuagugggauugcuuccagcuucucuccauuuacuuugauguuggcuacugguuugcuguagauugcuuuuaucauguuuagguauuggccuugaauuccugaucuuuccagaacuuuuaucaugaauggguguuggaucuugucaaaugcuuuuucugcaucuaaggagaugaucaugugguuuuugucuuugaguuuguuuauauaauggauuacauugauggauuuucguauauuaaaccaucccugcaucccuggaauaaaaccuacuuggucaggauggaugauugcuuuaauguguucuuggauucgguuagcgagaauuuuauuaaggauuuuugcaucgauguucauaagagaaauuggucugaaguucucuaucuuuguuggaucuuucugugguuuagguaucagaguaauaguggcuucauaaaaugaguuggguagaauaccuucuacuucuaucuugugaaaaaguuugugcagaacuggaguuagaucuucuuugaaggucugauagaacucugcacuaaacccgucugguccugggcuuuuuuuggcugggagacuauuaauaacugcuucuauuucuuuaggggauaugggacuguuuagaaggucaacuugauccugauucaacuuugguaccugguaucuguccagaaauuuguccauuucguccagguuuuccaguuuuguugaguauagccuuuuguagaaggaucugaugguguuuuggauuucuucaggaucuguuguuaugucucccuuuucauuucugauuuuguuaauuaggauuuugucccugugcccuuuagugagucuagcuaaggguuuaucuaucuuguugauuuucucaaagaaccaacuccucguuugguuaauucuuugaauaguucuucuuguuuccacuugguugauuucaccccugaguuugauuauuuccugccgucuacuccucuugggugaauuugcuuccuuuuuuucuagagcuuuuagauguguugucaagcugcuaguaugugcucucucccguuuuuucuugaaggcacucauagcuaugaguuucccucuuagaaaugcuuucauugugucccaaagguuuggguacguuguggcuucauuuucauuaaacucuaaaaagucuuuaauuucuuucuuuauuccuuccuugaccaagguaucauugagaagaguguuguucaguuuccaugugaauguuggcuuucuguuauuuauuuuguuauugaagaucagccuuagugcauggugaucugauaggauacaugggacaauuucaauauuuuugaaucuguugaggccugauuugugaccuauuauguggucaauuuuggagaagguaccaugaggugcugagaagaagguauauccuuuuguuuuaggguaaaauguucuguagauaucugucagauccauuuguuucaucacuucuguuaguuucagugugucccuguuuaguuucuguuuccaugaucuguccauuggugaaagugguguguugaagucucccacuauuauugugugaggcgcaaugugugcuuugagcuuuacuaaaguuucuuuagugaauguggcugcucuuguauuuggagcauagauauucagaauugagaguuccucuuggaggauuuuaccuuugaugagaaugaagugucgcuccuugucuuuuuugaugacuuuggguuggaagucaaucuuaucagauauuaggauggcuacuccugcuuguuucuucauaccauuugcuuggaaaauuguuuuccagccuuucauucugagguagugucuaucuuuuucucugagaugaguuuccuguaagcagcaaaauguugggucuuguuuguguagccaguuuguuagucuaugucuuuuuauuggcgaguugagaccauugauguuaagagauauuaaggaaaaguaauuguugcuuccuguuauuuuaguuguuaaagguggcauucuguucuuguggcugucuucuuuuagguuuguugagggauuaccuucuuguuuuuucuaggguguuguucccguucuuguauugguuuuuuucuguuauuauccuuugaagggcuggauucguggagagauaaugcgugaauuugguuuugucguggaauacuuugguuucucccucuaugauaauugagaguuuggcuggguauaguagccugggcugcaguuuguguucucuuagugucuguauaacaucuguccaggcucuucuggcuuucauagucucuggugaaaaaucugguguaauucugauaggcuugccuuuauauguuacuugaccuuuuucccuuacugcuuuuaguauucuaucuuuauuuagugcauuugauguucugauuauuaugugucgggaggaauuucuuuucugguccagucuauuuggaguucuguaggcuucuuguauguucauaugcaucucauucuuuagauuugggaaguuuucuucaauaauuuuguugaagauguuugcuggaccuuugaguugaaaaucuucauucucauccacuccuauuauccguacguuuggucuucuuauuguguccuggauuuccuggauauuuugaguuaggaucuuuuugcauuuuccauuuucuuugauuguugugccgauguucucuauggaaucuucugcaccugagauucucucuuccaucucuuguauucuguugcugaugcucaaaucuaugguuccagauuucuuuccuaggguuucuaucucuaguguugccucgcuuugaguuuucuuuauugugucuacuucccuuuuuaggucuaguaugguuuuguucauuuccaucaccuguuuguauguuuuuuccucuuuuucuguaaggacuucuaccuguuugauuguguuuuccuguuuuucuuuaaggacuuguaacucuuuagcaguguucuccuguauuucuuuaagugauuuauuaaaguccuucuugauguccucuaccaucaucaugagauaugcuuuuaaaucuaggucuagguucucagguguguugggguucccuggacugggcgaagugggugugcuggguucuggugauggugaguggucuugguuccuguuaguaagauuccuccguuuaccuuucgccaucugguaaucucuggaguuaguaguuauaguugacucuguuuagagauuguucuucuggugauucuguuaccgucuaucagcagaccugggagacagauucucuccucugaguuucagugcucagagcacucucugcuggcaagcucucuuacagggaaggugcgcagauaucuuguauuuggaccuccuccuggccgaagaagaaggcccaaaacaggaccuuucucagacacuguguugcuuuggcaguucccaggugguacagacucucaccuaagcagacuaaauuccuaaguuccuuggagucccgggaccaagauggcgaccgcugcugcuguggcuuaggccgccuccccagccgggcgggcaccuguccucugguccggaagguggccggcuguccccggcccacacagggugcugccucagcgccucugugcuucugccuguuccagaagcugucagguucucuggcgcacccucucaccuguucagacuaauuuccuaaguucggcgggucccggaccaagauggcgaccgcugcugcuguggcuuaggccgccuccccccgucucauuacuuuauucuauaucagcauauucucucuuuguagcuuuguaauaauuguuacuuuuuuuuuuuuuacaucuuuucuacucuggcuuuuuaagaaacuuguucuaaaguuuugcuuuuuugacaugcacugccauauuuucuuuaaaaauugaauugugaaagcuguuaagaacacuuuaaauagcauccuagugucacagggacaguuuuccucuguugcauguaacuauuaaaacaauccaugcuaaugccagcuaugcaguaacgugaucuacucucccucauugggagcugcaaggcuggcugucacaaaucccugugucccaggaacaucaaaacugcagaggcuuguaaauuaucaguaagauuuauaacaguaaauucucaacccacacaacauccacacaaagaauaguugauguugauacaagcugcccaccuagauuggacaaauugcccuauauuauucuauacucuucuaugauauccauagcuaccuguggcuauuucaagucacauagaugcuguuuguccucuuccuccaucuuuuucuguccuucucccaucuguccccuguccucucucuauaaaacuccuagcccccugccccccuuuaccauugcccagucacaggcucuagccuuauauauauaguucacuugaccuuaccuauguacagacagcaauuuacauuccucugcauuuauuuuuccuuugcaguaguguugggaacauuccccaaauguuggauuguuuugguguugaucuuuugaugguaaguaggaaauuuagugguguuuuacuguggaauaauggaucguuauucagaucgucuguaguaccuuggggagccaguaaggagcagagugagaaagaagccuuuauaguaaguagcaucugugcugguuucuccuucuguuucagguuagggaacgguuuuccuuguaagucagugcauggguguaaggcuuguuagauaaggaaguugagguggguaucuguuuuauucagaguuuaaaugcuagucuuucuaaaaaaauguacucaguauuguuuaacugacuaucuagguaucauauccuggccaaguugauguaaaauuaaucaccauuucaaggcaucaaacuuaacaacuguguuagcucacuccuaaguuaaguuacugcuuuguauugguugucagagagucauuucagucucaggaguuuuggggcaguguuuuaaagugagcuuuugggcagaggcaguuuaugaagaaagccccuaguuccuuuucuacagaggaugucuuugaagguagcugauaaauggcuagugccuccauguuaauguaccaggugcuagguagaagugauuuacuggacuuaucucauuccgucuuaggaaaccuuacagcuacagcuguacacacaguaacuaugucaguuccuugucuauugcugcaguaaagugccaggaccaagcgcaauuuaaggaaggaaagauugguuuuggcucacaguuccagggugaugacuaggaagacaggacagcugagggccaguaucagaugccagcuuaucaucugacagcugcacacaggaagcagagaggggaccaggaagcaggagugagacuuuaaacacccaaagccugccacagucauauacuuucuccagcaaggcuacagccuuggaaccaagcaauacuguugacugaugaccaagugcgcaaacacuuggggguggggguauucauucaaaucacagcacuuaucaacagguuucuauuucuuucuuucuauuucuuuucuauaaaaagccacaauacacauugguguaguaucuuaaguuuucugcugcuuauauaguugaaugcucuuauaaucaggacucuaaaagcugguucucaaauuucauuugguuuuauuuucaauuaggauagaguuuuaaaauauguuuuuuagaaggauaaagagacuagauuuuuuuuuuuaauacuggguuuaggggagauuaauaaagucugcaauagcuuauucuuauaaggggauguagggaggaaagauacaaacagaacaauuagcuagugauucaguugauugugcaaauagaugcucuuaaaaauaugcaguuaauaaguaccaguacaagcugcccaaaauguuaugugucagacaguuguuauuucaggguagaggucugcugucccugaaacugucacaguccugccucagccucccaaaguacagcauuuuuguuuguuugucuguuuaaaaugauguauuuugagcuguauucauuuguugaauaugaguuuuguguuaugucauuuaccagacuacagauacacaaaagugaauaaaagaaaauuugcuucaguuauuaccgagcuuagcauuuaguagagaaauaagagcuuugaggaauugaguauauuuuguaaggcaguuaugucuucuacaugcauuuguuggaggagauaguuagcaguggcuggaauguuccugagcuguguuguuaggccaggacuuccuggaucauuuccuacaguugugauuucagcuagcaaccuugaaugauaagguuccuuaucacauccuuuauuccaaagaggugacuugcuuaguccauuacaaaagcaauaaacaacuauaucacuccuguuuauugcuuuaguucacuuuugaugcagacauccagcuaagguaaucuuggggguuauugugugaaacuggucagaggcaccgacuacuaucauaaucuggguucuuuucugccacaaacaagacucuguuugucuugguagucuuguguuuugugucagcagccaugaaucaggcaggaccuaguuuguagaaaaauagagucaaauccuagccccuuuccacaguguaacauuucuguguuuaaucucauauaugcauuauguauaucccauauauacauuaaucuuacauuacauggcuacuucacaucauuaauaaagacaaaaauuaaaugaagcaacuucucugaauguguguguauauacauauacauauauauguacauaugcauauacauauacauacacauauacauauauuauucauacaggcaguagagacgugguuacuuaguaaucuuugacuugaaagaaauaaaccaaagacaaggcaggguguuggaccaggaggccagacgugagcagguguccuguagguguguugccagugugcggcaucugacccugcuguagauucucacagaagcauagaaaucuucacgguaaaaaaacaaagccuagugcuuugaguaaaauuguuuuggacacuaaacuauaauuucuguccagaguuuuauuuuaauguguaauaauggcacucuuuaacaguauacuuucagagaccauaggcuuuauuaucuuuugaacauagauauuuuuuaaaaaugucucucaguauguccccauauaagcaguacuauggaacuaaugaagaggaacuaguguggcccaaucucaagaugcauuuuuaaguucuuuucaaacagcuuuuccuggaugauaagugauacuguuuguuaucuuuugucacgggaaugagauuguaggaauuuaaagggguugaaaggguaguuuguuugcucucuuguccuugaggaagacagggccaagaagugagcugaaaauuucuguaucgugcccagcauuggagagcagaagggcuuguuauguuggucauguaacucggcccugauuuuugcuuuacagcccaaguuuaaggugaacuuacagaguaaguuccugugcuguccucuuugguugaauaauuauccuuggggcuuucuucaagguuacgcggcauuauagaguccuugcuaccaucuucuccacagugcugccugcugcuucuggaguccuuaugccuuggucuuauccucauacuccgcuuuucggucuuuaucuauuuaguuggagcgucuuccuagaagauuucucagcugaagcuucuguguucauaccgugcuuuguuguccaucccucucucaaguucucaugcuuuguuaccgacuuaaucuuuguguaaauguguugcgguaguagaagacgcaaacuggauaaagucauuuacaaagaaguuguuucaagucugaggguaucuaaaaugaugacauuguugaaugcuaaauuguugcaggcccucuuuuuucuaauaaagcugauuucuuguaaccacucugaagaucaggaugaagcaucuuccuggugugguuguguaucuauaugagacggcaacuccaauaauaaaaugugaaaagaagaggguccccuguguggacaagagccuauuagagcauacugaaauugugauauauacaaugauuauauuugacagcuuuacucuuuuagucgaaaguaugguuacugggaccacaacccuccugcaucugccuuccagauacuagcaccgcaguacuuggcuuuaguuucauccccccccccccuuuuuuuuugugcauuuacacaugugugcauauagguaucugcauguuccugcagcuaccugcagcagucauagcuguuagaucuuccuggaccuggaguuguaagugguuguucggcaccuguuguaacuaggaguugaacuugggccucaggaagagcacuggaugauccuuaccacugagcuaucucaaacucccaaauuuauuuuuauacucuguauucucaacuuagaauuuaaauaaucuuaucauacuugcauauacugcuuuaaacauugauauuuaacauauucagagcuccuagcauaauuaaaagagaauauucuaaguuacuuguuugguaauuuuguauuuauacauguuaacauggaauauauuaggauugugagggccagugagauggcucguggguaaucacuggcaagccugauuaccugagaucacggagcacacaugguagaggagagaaacaacucccaucagugguccuugaccuuuacuugcaugccacacauagacaugaaguaaauauaauaaagauaaaaaauuuauaggcacugaacuuggugcuuguacucuggcugaggcaggaggauugcuggaaccuagaggucagcauggguuucacaauuuaaaaaacaaacaacucguuuuccaaauaaaacuucucuccagugaaaaacagcaaaagaauguggaacuugugucugugagugugggcgaagggcauuuuugaauagaguagcaccuagucuaugaugcucuuguuuuaaauuuuacaauuguuuguuauccuugugguugugagugugugugacgugggugugaguaccacggugugcaggacgugguugugacuugguguaguccguuuucuccuaaagccuuuuggugguuucuguucauggaacucugucaugcuugcauguuaaauguuuuuauaugcugagcuauuucuguccuuacuugcuuuuuuaugugaagaauucaugaaguguuuuucugaacuugcuuuuauguuggucuaauugacuccauaauuauuaacguuuuucugucaagaagagcaaugagugauaaagaucuuuaaguccuuuguuagguuugaaggacgcugaguagagcccugaguaaagauggagugguguggggacuccagcaacuugcaggggauucuugucugggucuugucccugcucauuuucucuguucugugguuucauguaccuaguuggguuugcaauuucuuuguaguggcagguucuguuucuaaagaaggaaagccuuguugaugaccuggauuuuacauuucaaaaaguuagacauuccccacuuuccuacugacuccaccagaaacaacaucuugcagccuuuguucuuuccugugucuguugcuguuguggaguuccuccaaaguuccagcugacuuacuggguuauguggacucagaauauuugaccacaguuuuaguagugccagguucaccugagaguggaaauaacuccauuuaacauugugggucuugggcuucacagucuagagaguaauugucacauccguaggaagguagguugggaaauguagucucugugagggacaugcacccaguuacaagauuggcugaguggucuugagcagucacugguagcuucaagcuugccugccacuuauuugugcucugccucuucccacucccgcgucauucaaggugagugaaguacuuggcuaauuucugaguugacccugcuucacuugucuaaggcuuuuaugcagguuccgguuuucaccucuuucauggaucauaagcauuuaucuucauuuguucugacuuagggagaaagugaauuauuguaauguuuaaccuuguagaugugugucaacauuacugcuugcuuacuugaggcuuccuucuuuguggaagugucagugugcaggugugcgugcgugcgugagugagugugugcgugcgugagugagugcgugcgugagugcgugcgugcgugaauagaccagagguccaugucagguaucuuccuugguuacucuccacuuguuuuuuagucagggucucauauaguacaggauguccuuaaauuuacuaaauagccuagugauacugaauuccugauaguucuacuucuaccccacagacuguuggagguuuagacauccacugguauacaguguuugcuauggauuacuaaaauaucaucuuuauggaagggacuaauaugacuuacugcuuagaucuuuucauaauggaagaugccauuguguuuguaauaccagucucauuuguaaaacauuaagcuugcuuuguaaaauaaaaaugcuuaauucauccuuaaauguaauaauuucuuuaaagcccuugcugugaauuaaaacuugcugugguauaucuuaaaagucauuucccauucuauuagugcaaacaaucuuacuguuuauaauaaaauuuuaaaaucuagagagcacuguguuaauaaugcaguauggaggcaaacauguucuuaggcaucaauuuuucuccuuuaggagucuugguucuuaguguuucuccaggacaugguguggcugggacugcucccccaauggugcggguguuccuuggagugaauauugguaacauucauuuugauuuagauuugcggggaagguaaaagaaguuuuucuucuaggucauugauugucuaguuacagauacucccucagguuaaaaagacauuaaagcugcuguguggggagcagagagcuagcuuagcaacuaagaacacuugcuugcucauaggagcaccugaguacaguucccagcuuauaagugccuguaacuccagcuccaggcagcugaagccggucuugcuucugaggacacccacacuugcaugaacaaauacccucacacauacauacacaaaauuaaaaauaaaucuuuuuaaaaauguauauaagggauuauauaacugauauuuuauuuaagguaugauuuuaguguauucuggcuucauguauuauuccccugaauuuugcuaaauaauugacauugacuuuaaaaaaugucgauauauauaaacauuuuuauugugugugcaugaaugcuugcacaugcaugugccugcuugugccauguugagcauauggagauacggaagucagagaaaaacuuuuaggaguugcuuauguucguccgucauguguguuccagggauugaagucagggagucaggcugggaggccagugccauuguuagccauucugcugguggaacauacuguaccucuccuccucuuuuuaugaggcaggaccucucugacucuguagaccagacugccuucaaaacucauggcaguccucuugccucugccucccaagugcugagauuaaagacaccucugcacauugagauuuacaauaccuuaggaaaugagauuuucauuaaaaugacugaguuuucgaguguaggcacugcugccccacaguguaccugucagagcauaauuugggaaucagucccugcuacuuccagacucuaggcuagugggccugugagcucuuaguuuauguuccaaauuccaucccucaucucuguagagaugcugggggguagguauaugucaccaaaucgccuucauguuagguuaguaguucuuuucuuucacuucgucuuuucaacuuuuuauauuucuuuuaaaguauacauacuugcauaccuuuuaaaaggccauuauaaauguguuuuacaguaaaauggacuggaaaucaaguauaugcuauuuugauaucuagauaaggauacuauuuauuuucuuaaaaagaaagguuuuucauuguaaauauuuguauuuugagauuuucauacauaaugauaaugauaguauaguguguacacaggugccuucuguugggacucaccauuguuaauauuugguucuguuugcuuuacucauguaugaaguuuucgaguucacccacugcagcuguaagauaucucacaggaaggacucaggaacaauucuguaccuaaguggugacauaaauauuaauguaguuaucuauucaggcucaaguuuacuacuugugcccaaguuauauuuuucaucuuguuuauuuaaaucagguacauguauaacauuucugaaaucacucuuuuauucauaacuuuuuuuccuuuuucuuuuuugaggcaguuucaauauuguaggcuggccuggaacucccuuuguaguugaggauggccgugaacuuuugauaaucccucuccaccuuucaaauucuaggauugcagauaggugcccccccacccccauuuugguuccccuuuauccaggguuuuuugcaugcugagcaagaacucuacagacccaguugccuuauucuuccuuagccuucaggucaaugcuuuuugaaaacaguaagacuuaucccaagaaugggcuacauuacaggcauuucccacuguuugacggaggugaggugaucuggcuugucguaguccuuuacuuucuucaaagugaaagugaggauuaaaggcuugacuagaguucagguuaaauaucucuacgagaguucuucaugggugaaagaaacuucaguuaauguauaauguaaagaaaucuuacuguguuugaugguggaacucuuuauguuaaauugguuuacuaggcuacaguguugagagagaaaucucgucuuuaggacuucacuauaucuugcauugguuacuaucaugcaugguuacucccaauuucaaugugaaagauuuccugauaugcaguuuccccaaaauaaauucuuaaaaaagagguuaguuugaaaauuaaguuguugauaauguuugcuuaaaaauauuuucuagcauuaggaucaauauugauaauaaauuugaugcaaacgacugggauuggugaauaguguucacuacucucacaguagugaagauaacacaccaucugaaaaccauagcuuuguuaggaugaauacucaguuucucaucagauuucccuuuaauggguucuaagccuccauaggcagugcuugcuggcaucaguuauaaccacuggcuaguuucucguuauuuuaauucauguguauuugcugaauuuuacaaaauuaaaauuucuuuaucaccuacaagguaguaugcaguucuuauagaugggacuguugaaaaggacaaacagcauuuagucaacaauuucagaauugauguuggugaaguaguuauauccaacaucaugcagugggccuccuauccuuuuugauugucacaaagacuguggaucuaaaauaugugcagaaugucuuagcauggacauaggguccugugcuccguuugagugcuuguuuuauaggcauacaucaccauacuugguucugauauucaggguuuucccucuuuuauauacggauuaucucuccuguagccaguuugauauaugcuaaugguuguuagccaugugcauuacuguuguagaaguaaugcucucugauuauuuuaaaaugggaggcuuuuguuuuugcuuuggccucagccacauuuuauuuuuucuucacuguuucaugcaugguuacucucaauuucaauaugaaagauuuccugauaugcagugucccuaaaauaaacucauaaaaagagguuaguuugaaaauuaaguuguugauaauguuugcuuaaaaauauuuucuagcauuaggaucaauauugauaauaaauuugaugcaaacuacugggauuggugaauaguguucacuacucucacagagaugcucuugugacaauuuaggaaauaauuuccacauaaguuuuuaguaaacuaagaguuaauuuaugaaguagcauauuaaaaauuuugcuuuuaaaugcugauuuaguuguuuuugaaaauacauucuccucaccuccaccccucaaccccccaccccccccacacgcacgcacgcacgcacgcacgcacgcauguagaauaaaaauuaguuguuggcauguaaaacuguagaauugagcaucuuaacugaaaugaacuugaucaaggaguaauauaugguacucagaaagagucagaaaguacuaaagguaucaggauguacugacuuccaaacauaugguauagauugcacaagaugugaauaguugcuucaaaacuaaauauacucaauaauucaccuuuuccucaugaagcucuugcccauaucaguauauuuauugcaauggucaggauuuuguuguuuuucacauuauaaaauguaucuuagauggcgccaacuuucauccagaguugauugguuuucugucaaggcuccuuccugucuuuaaucuuucaauuguaguuuuaaaaaggauuuaguuucuagacauucuaaagaaauuguaucuguuuuugagggagcagucuuuuacuuacuuauuuccuuaugugucuguaccuucuacuccauguuuccuuugugacgggcuacucaacacuucuauaauuuaauagagguauuuaauucuuuuugauuaaguggacugaaccuagaaaaacauaaagguucuaaguuuuuugaggcaggugauuguaaucugugguguuuugugcucauuaguccuuaaaauugaacagcacacccuucugcaacuguucagacauugauacuguaucagaaggcauaagcaaacuuuuacccucguggaguuuauauucuauguaguuguguugugcauacaaccaccaaagcccuuuccugagggcuuuguguucauggcucaagcuuuacuugguggggaagaaauuucuuuuaagaguugaagacuuucuuugucucuguuuucuuguguuucuguuguaguguauguccaguuuuuaccacuauggcaaacaucuuagguagacggcuaacacaggaaaaagguuuauuuuggguaaguuuuguagguuucaguccacaaugaguuggccccuuugcuuucaggucuggagaagcaacacaugaugguuagaaugugugguguagcaaaaaggcucaguucaugccugggaaggaauagggugaaaaagggaccuucaccucuaaacaccuuucaagaacacacucagaauuccaugaagaccuuccacuaggcuucgccucuucaaguuccuacugccucacguuagcgccuuccuggagaccaggccucugacucauggacauuagggaaccaucgacgauccaagcuacagcaguuacagaacuaacugggaccugauucauugaaaugagacacucaaugaguaaaaauuauauaugcuucaaugagagggcugaguuuuuaaauuuaaagucuauuccuauuuaaugguaacaugauucuuauuaaauaacauuucaagcauuagcaauguacugcuuaguugcauaauucuauguaagggauuaacguuugcuuugacuugaaagugguugauacuguacuguuggauuguuuuuuaaaugcuguauacaugucaagugcuauauuguuuaaagugcuggaggaugcagugguuaucugauacaaguuucugcccucaugcagcuuagcuaugcagggauagcuguaagaugauuaauuagagcuguuucuaacauaguaaaagucaugguguauuugaguauguuccaugaagaagaauagcauugguagcuguggaauugggucauuuuucauguaaguaugaagaccugacuuugauccaguauuuuugauccuguuuuuuauuuuuuuuaaagauuuauuuauuucauguaugugaguacacuguugcuaucuucagacacaccagaagagaccauccgaucccauuacagaugguugugaggcaccaugugguugcugggaauuaacucaggaccucuggaagagcagucagugcucuuaaccacugagccaucucuccagcccuauccuguuauuuuucuguugcuguggugaaacacugugaccuaggcagcuuauagaaagaagaguuuguuugggcuuauuguuaaagagagaaauggcaggcaugguaguaggaacagaaguugagauuucacauuuucaaacguaaacacaaggcagagaacaaucugaauauggccagucuuccaauucucaaagccugccucuggugacauacuugaacagcaaggccacacuuccaaacagcaccaacaucugagaaccaaguguuguagcacaugagucugugggaaguguccuuguucagaccaugacagauccacagaguuugcauaaaaagcuagguuugggugaugagguggcccaguggauaaagauucuugcuaccaaugcugacugaguuugaccccuggaacccaauugguaggaaaagugaauagguuacugcaaauugucuucugaucuccacaugugggccaugcgaugcauaugguccccaucgccaacacacccuaaauacaugcaugcauauauacauacauauaugcauguaguagcuuuuugaagauuuggauacagugaugugugcugauguuccaauucaggagagacagaaauaagaguauuccuaggacuugcugaucugccauucuagcagaauuuauuguuuuaacuaguuccacuuucacugagagacacugucucugaacuaagguagaaaaagcauaaggaagauuucugcugaaaauguccccaggcuuccacacauagguacccauauguguacaaagcacacauagaaaaacuaggaacagcaguagcaguauuugggaggcauguagugaccagcuuucugaagaucuugggcacagaaaguacauuauaaauagaagcauaggaaaaaagaugauuagucagcucuuuuuuguuaaaguuauuugauguaagucaaauauuucagucaugccuagaguuuuuacauuuuuacaaucauagcuuucugcuuucaugaguauaauaggcaggcugugcaaaugaauuaggaaaggaaagaaaagaaaaaccugaguaauaaaaauaaaaugaagcaggccuuaaacaaguacugucuguacuccucccccaaaggcuccuguuuacaucaucauuggcauccuagaauugaccugugacugcaggugccucuugggcagaguacagauggaaauguaaagccgcagccuggaucuuuguguuuuucguaguggcugaguagguuaaccagugccccuggugcccugcugccuuucuugugacgcccuguguuuuccacuguguuugcuuugcaguucccacaguguggagugccuguuuuuccuuccuauacuuggaaaguugaaguaugacagcacacucuuucuguaacagccucuacuauggacuuuuguugucagcacacacuguuuuguauuuauuuuuuucagcauuuguauugcacuuugcuguuccucuaccaaacaguucugaguccggaucaccauaaucacuucuuaaggucacagcaguagcugucaugcuaccagaucaaggccauuuaucuccucuuucauccaucagugacuuagcuuaauugacuuuugcuguuaugaaauauuuuucacuuguauucugauucaucugucucucucacucaucucuuuuuuuccaauuuguuuaucucaauuucuuuuuauguuucaacuacucauuuuaaauacugucacagaguucagauuuuagacaguuauucuacuuauacucacuuuaaagucuguuacuugauucacuaaccacaaaaaaaaaaacaccaaaagcuuuaugauuucaacuuugaaguauguucguuuaugugugugagggauggugcuuguguguggaggccugaggucagcugcagugcugucuucaggagccaggagucucagauauguacgacacguugguucuauugaguuguugugcauuauauacauuaaguuagcuucuuagggaugacuuuuaaguacuauuauguuccuaaauguagaucagaauauaaguaaugcugcuaauagacuuaguuuuguauccccuuucaguuuugucauuacaguuaacucaaagacucagugagucaaguaagacacauccauuuacagcaguguaguaauucaccacaagcagacagguaguaggaagggaggcaccggucaucucaacaaacuccugacuaaggccagugagauguggcggguaaagguucucccugccaagcuggaagaucucaguguaaaucccuuggauuuacaugggggaaggagagaauccugcaggcugucuucugacuugcacguuuauguaccaugucaugugcacacacacuuauaaaacucauuaauuggccuguggauucaaauguccccaagccauuauuagucagccucuugugugugauuuacucauccagauucucccucccuccaauugugguauaagauauguguauauuguagaaaauugcugucagaggaagaguaagaaacuacaauagcaacuguuccuuaucuaucuuaacugcuaaagauaauuggugcuaacaguccauguguuacauucuguuuuuaaugcaucuuuccaaugcaaauauauauaauucauaauuuacuuuaaguacuuaauguaaacuuuucggaguauguagagugacgucaguauuuggucaugauagauuagccucacuggauuugccgucugucucuaccuauauuguaucuuaagagaguccugaugaauuuuuccgugguauuuguugaccguggacucuugauagugaugcaugcuuuguaggacgauauuggaagacagaugagaaggaacugcuggccuuuucuggagaagaguugguacacagcuaaugugaucucuauaaugugcauucuauucugucagucuuucuccucuuugaguggacaugaacauacaguucauuuauauuacuucuugaacaaagguuagaaugcuuucuggccaguucuguuuauauuuaucuugggaaaggguuugagcaguuuggaaaucuauuuguugccgaauugcuccucaaaaagaccgugucauuuggaaguuuauuuauuaugaauuuuguucucuuugaauuuuaggauagaccacuaucuuguugagcucuuuuaaaugaaguucuucuacuugaauauaaagaugaggacuagauaacuucuugaguuccuucuaaccccuagggugaagauaguaacuaacauuuggucuggugcucgaaagcuuacagagugaguucauacaccaucccacuagauccuuacaacagcacugugagauaggaagcaagagauggaggagacuaucggacaggcugaaugucauagucauacuccugcuccagccucucuauuaaaugaugucuuacuggcugcgaagucauugaguuguauaacuauaaugcugacggcuuuccucaccccugggggaagaagaacagcuuccuuccuuccaucccuuccuuuccuuccuuuccuuucuuuccuuucuuuucuuccuuauuuagccaucuguaaauuaccugcaucauccucauccaugcagcauaaugucucuaauuaccguagguuuggacaugaaccuagaauuaggagcuuuucaaggcauagaucacuuuuguaccaccucaguggaacugagauaauugaguauuucagguauaguauuccaugacauucucaaggggaaggcagaugauaacagagcaguaguugaggucagaucaacaaggauuauugcuaauucucucuggcuaguuaccucaccagguagacauuggucaaaugaaacagaugugggugcuuacugguaaaguaccucauauguuagcaguaggcuuagauuuuuaugacuauacaauaucacauuaaaacacuuugauuuuuuuuccaugugcugcuuuuaaauuaauaacacaccccaaauuuuuuaaaauaauuuuuguuuuuguuucuuucuaguuguuggucuugacgauauuauggaugaaggaguuguuaaagaaagugguaaugauaccauugaugaagaagaauugauuuuaccuaacaggaguuugagggacagaguagaagacaauucaguaagaucaccaagaaaaucaccucguuuaauggcacaagguaaucauucccaagaggcuaagccagaaagccagaugcauaaaacaugaguguuaggaugugcaaugcuaaacagguuaccgaucucuccacccaccuaucuaccugccacucagcugauuguuagggucucuauagcccagaccgacugcagacaacaugugaaacucaggcuggcuuugaauuucuuuuguguuaccuccaguuucugaguacuaagacuacaggaguauucuagucacaucuggcuugaaaaaauauuuuucaaaguauguuuuacgguauaagcauuuuuaaauuauuaauuuuugacauucuaaugcuauuacauuguuuauuccuguucugccauccaaacuuccauaucucucuccuugaccucuuuaauuucauggccuuuuuuuuuuuuuuuggagacaggguuucucuguguagaccaggcuggccuugaacucagaaguccaccugccucugccucccaagugcugggauuacaggcaugcaccaccauggcauguuuauauuaauuuuuguacauguguauguguuucuaaauacacagauacagccucugagucuguauaauguuacuucuuuguguuuucagggcuggacauuugaugcuggacaacuaguuaguaugcucuucccugaagaagacuuucucuuucucagcauuucucaguugccuacaguucuuguguaggguugaagcuuccuggguuuuucccuguccauauuagcauguuuauuguuguccuuguucaguuuauguuuaggcaaucauaaugaugagacuucauggguguaguucugacauuacuaggauuugcaaucuuagagcaaauucccuccuccuuugccucuuacagucuuuccucccccucuucugcaaugacucccgagccuuaaguguucuuuuguagauguguccauuggagccauguucuacagcugugcauuuugauuugugguguucuguaguggucucugucuguuacaaagagaaguuuucuugaggggugagggccauacuugccugugggauauaaggacacauauuuagaauguagucagaagcuaugcugguguuaguaaaguggugguucugcugcaagauucaugacuucacugccugucggcuagguuuucaguaccaggcauaguuuccuucuucuggguccaguuagagagcuguugauuacugacaaguucuguguggacuacuuacugcaccuuucggguuauugugcuaugugggucucuagugugguucauaggugucauagcugaguaguacuuuugguuguuccuucccuccuuuggaagcuugaauggcgcuuucugguaccauggaagcuaguccucggggaggaugcuuuccggucagaugcagcucuggcuggcauccgggcccucuguccaaaguguuuaucuucagcaauagggaaccugguugcaaccugagguaacaauaagcuguaguguuuugggaaucucuuggacaacacuaacaacugaagagagggcuucucaugccugggcuugggguuuuuuguuagauugucguuggcucugggaaggaguauuguuaguccagaugagaaaauuuuauuuaaacuauauaugcauacaaauuuuuucacaguuucauaaagauacgcacacauuacguugguuguaucuccgacacuauuauuuuccuuuagucccuuccacucuugcugaaaauauuccuuguucucccaccaagucuuucuccuacuugaguguuucuguguguccgagcaucuuaucccacuugcuugcauggacguggguaagaauaacuuacuuuggcaaagacaaauaaccauaggaacugaccugagagcacgacuuguucacugaguuaggaaguuguuuacauugauuucugauuuuuugggggaaggggugguauugcuauaugcuggauggaaguuuauagacucuuucucacuguuucuaaaacaguauuucaugacauggaaguuuggggaauuaagguuagcuagcauucgguugauuuggaguccgggaaugauugcucacuucuggaaaguuuuccacacuuuauuccuuuucauuaguuugucaacucuugcuuucuggauuucaggucugguaaaagaugcuggccuuuuguuuucuuuauuuuuccuuauacuuuucuauauuaucuuuuuuacuucgucuuucgaaacuguuucauuuuccucugacccuucggucaaguuuugcauuucuaauguccaaauguuucuugguuuuuuuggagaaggacccuaaaaauagcaauguauuuauuuuuauuaaaauguguauaauaccuuuugucuuuaaguuacuaacaucuuuuaucuuuauuaagauacucaaaguguuuuuaaaaggauucaucuuuuuguuuugaaagaaaaaauuacuauuuuaguuuuuauuuuuuccccuuugucuuauuuaggauauacaaaaaaaaaauucaaagauuugagcaaacgugaaauguacaggaauucuguacauucagggcuagucacuggccacugccagcauacacagcaucggaagauggggcuuuuuagggccagugaggagccugaaagggcagaggucacuuuguugucacacuuaguucguucguggguaaagcaguuccugcugcugcaguguuacugaguguaggcucccucagucugaaguugacaccccuagaggagccagggccuuaggaaaggcaggacaggggagcagugagugcacgcugccauguugguuuccgggaacgaauacugugggaaacucagcuguauggacugaguguaggagcugagcuuuacuugccuuuugggauucucagaaagacuuccgguucuuucugcgguccauuagcauauuuugguaccccgagaaggaaguugauagaauaucuguugucaguauuauauaaauuguguuucacaguuaccgucgucguauugcugcucucaacuguggcauuccuagucuagaaccccuuuuuauucucuaggacugagacucucaaccuuccuagugcugcagccauuuaaugcagcuccuuauguugugcagacccccaaccauaaggauauuuuuguugcuacuaaauaacuaaguuugcuacuguuacauaaauaucuguguuuuccaauggucuuagacaaccucuguuaaagaguuguuuauccccaaagggcucacaacugacaggcuaagaaccauugcuuaaggggcuaagcuuuagggguuuagggcaggguguuaaaacgguggauuugauaacuugcuggcuuacuguuugucucaaguauacuacuuaauuguuccuugcuugaaucacaaaaugugucauuauuccucucgcucuucauuuucuguaaauucauaccuuuucagaaaagauccuuuauuguaccuaaaggaacaaggguuguccuuaucauacuuuccuugguauauaaucuuaauuuuaaaaaaucaguuacuuggcacauguacaugagacuuuaagaaauaaauaagauaaaaaaaauauagaauaaauaacaagguuuuuuuuuuuuggccuauaggaagguaugcuuuagauuaaggcaauuuauauuuaaagaaguaaaggcuucuuuuuugcuuaauaaauuucuuccuauuugaaaauaauauuuuaucagaauaccccagcucagcugacuaucaugccacuuugauuuuagcagcuacuucaaagcuaaaauuuuuuuguuguuuuucagugguuuuauuucaagcauagaguucagagcuuaauaguccccugaauacagaaauaaaacucugguagugauuuuaaaaauaacagagccuguaaugaacaguucauaaaccauuuuuguaaugcguucuuacuuacuuucucuuuauguguuguauauacacauuugugugugugcauguguggugugugugugcacucuaggacugucuuuuuccaucaccuucuaccuuaaguuuugagucaguagcucucacugaaccuggagccccuugacuccacuaggcuggaagucagugagccucuccugucuuagcacccugcccugccaccugcccacacugguuuugcagacgugugcugccgugcucauccuguauguggguguuagggaucuaaacucagacccucgugaugcagagcagcacuguagggacugagccaccuccccagcccauaauuuuguaaaguuguugacugugucacauguucagagauugugcggccuaggggaaguagaaaaaguuccaaaggcuggggugacuagguaguugauuuuucagugggacacugaagagugagagugcuguuagcuacaccaggaccugcugcaucaccuggaugagaagcgcgcuugcucuucaguagucuccuccucugugagaagugacagguuggacauauucaaaguaguaguaugguggcauuuaauuuugaaugacuaacuuuaaaucaugugaaguugauuuagcaagauagugauaccuuuauacuuguauuuugaauuuuaauaaacaaguuaguuccuuuuguauuuagugaaguuuuaaaguuuucuuuauuuucaguucuaaaaagaacuguguguuucuucucuugggaagauuuuuaggcucaggacucuguuaggaguacugguaaaagaaggaaucgucaugcuuuucuuuuguauuuuacuuacacuuuuucuuguuacugauucauuuggcagucuguguguggcauucuuggaacaaauuuuaguuacucgcauaggaauaguauagggacuggagauguguguaguagcucaguuguucuagaguacaaccuguaaaccaugugagaaguagaggagagaggaucaauuucaaggccauuuugaaguuuuugagucuagccuaggcuacaggagaccuguuucacgucuuacaacagccuuuaauguaaaagggaaaugcauugaagugggaauuggagguuuuuagaggguauaccuugaaacaauagaucuuguuuaugauacaugguuuuguuugcauauaagacuuugggcauuuguacuuauuuuuauauaauaagaaauauuugauguuuagaauguguuauaauucuuuaagacaguuauuagugguagugaaucucauuuugcuuauuuugauuuccaucucuuacagaaaagauacuugaugaaaauauuucuuaaaauuagaugaguuugaaauuucuauuucuauucaucugacagaauucaagagacucuaaucaauguaaauuaauauguuaggcuacuuauauauaauauauuuacauauguauauauauuauauauuaguauauguaugaucaagaguagucucaguaaauuuuuauugauaugaucagguaaguuucagaugucagaauaaggaaguaauauacuuuaaacuacugaaauaaaagcacauagcaaauagcuaaguuauuuuuauuuuauuuuucccccuaugauagaacaaguaagaaguuugcgacaaagcacuauugccaagcguucaaaugcagcaacucuaagcacaaaaaagccaucugggaagaccuuaucuaccucuaaaguaggggugaagccagcagaaagaugucaggguaaagaagaaguuuaugccucacugaaaucugaacacccuaaggagaguagaaggaguggccggcaugcugaacagauggacguggcgccagaagucucagcaucuucaguugauucuucagugucgucuugugcuggaaugaaggaggaggcugaguuugaucccaaacaugcaugcaauaaucagggugaagugaacgugccaucuccugaguuagauuguccacuucucucagagacuagugcuaguguggaagagaagaacauugaggcucugauggaauguaaagcuaagacuaacaguagcccguuauuuaaguuuccaguuagagaagaugagcagagugaucuuguuucgggugaacugaaugacaccauugaaggaaaggaugcagggggaaaaccugaucaagaaucagaggaggugaaguuucccugcgaaggugaccagacggccgaggaacccgaaucuucugaugugucuagugacucugcuugugccaauaaaaauaaggcagaaaagaaugaaggggcagaaugucauuuggaauugaagaauacuguggauauuguugauaaaccugagaacucaccucagagaaaugaguuggaaacacugggcuauggugaggacacggagucuaaugaugcucgguuacagagcacagaguucaauaagucagauuuggaggaaguugaugcuugugcuuuugaaccggaagcuagcacuuuagaaaauacuauuugugauguucuugaccaaaauucaaagcaauugaauauuacucaaaguauuaaaauggaaacagccaaucuucaggaugauagaagugguuuagagcccaaaaacauaaaacccaaacacauaaaaucuguaacucauucuaaacaaagcaugaccacagagacacccagaaaaacuguggcagcaaagcaugaaguaggucauagcaaaacuaaaucuaaugucaaggcugugaagcgaaauucuggugagccggaaccccagccugauucucagaggccagucaaagugagaaaaaaacaaggugauaagguuuggaagagucagaguuguaauucuggaguuaaaucugugaaaagccaagcucauucuguauugaaaagaaugccccaggaucaaaacacaaugcagauuuccaaaccuuuaacucauccucauagugauaagcuucauggucacucuggcuucucuaaggagccuccccauccuguacaaacuggacacuuggugcauuccagucaaaaacagagccagaagccucagcagcaggcagcuguggggaagggcaguagccaugugaaggaugagcaugaccauccagucagugagcaucuuaaggaggacgauaaacugaagccaagaaaaccugauaggaaccugcagccucgccaaaggagaagcagccgaaguuuuucucuggaugagccuccauuguucaucccagacaacauagcuacuguaaaaaaagaagggucagaucagaccaccucaauugaaagcaaauauauguggacuccaagcaagcaauguggguuuugcaaaaaaccacauggcaacagguguguguguguguguauguauguguguguuugugcauaucuguauggguguguacauugggaaacuucuagaaugaggauugggaucugugagaacuuucuaauaugaaaaaauuuauuuuaauauacagagacuuccaaaaacuccuuaccaacccuggauaaaugauagcaaccuggaaccauugaauuuacagcuagaucauuguagaauaucuuaaaaagcuuagucugaccagucugauaugcauggacaugcuuucucauuguaaccaguuagaauuugauguagucauugcaucugauaaaaaccaaacccauuuugcuaaucagaauuguuaugcugccucaggacuggagguuuuaugucauuuuauuugacugcagaacuaguaauaaaguguaaagcucugaauggaauggcuauuuuucuuuugaagcuguuauuuuuguuuuaaaugaugcacuugaaacaccaacuguuaccauuucaaaaccaacauuugaucuuggaacuaaguucaauagcaaaagcaacuguuagaauaccuagcugaauuuuguauguguuauggaguagacugaaaauaaguauuuguuuuuggaacguuuaaugguucaaagaauuggugaguucugaucuuugaaaaucuuuuagagucgacguuaccacuacuuuuaugauaggguuauuuuggacuccauuuuucgaagcuuaucccaugcucucucuuuggaguauuuccuuaugcuuucuuuugagaagggacaaagaugaaguggucucugcugcugcagauggugcugaucaaguacuaacguugcucuuuagaguuaugucagugacuguacacuaaaaagaaugaaaacagacaguaaagucccaugacaguguccucucccagcucugucagaugacacaaaagugaaaccaaguuuagagaggcagucaguaaucagcauggugugcaucacuuucauugggaguaagagggagguuugggaauuguuaaacuaaauuuuaugccauagagguugguaacauuuuuuuguuuguucggagacagacuguagcagagccuguuugaaagcucaguauauaaucugugcuguccuugaucuugggguccucucggcuccgccuuuauacugcugaaaucuuuacuguuuguguccucuuuuaacgucagggauuacucaaugaaaaaguauaucuuugcuuuuaaacuuuguagcauguuugaauauagugcuaccuuuauccgaguuacauaccuuuucaugguuuguacauuuaugguauguucacauauuucaaagggagcuuacuuuauaucucagcgauguaaggauuaacucacauuguuaauuguacuuuuaauaaaagccagcccucugucucauuuaguaucuuuaaaaaauucacaacacugacauauggucagggacuuggaaccucaaggauuccuuuggcauaguuugaacccauguucaguauguuacuauuagcucuuuaauaauaacuuuuguccuaaugguguggucuucaggaguuugucggagcucuguaguggugacagucacuucauaacuucagcagcuacuuaaaguaaaaauuacauaaagauuacauaaagaaaagacuacauaaagauuacauauucucuuuaaucuccuuccuuccuuccuuccuuccuuccuuccuuccuuccuuccuuccuuccuuccuuccuuccucuccccccuuucugaugcugcuauauaaaguaugaacuuccuuugcugcagucuagaauauagcuuagcaugauagugguggggauuggguguugacccuguguaauugaucuggaugauguauauuggaaauaauuaacuucugaauuggcucuuuagccaccuuuagugccuuuuuuucagucugaauaaagaaacuaggccauugguuguguuuuauauacauguauagucuugagcacuacauuguuacauugccuuuccauucauuaaauaccuaaagcguacuuuucacacaauuuguaauuuuucaauuuuaauuuacaugcauaaauacagaucuacuagggaaauauggaaauguauuaucugauuguauauacuggucauauugaaagcuauuuguaaauagcacuugugacaguagaguuaauuaguauuuuacauaaauuacaauggaaauagcuuuuuucuauauauguccaguuggauguuaggcuuuguauuaugggucuucaugacuaacauuaugaucuucuguccuagagacaauaggucuuuaauacagacauaacaaaauuauucaauauacuuuuuuauuagauauuuucuuuauuuacauuucaaaugcuaucccugaaaguugccaaaaccuccccccgcccugcuccccuacucacccacucccacuucuuggcccuggcauuccccuucaauauacuuuuaaaaugagacucuuguuuacuuuuacauaaaugugacuuuugaaucuuuucaccagaagacauuuugagugggaauuuucuuaaagucacguuguguuauguaccuucagcuucucuuccuccuuugucuggaagauguuugugucuuuaauucauaaugcauuuucuuaacccuaauuguagguuggacaaaauuucaaaaacaaacagcaaaaaaugucuccuuaguaacauuaaguuacaguguuacauucagaaaagaaaacuuaauucuuaggacacgcuucuagaauaaauuauucugguuuucucuuuauguuuuauaggcuauuuuucaagucaacuaucuucaaagauuagguugacuauuaagaugauuuugcauuuauggggaauaaagucuuauauguaguggcaggauguuuggggcugucacuuaaauuaccuacagaacuguaggcccguauuguaauaccuuucauguuaauuuguggccuguuucuuuuaagaucgagauuucuuagaauuaauucuauaguuuacuuuaacaacuaagguuuucuaaggauuuuuuucuggcucuuaccaaaaaauuaagauuagaaauacaaguugcuuucuguuuuucaguagaccugauuuuuguuuuuauuguugguuuauaugugagcauaguagaaaaacaaaagcuauuaguguugcugccuuuucacuugauuaauacauacugauuugcuugagucagcuuauucagcaacaguagacucauauuauccauaaagaaauuucuucuuuuauuaaccacacauucaaggacagggcaagaacuggaguacuagguauuggcaucccacugcugugaauccugugcugugccuucuaaguauucccuccuagcccucgggucuuuaaagcaguacagccugagaggagacaagaaggggccuucuuccggccaucuugacuccccuucucuuuccucuuauucuggcuucaacaacauuuuuuuaguucauggguuuuagaaguuccuaaguagaaauugguguuaacaguuacaaguaauugacuauaugaaaguaacuccaccccacuccuggccccaggacacggguguuugcuacuauuuuuuuuguguuuuuuagaaaguuuuaucuaaacauuguucuaaaguacuaaaaugacaucuuuagaugacagagauuugguuuucaaagcaugucaacaauucaguguaagcauuuccaaaguaaacuugaaaugagggaugguuucuugauaaauuuuaugaucauagaucagugagcuguuuugguuacaucaaauggauguuugagaaugcuuuuacacuguuuuaugaucugucauuuaagacugaaaccaaugcaaacuugacuugaagucagugcagcugugguuguagaagagaaggaagggaccacucauuuuccuucugaaucucaaagcaguuuauacuaggcaguuggcuucaggaaauagcaauauguacacuuugcaugaagcaagggaagagaauuaaaguauuaaacaugaaagaauucuucaagaucccuacccuguggagcaauugucauugagacggcaugaagucaucaaacauuucaaagagaaacuuccuuacaaguaaauguuacauuauuuaaauguucuccuggcuugugaauaaaaccuacuuacccuuauuuuucaaaccaagugcaucauaguaaaggugaagacugacugaugacuuuggcagcagaaggaccacugaggauaaagaagggccaauuguagcuuguuuccuaagacucagcguaguaguugggcagacagaaaugcacacaggaugaagagcugcugucgaggagggauggauuuggcaccacuuuuaaaacaccuccuaaauguagcacuaauuuugguacuuacuuugauauuuugacaauuuuggcuugaaaucaggccgcagguuaguuuaaacauuccgucuguuagagaacacauuuuuaaaggagcagggcgugcuugguggugccaccauuaacaaagucagugccacaagugcucagauuauaaagggcuaccccaaaucuuugagauaagaauugccagacagagaaagaaaaaagggggaagagaucugaguauuccagugagcugauagcaucgcuaaucauguaugaguugccauuuuauuucugaguaguugcagauaccuuuaagugacccacugcuuggcuucugaaucaugagggaauacaguaaaggaagaacucagcaaaucagagucaaaaccuagaugccagugcauucuuguuaagaugggcugcuauuuauugggcaaaugaguugauuuccaagaacacauaagacaugaaggaaguccacacccaaaaguaaacgagaauccuucagcugaaucaacaugauauauuggaucagaaagaaucagguuacaugcuggcuacuaggaaugagagacuuauacuuagauuuuuuuuuuuuaagucaaauaccccaguuuucuguacgcucucaccucuuaaauugugauugagcucucacaccugacugggucuuuuuaugugcuuuguucuaugguauuuuuguacagugggcuaccaguuuucaugacugccuuguguccucauuccuauuccccaccagcgucuuuugucauuucuuauuagagaggagagucgcuugauguaaaaguuaugguaucauggaaugcuccuugggaacuugcucuguguugaacuguugcguucauggaaaauaggaacagugucugaacauuaaacauuuucacuugauacuaagguuuuaaaacaaaucaccuuucuccccccuuucagguuuauggucggcugugggagaugugaugacugguuucauggagacuguguuggauuaagucuuucucaagcacagcaaaugggagaggaagacaaagaauauguuuguguaaggugcugugcugaagaagauaaaaagacugacauacuagacacagagauuuuugaagcccaagcucccaucgaagcccacagcgaagauaaaaggauggaguguggaaagcugacaucaucgaagcacgcagucacugacgauaaacacagacacucagaugacccugggaagcacaaggucaaaauuuuaaaacggguaagguuuccagacaguacauuuguuauuucaagagcuuuguauggaccuaaaugauacucagaaauuucucugucaugucuauuacaguguacguuauuacuuuagcauaaaaaaugaguugaauuuaaggcuuggggaggaggggaccaauucuguugaaaagugaggacuuugacauacgcauuuuuuuggugugugcuguuccugagcuguagguuuauauuugaaucuuuguuguacaauauuuauguggcuauguggccuaaguauaaauuaugcuuacuaaguacauuuuuaaucuaaauauuuacugaauguuuaacuguuuugcacuuuuuaagaauuaaaaagaauaauuauagcuuuugcucucauuugcuuggaagucacuucuuccacuuucccuguugaacuguggacuucuaaaaguuuguuuuccaugaucuggcauucuauauauauuuuuuuauaacuuaccuagcauuaauuuaugugccuuggugugaggguaucagauccuuugaaaagcuaaaguuacaaaagguugugagcugccaugugcgcugggaagagcagacagugcuuuuaaccagggaaccaucucuccagucccccugaccuggcauuuuaaaccaccuccuaaaaguauuuucuaaacaaaauuuaaaauauuuuguguuuagaagaaggaaaauagaaaaaaugcauuauucucuucaauuaaguuuucuuucguuagcagugacuuuccucauccuugaauuguagcagaacccugaagaggaaguagcacagugucaauaaauguguaagaauaaguaagcacguugucuaaaaagcaaaggcaagacugauucacggguuggaggcuguauggaagccguugguuugaccugggaagcacuccuagcugagaagaagcaguagcuugggcuacuacuguauuaaaggauggugagggagcacagcucuguuagaaaggacuugagcuuguguuacgcuccugagcauagccaggcuuccuccuguggcagggaaagugagccagggaagugccggggcaucuucuaaaggccucucuauuucuccauuguuugcugagucagaucuuucaugcacuccuuuugugacuagucuugguugagcuccaucuugauaaaccuuugugacauucaacauuuuugucugacaagauguuuggagaucuugauuaacaucaaguuaauuguugauauugcugagugcuauauuaccauuuugcaguauguucucugaaaacuaauauauuucauuaacuguuggucauuacauuugguauauaguuucuugucuauuuggaaauacauugcuuuuuggcugaacugugucuuagcuaaaaagauguucuaaaauguuaccauuguuaauguugucggaaaucauagaagcuguucuguuuauagauucauguggcgugccaucauugcuugguauucuuuuguaauacccccacccuuuuuauuuuguuuuuaauuuuugagacagaguacuggcuguccuggaacucacucugaaaaccagguuggccuuaaacucagagaugugccugccuccgccuccucagugcugggacuaugcacauacuccaccacaccuggcugauggugaacucuugacucuuuagguuaaucuggugguaauuuaugcugccuucuuuucacauaugauuuucuaucauuacauuucucuguuguaauauuuacugcauuuccgugugugguaggaaugaaauuaucagaccuguaacaguaaaacaugcuucuggggauggagagauggcugagcaguuaagaguacugguuguucuuucagaggacccaggugaaauuccuaguguucacagcauagcucacagguaucugguaucugcaacuccaggucuaggggugacaguuaguccuccacaggcacugcgcaugcauauagugcacuuauaugcauauauagaaauaaaaaauaagucuuaaaaaacaccccaccagauuucuacucuuaauauuacgucuaguuaggaaacuaaaaaauaagugaaaaaugagagcauucuaaaguuuccauguuaccuugaucuuggucuguaaaugguuauucucccuauguuuuuagauaagugugauaugauuaauuucucucugagaaguagcagguacauugaugguacccaugggaguuaaaauugccuuugacauccugggaacauaacugguaccugugcugaaguuaaugagccuuguuuguucuuuaggaguacauaggcaaaugcaggugcucacuuguccgcaguuccuuccuccuucauauuuacagccaacuaagguccuuacagccugaucuccguucuguuuuccucuuucauaggauauuauguauuuuauacaaaauagaugguuaacaauagaaucuugugguuuuuaaugaugguaacuuauuuuuguguacauguguuuuuaagauuuauuuauuuuauauucgugaguacacuuuagcugucuucagauacaccagaagagguuaucagaucccaugacagaugguugugagccaccaugugguugcugggaauugaacucaagacuuuagaagagcagucagugcucuuaacugcugagccaucucuccagccaauccauauguauguguguguguguguguauauauauauauguauguauguauguauguauauauauauauauauauauaucuuacagaaguuuggauugaaaauguuuagucucuuacagguuguaauguuaacuagauuuaauuuuuuuucacuuacauauuauugagguuugucuuaaauaguaaguaguuuuuguuuuaaugaaacaauacuacuguauuuuucaggagucuggugagggaaaaacuuccucugacaguagagauaaugaaauuaaaaaauggcagcuagccccucuucgcaaguugagccaaccacauuuaccucggagaucaucagaagaaaaaagugaaaaaauagcaaaggaaucuacagcucuugccucuacaggagagagaguggcgagaucagguagggagacugcuggagauuauguacuuguauuuacuauuacagaagguugguauaucuugggaauacuuugaaaacaaaaacaaaaaaaacgugagugcguacacuuuaugacucuagaaccacucuugaucacaggagauuuuagguagcacucugcaccaggacugucugaauaaugaacucugggcucuggcauuauuucuaaauacuuagucugcauggauuucaacuuagaucauguauuauagagaaaguaucuuuuaaaacaguuuaaugaguuuagcugcuuuuuacaauuagguacucaugagaagcaagagacaaaaaagaagaaaauggaaaaggguggaccuaaugugcacccgccugcugcuacuuccaagccuucugcagaucagaucagacagaguguccgacauucucucaaagauauucuuaugaaaagguaacauguuguuaugccaguggucgaauagcaugggcuuuucauguauuugaaaauaauugaauugaaacacagggcccccaaugguggagcuagagaaagcacccaaggagcugaagggaucugcaacccuauaggaggaacaacaauaugaacuaaccaguauccccagagcucgugucucuagcugcauauguagcagaggauggccuaguccgccaucauugagaggagaggcccuuggucuugcaaacuucauaugccccaguaaugggaaaugccagggccaagaagugggagaggguggguagggaagcagggcgggaggaggguauaagggacuuuccggauagcauuugaaauguaaaugaggaaaaugccuaauaaaaaacuguuuaauucaaaacaaaacaaaacagagaaaaagaauuguuuucauuuuaagacuuacagauucaaaccugaagaucccagaggaaaaggcagcaaagguugccacaaaaauugaaaaagaacuuuucucuuuuuuucgggacacggaugccaaguauaagaauaaauauagaagcuugauguuuaaucuaaaagauccuaaaaacaauguaaguaauuuauuuuguccaaguuuucuuaaacuuacuuaauuuuguaagugugugcauguguauguaugggcaugcacauacugugguucuuuaucagaggacagcuuugacgagucauuucucucucgagugucugcagacaguuauaccuuggucaucugguguacugggcggcaagugccuuacccacggagccaucccacuccuccuguaacgcuaugcaugccauggucugaaccgcagucuaggacuuuaaugaaauagcccuuucuaauagguuccgaaugggagugagagggucaguuuggcucuggguuagacuccacaaauauguccugcaagagguccucagucugagugccuccgcgaacagcuguggugaugucuguagaugucagucacauugugaggcuguggagcaucccaggggagcccacacagcauucucucuguggucgguuugcuuggacuacuagggauuaaauuuagcugggccucacagcacacaguuugcucucugcagcugagcuccuucugagagcgucaguucucauugacagggaagggauguagcuggggaugacuuuaaguuucucuuucuucuaccuccaacucgugagugccaggauugcaggccugaggcccaaucuccacacacuugucucugggacucaaacccagagcugccgcaugcugagcaggcacuuuaccgacugaguugccugugcagccccagaacaugacaugaguaagcucccgacuuagggauccuagacagcagugagggguguugagucuguugagcaauguguuuggauagaugugcauuuucuucucgucacuaucucuugcauaacacaguuaaaugaguaaaacaauuuacucuaaacuauucuucaaaaucuauguuaagccuaagcauuuguuauuuaaaccuguaaguagaacuaugcucacucaaaacgucacauuuuguuguaaacuaaaaaagauccaagccugacaacaugagcuuugcaucagagcuuucuagggaaucugugacagaaagaucaccuaagcugcgaauucccaggcagccugaacagcagagugagacucuguccuuucccuggaaaaguauuuuaaaauauuuuuaccaaauuaaauagaacuuuauuaaaaauauauuuuaacuguggauuaaacauuauugcucucuuacuuauaucuugggauuucuuguuggagacuuagaaaaaauccacaagguguguguguauuuguauuuguguguguguaugaguucacauagaaaguucuguacugcauaugcuaagcaaaaauuaugcagugagcucuuucaguguuccaaauauaaauaaauauaaauaugauuauuuuguguguuauauuuauguaggugcauugagaaauuuugcuaaagaugauucucaauuauagaauuaaauuaaauguauuuguguaaaaguuugcacauuagugauguaaguuugcauauuaauauuugcuacaaaauagucauaucucaaaaauaaugcauuucaacagcagaccaaaaauacugaggaaaaauugcauauguacuaaagauguauaggcuuauuuuucugguuaucacucccuauguaauguguguaacagagauguacacaguuugguuuuuuuuuuuuuuuugguuuuugguuucuuuuuugcuuuuuuuucaguuuuucgagacaggguuucucuguguagcccuggauguccugggacucacucuguagaccaggcuagccucgaacucagaaauccgccugcuucugccuccucccuagugcugggauuaaaggcaugcgcaccacacccagcaaagaaaucuuuuuuuuuuuuuccuuuuuccagacaggguuucucuguguagcucugguuguucuggaacucacuuuguagaccaggcuggccuugaacucagaaauccgccugccucuaccucucaagugcagggauuaaaggcgugugccaccacacccaacucacaguuuuuaacauauuaagaaaauauaggggcuggagagauggcucagcgguuaagagcacugacugcucuuaugaagguccugaguucaaaucccagcaaccacaugguggcuuacaaccaucuguaaugacaucugacguccucuacugaauguauuuacauauuaacaauaaauaaaucauagccgggcgugguugugcacgcccuuaaucccagcauucaggaggcagaggcaggcagauuucugaguucgaggccagccugaucuacaaagcgaguuccaggacagccagggcuauacagagaaacccugucucgaaaaaacaacaacaaaaaaagaaaauauagagacaguuuaaacuauaaucacaugacaguguugcugcagcaagaaaaagccaucauuaggugauuuugggauugcguacacaucagaguguauuuacauagacaaaggcagcuaaguccccuucuuuaucacuaaguaguaaauuuuaaauguguaucauuguuugcauggacuacuguugacuggaauguuacaucacaugucagcugugaauggaaugggguguguuaaguuauaugauaauaauaguacauaguuuuuauuggcaauuuaaacaucaaagauuuagaauuugggcugaauucaugggaacuauuaggggcaguguaauugauugaaguauuuuaaaauaugcuaacagcuguugaagaaaaaaucuacguuguauagucugucauggaccuagaacuauauauuauauaaacuaauauaaacuauaacaaauauauaauaauauauaaugaaauaaaauauauaaacuguauaaacuauaaucuagaaauguuucucaguacucaaaugaagauugcuuuuccuugcaguuaguucuuugcuguggucucuacucaagccugccaugauucaaauguaaaaaucuuaagaaaacagaaaaacagaggcaccacuacauugauuaaaaagcucuuuuagucagcgccuuuccagaaguggugugguuauuauaauuuguccugaggcagacuugaaagaguuuuuuggacagauguauagugguuucauugcacuugcuuuuucauguucauuuuuacauggauuuucugguuuagggaaugggugggugggcggccagaagcuuaacagaauaucacuguguaacuguccuugaauuucauccuccugccucagucucaagguugacugcugggauuacaggaauggccacuacacuggcaucaaauagaauuuuauauagaauguguuuuauguuuuacucuuccacacuauaaagcugcuaggcuguauguacuagguuaaauuacauauucauaaaccaggcuuuaaaguggcuucaaaguuaaaguuuguuuauuggaaguucacauguuacagcucuuuuuuguuucuaaauguuugugucuccuuuucauuuuacaauccuguagauauuauuuaagaaaguucuaaaaggagaaguaaccccugaucaucuuauaagaaugagcccagaagaacuagccuccaaagagcuggcugcguggagacgaagggagaacagacacguaaggacaccuaacuuugucuuccgcuugccugucaguacagagugcaaggaaaagaggccuucucuucccucacuuccuagucucugcuccaccccuucucuucucuccucuccucccccuccccucccccucaccccacccgaucuggcugggccaggugauucucuuucuucaauauucuaaguugcugagacuacuggcauguaucacuucacucuuuuuuuauuuuuuuuuaagauauaguuauuuuauguaugaguguauuuccuguauauauguacuucauguaccuguaguaucaaaagagggcauaugucuuuggguuucucuugcugugcugcaaccccagggccaaagcuacgucgggaggaaagaguuucuuggguuuauauauccugaaucauaacccauugagggaagcuaagacaugagcucagacagggcaggagccaaugcagaggccauggaggggagcugcuuccuggcuugcucuugugucccuaacagugagcugggcccucucccauugaucacuaagagaauccccugcaagcuugucagccuacagccugaucuuguagaagcauuuucuccauuaggguccccuccucucagaugacuguagaguguaucagauuaauauauaacuagucagcacagcuucagaucucagaaaacuagaguuacaaacaguugugaaccuccaugugggucaagggaagugagccaauggcuucugcaagaacaagugcccuuaacuaugagcgucuccagccucugcuuccuaaauucuuagauuuuagugccugucuucaucucugcaggguuuuucuuuuuuuugcuaauuacaagauuguagaauuauuuuaugauuuguuacuugcaaaucagaacaauuggaaaauaagcauuaaccaaccugugcuuucuauaagcaguuucaaugcauuaugaacauuuuaaugaaucagauuguucaauucuaaaacuuuguaaaacuuuucggaaucuacuagaagauaaccugacuugucauauauaaguaugcauagaaauauuguuauguuuaugugguauugucucagauuaaacuggaguguuguaauuuguauauuguacgaaauuuuuaaaauaaaaauuucucaaagucacaggugccaaaaguuuucaguugggauuuauccuugcaguaccuuuaaugucaaucuuuaaagauuaacuaagaacucugcucauccagucauucauucauucgaggaaagagcucacuguauagcccaggcugcagucuccuugcucccacucucccugagugauagauaaauggccacuugugccaccaugccuagcaaguuugagggaaugaugauuuugagcauuuguuuucaggucuagccauuagcugcccauuuuaggaaauaaugaguauguaugguuuuuauuggccugcauaauauacaggauucuuuuguucauggugcuuguuuguggcuuagacauuaaccuucccugggcugugcuugagguggucugagggucgagaggccuucaugcaguguaucagacuuuuuuuuuuuugcuuugauguuauauaaucuugccuccucuguauuucgaaacuaauguucauaucgucuuucugucuacaccccaagucucccaagucugcaugcacucgccuuaccugagauuugaaacuggaugcauuugcuuuggagaccauguuuuucuuuucuuuguaugguaaagacccuuuacccacugaacaaucccacuaguucuauuugacccuuuuaauggauguuuuacaaccaacaaaugagaugaauggacagaccuuuucaguccuuauuguucuuugcucuagugcacacaugcacaugcaggcgcacacauacacacaugcccugcucucucucauauucuuguuauacuugcuaacuuucauagguuguugcugaguuucuuucuuuuaauugccaguguuaacuaaaaagguccaggagaagugaguugucuuguuuuuuguuuguuuuauaaucauugacuaaguuaguauuggagggauacacuagaccaucagaugaagcacaugagucaaguucauucuugguuccuugcaagcugauuucaaguauaaauacuguguuucucacucugagcauugccucuugguugccuccuugccgaggguuaaugugagccucucauggcugagauauagaguuaauucuuaagaucuguccauacuucucagcuccuauugguauuuuauaucagagaaaaacuaaaagucaauuaaaauucuuucgguuaaauucucauaaauuaaggcacauacuuuaaauguuuccuuaaaauauuuucuguuagaccauagagaugauugagaaggaacagagagaaguggaaagacgaccaaucacgaaaauaacucacaaaggugagauagaaaucgagagugacgccccgaugaaggagcaggaagcagccaucgagauccagguaggagcagaucugaccuauguggucugcagcuccaaauacgaagguggacaaaagcuuuucucaugcucuuaaagcagaacuuuguuuuaaaguagugagcuuuaaaguagccuguuuuacuggguuaguucuuaagagcuuagugcacauugucugcauuguaggugccuguuaaaagcuuguuagaauccuggggguauuugauauaguaauuccuuggugcuuuguuuuuguuuuguuuuugucguucuuugguuuugguuuugguuuuaagguguguauuguagaaagguagagagagagagagaauaauagagaaguagaggcuggccauggccauguggagaggggaaagggaguggggagagaggcggcaagcgggaagcaagagaaaagagacaagagaggaagaggggagugagcgagagagagcuccuuggugcuuuguaaauagugcaguuugagaaccguugcggcuuuccuuuaauuauauuaagaugucuuuuucucuuguauaauagaaaaaugagaaauaaguagaucaggguggagacagucuacuucaggguuccuuguuuucaaaaaccaguggaaaaaaugacuugaaguuucauuagaagcuuuaaaaaaugaguuguuuugaguuuuuacuuuaaguaacaauacuaaguauuauuuuuuuuaagaaaguaaaaacaacuuuuugaauguaauggcuugacuuugacaaauuaacaacuugauuuuuaaaauugcugccaaaauuuaucgguuaaaauucauuuuuauuuucacuucuguuaggaaccgucagcuaauaagucaauggagaagccagaugugucugagaaacaaaaagaagagguugacuccacaucuaaagacaccacuagucaacacagacagcaucucuuugaccugaacugcaaaauaugcauagguugggagucuugcuagcucuggugcugugcuuacugcuuaagggguauaguuuagcacucagguuuguagucaggauagguuuuacucuccgguuuggauggugccacgccaacccacuccuguuguaugagaguggauccaguguauaaacaccgaagcagacacagcugugcuuuaccaugugcacagggaugcaaacauagcaguagauagcugcuaagaagaccauucgguuugcuaauuuucagaauguuggagguuuuguuuguuugguuuuccuuuuggauauuauagucccaaauuagugucauuuucuauuuuacacuguucagguuuagugccaugugcuauguaugcauuuaugguuaggaguagacagaauacagauuuauuuuuacuggcaggagguuaucaguauuuuaggaaaaaauucaugagggagccagauuuacuuuacauuguacaauauuuucauuuuagauuguuaacauucucguuuuuguuuuuguguauuugcuuuugugagagggguuuccuuacauaacagcucuggcugucuuagaauucacuuuguagacuaaggcgggccucaaacucagagagcugcugcccucugccuccccagugcugagauuaaaggcuuaugucacaacauuucccauuacuguguuaacauucuuaauuuuucacuuucauaacugaggaguagcaccagugacuucucauuugcaccauuuucuguuuaaacaguggugauaacuggaaaauagauaaaaggcgacauuaagucaguccaggugaaacccuucacagugugaggaaaccacauuucaguuagcuuaggucucugggugccauugauaaauuauuugcuucuuagaaaaaguguaacaauuugcuaugagaaaacaucacagguauauauuaucccaggaaauauuuauucaauaauggaaccaaagaacuuauagcacuuuugaaaguaaaaaugcaugacaguguaaaacuugcagauaacaaucugauuuugguguuuucugguuucaggucgaauggcaccaccuauagaugaucuuucuccaaaaacugugaaaguuguuguaggaggagcccggaaacacucagacaacgaagcagagagucuagcagaugcguugucuucaacuacgaauauucugaccucugaccucuuugaggaggaaaagcaagaaucucccaagucaacguuuucccccacuccacgguagcucccucucucgggcauagucuagaauaagcuuugcuuaauuguacuuaaagaugcgcaaacacagaaaagggacauuuccuagagacuuuugagaaagugacuauguauaccccaggccaauggauaagugaacaggacuucaggguuaauuuauuugaauggauuuuagauuuaagaguacgaaguaauggcuuucagacucuuaauuaugggcugaaaagguggcccagcauguaagagcacuggcuacucuugcagaggaccugguuucuauucccagcacccucaaggcagaucauaaucgccuguaacuacaguuccaaaggguuggauaccucccucuggcuuccauggacacgcacauggcacacaggcagaacuccauacacaugacauaaaaacuccauacacaugacauaaaaacuccauacacaugacauaaaaacuccauacacaugacauaaaagcaaguaaaccuuuauaaacaaaucaggaaaaugauguaaauacagugaccucaagaaggagggguguagccuuugcgcgacgcaugcacaaccucagagcacuuuagaggggguccuuguaaagcaugacugugugguugugguuguaaauguauaauugaaagcacacaguuuuuauugagugcaauugaauuaaaguguuuacugacuuuuugacauaaaauacuuuuagugauuauagaaaguagacucacucauucauggauauuucauuacauuuauuuguguguguauuugugcuacaauacucauguggagguuugaggacaacuuugaggaguugauugcuucuuuccaccuuuauguggacuccagggauugaaccccggcccuuaggauugggggcaaguaucuuuaccacagcgcuaucuggcuggcguguuuccuaacuuuaguauccuuuucuaggccagagaugccuggaacuguggaaguugagucaaccuuucuggcucgauugaacuucaucuggaaagguuuuaucaauaugcccucuguggcaaaguuuguuaccaaagccuaccccgugucuggauccccugaguacuugacagagguacugugaacuuuccucccuuuccuugcuuggguuugcacguguuucugaaaacagcaggcagggaaacaugcuguuaguaauaauuuaaaaaaaucuauaaugcugacaaauuuauggcaaaguuagccuaugaaaaaaggcuuaauugcuuaugaaaaaaauuguuuaauuguuaaagaaauggaauuccuacacuauucagguuucaggaccauuguaccugacugugucugucacuguugagguugucacucugucagucucagagagcacugaccagccacugcagcacuuccugugguuaguuaaauagaaaauaaacaacaguaguguaauacugugguuagugaccaagugucacauuuaaacaucaaaggagaucaagccaguauacaugcgcugaauacauuauuuuuguggauuugauccauuagucuuuugguuuaucuaaaucaucugaucauuaucaucccuauaaugguaaugguuuuccuuugauuaggcugaaauuuuccugucucaccuucguccuuuccccuugugaucuuagugugcagccaggggcccuguguguuugcagcaagccuucugucgcugagccacagcacugguccuuuacauucccauuguucugaguuacuacacagagcuguuguugugcaguuuacuugggcaauauugaaugugaauauuguuagagaaaaauuaaacaggccgcuaguggucuuuugguggguaaaaaauaacccuuuagaauuuuuauuuuuucuuuagaucauuuugaagcuaauccuuuugcauggauaauuagguccuggucucucagacccuuuuaaauuugaauaaagauuuuuucuuagugccauaguuuucacugugguuaguuuccuaaacuccuucacugacuuuuauuuuacuuuuauuacagcuaagauaucaaaauuuugaaaguaacuaaugaauuaaauaaacuuaauucuacuuucaugcuuuuccuuggucuucauaggaaaaaaaauacugaauaaaguuuuaaaauuuugugauuaacuauauauagguaucaauauacauauaguguguguaguuaagccuuuuaaaacuggauuguuacagaguuaauuuucucuugcaaaauauacuauguaauuaaauugcauaaaaucugaacuucagcuauuaauuauuaaggauuccuucaaaaaauaaaaaagcauaaaaaaaaaaguggcaggcauagugguacacacuguuaguacaagcaccagagacagaggcaggaggaucucuuauaaguucaaagacagccuggucuacauagugaguuccuggacugcuagaacuacauuuugcgacccuguuucaaaaaaaaaaaaaaaaaaaacaaaacaaaacaaaacauaguaauaaugcuguccacugccacagaccaccauugaguagcugagagcccaccccaaauuguguguguggugcuggcuacgggguccuugugcuuucuauccugccuuggcaugaccuuagauuuugaucuuaauguugaggcuguuuaugucuguguguccuuaguaacugcauuuccaguauuauuuaucugaaguuggcauuugaguuaggcucaguugcuaucucucuacuggguuuuauuuugugaugugaugcaguuuguuuauucuuugugucuucuggggauugauugaacucugagucuuacacaugcuaagcaugugcucuauuaccauguucuaagcccuguuuacuuguuuuuauucuuauucaaauuauuuucaaagcuaagcgugucugagucaugggauuguagugaagauguuguggauugguugaucaucuuuucuuuuauccauaggaccuaccagacagcauucaaguagguggcaggauaucgccucagacaguuugggauuauguggaaaaaauaaaagcaucaggcaccaaggugaguaaacucaacaguggcaguaugcaaaauguuuacagagucaaacuacuuaaagucucacacaaggauccauugucucuuauggagagggagcuaauacaaauuggaaauguauauaaccucucuaggaggaaaugggccuggguggugauagacaacucaguuaccaagugacugcuaccuaggcuggauccccagcacacacauaacacacuuaucagcucagcucuggggagacagagacgugcagaccaggcaggcuaauuagagcucagcuacacaugacgcuuugguugaucuguggauucuaagugugaauacauaaacaaagccguuugcucaaccuucccuugagucucugcuuucuggaauguguucucuguagcuucugucaacacuguggaaagaaguguguuagaguaaggaugacguuuaccugugucaggcagggcauggccaagcucuguaugcccguguagacucugcugcaguccggcgguucagacccugcagaagccuguccuccuuugucaggaugcugggaggccuagggcucugagcuuguagaucagcugggaagcaggccgcuucuugccgcuucacuguuuccaguagugcgugcuuccaucaagcacagaagucacaggucacucagcagcagcagaugggaaccagcgaaggcugagccuuagaugguuuuuaacggcaaaccccagaaauugcaguugucuuugcuugagcuauaguuggugagaacugagucacacagcuguguacaacuggaaagaaagcaggcagagagggcuagccagacaugaaggucuguuaguaacaggaagaggugauuauaaccggagauguaaccucggccuccgucacagugaugcuucucuucagcuguggucuccauuuauuuccuuaaacucagagaauaauauuucauggaacaauuuaaauccguuuuuguagaaauuucuuguucucuuuagagugacuaaaagggagagucuuaagcugagaaggcucucuucccccuguauaaacuguugaauugacacaguguuaacaguucauugaaacaguuaaaagguuacggaacuugggaggucaggacaggcagaccucuugagggcagcuugguuuacauggccgaaaaaagagcuacuacauugguugcucuuacuucuuucucucucccuccugacccccuucucgcuguggauacauauuacuguccaguacuuuauaacauaccuucagcuugaaauaauuuaaacacauacuaguuaguuagcuuuagauauauuagaaugugauaucacuaauacauuuuggauaucccuuauccaaacuguuugagaucagaaaugcuucagauuuugagcuuuuuugaauuuuggaauguuaguauauacauaacaugauaccuugagaauagggauucaaguauaauuaugaaaugaguuauggauuauguaaaccuucuaaacauagacuaaugguaauuucauacaaaauuuuugagguaccuguguuuugauuccucacauguagauagguauagaauuuucuaaauguuguccuccaaguuucagaguugagagcauuucuuuauaaccuguacacaauucuaggaggccaagccauagcuuagcucacacuaguaauuuucuuuuugugucaguuuagacuuaguagugaggaaggccuuuuccugaauaccuuuaaaagaaaaaccuacauuaauaaaguaauaccaaauuaugauuaucuuuuuauuugaaauaaaguugagcaccccagagacagauaacaaaauucuuuuuuuuuuaaauuuuuuauuaguuaucuuccucauuuacauuuccaaugcuaucccaaaagucccccauaaccaccaccacccacuccccuacccacccacucccccuuuuuggcccuggcguucccuuguacuggggcauauaaaguuugcguguccaaugggccucucuuuccagugauggccgacuaggccaucuuuugauacauauacagcuagagucaagagcuccgggguacugguuaguucauaauguuguuccaccuauaggguugcagaucccuuuagcuccuuggguacuuucucuagcuccuccauugggggcccugugauccauccaauagcugacugugagcauccacuucugugauaacaaaauucuuaaaaacuuagaaucuguuauauguaugcuuuuagaaucuuaucaaaaccaaaacucaaaauuagaugaguacuaauuaauaaacuauuuaaaaaucaaacuacauuuuagguuacuauuuuaagcaauuguuuguuauuuucuugaauaggaaaucugugugguucgcuucacaccaguaacugaagaagaucagauuucuuacacuuugcuguuugcguacuucaguagcagaaagcgcuaugguguggcugcuaacaacaugaagcagguuaaagacauguaccucauuccauugggcgcugcagauaaaaucccacacccucuugugccuuuugauggaccugguaugucuaugcucugguaauagaaugggcuugaagugagugggaaggggagguccagaguagaaggacugguuggcugcuuucugucuuagauccagacccuuagagaugacaggacuggguuggccacaguuuaauagcuuguaauaaagugcuuguaaaagcucugaaaugauugacgacagacggcuaguuuauggcuguuauguuuguuuauuuucucuaggacuugagcugcacagaccuaaucuguuguugggccugauuauccgucagaagcugaagcggccgcacagcgcuagugcaggccccagucacacaggcgagacuccugagagcgccccaauaguguugccccccgacaagaaagguaaaauggagucaugcacagaggaagcagcagaggaagagagugacuuuuucaauuccuuuacaacuguguuacacaagcagagaaauaagcccucacagccucuucaggaagaccugccaacagcagcugaaccucugauggaagucaccaagcaggagccaccaaaacccuuaagguuccuuccugggguccugauuggcugggacaaucaaccuucuacucuggaauuagcaaauaagccucuuccuguggaugacauacuccaaagccuuuugggcaccacuggucaaguauaugagcaggcucagccacuuguagaacaaagcacucuuaaagaaauuccuuuuauaaaugaucaagcuaacccaaaaguagagaaaauagauaaaguggaggugacugaaggugacgccaaggagauaaaaguuaaagcagaaaauauuucagugucuacaaguaaaaacucaggagaagagacuucaucgguagguucaucuuccauuucuccagggccuuuggcaagucucagucugagagggaaaccaccagauguuucuacagaagcauucuuaacaaauuuaucaauucccucaaaacaagaggaaaguguggaaaacaaagagagaacauuaaaaagacugcugcuccaagaucaagagaauaguuugcaagacaauaggacuucaagugacucucccugcuggccuggcacugggaagggaggcauggauggggaugggagcgggagcgggagcgggagcgggagcggcagugaggguccaguggcuaacacaagagccccacaguuuaucaaccugaaaagggacccuaggcaagcagcaggacgaagucagcagacagcuucugaaagcaaggaugcagagagcugcagaaauggagacaagcaugcugcgucugcuccaccacacaacaaagagcccuuagcagaggcugucgguggagagggaaagcugccuucgcaggagaagagcucauguguagagcagaacgacgauucggaagcugcaccaaacucauccucaguagaaaacuuaaauucgucacaagcagaacaagccaauccuucacaagaggauguuuuaacacaaaauauugaaacgguccacccguuuagaagaggaucggcuccaacaucaucucguuuugaagguggaaauaccugccaaucagaauuuccgucuaaaagcguuagcuuuacuugcaggaguagcagcccucgcgcgaguacaaacuuuucaccuaugaggccacagcagcccaaucuccagcaccucaaguccaguccuccuggauucccauuuccaggaccccaaaacuucccuccgcaaaauauguuuggauucccaccacauuugucaccuccguuacuucccccuccaggcuucggcuucccucaaaauccccccaugguuccuuggccaccuguucaugucccaggccaaccacaacgcaugauggggccccuuucacaagcaucacgguacaugggcccacaaaauuuuuaucagguaaaagauauucggagaccagaaaggcgccauagugacccaugggguaggcaagaccaacaacaaccagauaggccauuuaauagggguaaaggggaccgacagagauuuuacagugauucgcaccacuugaaaagagagcgucacgacaaggauugggagcaggaauccgaaaggcacagacacagagacagaagccaagaaagggacagagacagaaaaagcaaagaggaagcagcggcacacaaagacaaggagagaccgcggcucucacacggcgaccgggcaccagaugggaaagcaagcagagaugguaagagugcagacaagaaaccggacaggccuaaaggcgaagaccacgaaaaggagaaagagagagacaagagcaagcacaaagaaggggagaaggacagagagcgguaccacaaagacagggaccacaccgacagagugaaaagcaaaaggugaaacuggaggcugcuuuagcgucuuacaugugugucuuuauaagauugccugguaggacugugccaucuuaacccucggauugcugcuuggcagagcaguaaacuaugcuggugcacgguccugugaccagugcccuccgccccuucuuuacaccacuguccuaccuacaggaauuuaauauuuuuaaaguuuuacaauacuguauauucaaagauuuguuuaauuaauaugcaauaaaggcuuagaaauuuuaguuuuauuccuuaauugguaaauaugguuaacuaugaaauauauuuccugccucuagugaauguccuuucuauaaugacuaauuugaaaguaaucugugcucuguacauuuguuuucaauugcacuguuuuuaaagaaaauguagaggagcagcaaaaaagccaagcgacuucccgaugagaccauacuauuuagguggcaguuuuugacuguaucacgaccccagggaggucauggguugcuuuaaucugugcucauugaaggcguuucuuaccauguacugcaguuugugguaggccauaucccuuuccuuucuggcucuucagaaacuugaauacuuaagcuuguacaugaucuuguguuuugcuauccuuuuuacuguaaaauguaaauauuuuaagggauauuuugauucuaaauaugauaaaagaauuucucaccuacuuugugugugugauuugaaauucaguaguaaaagagauucuucgaagcuucuucucaagacauuauuauuuuacucagccaagaguauguagauacacugucagacacggccuaagagaggaauggcuuucuuacaucuuagaugauucacgucuaaagaggcuagugcuuagaacuuccagcagauagcucugcaguuacccacuuaguugcuguuauguuucuggaagcuuacauaugauuaaacacaguaaucauuauaaaacugcagaacuuaagugaaauguauuuugauuuuugauuuuuuuguggggggguaaagugauuuguuuguagggcaacuguaaaacugaguaugccaguuugacuugaaauagaaaauacacaagacuguuguucuuucagaucuaaauuuaucuacaccccgaaauacaucuuaugcugauguuuaaaaccuaaagcaguagcugccagaugaugcuaacacucgagaccccacucaagagcgaucaguucuuaucuacuuguacccaugaagaagaauuccaguaacuccacaaaauuaagagaacuguuuuuaaaggauuaccagguuuuugaaaccgaauuaaccuugcuagagaaaacagcagucaaacauuuugucugaauugcaaggauugcaguauauuuuuuuuccaucuuuaccucugaaauuuaucaucaucaugaaaguucuaaaaugaaggauuuccguuuaaauaaaguauuuucaacguuuggucu

SEQ ID NO: 106 - RNA, 1612 nt, Mus musculus
ucuagcgcgcaggcgcggcgcacgcugccccagcccccggaacgguaaacaguggcgucacgugacgcggccccgcuccugcucccgcgccgccgccgccgcaagccgauggcugcgggcucucgcggcgccgcacaggcuccacgaggcgagcgacccccgggcucagggaagcagcgacugcagcucggacggggagggcggagcgcaggccggccguagugucgucaccgcggcggcgcgggccggggagccccgagcccaggcagcaacgccgacgcccugcgcgcacccccuccgcggcccccuccuccgcggccccgcggccuccaucuuccucuggcugccgguggcagcgcucgucugcggagcgggugaguggcggcgcccgccgcgacgggcacucgguggccucccuccccccacgcgggcggcccggguccuuuccccgcacccccaccucgcgcagcggccgccugauauucccgggccguucggccuccccggcucgccccgccccgccccagccugccccgccguuuggaccgcgagcccgaagcggcggugacggcgcggccuccgcgcgaucgccgggccucggcucucgcccgcgagcgugccgggucucugucgccgccgcgcgggcaggcgucgcggacuacuccggguuccaaggccccgggucuccggcgcgguggccgcagcccgcucgcggagccuggcagccggccaggguccccgccgaggccgacccgcgcccgaggccgguccccguccccgcauccggggugucugaggcugcggaucgcgcgcuuuugugcuggggaccgggacugugggccggcuccuuuugacuaguuugaaaugggaagcccgaagaguccugcuugccgacaggacguguaauuuaaugaaccacuagucgauaaguacguguuaauggugcuaaauaacugaucaucugacaccgggcgggggugggguacccagggagaggagagaguguuguagcucgcuccagccagaggcucugucccccaggugccucuucucccugucucuggguagcuaaaugagguuuccuaguuguuacaauuugaauguguguuuauuauugcuauugaguaaccauuaguagagcgccguugcgguuugagggagguagcagugcuuuaaugucggcccgauguuagucuucauucuuccgacaggucuuuuuaaaaaaggaucgaacaaucuagacuugccccacauuaugaauuuuguuaccuuauuuuacacuaaaaaaaaaaacaaaaacugaucacagcaaauuguacugcuguauuuaguucguauuuugccaucaaacuuugucuuguguuuucaauuuccaaaccaacaucucgguuccugccuucuuaaaaauucuuguguuuggcauuuugaaaacguagguuacauuuaguuguuaaaaagacagaugaaacaggaaguguucuguuguagcauccuuauguuuuuaauuuauagugcuauuucagagcacagaagauguugagagaaaaaccaguuauuucaaacagcaguccuuagcaucugacauacuuaggugguaguuuuucuucccacu

SEQ ID NO: 107 - RNA, 9459 nt, Mus musculus
gcgccugggcgcgcgcauuggcucugggcugcggccggcucggcgacgcuccucgggcagcucacugcauggucgucuggugcccccgccgccugcauccccgccgccgccccgcgacgcccaccgccgccugcccugccgccgccgccugcgccgccucgggaccggcuguaugauuaggccacaaucuucaaugaguagacauauuccugugaguaccgcgggcccggccuuuguuagagcgagcgaccgaggagggaaaggaggguggccgggcgaccgaaacgccggcggcggggcccggacccggagcgaccggcagggcagcccagcggcuuugugcgcgugccacccugcggccuuuguuccgagaagccgcgcgggcgucguggacguggccggggcggggcggggcugcggggggaccgggaccgggcgcccggggccucccaagauggccucgguggccgcccgcgcucgccaccgugaacccgugauugcggaccucgcgacugugcgcgccgcucaagcccgggcuugccgaucgccgccgggcuucgguaguggcgacccggucggcggagggggacucugacucggccccgaggcgggcugcgcguggggcgguccgcucuugggcuggagcaacaggagcugcugggcagaacugcgcggcuccuguugagcgagcagcccugcaccauuccaccgcuggcgagcugaaauuuccacggugucggaacggucugugcggugaccagaggucuggauuccggagcuuaggggucaugaauccuauccuggcuugcuuuuuuuaauuauuauuauuauuuugcuguuugcuucgugccggcuaaaacgguuggaaaaccagaaaaucgcgaucuguucccggaaggaaacagcgcuugcacacgcgcuagauugggcgcguuaccugaaaccugaguguauuuggaacagaauuggauaaagcagaugaucccacagacugguuugauucuagagucugacagacugaagcuaaugcuacacacauacacacacacaaaugauccuuuuuuuuuuuuuuuuuuuuuuuugcuuauggugcaugcaauuaaaaugggacgaucucgucguguaucuuggcugccuaucauguugagguuuugccugugagggagugggaggauauuauuaagaaggauuucgguggucuccacuguuuuaacagaaguguccuccagccacuggguggcuccacucauuucaaagcaguucaggaaaauuuuuuucuugcugcccuccagcuuccuaauggaacucuuuaaaagcuauaucggaccuguguaugaauguucaauaaagugccaaauuaacaaaaacaaggaagaaaaaaauuuaggaccauuuuauauacacgggcaaaagauuuuuauauaugcaauauauauacauauguauguauuuauauauauauguauauauauaaauaaauaauauuuuugagauuauuggagggagucugcucucugaaguauuaaucuuuacugguaauuuacacuggguuuuuuaacgcacugaauagauguacuuugugagggcacgugucgggaauaaguugucuugcuugugguaccuccuaguaaauaagaguuugggggauuaguuccuuuguuucacuauaaaaauagucagggaauuuuugacugauuuuuuuguuuguuuguuuguuuuuuuguuucaagauuuuacuugaguaguuugcucugaaggacaacgguugucauugaguguucuuguuacuaagugcaacugcuuuucuuuccaccacaaacugccuagaguagauagaccuuaaaggguuuuguuaauucccauuuuacuucuauuggguuuaucugaaaggcuuuuaugcauagacucugaaaaaguaucguaugacuaugaauauacuaguuggugcuggcaccaaucugcuuuagcuuuuuuaaggaggaacuuauggaaauguaucugucaaugaucauaguuaugguuacauuguuugagaccauuagaaagucuugauuuccucuuuucauauuugaauuggauuuuagcuuugcagcagagaaguggaauuggaguuuuaaaauagcaaaaagauaauauuguguauauuuuauuugaacuugucuuaaguaggauauguuugaagaucuaaguaaguccauaaguccguauuuauaagagccaaucugauccaaagagauggcauaaaaauucuuaggaucuuuuaagaaggagauugcuuacaguuucacuuagagaauuauccugcagugcaaugugguuuauagaaacaagauggccuggcauucuaggcagccucccuacugaugaguccuagcgucuuguuuaagucugaucgauugggauggaacccacccucccucccacacacuucacuccagagguuagugacagugccaauugcagacugagaagcuuuaccuaaagcuauaacugugcuuacacuauucuuaaauguaaaggagcugcuacaaaauacaaaaaggcaggcccccaaauuuaaacuuuagagacuaaaauguaaagggguaauugcauuaaaaguguuuuuguuuuguuuuguuuuguuuggaagaaaagccauacuccuuacuuugaacccaguagcuuaauaacauaaaauaugaaaucagaacuagugggcaguugaaaucacugucugugaauucugcaagcgucagaccacauggcgucuagaguagugucuaugaacagcaggcuaaggcaguauagaagacacaauucgggccagaauaaaaguguaaagagagacggacuaauuaauuaaauccaugugucuagauguguaaguggaauuccuauguagcugugacucugaguucuugauuguugagagcuucacuuuaaugggcuugugauugcucauuuuaggccuauugauuuaaaaugcaguaaccuugaauuuuguaaugcaaguaaaagucaaauuagcuugucucuaauuugagcagcuguguacuuaguggaaaaagcaugacauauuccuuuugaauuagaaaauaacuuuuuuucccuuucuugcuuuccuuuucuucuaaacagcaguucugugguguucucggucacacauuuauggaguuucugaagggcaguggagauuacugccaggcacagcacgaccucuaugcagacaagugaacuguagaaauucauuacuacuccaccaagaaacccccauaagaguggauaaccuggacacaggcguguugaauugaaaucugcagagcauuugacaagagcucagaccuggaugggguaaaccucagugcacuuccuuuguauugccucaguauuacuggauugaagacucacugcuucuuguuaggagguucauuucauugcccguuucucccaauucauacucaagcacugagaauuucaaguggaguauauugaauauugaaguagacuucagguuguuuuuugguuuuguuuugguuuuuuuuuuuuuuuuuucuguuuugguuuuaaaucauuucuguauucaauuuuuuaauucuuucauaacccuauuggguguuuuuuuaaacuaaauuaacauggcucgaaugaaccgcccugcuccuguggaagucacauacaagaacaugcgauuucuuauuacacacaauccaaccaaugcgaccuuaaacaaauuuauagagguaagauacaauuuuuaauguccuaauugaugacaguuaauagugggucugcuugaaagugucuagcucucgcucccagagaagaaauauuggaacgguagaagugugcuacacuugagaacuauguagcccuaaguuugcuuaguuaaauuuacaaggcacagaguuuuuccuauuucuucuuagccuaguguuguaaucuuccauuaguuggugucugauuuuauuugugcuuuaagucuaguuuuuagcugcuaauucugcuauuuucugauggcagauaaugaggccucccaacuugcuuguacuaggaauuggaauuuaaugccaaauaauuuaauugagcuuacauuuauaaaguauaaaaaucuacauaugcuuagauagcaaauagagaaauauuuaaauguuacauaauuuuuuaaauuuugaauuacaauguuucuaaugucagcaggguugaguuauaauuacuuaauguguccuuaggccuuaaguuuuuaugauggcuuuuuaaaacugaaaucgugacauaacucucagacuuaggucugaggaggcucagucaguaaagcaguucacugcucauguagagaacccugcugcuucuucagaauccauauuuagaaaaccuugagcgguuguagguggggcagggacaccuugggcuccguggcuugcuagccucgccuucugguaaggugccagacagugagagagcaugaggugaagagcaccugagguuaaccuggugccgcuccaccugcacccaagugcucacagcauuuugcuuuuaguguguguuuuaccagaauuccuccauccacaccccccaacauaacacguagcauuuaguagcccucuuuacucuuaauaaugugaaacaagcauauuaaacagguuuugccauuuguuuaccagcaugaucaaaagaggugcagauggcacagcaagaauacgguuccagaaaccucauuaauguuuuuaauauaugcauuguuuccuaggaacuuaagaaguauggaguuaccacaauaguaagaguaugugaagcaacuuacgacacuacucuuguggagaaagaaggcauucauguucuuguaaguacuuguguuuucaugucuucguuacauacacuacagaaguuuauucaaaucagaccucauagcuuuuaagucaaggcaaaauccuacaguaguaacaugugauuacauuuuuugucugcucucagugugagagucuuccugcauugcccaguuagccaggaaagugcugugaauuccgcaggcugccuccucuccuggauuuggggauaaagggaugcgcagugccuugacaauuuaaaacucugaaacuuuucuuuugaaucaggacuggccuuuugaugauggugcaccaccauccaaccagauugucgaugacuggcuaagucuugugaagauuaaguuucgugaagaaccugguugcuguauugcuguccauugugucgcaggccuuggcagguaaggaaauccccuagucuccaucuagauugguggaccucacccuuccuaaugccgcagcccuguaauacauauguaaucauguucugaugaccuccaaccaaagcauuauuuuguugcuacuguucugaaucauaaagaucagauauggaguccacagguugagaauugcuauucuagguaaagguccacauugaaaguauuaaugcuuaugacuuuucuuuggggugacucugacccuccugcaugcaggacaggacucauaacaaacacuaugcuauacucuuucccaguugucuuauuucagauaacucacugaguugucucagcuggucuugaagucacucccaccaggccuugaaauguaccccuaaugucugagcuuuccaaguagccgagauccuaagccuuguagcaucaaaacuaagucugucguugaacugauugauuauacuuuuuuaagaucugggguagaugaacaauuaauuuuucaggguuuaauuagugaucaaacuuuuuacauuaccagagcuccggugcuuguugcccuagcauuaauugaagguggaaugaaauaugaagaugcaguacaauucauaagacaguaaguaacgccgccguccucuuucaugccugcauaaucuuauuaaauaucuaaacuaaguaaaauccaagccauguaccaauuaacuguugguuuccaccuauguacuuugucugcauauguugugugccugugguggccuuuagaggccagaagagggcauugaauaccaugggagucaaguuauggguggcugugggccaccauguugguguugggaacuuaaacuagguccuuugguugaagcagcaagugcucuuaacuauccccccaauugauaucuuuaagaaaacuguacuaaggcgggggaagggggcuuuuuuguauucgugcagauaauuguuggaauuuuuuuuuucugcuuuuugaccagugugguuguuaaucuacauuuugcugagauacauauagcuggggggaggagguuguuuugaccuagacucaaucauuuauaggauaaaaguuaaaucaaaccacuuagcauaacauuuagaaaucucaaguguucuaggugggcccuuuggucuucauuuccuuacuaccagaaauagcauccuucuaacuucugucaugaucaaaaaguccuuugucuuuuuccuuccuuccagaaagcggcguggagcuuuuaacagcaagcaacuuuuguaucuggagaaguaccguccgaaaaugcggcuccgcuucaaggauuccaauggucauagaaacaacuguuguauucaauaaaacuggggugccugaugccauugccuuggaaguggaacuucagaugggaccugauuugucaugcauauuacccaaugugucggcuuacugaauaagucuacugcagcuccacaggaauacugaaaaaccagucuuaccaggccacaaguuugacagaauugcaaccucuauauuugggcuaugaucaacauguuuggacacuuagcaaaagauuuuugcuggucagcauuuaaaaugugcuuauuauuuguaccaauugaccuuuccuaaaauaagguauugaguuaugucauuaaauguacuccugugccagaauauuauuagucuauaaggaauuuagaaggauuaggugccaaaauacccagcacaauacuuguauauuuuuagcaucauacagaaccaaaauugcaggaacugagaacucuagaccauccaugguguauuccuucagucauuucaaacacugcagggcuucucucguuaucugccugcucacucuguuuacaucucccacacuuaugccagaauacgucagguuugcuuagccauccuuuauuuuuuuuauuuuuuuuuuuaacuaagucuugcgcugauuauuuaauaugucugucucauuuuguuuuguuuugggaaaccucuguuugaaaaucaacuuuguuacagaagcacauaucuucaacaaugucuccagacaaaaagccuuauaguuaauuuaauguuugcacucagaagugcaaccuaacagggagggccugaaaaagaaacgagaggaggcuauuaaauauuuuuaguaauauguugccuuugucaugugcagaacauguagaguaugcucuuuaauuuaguaaauauuuuuaagacauagagauacauuguuguagcuaaccaauucuuaaucaaaauuucugaaauuuuuguguuuuccauaccuaucagaaguuuuccagcuuguuugaauuauggcuuuccucuucccaaucucuugcaaaaaagacaaagugggauggaucugcuagugaacugagcagaaauguuuuauacgccuuuugagcuauguaacuuaauaauuggauacuugaucauuuguuuuauuauguaaucgauaaaauggugauguguauuaaaguuaguucaaccauauauuuauacugucugggaaugugugguuauaguucugugggagaaauaguuugucaguguucaccagcuuguaaaaacuuaguaugagagcuucaacauuuaaauaaaugaugaaccgcauucgucacugaggacacuuuugccuaaaauuaacuuaauuuguagaaaacaauggauucaguuaauaucauuucaauuuauggaaaaaauuguuaggguugccaagugcuuuuuauuaaaaguuucucuuuaaaggucuagauaauugugaaucaguugaauguugggcaccgaggggaaacaguuuguaauagaugaucuagauuuuucaguucaguuccaucagucacuuguagcucugcaauuuccagaccaguuuucucauuuuuaaguucauuacaugccuguauauauuuugaaauuaauuugaaccugaguauuuggcacaugauggcuuaauaaauuuuaacuuucaauaaucugaaauguuuccuuuuccuaguucaugcucguguuagauaaauaggauuuuuugaaauuuugaaaaaaggauauuucaucuuacacauuuaaggcuuuacaugcgaaucuagcacuuaaaacgugcuggucuauaggccuuugcuucuuuacuaaaugauacacuauugccacacagcccauaaguaaacaugcuuuuugggagaagaaaggugcugucaugacuacugaaaguuuugacuuuauuagguuguauauauggugcuagaagucacuugcauuauaaacuuaccuguauguuacaaacugagauuugcuuuauauuuucuaucugugaguacacuaucauucugcaauaacauccaagaaauaccuugggucuaauaagaauuuaaagacuuauaagcugcauucuuaaaugcaaguuggcuguuauaaauuuaacuuccuaggagguugggguauauauauauauauauauauagcucagugaaugaaugcuugccuagcacacaggaagcccugaguuuaauucccagugucagauaaaucaugcauagugguaugcagagauuagaaauccaaggucauccuuagcuacauaauuuagcuagccuggucuacaugaaaugcugugucuaaauguacuaugccugcuuaagcuggggcacuuuuacuagauaacauagugacuacuugcucuggcuucugaauugggaucacaaugauacugaggcaagugaugugauuacucauucaggagaagaggccgucuccacuaagagguaccauaaaauagaugccagcagucauugugcccacugagaucaaggucagagcuuucuacacccagacaacuaacugccugccuagugaucacauugcaugugcucaaguuccagaguguuguaaaugauaaccggccccauagccuagcuguaaucgcaauccugggaucuguuguguuacagucaucuggcaaauaucugcuccugauauuuaggaauacugcaaaggguuuagaauugggugccagauucuguuaauuaucgcacuccuuaccaguaacaauuuuuuuguauugaaguuucaggaaauguuaauuuggugagaaugcuucaaauggaagugacuugguuucuuaauuuauaagugaaagguuaaaauacacaaauuaguaucugcuguacacauuuauaccccacauucuugaguccuugaauuaauggugugucugcauuuuuaacucaugaauuggaaauuaaagacuugcuuuaaaaguguc

SEQ ID NO: 108 - RNA, 2159 nt, Mus musculus
cuuuccuggaggagcagugagugcccacagcuggucugcagucauucaagagugccuucucuccucuccgcugcuguucacuacuuuuuucugcccaaaagcaagauggcaaucuuaaucaaauagggaagcuagaucuuuaaaauaaauuaaaaaucacuuuuauauauagcagcaaaaacauauguuccucucugcgaaaagaaaaauguuaacaaggaacauggugauguggugggcuguccgaaacuucugcuggacuggaucccaugagcaucucagagucgcuccuucaccuugcccaugcugccugaagacucuuuggugucuccagucacguuuucacuuucuucugaacuuaagcuuucauuuucagaccuggucccauuagcgaucgaguuuuccucauugacaagcccauuuucagcagcuuugacuuugcugacagucucugugaggcucagagacuccugcacaccugccuccuccuccaacuuucucaggaccugagggagccuugaguccuccacaccacccuccaagagccccaggucacuccccucguaucuggacagugguagccucuccuccauguguuugcaguaguacucccgguucacggccacacucuucacugcuuuuuccaaaaucuccuuuucacccaagcacaauuugauggccauuguggcccggacagagaggucaggauauuucaagucgaucuuaucuuccucaauuguugucuuauauguuuuuaaaagaagugaggcucuaucuuccagaaauguccaaaguuugaccucauugucccagcugacaggaaacucugcguuccccagagugaagauccugucaauggcgcuguccccuagcaaaugcucuuucagcuccucuucagucaugcagaauacucagagaaaagcuagaagcugggcagagauggguggcucaguaaaaugcaaugcaaaaacacuggauguugggaugccagcccaagccaggaccucagccuucauggcauagagcuugucacuuuuacucaugcccagcuuaauuuucaaucugucgugggaauuauugucaaagaaaaaaaaccacuguggaucacaaacucugcauuugacggaguaccauaaaaaauguaaaucugaucuccagccugaaagucccgcagagccacacacucacagcggucaucuuccagguuauagccaguugugcucaggccaucgguaugacugcauaugucccauaaaggaaucagagccaaggacaccaggaaccauccucuguaggaauuugguuuugccgagucauaacugagagacggcccaccuguaguccucguaagugaaagacuccuucaagggcaguuuguuggcaugaggaugggucuggaugacuuuauagaaauagccguacugacgugcuguguuuuuauacuggcugaagacaucauggauggcuuguguugacugaagacaucguacuuccuuuucuucgaaguagagaggggugucauauucacuggggagggucugaauguauggcugccagaaagaguuggggcuggcucacucgcauagcagauaaaaggccagugcaauguuucccauagcuuagagaauucggucuugggaauacaggggccccaauacuaaauucuuagcagauucaacagucauuaguaacuuuugugggacccauaaaaauaauucuucugcuuugaugucucuuguugcucucaaaccaaagcccucuucucugaaguuaaccauuucaaaacccucgacagaagccccguuuucagaggcccauuucauuacaucagggaaguaauugucucuuuuuccaucaaaaguaacagacagaccuuuuugcuucuuccguauuuucucaaccagagcccggaucugcguguacucuucccauucuuucccagggccgggugcaggacugcuacauuucugcaacagcucacuugucagguucaaaauuuccuuuggugacacaguggcuguagccccaguaucugauuucugaguuuucacucgacucuucuuacccauuuucugacugcccgcuucgucucugcgcaguggcagugccacacuccagccgggaucccaccgucccucucaaccaacccccagguagcc

SEQ ID NO: 109 - RNA, 12313 nt, Mus musculus
cggggaggugggggcggugccguccgcgucagcggcgcccguggugacggcgacgugcggcucgcgccacugcugcccgcggacgccgaggacccccggagcucauggcccaggcgaagaucagcgccaaggcccacgagggccgcuucugccgcucgucuuccauggccgaccgcuccagccgccugcuggagagucuggaccagcuggagcucaggugagggccgcggggcgcgcacaggggcgagcgcgggcgggggcgcgcuccgguugggcuccccucccccggcccggcagacuggcgagcgagugcggcuugcagaacuuccagaaucuucugcgcggucccccucugccuuuaacuuuucugcuuccaggagggaggcagcagguuggugugccccccccccccucaccccacacuggaguaaguuucuuugccccagaucacuucauaguaauacaaguguaagggaggggggggugguaguauccaggacggccccuccuggggaucaucgagaaucggacucaugagagaccgcgcgagguacaccgaaguuggauaccauccuucauucucucaaccacgugcaaugcccucugcagucuguccguguuuguuguacauuuagaagacacggcugacaccuuggaagugccaaucgcaggcccgaaaacaccaaaggcaggagucacacucucccuaagauucugacacggggacagccuugucguaaaauuucuaacucaugaauacuacuaacgaaugcugugaacacuugguuggcuuuaaccacgugagccuuauguaucugguggaaauguuaaugucuucaaaguugugcaaguuuugaucaugugcagguguuccaugaaaaucuuaucaagaugcccugacacacacguuguucccuaguuuucuccggguucugcguaagcagaacacuaugacccaaaauuauaagagggagaugaaucucccuccacgcagccaccaaacacagggaagugugucugcacaggaaaaaaaaaaugcaagcaguguucguuacacgggaggcgcucauuacuguuacuauuaggagaaaagagccagaaggugagaaaacuuucacugacuguggaguagccacaaaagaaaccugaacccuauaucccccaacuccgggagacaaagggaccugcgcugugaaagggggcgagaauguuuccuugugcgagguaggcucuaaccuuugacaguauauucccaacugcuccgauuuuuuuucuugaaaggguucaggaaguugugacucuucaagcugagucauuguucugaaccuuuacuuaaucaagccugugugccgaguccuugcucuucuccugggggccucuugaaagucuggaguuugcauagacauucuagugucugauuacuaucaaaggaauccugacuaccaaacauaagcgauuaaauuacguuacuuauuaacaguugcgcugaagggguuuuauuucuguguuuaaugguucaaggccuuuaccaguaacugcagaguucuguaagucuuguuucucccuuaaaaauguaaugagcacuuagaaguaagugugucagaaggggcaaagaaauagaaagagaugcugccugguaaggcuuaggggcccuuuuuagaagccaucuggacagugccacagagcaugacaguauucaaaauuagacuuuuuaaaaauggggacgaugcuccugugacuucccccuagcuuucuuaguguacacgucugaggacaacaguggacgggguacuaccggaaaucacuggauugucgccagugcgcaucuuccauucaggugaauggguucugugaacagcaaaagccugcucccuuguaagacugaaaccacacccaaggcuuucuguccugcaggaugcacugaucuuccgggcauugaaaaugcuuuuaaauguuuagcccaguuuuacaagcugguaaagggugccauugguuuuuaauggcuuauaauauuacaauuaaaaacauuuuuacauuaaaauauccuuacauuaaaaaaaauuuuuuuuuuacuacaucuccuuuccuguggugcuuucucuaaaaagauaauccuguccuuuccugauuuucaugaccaguucuauggggacucugcacaugcugaggcuaaauacuguacuuuucagugguuguaaauaauccacguuagcauuagucuguaggcuaggccgcgugucucugugggaguuaccguuaucuguauuguacagaugagaacuugaagcucagauauauacagugugucucaguccagagcaguggacuucgccuaggaacacggggagaccggcugcucagaccaacaccauuuguccuggucuugaauaucacuuuucaaacuguccagcugauauaugaaugaauaugauuuuacuaaaggaggggaaaaucgauuuagcauuugauucaguaaaccuugaagaccuagaacgugccaguuaucgaguagcugcuccgggccugggguuuggacauuggccaaggagggauaaaugauugacagggcuggaaggcuggcucuuuacacaucucccaaaaccgaucccgcccgcagugagcagcuccuuuccaguucacucagccaggaaagggugacugccagcgggagccagggaaacgggccacccgccugcuuugguuucuuacuguuuaagguuccuguucggaugcgccaguguuccaggacccacgaagcaaguugacaccauacuuaauuuggaguaacagucuguaauuuagaaggaacacuuuucguguacacuguaauuucaaccacuguaauuucaaccuuauaaagccccugggaaaggaaggcauuaucuuuuagcaaugagagcgcugggcugcgaugggucuuaauuggaacgauguuuguuuagcacauucacaaacauagguuugaucucuggcuucagaaaaccagcauagugguucaugccuguagcccaaauccuagaguugugaggauuuggucauccugggcuacauaaggaguucugggucagccugggacacaugagacccuguccggggauagggguggaagaaacugagggacuaggugccuugccuuacugguuagugguucauucacgcugacagugaaugaaauacaagcauuuugaugacugggaaaaccaauuccugacaguaucgggaugcugagggucucacauggagccuggucuaugaguuuaagaauguguuuuagaaaaagcccccuucgcauaaauccacagagaugaguggcggccaccucccuguuuaugaaagcacgcaauuuugucauuggcaaaugagcccguguucaugacaguacgugcagauuggccacugugaaaccggcgugugcugacgucauaaguaucgguugacucgugcugaauuucucagccaguucggucagucaccuuguuaaacuucaauccugcuuugcuuuguucggcuccagccgaggucuccuuauauuuggugucuggugggguguggaggaggaaauuuccgcaaaaucagcaguaacuccucacacagcuggugguuggcuugcaguuuugugcgcugcuguuuagggacggcugccugcaccugacauuuuauacuuccaccgccacggcaggcucaggagacaccugagggcuggggaccagaugagggugcuccagcuuuaugcuugugaaaauucuuucuacaauaccuuugccaaagccugcuuaaggugauguggaacuuucuagaagcucugcccagucagcugcuuugugaggguguguccuuucacauuuugaacagguaacacacguagcugcucccuggauuccaguccacacagaacugccccuugccaacaagagaagagucaucgcuugaguguauuaagauuguguuuauauaugucugucccagcuacuugaggaaugauagagagggaggcaggcaguauuuaaggaucagucacuaaucgcaaaguaacgggaaagcuacguaggcaacuuuuugugaaucgaguuuuaaguacagcaauagccgauaaacagugcgaauggucuuaaacaagccaagcagugaagaaugcugacuuaguaaccgugaagcccuagguuccaucaccaagacugauaaaccaggcaugggauauguuuguaaaaccagcacuagcgggcagaagcugaugaagcagcaguucaaguguguuccaagccagccugggauauaggagguccugucucaaaaaagaagagguagggguguguguguguguguguguguguguguguguaaaacaaaacaguguucuccuggcuaguuuuaaagaaaagaacacaaguuacagccaugugggagaaagaacucucaguugugaaaauaccuauuaagaucaagcuguagggggcuggagagauggcucagcaguuaagagcacuggcuguucuucccuagguccugaguucaauucccagcaaccacaugguagcucacaccaucuguaauggggucugaugcccucuucugguauuugggcauacauguggauagacacucauacacuaaguaaauaaauaaauaaaucauuaaaaaaaaaaaagaucaagcuguaggcaagaucuugacuuccuaacacuggaacccuuucauacaguuccucguguugugaugugucccccaaccaucgaccuguaguuuugcuacuguuaugaauuguaaugucaaucugcguuccccagugaucuuagaggaccccugugaaaggguuguuugauuccccagagggguugugacccacagguuuagaccaacugacuguguuaggucuuuuuuuuucgagacaggguuucucuguguagcccuggcuguccuggaacucacucuguagaccaggcuggccucgaacucagaaaucugccugccucugccuccugagugcugggauuaaaggugugcgccaccacgcccagcuucuuuuuuucuuuuuaaucagugauuuguguuuaagaaaccugugcauuguggauggggccgagguuaggcuggggguccuggguucuauaagacagcaagcugagcaagccaugagggaacaagcaagaagcaacauuccuuguggccucugccucagcuccugccuccagguucugcccuguggucugagcaccggaacugccugaugaacugugauauggaagagucuggaaagagccuuuuccuccccaggucgcuuuuggugauggugauguaucaccgcaauaagaacugugacugagacaagcuccacaggagguauuagucuccuuaacagagaggaagggggaagcugugaacauucuugcccaggggaaagucuuuuaaaagauccuaaguauaaggaagaaugcuguaaaaacagcaaaugaaaggcccauggcaaauguauagcuauauagauaaguguauuccacuggcaauuuguauuauguuauguauaaagaacucuuucugauuacacacacacauaucuaucuauguauauguauauguauauguauauguauauguauauguauauguauauguauauguauauauauaugcuggagaucaaacccaaaguuuaacaaacugaagugcauucuguaugacaaagcucuaucccuagcccaaaacagucuuuuguuuguuguuguuauuuuuguuuuucgagacaggguuucucuguguagcccuggcuguccuggaacucacucuguagaccaggcgggccucaaacucagaaaucuaccugccucugccucccaagggcugggauuaaaggcaugcaccaccacugcccagcucaaaauagguuuguuuguuugguugguugguugguuuugguuuuucgagacacgguuucucuguguagcccuggcuguccuggaacucacuuuguagaccaggcuggccucgaacucagaaaucuaccugccucugccucccgagugcugggaguaaaggcgugcgccaccacugcccggcucaaaauaguuuuuuuuaauaaacagauaaacuuucuuaaguugugcccuuuuucaucuguuguguuagccucacagacucccugccauaaccgauuacuguacacgaacccuuuuuagaacagcccucaucccgcagucaucucacauuuaauacgaguguuagaauggcaucuggucugugagcaucugugcaucauuucccuaaaacacgggagucauaauuagaguuccuaauuauagacaucucucacucgugccagcugggccuccuuccuaccuacugggcucauguaucugccagaggacaguacuguaauccaggggagcgggagggggcucuugcccugccuuacguuguggccagauuuguacauacaauccucgccugcucuuacuggcucuuagagccaggcugugagcgucacaccuagcagcuauuuugggguugacaggugggugaugggaugagaauggaggucuugggguugaugcgagcuaauaagagguuggugaaccaguucucucccuggcuaguggucugguuugaaugccugcccauggccucaccucuagggucaucugucacuguuucucuacaaaagcugggaauguggucacuguaaccuguaagaaaagugaccuggaaacagaaaucucuuaaaugggugagauuuuuuucuuuuuccuuuccuuuccuuucccuuuccuuucccuuuccuuucccuuuccuuucccuuuccuuuccuuuagguuuuuuugagacaggguuucucuguauaacccuggcuguccuggaacucacucuguagaccaggcuggccucgaacucagaaaucuaccugccucugccucccgagugcugggauuaaaggcguacaccaccaugcccggcuuucuuuugcuucucaugagucaaacacccuagguuuguucucagugugcaguaauaguaauuaugcuuuugugugugugugugugugugugugauaguguccuaugugacaaucaggguuuuauaccaaaaucuuuaagaggcuuucccuuuaaauuugggaaaaggcaaaaccccaucccugcaacugucuaguacagaccuagaagacagcagucaaugcuguaaagagacaacaauuguauuaaagacacaaagguuucuaaaagaugguaugaucaucuaggaagaaaugauagauggggcagguagccguuagacuuuaaugccauugauacggccagcugcaagcugagccagcagaaacagcaugucuccagcaguaauaacugaccgaaauguaauuacaauuuucugcaacgaaacccacaaguucucuagagcacucagaaauccauaaggcuucagugaagaauauuuaaaagcuaauaaagaaucuauaaaacugaagaaaaugagggcucagugguuaggagcacugacugcucuuccagagguucugaguucaauucccagcaaccacaugguggcucacaaccaucuguaaugggaucugaugacuucuucuggugugucugaagagagcaacaguguacuuauguacauuaaauaaguaaaucuuaagaaaaaaaacugagccgggcgugguggcgcacgccuuuaaucccagcacucgggaggcagaagcaggcggauuucugaguucgaggccagccuggucuacagaaugaguuccaggacagccagggcuauaaagagaaacccugucucgaaaaaccaaaaaaaaaaaaaaaaaaaaaaaaaaaaaaaaaaaaaaaaaccaagaaaaaaaacugaagaaaacaagauauaaauuaaauuacauugucaaaaaguaugucaaaucacgcccccccccccauuuuuuaaagaaaucaaacuuguacaguuuauguggugggauaaauaucuauguuaucuuuacagaauaaccauugggggggggggaggccauucugccaauuauuacaugggacagagccugugaugcuguaaggcagguguggggugaggguagccaguuuaaucacaggagagauuuaaaaggugcacuuuguauagguagcacaggaucugauguaaugucagagucuauuucgguggacuuaacaaauaaauaccaggaagguaaaacuauaaauaggacaugggaaaauauuaugaccagaauaugagaaaagcaacuuaaaacuucaaaaguauaagccacacacaaagccacggcagacugaaaacaucguucaggaaucauaggcaggaaggccagccugcauuaugccgggaaauccuguugcaaaauaauagcaguaauaacagcagcagcagcagaguuugagagguggcucaguggugaagagcacugaccgccacuguagagggucugguuugguucccagcaucuaucccaaccaucuguaaccccaguuccaggggagugagcgcccucuucugcccucugcgggcacgugcacaacgcacucagaugcagccaaagcacucaggcacauaacagcaaaccuguaaguaaaucgaggcucccuuagccggauaggcuaacacaugcgggcuaucccaggggcuugcggcugaaacagagcacagggccacccuggguaauagaguucugggagcgggguggugguggugguggugguaucucuucggugagggccaacuucaacaaagcucacaggacagaugauuacagauuaucgugucugaccaguaaggagucaauguguugaacacgcagacuccagcuaagucacugaagugagugugaguggccgucucugaggggucagagugaagagaagcagaaguucuacacaggacagcgcagcacugagccccaggaaccgggagguucugaagaguaagccgggaagagaucgagagagggacccagagggggggggggcuacaaauucaaaauccaaguguacuaauagagaguuuuuaaagaacaaauccauguaaaugagcauggagucuaacgcugccccgagcaggaaacagccgagcacacaggggccagagagaguggcugcugccugcugccuaagcaccgaggcaggaggauugcugcgaguucuaggccugccuuugacagaacaguaacacccagggaagaaacuguuugaaaguaaugccauucacuuguuuucuuucugagacaagguuucucuguguagcccuggcugcccuagaauucucuucguagacugggguggcccccaaacucggaggucuaccuuccugggauuaaagacgagaguucucucaccuuggcaacuaagaaauacauuuuaaaaaguguccuugcuguccuuuaaacuugagcugauugagauggcagccgaggacaauuaccaggaaggacacugucccuauaacaacuguuuuguuuugccaauucacacaggguggaagcuuugagagacgcagcuacugcuguugagcaggagaaagaaauccuucuggagaugauccacaguauccaaaacagccaggacaugaggcagauuagcgauggugagagcuguuuccagaggggcgccuuggaggccuagggagucugggcuggcgugagucagggcuugccugaccccguucagcaguaacagcagcuggggugcaccugcagcuguggguccgcuguccgucgguccgcugucugucgguggucuuccuuucagugcuccccuaacacuggcagggauggugggagaagccgugugagcgccagcagggugggcagguaguacagcccugcagcucaccucagaaacaguuuuuuuuuacaagguccugacugcagguacaguaaaagcagagggccuagguaaaaguagagacuaauagagaugaucugaggcagagccggcaagugcauugucgcggucaucugagcaguaugacagcccggagacagugggcuagagagcugcggagauaagcagcugaacucccagauccaaaaugcuuuccaucaacaaugccuagccugucuauucaccaucgugguaaaagaucaaugacuaagagaguucuggaaugggaaaagacaggaauuguugacgguuuuguguaaaucuuguaaguacacuguagcugucuucagacacuccagagaagggcaucagaucucauuacggauggucaugagccaccaugugguugcugggauuugaacucaggaccuucagaauagcagucagugcuuuuaaccccugagucaucucaccagccccguguaaaucuugaaauguuaucacaguccauggcugccacagcucccagucacuggccaaggucagcuugaguaugucugcuggggaggaggccaggacuugcugaggagcccacuggcccuccauuccuauuguucuuucuuggcuggcagugggugguauauucugaugaauaugcaguguccccgcccccgccgugagcccuccucuggcuaaccucugcucgcucugaaguugcuuggcugcaucccagcugcccaugucucugccuucuguggacacauagacucaggaugaucucuggcccuaacugugugaagacuuuuccucaguuaugcugauaugccguaguacuuuuggcuuuuaccuuuagaaaaauuuacagaagugcuuacagaaacuaaagauagcgcaagugcaugcuguggcguugcugacgugggaaguuucugccucauacugacugauguuucguguuuaggagaaagagaggaacuaaaccugacugccaaccgucugaugggccggacccucacgguugaggucucgguggaaacgauccgaaacccccagcaggaggaauccuugaagcaugccacgaggauuauagacgagguggucagcaaguuccuagaugaccuggggaaugccaagagccacuuaaugucacuuuacagugccugcucaucggaggugccgccugggccgguggaccagaaguuucaaucgauagucaucgguugcgcucuugaggaucagaagaaaaucaagaggcgauuggagacucugcugaggaacauugacaacuccgacaaggccauuaaacuccuagagcaugcuaaaggagcugguuccaaaagccugcagaacacugacggcaaauuuaauuagccuucaaauucaccggcccuuacaaaagauguagaaaagaaaacuacuauuuucaauagcuaggucucuauguuaggcauaaccacuuaauugauauugguaauuauuucagauggggaaguauuccaguguuggcagacacagguaacacuuaacacuaggaauauuucagucaccuacuuugaaguuuuggacaguguucccaucuugaacuggacucuagcacuguauauuuaacuucugaagaugcacauguaguguguguguguguggggggaguaaaaaaagagggggagcagcaaaagucccacugcccuuuccuugacuucagcacagagcauccagccucuggagcagugcacucacaucgcagugugagcagagcacccagcccuggaguggugcauucacaccacagugaacagaacacccagcccuggagcagugcacucacaccgcagugugaacagaacacccagccccuggaacaguguacucacagcacaguuugaacagagcacccagccccuagagcaguguauucacaccucggugugaagagaacacccagcccccggagaggugcacucacaccagugugaacagaucacucagcccuugagcagugcacucacagcacacaguguaccuagaaggauaagcauaucagaacuucacccugcauggucuccauguuucaggcaucuguuuucucuaugcauaugcaucucauaccaugaauuuuuaggugugcguggaagcaugacaaaugugaggagcccaccuucauuuuaccacugugaagcuccgcccccaccccagggccagugcugaccgcucucuucaugugcugccuugagcucacgcgugugcggcgggagcacuugccuaaccacuucccugugggcaguuggaugguuucaauuuguugcugugacuacaacauacuuguaucugcugagcuuuauucuguucuuggucuuuuuuauauaaaauuccauuaauggguucaucaggccaaaggauauauacauuuucauggucuagaaacauauuucuaaauuuuuauaaguuauaucaguuuguacugucuucaguaauuaaaagaauccauuucgcugaac

SEQ ID NO: 110 - RNA, 310 nt, Mus musculus
acacaggguggaagcuuugagagacgcagcuacugcuguugagcaggagaaagaaauccuucuggagaugauccacaguauccaaaacagccaggacaugaggcagauuagcgauggugagagcuguuuccagaggggcgccuuggaggccuagggagucugggcuggcgugagucagggcuugccugaccccguucagcaguaacagcagcuggggugcaccugcagcuguggguccgcuguccgucgguccgcugucugucgguggucuuccuuucagugcuccccuaacacuggcagggaugguggg

SEQ ID NO: 111 - RNA, 3778 nt, Mus musculus
cagucuuccacuagcagucuuuggaugaagagggagaacucucagcucugccugcgccaugccugccuggaugcugccaugcucccaccuugaugauaauggacugaaccucugaaccuguaagccagccccaguuaaauguuguuuuuauaagacuugccuuggucauggugucuguucacagcaguuaaacccagacuaauacaaaaaguauaaguaagauccccggccuagaguacggcaaggugcggacucuauuuuaccucccaugcugugucacuaccgaaucaacguuaucauuucuguuagucugggaaagauuuguuuuugagaggucuguucauuuucuucauaagaagaaagcggugacaucuagauggcccuguagggaaagagguggagcuuccacuugucuuucaacuucaaaggacagcaagcuucuaaagagcgggguagccaauagcuacucuuuuuucuggacuccugggccguucucacagggaauggggagguagcguaugcuugccaaucagagaaugccagggccagccaauggugaccagcaaccaaucgucaaggccggccagagcgugcucccuuaguagguggaugguggucggagcgccggcugucuucucggucgccauuuuguguuggugacuguggccggcuaggaggagguggcacugaguuuccuugggagggcaacgcgucggucgcgucuccccucccccuuuccucuuuuuuugcucccagguuuggacuugguaguugcaugcauuggcucccauuugaacuaacaguucugaaggaggugguggcggacagagcccucccucgacagcccgggccgagaagagucucugcaggagguaucauccagacgggcagaucaugcuggcagcaacagggguggcugagaagugaaaggagccagcuacugaggaggggccccagcagcuccuaaaacuccuaucaggacauggaguaugaaagacgagguggucguggugacagaacuggccgcuauggagccacugaucguucacaggaugauaguggagagaaccgcagccgggaccaugauuauagagacauggaguaccguucauacccacgagaguauggcagacaggagggcaagcaugaguaugacgacucaucugaagagcaaagugcagagauccguggacagcugaagucccauggagucaaagcacgggagguccggcugaugcggaacaaauccucaggucagagccagggcuucgccuucgucgaguuuagucacuugcaggacacuacacgauggauggaagccaaucagcacucccucaacauccugggccagaagguauccaugcauuacagcgaccccaaccccaagaucaaugagaacuggcuguguaauaagugugguguccagaacuucaagcgccgagagaagugcuucaaaugugguaugcccaagucagaggcagagcagaagcugccccuuggcacucggcuggaucagcaggcacugccacuggguaggcgggagcuaagccagggcuuacucccacagcugcagcccuaccaggcccagggagugcuaaccucacaagcccugucacagggcucagagccaagcuccgagaacgccagugacaccauuauuuuacgaaacuugaacccacacagcacuauggacuccauccucggggcccuagcacccuaugcggugcuguccucuuccaaugugcguguuaucaaggacaaacagacucagcugaaccgaggcuucgccuucauccagcucuccaccaucguggaagcagcgcagcugcuacagauccugcaggcccugcacccuccgcucaccaucgauggcaagacuaucaacguggaguuugccaaggguucuaagagggguauggccuccaaugaaggcagucgcaucaaugcugccucuguggccagugcugccauugcugcugcccagugggcaaucucacaggccucccaggguggagagagugccugggcugcccccgaggagccaccacuugacuacagcuacuaccaacaggaugagggcuauggcagcagccagggaacagauucccucuaugcccauggcuaccuuaaggacagcaagggcccuggcaugacugggaccaaaggggacccagcuggagcagguccugagaccucccuugaggcuggagcagacucugugucacuucaggcuuucucuccagcccagccuggugcugccccugggcucuaucagcaaucagcugaggggggcaguggccagagcacugcuaccaacagccagucauauaccaucauaucaccugcugugcucaagucugagcuucagagcccuacucaucccagcucugccuuaccaccggcuuccagucccacugcccuagaguccuacagccaguacccuguuccugaugucucuacuuaccaauaugaugagacaucuggcuacuacuaugacucccagacuggucuauacuaugaucccaauuaccaguauuacuacaaugcucagagucagcaguaccuauacugggauggggaguggcggaccuacauaccugccuuggagcagucugcugauggacauaaggacaugagggcaucaucaaaggagggaaaagagaagaaagagaagcauaagacaaagacagcccaacagauugccaaggacauggagcgguggguacgcagucucaauaagcaaaaagaaaacuucaaaaacagcuuccagccuauuagugcucuacgagaugaugaaaggcgggaaucggccacugcagaugcaggcuaugccauccuugagaagaagggagcgcuagcugagagacagcacaccagcaaggaucucccaaagcuggccagugaugaccgcccaagcccaccucgagggcugguggcagccuauaguggggagagugacagugaggagaaacaggagcgaggagguccugaacgggaagaaaagcucacagacuggcagaagcuagccugucugcucugccgccgccaguuucccagcaaggaggcacucauccggcaccagcagcucucugggcuccacaagcaaaaccuugagauucaucggcgagcccacuugucagaaaacgaauuggaagcacuagagaaaaaugacacggagcaaaugaaguaucgagaccgugcagcugaacgcagggagaaguaugguaucccugagccaccagagcccaaacggaggaaguaugguggcauaucuucagccucuguggacuuugaacaacccacucgggauggauuaggcagugacaacauuggcagucgaaugcuccaggccaugggcuggaaagaaggcaguggucugggccgcaagaaacagggcauugugacacccauugaggcccaaacacgaguuccagguucuggccugggugccaggggcaguuccuauggggucaccucaacagaauccuauaagaagacacugcacaagacaauggugacccgcuucaaugaggcccagugaacaacuuugaaagcagaugugggguauccauccagguacagagaagaugaaguguggaauggucuaaggaaggcucuucuaucuaccagccugcuccccaaccagagaagccaaauuagacuuggcguuggugacuuuugcugggaaauugggcucaaucauguuccuuuuguaauaaaaucuaaaaagccugcaaaaaaaaaaaaaaaaguauaaguacuacuaagaaugaguaaa

SEQ ID NO: 112 - RNA, 12595 nt, Mus musculus
uuuagaaauuuuaauauauuguaugaaauuccaccccuacuuaaaagauugauugaacccuaaaggaaaacagacuuuugaucaaaauaauauaaagcccaaacauaaugcauaauauacauguacauuuugcauaauuaauauucaucuguagccacccaaguuaaagauuaguuugagcuucagaaaggauguugcuguuguugcuuugugcuuugguucuguccuggcuugucagcggcgcacagagggccuggcaccagauuugacagcucugcgcuuuacuggcauugaguguaccacagcugccaaguuuucucucuuuaguuuuucaaugaugccaaagaagccacugauuaccuaaggaaucugaaagaugccauccagcgcaaguacagcugugacagguccagcagcauucacaaacuggaagaccuuguccaggaguccaugguaaggaugcagaaacucugggcuuugucauacaaacaacaggguagauuaguguuuuguucuauguuucuauguucuauguuacauacagauuuguacuucagacacacagcugacucauucaacugagacuuuggcuuggguaguuuuugaugauguuuaaacugcuuuagcagugauguguguggucaguuuucauuucuggagauauaacaauggacaaagcaagcaggaaucacccugucuuguggugccuagauauuaaaggguagcaacacagucauacauuaaauaaacaaaaugcuuguagacuguuacauuguaguaacagcaacaaggaaacaaaauaaccguagacugguacauaguaguaacacaagggaaacaacaccauagacugguacauaguaguaacagcaacaaggaaacaaaauaaccauagacugguacauaguaguaacggaaacaaaauaaccagaaaaaaggaaggaagagggcuucaagagggaugggagauguggaagguguccccaguagucagggcauucuucagugaugaugguuugugugaggcccugugggaugggaaguuugaaucauuaauuuucaagucccgccguguuugcuaccuaggaggaaaaggaggagcuccugcaguaccggagugugguggcagggcugauggggcgagcgaagacaguggugcagcugaagccgaggaauccugacaacccacucaagacguccauccccaucaaagccaucugcgacuacagacagauugagguaccuguaauucucaaagcagacuggauauuaaaugacgucauaacgcuuucuagccagaaggcauuucucugucucauaagauauauauauauuauuauauauauaauaauucuaaagaucgaguguggaggaagaugaauugauggugaccucagcuuuccuuucuuccauuuaaaaccagauaaccauuuacaaagacgaugagugugucuuggcaaacaacucucaucgagcuaaauggaaggucaucaguccuacugggaacgaggccauggucccgucugugugcuuuacuguucccccaccaaacaaagaagcaguugacuuugccaacagguuuguaugguuuggggccuuucugaagauuaaagaagccaucaggacugugucagggaccuacgggguuggaaaguuccggagcuacuacacaggggcauuuuagaaauaacuauuguagcaucuuuucagaaaggaguaaaaaggccuaaagucuguauucuccuguguguauuccagaauugagcaacaguaucagaguguacucacucucuggcaugagucucacauaaacaugaagagugucgucuccuggcacuaucuagucaaugaaaucgacagaauucgagcuaguaauguggcuucggugagugugacaucauuuacgagccuccccacucagauguagcuccuggcgccacgccauuaauccaaggaucccuguucuuuagauaaagacgauguugccuggcgagcaccagcagguucucaguaaucuccagucccgcuuggaggauuuccuggaggauagccaggaaucccagauauucucaggcucggauauaagucaacuagaaaaggaagugagugugugcaggaaguauuaucaagagcuccucaagucugcagaaagagguaaggcaugggguugcuggguuucuuuuccuuguggggguuucgucuagacucucguacuccccuuggaaaucucagucuuggguguauuacgucagucaacugggacacgcaugcaagauugcugaacaguaugaaaauguguguguguguguguguguguguguguguguguguaugugugugugugcgugcgugcaggagauggaacucaggagcacauaacuucaugcaugaagcccugaguucaaucccagaaccaccaauaacaaucagaacuucugagcuacgaagaugccagacaaggucauuaauuucuaaaacuggaguaacuaaaaauugcccccaaguggugggacagucgacagccucagcucaucugugugaagcacauuugcugugcuuuacccagcaacacucagaauggagguccuuaaggcucacgaaagaucugauucuuuucccauguuaaguuuuacacagcacuuaaagcaaagugccucauuuaguuaaauuuuauuuaauaucaaucuuagcccuaacuccucauacuauuuagaaacaagugauuuuauuaguaauauuuuguguuuuuaaaaccuuaaaacaguaacuuuuuuuuaaagauuuauuuauuuauuuuaugaaugugugugcacuguugcucucuucagauacaccagaagagggcaucagaucccauuacagaugguugugagccaccaugugguugcugggaauugaacucaggaccucuggaagagcagucagugaucuuaaccacugagccaucucuccagcccaauuaacaaaaaauuuuuaccugcuuuuucccuuuagauuuugguuuaauuuaaugguuaauugauagaauauaauucacauuuuugugauuauuaaacagaauaauaauacauuacuuccuuugggcauuucagugaugauuugguauuuuaaaugacuuuagggaaauuugcuugguaauuuuuaaguuuuaaaauucacauucuaagauuucuguuuuaagguuacguccuuaggguuugugcuaauaggaaccacugguuugucucaguaagaacaaagcugguguagugaagcuugcacgagagcuuccuggggagcggaaguuacuuacacgcuguguccuuccacagaggagcaagaggaaucuguguauaaucuuuacaucucggaagugcgaaacauucggcuccgccuggagagcugugaagacagguugauucggcagauccggacuccccuggaaagagaugauuuacaugaaagcaugcucaggaucacggagcaggagguaagaguuacacacguguuagcaaagccagagucauuuccucuuagagacccugaaugucaccuucugauuuccccgcaugagacugugacuucaguucaguugugcauuucuuacuggaugugaacuaagaucccaugacugaggucugccucugagguaguaaacagagaggcacccuggugggcuucaggcagaagucauuauacacccgcugguuacagaguuagagauuuaggucaaaggacaaugcaguaacgucauuacugguuaucaagcugaauuggugugcuucuguuuacuugguagaggaaaagguuagacaggugcuuauauugguaauaaacuacaaaauguguuuuuaagcugcucuaagaaccaugcccauugcagagacaaagauaaccuccguuuguuuucuguacuagaaacugaagaaagagcuggaucggcuuaaagaugacuugggaacgaucacaaauaagugugaagaguuuuucagccaagcggcugacucgccgucuguccccgcucuccgaucagagcucagcguggucauucagagcuugagucagaucuacucuaugucuuccacguacauagagaaguauggcagcaaucaguccuuaccccguccccucucucagugcuucugcgggcgauccauuuaucuuaagaaacuagauugaugauguuucuccauguuuugggggggaggggcuaccuggaaacucccuuuuuguaguuugaugauauuucuccaugggugagggggcuaccuguaaacucccuuuuugggguuuccgcucaugcuuggcauaaccuauuggaaccuaggaaccuauuggcaucuguguaacagccuccuaggggugggguauuggguggugucuauuaggaaaagaaucagcugacugccacauggacaggaggccagucagugucccaugucaugaguuuuaaugacccuguaagucuacagugugugucgggggaagacauugaacagcaugaacuaguauuuauuucuccuuaaagauugaagacugugaauuugguuuuaaaaaacacucaagcugcagaagcccuugucaaacucuacgaaaccaaacugugugaagaggaagcaguuauagcagacaagaauaacauugagaauuuaaugaguacuuuaaagguaagagucucacuucugaccgcggcuccaagguccugcuucgagucauuccucuagcucaaagcuugagcgucaaacauccggcacuaagacucugauguagagagugcuucugagugugccaccuccguuucacauuucuaauuccaaaacuuccuauaaauaacuacacucaaucguuccaguauaaguuauugaucuauugccaugaggagacaucaggaccaagguaauuuauaaaggaaaucuuuuaguugggggcuugcuuacagugucagauggugacuccaugaucaucauggugagggguauggcagcaggcaggcaggcauggcacuggagagauagcugagagcuuacauuuaauccacaagcccaagacagagagagagcaacccgaccugggcuguugaaaccucaaagcccaaaccccagugacacauuugcuucaacaaagccacccucuaauccuucccaaacagucccaccaacuggaaccaagcauuuaaauauaugucauacaaugaugaacaaauuguaaccguggguaaacaguguguuucuguaugacuuguugauacauuauaucaugauguccauugauucauguauuucagcaauggcgaucagaaguagaugagaagagagagguguuccaugcauuggaagacgaguugcagaaagcaaaagccaucagcgaugagauguucaagacacacaaagaacgggaccuugacuuugacuggcacaaagaaaaggcagaccagcuugucgaaagguggcagagcguucacguccagaucgacaacaggugggucaccuuucuguucagugcacauguaggugggagucccuuuguguacagagggcaaauuccaaacuuaccagguguuaagugaccuuccauagcuaaugugugagcuguaggauuauucccuaauuccauuucuuucuuacagacucucuuuugcaaaacacguaacaugaaagaaacauucuccuuucuuuuuaagauuuauuuuauuuuaugugcgugggugucuugccugcacgugugcaugcuuguguuccgcaugcauaccagguacucgaagaggcaggaagaaggcauuggaucuucuggaacuggaguuacagucaguagugagcuucuauauggaugcugggaaccaaacuuaaguccuauggagagcagccagugcuccuaauugcugagaugucacuaccuccagaaaaaugaccuuuucaacugugcacaacuaaaaauucugauuuauccugauauuuguauaaucugucuuuuaaaaagauaguaguauacugcucuaaaaguuauuaccaacuuacaauguucaaauaaccaugaguuuaugaaauaaaucauaagcuuauuucuugggcucuacauagcaauaagcuacucaggauccguugauugacuguaaugaaggucacuugcccugcguuuucagcuuuagccuuagagccauaguaaaacagcaccaacaaacuucauagcuccugggacaggcuaucucuguucaccuggacaccacauggggcaggugcugcuggaauuguguuuuaggcugcugccagguaucugcccuguugugcuugguggcucuucccugcccuuccccucuccugcuggaaugugacuauuccauugcuguucuuguaggcuccgggacuuagaaggaaucgggaagucccugaagcacuacagggacuccuaccacccucucgaugacuggauccagcacauugaaacgacccagagaaaaauucaggaaaaucagccagaaaacagcaaagcccuggcccugcagcugaaccaacagaagguacuugaaacugagagucugucugaauuuggucggccucaagccucaccuuucucuccugucuuggaaucaaaggcaguugcuuagaccaaugugaggaaugaugaugcaugugagaauucuauaccuuaaaccugccugcauuuacuuuuacuuuccagaagucauuuauaaaagcauagauauugaaaaguguguuaggguaguuuccacagacuucauuuucuggguuucauaggcugggucuaauuuuucuugauaauaugcuggcagcauaguuuuauacuugcuaaauuaauaaacauggccagagguaauagauagaaucccggcuaguggcgauuggugggaaguuggaugguuuaagguuuuaucauuagcagccaguaaugucuaagaguuugcaucuggaguggguauaagggacagcaccacgucugcucugcaaacuucucauuucugcccugaaagccucccaaggguagaucguuuauuaaucuucccuggaaguuuguuauuuaucuauaagucaaggcacguguaaguaugacgcauuaaguggugcagcacugaguggcugcaugcuuuuucauuacugagcaugggggaacgcuguagagcuccugucuccuccucucuaaacucugcguuuacagaugcuggugucugaaauagaggugaagcagagcaaaauggacgagugucagaaauacucagagcaguacucggcugccgucaaggugaggacagacaaauagcuauauaaugcuauagcauaguuuuaaagcaguucaagucaguccguucuguuuacaaagagaaagucccuauuugaucauuugcauacaugccuaguaauuaugaaaugagucaggugauggcccgugacugguucauuuucucuguuucugugaaugcaugaacguauacaggugccccaaacacauagcucugaaacauuucuuucuuccuuuucuuucuuuuuuuuuuuuuaaaggauuuauuuauuuauuuauuuauuuauucauaugugugcucuauagcuaucuucagacacaccagaagagggcauuggaugguugugagccaccaugugguugcugggaauugaacucugggccucuggaagagcagucagugcucuuaaccacugagccagccaucccuucagcucugacauugguuucuuacugcucuccuuuucucuuuaaauaauuuaaacuguagagaacauuuagcuuguccugaagaaacgcugucauaguucgaugcuaacacugaggcuaucuuaggcucccagcuccauagcucuccuguugaacaacuggaggaugccuauaacugauaguauucugcagugaauguuuucucgaguucuaaagacaauugggaccuuggcugaccacugcacgugucucugcucaugucacugccucgcaaguaucucuagaaucaaauaggucuuuaaguuuuucguuuucaaggcaggcagugguggugcaugccuuuugucuucgcacuugcaggggaggcgcauacaucucuagccuggucuacagagugaguuccagggcaggcagggcuacacagaggagccuugucuguaaaaacaacaaccacaacaauaaaauguaguauucaucauugacuuuuuuuauuuaaaauuguuucagugaacuaguugccaaugcucuguggucagccccuguggagugaagcugucaggcuuugcuugaauuaauuuuuaucucauugguucuuucaugcaggacuaugaguugcaaacaaugaccuacagggcuaugguggagucccagcagaagucgccagugaagcgacggcggauacagagcucagcagaccucguuauucaagagguaacaaacacagaagggcagaggacaggaagggagaaacaauguuuucaaaacacuuuuacuuucuccugguaaagcauaacuaauauaaaacuggccauuuuaauuauuuuuaaaugauucaauagcauauuaguauauaacaauuuugggaaugcaugacgguuuacuucuaguguuucuuuuagauaaucccucacagaaaguaccacgauacuacauuuuauuaaggcucuuuaaaaacucuuuuaaagucaagaucauuuauuaacacagaaaauaauguuucaugagucuacccagaaggagguagggcauacaaagaggucagcaagcucguuacuccugaagugagaccaacuacuggauaagugcucuuuauucccgaaagccuagucgguagcgcgggcaucagucagcaaucacacaccgccuugguugcagagcuaacgcucucucacuucucccuugcaguucauggaccuacggacacgguacacugcccuggucacucuuaugacgcaguauauuaaauuugcuggugauucguugaaaaggcuggaagaggaggagguaaccguuaacauguuacauccgugugaacagggacuagguuugagccgaaacuguaaugcuuugggaaggaaaaauaagcuucgugaugaauuuacauggcugauugcuaacaugcaagucguuaauuaguagcuuaaccuggaagagacggaaagccuuggacguuuguuuggguuuucgagucuccaaaacagaaaaacauuuuuguaaaagauuuauuuauuuauuuauuuauuuauuuaauguaaguacacuguagcugucuucagaagaccagaagagggcgacggaucucauuauggauggcuaugagccaccacgugguugcuggaauuugaccucagaaccuucagaagagcagucauugcucuuaaccgcugagccaucucuccagccccagaaaagcauuuuuaaagcuuuacuucaggaggacuggaguaucggcugaguguacuuuagucauggguuugauccccaagccucaaaagcagcuacuucagcaccagugugguagaaucagugucauccacagugcugggucagcgggaacauuugggcagaagcggcuugagcuucuucacaucugaguuucuaucaagugcagaugcugcucauaggaagucuguagagaacuuccacgcacacacaccuccguuacgcaucuuaaauugacauacguuguuuaaaaguuaaauuaaaaucagcuguauuaaaaagacacacuuaauaguauauauuugugcaaaagaaugggcuuaagaaguguggaacuuuaagcuuugcauuuuugccaaaaaauuauauguguuaagaagaguaaaccucuuucugauacaaaggguauuugcagcuuugauccugaacuuagaauugugcugagaaacaggaagaguaagaaaugacuuguagccgggcggugguggcgcacgccuuuaaucccagcacucgggaggcagaggcaggcggauuucugaguucaaggccagccuggucuacagaacugauucuaggacagccggggcuacgagaagaaacgcugucucgaaagacaaacaagcaaaagauauguaacuaacuggaguuuuagaccccuagugcuucugaaacagucuugaaguucuccaggaugaacugcccucagagaacaguuuuucauaaucaacacacaagcagagauaccugaagaguucagaaguaacagcguguguuagagaaauauagagcauuaacuuagauguguauuugauaugguggagaaauucuguagcugauacgaacacccaacucuagaaguuauugaucccucugcagagagcugagagaccuuucagggagcugauuuucaugcauaaguuugauggaaagauguaaaaccaguaacugaccuaauuauugaggguaauuuuaagcauaagugaaaaaaaucuaguuaguuagauaacauagacuuauuaauaaaccaccaaaauuacucuaauuaagauacugaagacucagcaauagauuuuauuuuauuuuugcugagguaaacaaauucugacuaagagaaaacagcucagaauaacauggcuauagcuaagcuaugcuucugagaaagauuugaugagggacugguucucagaaagaauuuuuuuuaaauuaaauuuugugguuuuugcuuuugagauagugucucucugguuaacccagaaugaugggccagaacuccaaguccuccuguuucaaccugaguacugggaucacagguguguggucugugcccugagaagacuucauguuuucaauaugcagaaugcuguaguguccugaggguugacuuugauacagaauugaaauauaccauugagcguagcaauugcuacgagacuuguuuuucuguggacucguauuaacaaccauggggagauuaaugaaggaaguugagcuuuuaagccccaaauuaucagagaccaagaaaguggaagaagaaaaagauuuguuaucaguuaaauccuugaaagucacauauuccagugaaaacaaagcauaucuagaaaaugauuuugucuuucuaguucagcuguuaucucucuuuucaaauugauacugacuugaaauauuaaguaagaaaacuagaauauguuuauaaacuagcccaaacauucaguauuucaauuaauauuuacuuccccgguccucccagcugcugaaagguuuccugauacguauuugguaagauggauaugaaucccuauguauauuuuuaaauccuuccuauuucacaaguuccuuuguauuugugggguaucuuaaggacuugacaagacggguuccagaugaggcauaccaacaacgaugaccugggggcaccugaagccaucagggacaggcgcugccuuugcauuagcaaugaccuucauuguaacugucacauuugcaugcauaaacauugacuuagaaaugucaauguuuugcguacuucuccuuuccccuguuuuaaaguacuauuucugacuuuggcucucuguucuguuucuuuaaucauaaacaugggacugcgcauaucauguuuaauuuccacugaacucuccgcucuugaaaacugaaucuugcguucuuugguucuugugugguggugguguucuaagcugacagaauuauguuguaugagacuagaguggcuaucauuauaagaaaagcuuauguuuucuauuuauaaaaguuuggggucccacucuuguucuguagagacauuucuugcuucagaaccucaagccugcuaauuuucaauaugaaauuacuccugaggggcagaagacauucgcuggcaaccgaacaggcuugcaggauuucugucuccuuccuccuggcuuucugaggcuucuguucugaaggugcuggugcugguggcgacugcuuauuccgcaucuaaguucccuuggucucguaaguacugcuccagaggcugcagaaucuaugucaaugggacgccuuugacccuuuaaauguuucucgcagaugaaaaggucuaaagagaauucugagcacggggcguauucagaucuacugcagcgucagagagcaaccaugguugagaauagcaaacuuaccgggaagaucagugaacuggaaacaaugguggcugagcuaaagaaacagaaaucccgggucgaggaggagcuuccgaaaguuaaggaggccgccgaaaaugaacugaggaagcaacagaggaacguggaagacaucgcccugcagaagcugagggccgagagcgaggccaagcaguaccgccgugagcuggagacgaucgugagggagaaggaagcugccgagcgggagcuggagcgggugaggcagcucacggcggaggcggaagcucggcgagccgcgguggaggagaaccuccgcaacuuccggagccagcugcaggaaaacaccuucaccaggcagacgcuggaagaucaucugcggaggaaagacucgagccucagugaucuggaacagcagaaacgggcccugguggaagaacugcaacgaaagcgggaccacgaggaggagcuccugcgacuggugaagcagauggagcgggaccuggccuuccagaagcagguggccgagaagcagcugaaggaaaagcagaaggucgaguuggaagccagaaggaaaauca

SEQ ID NO: 113 - RNA, 1249 nt, Mus musculus
ugccaaacauacaucagugagugguaggguagguuuauaaugaacucucgacuaacgcuaggcaaaggaguccuuucaaguuaguaguuccagcaucccuucagugcgagaauaauguaauacaguucuucuugcaaaacagucauuagaaaacauaugucuuagauguguggugcuguuauaaugagaagagaagcgugagcguauccccuaagauaagggaugcuacgauuaagucgaauuaaacuggacuugaaucaaugaaaauguuuuaaucaucaagucauaaucucuacagaucucuacagaaguauguaguagaucagcuacaaggucauucuaguggggauagcugucaagugugugugcagucccuuugagagugcuggccaacuaaauguauguccauuuagggagccacaaagcuggagggagggacucuguugccuuaacacuuuuuguuaugaggcuucggcuucagaauauuucacaccgaaagaaaugaaacagguagaguggacuagagcuguggcucaggugcuagauuccuuaugcagcaugcauaaagaccugggcuugaucccucggcaauaccuacaacuggaugugguaccccacaccuguauuccaagcacgcgggagguggaaaaagucagccuagcagcggcagcagcacaccuuuaucccuagcauuugggacucaaaaacagguaguuuaaucucugugaauucaagaccagcuuggucuacagagcaaauccccaggacugccagggcuacacagcaaaacccugucuugaaaaacaaaaccacaacaaacaaaguaaaaacaaaaaagaauuccagugucgucuuuagcuaccuguugaguuggagguuugcuugggaugcccgagaccccucucuguuacuguguuuccagugaaugaucacgcuaacauuuucaggugcuccaaaacgacgucuuagcccaccaguccacgguagaagccgucaacaaagcaggaaaugaucucaucgagucgagugaaggcgaagaagcaagcaaccuccaguacaagcucagaauucucaaucagcgcuggcaggauauuuuggaaaagacagaucaaagaaagcagcagcuggacagcgccuugcgccaggugacuagagaggcggagagaguccccaagugaugcgggugugccuugcuagcccuugugcagguccaauggugaugcuuuaaagagaggaguaaaaauaaucg

SEQ ID NO: 114 - RNA, 6288 nt, Mus musculus
guuuuuuuuuuuuuuuaaauucccauccauuagccuuuuuuccccaaguccauaaacauagugaggauggaggugcaccacccaguguccguaguuugguggcaagggaaccaaacgcccauagagcugauuuagucaucagucuuucagcauucucaaaugaaguccaccuugauagagggaucccaccaaaugugucccauacucacaaaaucccaggaggagcagaagaaggauucagcucccccacaucaucaccgcugggucuuguugccaauuuuugcacugggguaaacauagaggugaaaugugcugaggaauccaucagcccaggacaguccaagugggugaguugggucgaaguggaggucggcgaaacaggugccaagggacacagucaugcucugcuggugggaaaugccacuggugacugcaucucucagagcccagguuagguuccagagcagcugagggcuagaacccgugagagagcuggcaacuccuggaagcaagaagcccaugccaauaagcuuaggagcacuggagcuugaguuuuuauggagucucuuggucucaggcaauaugucaccuuggggagacguagacuggguuuggaugugggucugcaagauguggguaugugugauguauucagguagcaaugucaucaauccugaggacaguggauguucuuaggaccacgacauaggguccuucccagcaggguucuaggguucccuucuggugccuugacaggaagacccagccuccagagcaauagcaguggggaggaugagguggugcagccucaaaaacagccuucaggugaggccagagcuccuuuuggguguaggcuagauguucaagagagucaaguaaguggcaaucaucauuuucagcuaacacuucagauuuuagguuagguaaaguaugugugugugggugugugugucuucuaaacaugauuucauaagggguuaaauccaacguauagaguauguggugaacccuauagagggcgaaggggaggagagccauccaguuuccaccagucuccaaguuuaauuuaguaagggucucuuuuaaaguucuauucguccucucuaccuguccugagcuugggcgccuauaagcacaauguaguuuccaauccacuccaauggcuuuagccauccccuauguuaccuuagugaagaagacaggucccuugucagagcuugggagggcugacauuccauaccugggaaacaccuccucugguaucuucuugaucacuauuugugcuguuucaugccuggugggguaggcuucaguccauccugaaaaggugucuacaagcaugaccuguagguaccuguaaccauguuucccuggucuuaucucucaguaaaguccauuucccagugagcacccgguuuggcauccuuuauccuuugguugauucucugcauuagugagcuuacagcuaaagcauuuggaggcuaucugucugaucugggaccugagguugaggauuauuaggucugccuuuccuaccagauccucaguuuucuugguccccaaguggguuguccaguguauaugcuagagcagacuggcugccaaauugcugggcaggauuauuuugcagcccccggugagccaccagccaucaggcuuaugggccauaggcaguuugugaauagagagaacauccucuuuggaguauucaggcucaucugguaggauuggagcuccugggucaggcaguuggaaagucaaaguugccacaggauugagagcugcugccuuggcugccgaaucugccccauugacugccuuuugcuucaggcaucauugccuuuuggugcuguggguaguguauaauagccaguuucuuuggaagccaaaaggccuccaaaagguuuaggaucuccuguuuuguuguuguuguuguuguuguuguuguuguuguuguuuuguuuuguuuuucaagacaggguuucucuguauaguccuggcuguccuuuaacucacuuuguagaccaggcuggccuugaacucagaaaucugccugccucugccucccgagugcugggauuaaaggugugugccaccaugccuggcuuccuguuuguuuuuaauagucuuuccuucagcugucaugaguccucucuccugauaaauggccucagggacaugggcuguagcaaaggcauuucugcuagcuguauaaauguugaguauuuugccuuuuuccauuuuuaaggcuucuguuagggccaugaguuugccccauaguguagaagugcuggguggcagggcagaugcccauauaguuucugagucugauaacacugccaccccugcauacaagcacaaagcuuuaccguccaugauccaaguggcuucugcauuuggcagaggcccgggcuauuaggucuuucccaacucugugcaccuggcuuaguaugcccacacaaucauguacuggggucuccaaaucugggucugguagcagagaggcuggguucagggcagugcuugguaggaaguggauacacucaggguuuaguagcaggcuuugguagugagucaugcgugcauugcucacccauugaucuggggguuguuugagaauccuuucuauggcauggggagugguaauacaaaguucuugccucgaagucugcauccuugacuagcaaggcuguggcagugauaauucucaaacgcggaggccauccagaagccacagggacuaauuucuuugauagguaugcuacugggugaauccaggauccuaacaugugagugaggacuucuuuagcuaugccuuugcuuucaucuauauauagacgaaagggcuuggugaugucggguaguacuaaugcgggggcugccaauaaggccuguuugaaucuauugaaagaucuuuccugggccucaguccauugggcccccuuuuuuugguggccucauagaggggcuuugccaauucugcaaaauuagggacccaaaugcagcagaauccugccgaccccaagaacugucugaccuucuguuuugugguggguguggggaucuucaaaaugguaucuuuuugggccuccgauagccaucauuggcccccuuuuaggauguuucccaaguauguuaccucuuguuggcagauuuuagccuucuuagcugaugcccuguagccuaauugccccagugccauuagcagguccucaguacuccguugacauucuuccauggucucugcugccacuaagagaucaucuacauauugcaagagggugguauugggguguucccgacuguacucacccagaucuucauguagagccuuguuaaagaugacuguugaauucuugaagccuugugacagucugguccauguuaguuguccauugaauucuucuucuggguugugccauucaaaggcaaacagagguuggcucaagggggcuaaaagcaggcuuaagacagcaucuuugagguccaauacuguauaccaagucugggaagguuuuaacaaacucaggaugguauacguguuugguacugugaaauauauguccauaacucuuuuguuuaccucuuugagguucuggacuagucuauaguccuuugaguugugcuucuugauggaguguaggggcguguuccauggggacuggcaagguacuaguaugcccaaguccugaaccuucugaugugggggggguaugauaacugauuuggcuucacgggagauuggguacugucuuauucggacaggcguugccucugguuucaguucaacccgaauggggguccuaugguccgccaaccccauuccuucgguuucugcccaagcugaggggaacuugguuaacuaagcugagcucucauucgggaaagagcuuggucuuugguccaauuuauauucaucaucuagaggcagggggaguaugugacuaggguauccucuggaaucugugacagaauccccuuuuugaucaaaagaaaucugagcuccuaccuugguuggcaaauuucuccccaagagggguuaggacaaucugguauggucaugaaggagugggauaccuggcccguucugagauucacucuuuuuuggguacuccaugcauccugauucauaccaguggccccagguuccgacgauuucuuugaggacaguuuuccaugggcuuggacugaauauugugccccugugucuccuaagaaacuaauggauuuccccuccacuuuaaggguuacucugggcucagggagggggucugaacccuguccuccuuugucccucuuuggagguuucuuggggcaguccuugacccaaugucccaucuucuuacaguaugcacauugguucuuuuugagcuuuggcuuccucuuuuguuggggccgcuuaccuuuuccauugguggucuuucucuuccggggaaucugccaacaaaggcacacagaauguggccaaccuuugauuuccuagcuccucauaggcuugcaaguguuucuucguaaguauuucuuuguugucaaccacuuucucagcuaccaccagcaacuccugcaaacucuucuccccuagccugucuauucucuccaauuugugcuugaugucaggggcggccugaucuacuaaggacauaaugaccguugacuuaaucucaggugccgcugggucuagggacguguagaugcgauaggccucuauaauccuuucuaaaaagaaugcgggugauucugccauuuccugaugcacccuauguaccuuggccaaaugagugggucucugcgcagcagcccugagaccucucaucagagucuagcgguagacucagagacucuccuuaccuucugcuaaguuaaaauuccagucuggucuggucccguaaaagccugcauuaauaagagcuuguuuaguaguagggcucccauuugcuccuggaaccaauuuuauggccucaauuaaaauccucucucgcucacacucacuccguagugaagaggaucugcaagagcaauugacagucaucccaggugggcugguggguuaaaaugacagaaucgauuaaguuaaucaacgcagcugguuucucugagaacugaggguacuugcauuuccaauuauauagcugucuaauggcuaagggacaauauuccaucaguugguuccccucaucgucccggggaccuacugccgucaaggggagaaccguggacucagccacgggugguugaggcagcucuuguuggacuuuccauugggugugaggaggguucaccaagggagacccaugaaccccuccuggggccucagguugaaggccugggcuacccucuaauggggguucauaaggcgggucuggguugaggaagucuuccucagugcuacccugcaagacaggauaaagagagacccuaggguuaguuuguuuuugguucuucgcgguuuucuggggcgaguacggcggcacuugguugccuuggcagcagccaaggcuugagccauuuuggcggguccuggaccagauccagccaggugaugauguagggcacuuggucuggguguccgggucgucuaaaaaaugauauccuugguccuaaaaaaucgcgaguaaguuccaaguccccucuggcgggcagccaacguugaagguuggccauuccuuccugcagaaagcaguuagucucuucuuaacaacuaagccccgacuucuagcccuuguuuuauagucuuugaaauggucuaagaacaaagauaaaaggaguggucugggucugucccauggcgucagucacaaagaacuaagucagucacaaagaaauaaguccagacggauagcaaacagaugggcgaaagacaaaaaggcacucaguccuuccugcggcgaucuuaggcaagaacagaagugagagcaccgccucgggagcgacccucuuugucucuucaagucuacgaggggauccaauccccuacucgcggguccgggacuucucccaagucggguggcgccgguacgccuggaccgccugcuggcuacucguuuggagcgcugagacaccgaggcagagcacaaacauucagacacuuacccaccggguucugacucaacggcucggggguccugggggccucaggggaucccggaugagcccccaaauguuaugcccagauccuaggguccccaaagaccaccagaagucgaacucguaugcaaaagcaaagagucuuuauccaaguccgagcucagacccucaggcuccuccgacgcagcgggguagcaaagaaug

SEQ ID NO: 115 - RNA, 6288 nt, Mus musculus
cauucuuugcuaccccgcugcgucggaggagccugagggucugagcucggacuuggauaaagacucuuugcuuuugcauacgaguucgacuucugguggucuuuggggacccuaggaucugggcauaacauuugggggcucauccgggauccccugaggcccccaggacccccgagccguugagucagaacccgguggguaagugucugaauguuugugcucugccucggugucucagcgcuccaaacgaguagccagcaggcgguccaggcguaccggcgccacccgacuugggagaagucccggacccgcgaguaggggauuggauccccucguagacuugaagagacaaagagggucgcucccgaggcggugcucucacuucuguucuugccuaagaucgccgcaggaaggacugagugccuuuuugucuuucgcccaucuguuugcuauccgucuggacuuauuucuuugugacugacuuaguucuuugugacugacgccaugggacagacccagaccacuccuuuuaucuuuguucuuagaccauuucaaagacuauaaaacaagggcuagaagucggggcuuaguuguuaagaagagacuaacugcuuucugcaggaaggaauggccaaccuucaacguuggcugcccgccagaggggacuuggaacuuacucgcgauuuuuuaggaccaaggauaucauuuuuuagacgacccggacacccagaccaagugcccuacaucaucaccuggcuggaucugguccaggacccgccaaaauggcucaagccuuggcugcugccaaggcaaccaagugccgccguacucgccccagaaaaccgcgaagaaccaaaaacaaacuaacccuagggucucucuuuauccugucuugcaggguagcacugaggaagacuuccucaacccagacccgccuuaugaacccccauuagaggguagcccaggccuucaaccugaggccccaggagggguucaugggucucccuuggugaacccuccucacacccaauggaaaguccaacaagagcugccucaaccacccguggcugaguccacgguucuccccuugacggcaguagguccccgggacgaugaggggaaccaacugauggaauauugucccuuagccauuagacagcuauauaauuggaaaugcaaguacccucaguucucagagaaaccagcugcguugauuaacuuaaucgauucugucauuuuaacccaccagcccaccugggaugacugucaauugcucuugcagauccucuucacuacggagugagugugagcgagagaggauuuuaauugaggccauaaaauugguuccaggagcaaaugggagcccuacuacuaaacaagcucuuauuaaugcaggcuuuuacgggaccagaccagacuggaauuuuaacuuagcagaagguaaggagagucucugagucuaccgcuagacucugaugagaggucucagggcugcugcgcagagacccacucauuuggccaagguacauagggugcaucaggaaauggcagaaucacccgcauucuuuuuagaaaggauuauagaggccuaucgcaucuacacgucccuagacccagcggcaccugagauuaagucaacggucauuauguccuuaguagaucaggccgccccugacaucaagcacaaauuggagagaauagacaggcuaggggagaagaguuugcaggaguugcuggugguagcugagaaagugguugacaacaaagaaauacuuacgaagaaacacuugcaagccuaugaggagcuaggaaaucaaagguuggccacauucugugugccuuuguuggcagauuccccggaagagaaagaccaccaauggaaaagguaagcggccccaacaaaagaggaagccaaagcucaaaaagaaccaaugugcauacuguaagaagaugggacauugggucaaggacugccccaagaaaccuccaaagagggacaaaggaggacaggguucagacccccucccugagcccagaguaacccuuaaaguggaggggaaauccauuaguuucuuaggagacacaggggcacaauauucaguccaagcccauggaaaacuguccucaaagaaaucgucggaaccuggggccacugguaugaaucaggaugcauggaguacccaaaaaagagugaaucucagaacgggccagguaucccacuccuucaugaccauaccagauuguccuaaccccucuuggggagaaauuugccaaccaagguaggagcucagauuucuuuugaucaaaaaggggauucugucacagauuccagaggauacccuagucacauacucccccugccucuagaugaugaauauaaauuggaccaaagaccaagcucuuucccgaaugagagcucagcuuaguuaaccaaguuccccucagcuugggcagaaaccgaaggaaugggguuggcggaccauaggacccccauucggguugaacugaaaccagaggcaacgccuguccgaauaagacaguacccaaucucccgugaagccaaaucaguuaucauaccccccccacaucagaagguucaggacuugggcauacuaguaccuugccaguccccauggaacacgccccuacacuccaucaagaagcacaacucaaaggacuauagacuaguccagaaccucaaagagguaaacaaaagaguuauggacauauauuucacaguaccaaacacguauaccauccugaguuuguuaaaaccuucccagacuugguauacaguauuggaccucaaagaugcugucuuaagccugcuuuuagcccccuugagccaaccucuguuugccuuugaauggcacaacccagaagaagaauucaauggacaacuaacauggaccagacugucacaaggcuucaagaauucaacagucaucuuuaacaaggcucuacaugaagaucugggugaguacagucgggaacaccccaauaccacccucuugcaauauguagaugaucucuuaguggcagcagagaccauggaagaaugucaacggaguacugaggaccugcuaauggcacuggggcaauuaggcuacagggcaucagcuaagaaggcuaaaaucugccaacaagagguaacauacuugggaaacauccuaaaagggggccaaugauggcuaucggaggcccaaaaagauaccauuuugaagauccccacacccaccacaaaacagaaggucagacaguucuuggggucggcaggauucugcugcauuugggucccuaauuuugcagaauuggcaaagccccucuaugaggccaccaaaaaaagggggcccaauggacugaggcccaggaaagaucuuucaauagauucaaacaggccuuauuggcagcccccgcauuaguacuacccgacaucaccaagcccuuucgucuauauauagaugaaagcaaaggcauagcuaaagaaguccucacucacauguuaggauccuggauucacccaguagcauaccuaucaaagaaauuagucccuguggcuucuggauggccuccgcguuugagaauuaucacugccacagccuugcuagucaaggaugcagacuucgaggcaagaacuuuguauuaccacuccccaugccauagaaaggauucucaaacaacccccagaucaaugggugagcaaugcacgcaugacucacuaccaaagccugcuacuaaacccugaguguauccacuuccuaccaagcacugcccugaacccagccucucugcuaccagacccagauuuggagaccccaguacaugauugugugggcauacuaagccaggugcacagaguugggaaagaccuaauagcccgggccucugccaaaugcagaagccacuuggaucauggacgguaaagcuuugugcuuguaugcagggguggcaguguuaucagacucagaaacuauaugggcaucugcccugccacccagcacuucuacacuauggggcaaacucauggcccuaacagaagccuuaaaaauggaaaaaggcaaaauacucaacauuuauacagcuagcagaaaugccuuugcuacagcccaugucccugaggccauuuaucaggagagaggacucaugacagcugaaggaaagacuauuaaaaacaaacaggaagccaggcaugguggcacacaccuuuaaucccagcacucgggaggcagaggcaggcagauuucugaguucaaggccagccuggucuacaaagugaguuaaaggacagccaggacuauacagagaaacccugucuugaaaaacaaaacaaaacaacaacaacaacaacaacaacaacaacaacaacaaaacaggagauccuaaaccuuuuggaggccuuuuggcuuccaaagaaacuggcuauuauacacuacccacagcaccaaaaggcaaugaugccugaagcaaaaggcagucaauggggcagauucggcagccaaggcagcagcucucaauccuguggcaacuuugacuuuccaacugccugacccaggagcuccaauccuaccagaugagccugaauacuccaaagaggauguucucucuauucacaaacugccuauggcccauaagccugauggcugguggcucaccgggggcugcaaaauaauccugcccagcaauuuggcagccagucugcucuagcauauacacuggacaacccacuuggggaccaagaaaacugaggaucugguaggaaaggcagaccuaauaauccucaaccucaggucccagaucagacagauagccuccaaaugcuuuagcuguaagcucacuaaugcagagaaucaaccaaaggauaaaggaugccaaaccgggugcucacugggaaauggacuuuacugagagauaagaccagggaaacaugguuacagguaccuacaggucaugcuuguagacaccuuuucaggauggacugaagccuaccccaccaggcaugaaacagcacaaauagugaucaagaagauaccagaggagguguuucccagguauggaaugucagcccucccaagcucugacaagggaccugucuucuucacuaagguaacauaggggauggcuaaagccauuggaguggauuggaaacuacauugugcuuauaggcgcccaagcucaggacagguagagaggacgaauagaacuuuaaaagagacccuuacuaaauuaaacuuggagacugguggaaacuggauggcucuccuccccuucgcccucuauaggguucaccacauacucuauacguuggauuuaaccccuuaugaaaucauguuuagaagacacacacacccacacacacauacuuuaccuaaccuaaaaucugaaguguuagcugaaaaugaugauugccacuuacuugacucucuugaacaucuagccuacacccaaaaggagcucuggccucaccugaaggcuguuuuugaggcugcaccaccucauccuccccacugcuauugcucuggaggcugggucuuccugucaaggcaccagaagggaacccuagaacccugcugggaaggacccuaugucgugguccuaagaacauccacuguccucaggauugaugacauugcuaccugaauacaucacacauacccacaucuugcagacccacauccaaacccagucuacgucuccccaaggugacauauugccugagaccaagagacuccauaaaaacucaagcuccagugcuccuaagcuuauuggcaugggcuucuugcuuccaggaguugccagcucucucacggguucuagcccucagcugcucuggaaccuaaccugggcucugagagaugcagucaccaguggcauuucccaccagcagagcaugacugugucccuuggcaccuguuucgccgaccuccacuucgacccaacucacccacuuggacuguccugggcugauggauuccucagcacauuucaccucuauguuuaccccagugcaaaaauuggcaacaagacccagcggugaugaugugggggagcugaauccuucuucugcuccuccugggauuuugugaguaugggacacauuuggugggaucccucuaucaagguggacuucauuugagaaugcugaaagacugaugacuaaaucagcucuaugggcguuugguucccuugccaccaaacuacggacacuggguggugcaccuccauccucacuauguuuauggacuuggggaaaaaaggcuaauggaugggaauuuaaaaaaaaaaaaaaac

SEQ ID NO: 116 - RNA, 5959 nt, Mus musculus
aagauggggcacucugaccggcaguggaaucgagugaagccucuaaaggccuuuuugguugagggcggaagugaucacugcguggugccagcagcgccagaagaguugggacucgugagggagcggcgcucaucaugguaggauguuuugauuuccuguucugguuuagcgggaaagaaggggacuacgggagggcugaguugugguccucggugcuccgaaguggauggugacccuguguguucucuagcuccgucgggaggcucgccugcgccgcgaguaccuguaccgcaaagcccgggaggaggcgcagcgauccguucaggagaagaaggagcgagucaagcgugcucuagaagguaaggccucccugugcugguggguuacaaguccuugcucgagcauacuacacggagguguaaacgcauuugaacuuaauguauuuguaucaggguggcuggucaucuuuccuuucucugcucguuagguaggaccucacugcucacugguuucugaaugaucccaccaugugauaguauggccguuuaugcuacaguugcccaugucuacagguugauugccaguuuugcuuacagaauaucuaguuuuuauuuaguuuuaaaacauugccucugucggguggcggcggcgcacgguuucaaucccagcccucgagaggcagagacaggccgauccccgaguucgaagccagccuggucuacauaaugaguuccaguacagccagagcuaaaacagagaaucccugucucgaaaaaccaaaaaccaaaccaaaucaagcaacaaaccaacaaaaaaccuuugccucaucuaauugauucccaucuuagggaaugggucugcaagaauccuugguauuuguuuuuguugucuucuucaaaacaaaauuagaaaaaccuguuauugauuguuauaauugucuugcauuuuaauucuucuuccauuuagaauuugacauucguuuuacagguuaguuuaaaacuuugccuuacauuaauucacauuuucauuugcccuaauaaaugaagauccucuaucacagagcuuaauuggaaauguucuauuuaucccuauuuugcuuuuguaucuaaggaacuucaugucucccgccugauugauaguacaauaucccuggugccaguaauuaaauuccguuccuguaauuuaggacuauaaaguauaugugugucauguaacguuuuuuugaguuaagaagcauaauguuagggcugggauuguaccacaguuguuagagagugcuuccuaacaugaaggaggcucuggauucuguccccagccugacucaacugugccugggggccuaugucccaacacugguaagguggaggcuagaggaucaggaguucaaggcuugcuuuggcugcaugaguuucagaucagccugggcuauauaagcauaauguuaaguaucugugacccauuaccauaacuuaaaaaaaaaguuuuaaaaaaauggcucaaggauucagagcacuuccugcucuuugagaggacccaaauucauucccuacuacccauauagagugacucacaacugucuguaaccccagggauccaguguccucuggccuuagcagcuaccugaacacaugugaacucaggcaggaacacauacacagaaaaaugaucaauauauuagcauuugcaaccaucuauuauuaacuauauuauuauuaacuauauuaaauauugcauuaaaagaaacuguuguaaguauuauuuguguucacauuaugccuacuuauaucccuagguuauuagcguauguguuuggcuuuguauuuguuuggguugggggcucaguauuguuucuaagaugcagaaggaaugguuggacuuuucuucuuguggguaucccuagggaggcuccuuuuccuguggcagaggagagcuuaugucacuugguagcuagcuugacagagugcugcugugacucucucccuucccucacaugcuggagaugcggaacugggccucaggccuugcuguccaccuuaguucacagaaagaaccucugacccccggccagcugaggccaugcgccuugagguuaccugugccuccagguagcaguguucuuuuuuuauauuguuuuguuguuauugguuuuugagccagggucucacuauguagacuugucuggccucacucuuagagauccccugccuuugccuucugagugcugggaucaaaggcaggcgugcuaaccaccuuaguaggcagugugaagacuuggaggucacuggucuuccuuccuacuuaagaaacaauuucuuucugucuuuuaaauguauuuauuuacuuaaguaugagugcucugguugcauguccaccuauaugccagaagggggugucagauuccuuuauggguaguagugagcugugguaugguugcugggaauugagcucuggaccucuagaagagcagacagugcuuaacugcugugccaucucacuagccccuuucuauuuuuuuuuuaagcauuuauuauuuuuguagugcuccucaacaccaaggucuucuucaccugcaagcaaaccaacccccagugcauuaucagauuuucuuuagauuuuuugucugguuauaaaaaugacauuaaugccgggcggugguggcacacgccuuuaaucccagcacuugggaggcagaggcaggcggauuucugaguuggaggccagccuggucuacaaagugaguuccaggacagcuagggcaacacagagaaacccugucuugaaaaaccaaaaaaaaaaaaaaaaaaaaaaaaauaacauugauaaugaagaaguauuuagaaaaugagcuccccaguaaccauuaguugacaauuagaugaaaagaaguugauaacuaggggugguggcguacccuguacccuguuagcgacacacucagcagcaaagccaugggccucucaagaccauugguuuguuaccucuguucguucuauauuucuuacugacucuauugaggauguuaagaaagaaaucaggggcuuucacauuaaguccacacacuagugaaccacacaguguuauauacauugugucucacucugcccuucucuuccuugcagaaaaccagcugauucccaccgaguuacgccgggaggcucuagccuuacagggguccuuggaguucgaugaugcugguggagaagguaaucugugcucugcagcccucuuccacacugaaccaacuucugugcccacugggcuccagguccucuucagccacacuggacaauuucccaccugauggaaguguccaggugagcaguuucuguaccuguccccagguuccuccugucugccuggguggcaucacaggggcucuccccaaacaaaugcuuucaguucuauuuauacgauaaacacaguagcuuuuagucuuugcucguuggagugucugcuggagcagaaguguccuuagcacugguacccacagugggcugguagcugcucuccuggccacuagaggugcauuuccacuaggcucucuugagcagagucagcauuuuccuugccucuuguucuccugacagguguaaccagccauguagaugaugaauaucgaugggccgggguugaggauccuaaggucaugaucacuaccuccagagacccuaguucucgccugaaaauguuugcaaagguacugggcgucagggaguaggggauacccaggccuaguggccccaguucuaauucgguguugguccaugggcaggaacugaagcugguguucccaggugcccagcgcaugaaccgaggucggcaugagguuggagcacuagugagagcuugcaaagccaacggggucaccgaccuguuggugguccaugagcaucgaggcacacccgguaaggccugcuagagggcaagggagcuugggcuguugucauggcagagugucugacagccucuccccuacaguggggcucauugucagccaucugcccuucgguccuacugccuauuucacacuguguaacguggucaugcggcacgacaucccugaccugggcaccaugucagaagccaagccccaccucaucacucauggcuuuuccucacggcugggcaagcgggugaguaugggaacccugugggaagggcugaggcucagaccagcccugugacucucugucccuguguccccaggugucggacauccuucguuaccuauuccccgugccaaaagacgacagccaucgggucaucaccuuugcaaaccaggaugacuacauuucauuccgguggguccaugggcugaguguagggccugugaccuuuguaguuccucagcuaacccacagccccuacugacccacguacguaccucugcuuccuuuuuccucaggcaccaugucuacaagaagacagaccaccgcaauguggagcugacugaggucgggccucgauuugagcucaagugugaguuuaggcuuuaguuuaugccugagggagguuaguggggggguccuugacugugcauggugugacaucucuccccucacccuaguguauaugauucgccugggcacacuggagcaggaggccaccgcagauguagaguggcgcuggcaccccuacaccaacaccgcccgcaagagggucuuccugagugccgagugagcugagcuacuugccagucagaaugcagacuuggaauccuggaucagagacuugucacagacagauucacuaauccuaaguggagacuggagggaucuaaauaaccccucugucaucacgcucccagcugccucuaacuggucacgguuggccuacugucugucaggacaaaccugaagcccacagaguaucuauggguugaggaccuaaugacaguggacugaauagucaccuucaggcugggguagggcugcagaucugcacuggaaagugguuacuuucuucagaguugggcccugugaacacuuuuuuccugugguuuagggucagucuuugucaccagcagcaagccuacaccauuuaauuaccagccuaacuuacaagcaggggcacccuccucuaacugcgagcuuuuccccucagccucuuuguucgaagagauagcgacucuaagacuuaauauuucaugaauaaacgccuaggccaacagcuagcgucuauucccugccuagcucauuacucaguuccuuguuuguuuugugagugcccuauggcugguuaccucaguuucaugcaaccaucuccugugccucuuuuccagaauccccucucucuccgcaggauaucccaucuccuguuucuugccuuagcucauuggccauacuuuucuauugaccagugauauuuccauacagaacacaagagauucucucugcacccucccucuuucccaggagacagagugacacccacagccugccuaccauaucucugccuaucuacaucuacaaugggccuguccaucagccacagggagagcuaguguugcccagggaagggccucaagaggcugugccacagccguuugcaacuuacuguccucucuguauccaaaacccugaacuuccccaagggcccuggguuuguauagagugguugucaagacccuagagcucgcagagagaauuggugaugggaucuaccauaccauuaggaggaggccucugaggaagcaugccagacaggauaagggagaugucugcauggugucaugaaaaccuaacgauagugagagaacagaagccaucuggaugaugugcaaggcccuugagguccaauaagaugaggaagguuaggccagugcucugggacgggugggcccacaacugcagcucaugaauccaauucucaacaaggccucugggauccucccauggcuuugcgugugguguguguguguguauaaauuucaaaaugcaaguaaaaucaugugaucuau

SEQ ID NO: 117 - RNA, 3609 nt, Mus musculus
cuuuuuuucugggacuuuauuuagcagugaacaaucagaucaggcaugguagcacaggcuuuuaaucucagcacuuaggagguaaaggcaggagguaguucaaggccagucuggucuccacagcaaauuccaggacagucagaacuacaugagacccugucuaaaaagaaccaccagacauauaaauucaaaggaaauacaauauacacgcacagguuaaacgacagcaguguguguaaacuauaccacagacuguaaacuauagagaagcguauuuccuaaauagauaaauuacaaagacaaaauaaagagaaacuuaaaugauacuuagaacaaaugugcauaacugaaaagcaaacauuuucaucaacugacugauaaauauggucucaugccuacagcagacuauugggcaauaagaaaugaagucuugacauaagcuacaagguuuagaaacauuaugguaggccaaagcagcaagucacaaaagauaaucuaucccaugauuuuacucauaugaagugugacaggcaggcuugaagagaccaaaaguagaucaguguuugcaaggggcucaggucauggucacaguuggaaggagcuaaagagucauggcugaggguguacccauccuggcagaaagauguuuuaaacaggcucucugugucccucccuuccaucagacuacugaaguggcaaucuccaaggaacuggguuuucuucaggagucuccugugaggagaaaaguugaagcuuggagccagggaguggaaugugucucccagggagagguuucacucaguucuaacaacuugucagaccaacuagcaggacccuggagcccaacgauaaacacauggccagaguccauagcgacauauggcagcacacucuggccaggacugcucagcuaugcacacuucuggaccucuauuuaaaccuaaaccucaugucaggaccaaagguggacuuggguggaugccuuucgcuaugacuuggguguuuaauuggccucuaggacaacugguagaacauugguuguuggggcugccagagcccaggcuggaauccuaacagugaaugugagguuucucucgaggauaaagaugaauuaaaauuagaucgaucguggagauggcugcagagcucuaugaauaucacuauaccucccacuggggcuccagcucaccaugagguuagaugccauacccaugcacacacaugugcacacaccuucagucaacuaggucagggggucaaacagaauccagccacacacccagucuccauccagcucuuguuccccuacagcucuuccuaauuuaugauacccaaggucaaugcagcagaccaccauagucucaugacaguuuccaccuuuuacuuuccucuuucccccaucuuuuuuuuuuuuauuuuuuuuuuaauuuuuuuucuuucccccaucuuuauccucucucuuccaaagaacauuggcugcccuggguuauagucaugugacuuaaccuccagagagaggagacuggaguccauuuuugaguguaugucuuugagauuccuuuucagcuuacucuuaauucaagcucccacuccuccccuccucgcuucauuguuucaaccauuccuucuacacaugcccccuuuguggcagaaacauccccuaaugaauaaagauuucaggagaccaaucacuaggcgaggaguaggugggacuucugggugggagaggaagaggggauggaguaagagacugccuuuuuggaugggggacaggcagguggaggucaaacuguaccuaacaagaggccccgggguuuagaaggcggaucugccuuucgucuuuuggguucuguuuuaacugagaccuagcaauaauaaccaguccuguugugguguuuuucucuccacucaguaaccaauacacuagcacagcacaguguggcccuuuacaguguggcccuuuacucccccaaacuaguuggcauuuaaggaaugccuguuucguaguuaacugacacuacuuucacgguggguuuauugauggacaguggcucuccgacuuccugugcaggucagggauagagucugaacaagucuaaaagaaaaugucaacucaaccuuacuggucuuuccugaauauugaaagcauucccacuaaaagcagaaaggcaaccuagauuuaggaauaauuaaaacaccaggucucaacacaacaccaggaauaauaggaaacaccaagacaaucugucuucuccaaaaauuaccaauuccacaauacuggcccccgaugaagaugacuuacauaaacuucagacacacaauuaaaaaaaaaaaaaaaaaccaaagcaauccaucaacccagacaggacauggauagucaccaagagaacacaaacaucagcauggaaucagaaaguccauucaagaugugaaaguagaauuugauaaagacauacagagaggaaaaccugaacugagaugaggguagaaagcgaaaagugcaggucagguagaagcucagugggaagaagccccagaauagagaggauugcauacaggagaggaggcggggcuucagagcaaggcagaaccgcaucacucagucaaggccaaugaugcauguaagugugugugaauaaaacgugcaagaccuuuggggcauuaugcaaaggccaaaauuaugggcauacgaggggaauuucaugccaaaugaauucagaaaggagauacuuuuaaauuucccaacucuagaugaagaggugcaaaaagagauccaagaggcccucagaacuccaaaagggcaagaccagaaaagaaaccuuucuaucacaucauaauuaagacacuaaacaggcaggacagagaguguagagcugcaagagagagcaagcucauuuacaaaggcaggcuuggguuaagaacacgaggugcucucgcagaagauggagguucaaucuccaggauccagaugauggcucccaacugucuguaacuccagacccaggggaugcuacaccuucuccuggccucaucagguggcagauauauaugcaggcaacucuuacagauuacaagaaaaaaauccuaauucuuaaaaucuguaaauaugagugcauuugaaagggucucugaagauacaaguucagaauuguaaaugagauggaccuagacaugugcaguaagcacaguaacaaagguccuucuaagaaauauucaagagacuaggucaacagacucagcacugaagaugaaggccgacagugaagugcuaugguagcaagaggcgauacaaaggguuacugcagccaucagaagccgaagagcaaacacacccccauccccaacacacucagccuuagggagugaacacccucaccucgcaccaugaaccaauuucuguuaaauuaucagcuccacaagaaucccuuaugguagccauaagaaauguacagagcugggcuguggaggugcacgccuuuagucugagcacucaugaggcagggacaggccgaucucugagcucagaacuagcuaggucuacagagugaguuccaggacagcuagauagccagggcuacacaagcccugucucaaaacaaacaaaaaaca

SEQ ID NO: 118 - RNA, 3236 nt, Mus musculus
ugcccccuccaggugaggaagagugugaagacaaccagcuccacccaggcccugcagacucggaggaacaggaaacaaaccccgaggacuuggagacacugucccauaagagcgaaagucgauccggauccgauacaaaaacagaucccuuugaaagugcuucugaggcggagucccucccgggugaccucacugguggaguuggccucuccgaaagagaagcaggcuggggaugcccugaggacucaacaguuagacuuccccaagggcggcauuuggucugugacgaagggcuccauacagaggaagagccggaucuacccucaggcuuaaaggcagguucucagcuaaguaaauugcacauguugacugcuggaagacgggaugaagcaugccccugcagccguguggcuagcuuuguacaggagucugugccagcaucugugugcuucucgaagcaugccagcagcaacagcaguccccaccugcaacaggccaggucuaggggcuaucuggaugccccuguggucuguccuugcuuucgucgacacugugaacuaggucagagcuggccacaaauccacaucaggacugcagcagcaaagauaccucccacaggcucacagcacaaugacuucccucuguggaucaggacaaagaaggggccugcuccgagguccacagugggcacagacuuguucuggguucaucccuuccuugacauagccugucaaccucgauugggcacaccuuaucucuuagacaccaagugucaccagaguaccccagaaaaucuuggugccaaugccaagccaccucaaggguaccucugcuggcagguaaagacucuggucagggcccauucuauagcuucauuuccuuuagguuguccuaaagagccucugaagcagaaagguacaaauuggcccuacuugcgggaagggacagaaauagaacccgaccacccaauccuucacaaaacccagucuccugggcccacccagcugucucguuuacuuccuacuucucaaagcagggccccuccuuugcagggugagugcaagcugagugauuguagcuuuaagagggcaucuccagacacacccuguguaggccuuccacuggaaaaccagguagaacaggcuucuaggucaugcccagccccuucccaccuuacuucagaauugcugaagcucaacagccaagaggaagugcccaggccggcugaaugcaagccagggcacagcccagaaagcagacuugaggagcccaaagguguccacccugaugauguuaucaguaaacaacagugccugcuaaacaucuccggagaggcaggaagccagacggagaacuacccaucaaugagugcucuccaggaggagagaaagccgccugauagggccucccucuucccacaacacugcugccauggugagguaccugugugcaacagaaugcuugcagguuccugggaagaagagagcgauagcgccugugccccaaggacagcccugaaaucaagugucauuggcucuuuagaagcagcagaagagggagugguucuagaccuccaacgcaaugggaaggccuugcaaagucuuuuggacuucccaacauuggaaguaucucaccgcaacccugggagugagugugcacagggaccuggggaugacccggagccuuccccuucuggccagcggcaggcuccaggagcccacggggccuccaggcacagcugcaaauucauuaugauagcaguaaagcaggaaggaaggcagacuucuacaaggaaggcucacugucucauagaaccacagugugggcaccuuccagagaaggggacaagcgccacggcuuaugagucuuccagggccucagaaaugcccguguuuggcaaugaaugugagcugcugggauguccaggggcagagguggaugguggggcucuucagcugcuggcccaaggcauagagcacgugagagugccagucucuaggacuucuucggaugacacuuugagcucagaggagacacuggagggcgagcugcuuggggaaagauuggacuuagggucugaguguguacacaccgagcagaaccaggaguugcccagcucagaucgcaaacgaggaagguguggcacaggcgaugcggagaaugcggaaaucugcgccugcgcgggcgagguagaggguccccuuucaagagucuuggcuucaagcaccacaacacuggaguuccaggaaccaugcgguggguuucagcagagugugcuggagucagagcagcacccugccugucuucagaugaccccuuuaagaacugacaugcccugguccagggagaugccuggcggggacauacccuacagccaggccuuaaccucagaggacuugaacccaguuugcccuagccccgaagaaagggucccccacagucccugccagggggaaccaccucugcaccacgugcaccagagcguaucucuggagaccaaaucuggugugauucaaguagggacaucuggggaccucagcggugaaggaccuuccccagaaagcuacaacaucaagagacugaaaacaacagaaagcaagaucaaagccaggcuggccuuagcccauaagaccuuuaccaauuuuuuugaagccaaaguuauggagaaaacaaauacuggcucugucaaaggcgagaaagagaagcgcaggcgagcccggggcuccuggcgugcguuucugagaagcaaagaugcggaaggcuccaaacgaccugcuuuagugagugggguuccagaaccaggcuuuccccaacuccucugcucuuccccaccagccaccagaggccacugugagaaguggacgauugacaccgacagccauguauuuggggagcacuggacaccccuaaacuccccugcaacucuguccuccagccaucuggcuucuccggaacaccggaggagaagugaaccgaccauaagacgcacugcugcccaggaaagcaguacgcaccucucuucuggagucuucccaaagucuuccuggcugaccucugccaccagccccggagcagcgcagauugacaucaguuuugcccuccccugcagcucugccugccauuugaccuaugagaaccaaggcaugcccugcagacccacaagccccaaacccaggagucccauggcuggggcgcagaggauggaucucugccuuagaggcaggacuagugcuguc

SEQ ID NO: 119 - RNA, 3038 nt, Mus musculus
caagagaguugcuucagaacaacacaggaacacuggcggcuuacagcugacacagcaacucugagcccguggcaaucaaggccaagugacuggggaaguggcugcacucucacaaguuaggggacgcaccugaaaacuguuucuauugaaaacucucuaaggguguuauucaagacugaccuagacuacacaguagggucucaauccaaccauacaguauaggcuggagagaaacucagcaguuaagagcccuggcugcucuuacagaggagagcaguuuccagcacccacauggcagcucaucaucugcaacucuaguuccagggcaucugacacacucuucuggccuacucaggcacugggcacacacauaugcaggcaagcacucauacacgccaguguuuacaucuuaaaggcaaacaagcaagcaagcaagcaagcaagcaaacaaacaaaacacaaagggccaggaacacagcucaaacagagcacuugccuaacaugugcaagacccuggguucaaucuccagcacugcaaacaaaaacaaacaaaaaaaucauuuuuuaaaaaacaaaguauuuuuuaagguuagguaagcuguuacagauuuaaaggaggcaaaagauaaacauucagcuucauaaagagauucaauauguagcauuaaauagauccucauuccaaggauucaacaauauuggccauuucucagugaugcguucacuagggacaauggccgcuagcccacgccuacacccacagaacuauugggaggucggauacagaugcagguguuucuuacaggggaaaauucucuacaacaugacucaucuccugggaagcuacugaaggaaauacuucacaggcagaguggaaacugagaaaggcagcaacugaacaggacagaaggcaaaagcccacguccugcagaagagagcucagcacaggagccagacuauggcaggagcgggucuccugaacaagcaccaagaaagcacagugcuagacuagcccaugggccagaaacacacaccuagagaucgugagaguccuaugaacacuccugagagguucgagauaggcuguucaaaggagcaacagaauccuuaucgcugaaugugacaaaucaacaagaacaaaacaacaacauaccucccaccacaacacacugacagcagucagcaacaggagucuaguggggucacgacagacaggcauucuaacguggugguagcaaacacacugaucuccuuccuucccuagacagugucuuguagccuaggaagaccucacauuugcuauauggcagauuacccuccauuccaauccuccugccucuauccccauaaagagccaccgugcaggcugaauacaguauggggauugugugugcuggguaagcacucacuguaccaacugagucagucacacccccaguccccuguuucaauuguaaaaagcuuucuacacguauagggauuguuagauucugugcauauauaccuugaagaggaagagaagacuccugcaauuccacagucaaucaacacugcagugcuauuuccuuucaaguaguuggucauacaauaagcuuuuuucuguuuaagcaagccuggaaucucauuucagagauauauuucuggauuuaaaacauauguuuuauuuucauuucuuguuaaauaccuuucauaaacaaguaucaaugccagauaagcacugugauagccagcuuaauggaacuguuaccugcucuaagaugcaucuguauuuguguuugccuaauuacuugcugcaguguaucucucuuugucuuuuaaaaacaugcucuggcagggcauggugguacagccuuuaauuccagcagagccuuuaacucuggagagguggaguuaggaagaucucugugaguuugagucuaggcuagccuacacagugagcuccaggcuagccagggcuacaguaaucacuaaucaguuacuuuuuccugaggcuuucagaucaucagugcacccgaggcauucagugggacaggggcaggaggacuaagugccaggccugcucaaagucugaucaagauccucccacaauauugacaguuccaaggacgagaucaccauucccaacaaugucaccaaucaccaagaguuaagccuucacuaguucaguucccauuaagucuacgagcaugaaaagccuacucugaaugcaucugucugcagaccacauuuguucaaaauaaauggaucuccauuuagaucauggaagaggauauaucaccaaagccaccacaagucccaagguucucagacuccugugacacauuuacaacugcauuaagaaagggggcuggagagauggcucaggggaaaagagcacucacuguucuucggucagcccuggcacccacauggcaacucacagucaccucuaacuccaguuccaggggaucuggugccuucuucugaccucugccagcccaaaacucacaacguuauacaggcaaacacucauacacauacaaaaaaaaaaaaccccacaguauugugaacgugcccaagaagcccugcagacggcuuccucuaagcucgaucauaucaagaaagcagcagaacuauagggaaguccccuccucccugggcccugugaaagggagacagcuuuucaaggacccaucaaagaagagugcacggcucugauuuacaucaggcgccaacacaccaaaugaugggacaccaaagccuuccaaguuauuccugcguuagccaaauucggagaagcaucuuuauuccaagucucuugacaacaccaacacagauaaccuggcacuacaaagccacaagacagcuaagaggccuggucgaggcugcacccuggccacuguuccuguuacugcuuaccucagcuuucacagucaaggauccagcugaaacguacuucaauuuaacccagagcuauacaagcuaaaagugaaaugcucagagaaaauaaaaauagaucuucaaacaaagucuguaaaaauaaaauuacuaagugccuu

SEQ ID NO: 120 - RNA, 3038 nt, Mus musculus
aaggcacuuaguaauuuuauuuuuacagacuuuguuugaagaucuauuuuuauuuucucugagcauuucacuuuuagcuuguauagcucuggguuaaauugaaguacguuucagcuggauccuugacugugaaagcugagguaagcaguaacaggaacaguggccagggugcagccucgaccaggccucuuagcugucuuguggcuuuguagugccagguuaucuguguugguguugucaagagacuuggaauaaagaugcuucuccgaauuuggcuaacgcaggaauaacuuggaaggcuuuggugucccaucauuugguguguuggcgccugauguaaaucagagccgugcacucuucuuugauggguccuugaaaagcugucucccuuucacagggcccagggaggaggggacuucccuauaguucugcugcuuucuugauaugaucgagcuuagaggaagccgucugcagggcuucuugggcacguucacaauacugugggguuuuuuuuuuuuguauguguaugaguguuugccuguauaacguugugaguuuugggcuggcagaggucagaagaaggcaccagauccccuggaacuggaguuagaggugacugugaguugccaugugggugccagggcugaccgaagaacagugagugcucuuuuccccugagccaucucuccagcccccuuucuuaaugcaguuguaaaugugucacaggagucugagaaccuugggacuugugguggcuuuggugauauauccucuuccaugaucuaaauggagauccauuuauuuugaacaaauguggucugcagacagaugcauucagaguaggcuuuucaugcucguagacuuaaugggaacugaacuagugaaggcuuaacucuuggugauuggugacauuguugggaauggugaucucguccuuggaacugucaauauugugggaggaucuugaucagacuuugagcaggccuggcacuuaguccuccugccccugucccacugaaugccucgggugcacugaugaucugaaagccucaggaaaaaguaacugauuagugauuacuguagcccuggcuagccuggagcucacuguguaggcuagccuagacucaaacucacagagaucuuccuaacuccaccucuccagaguuaaaggcucugcuggaauuaaaggcuguaccaccaugcccugccagagcauguuuuuaaaagacaaagagagauacacugcagcaaguaauuaggcaaacacaaauacagaugcaucuuagagcagguaacaguuccauuaagcuggcuaucacagugcuuaucuggcauugauacuuguuuaugaaagguauuuaacaagaaaugaaaauaaaacauauguuuuaaauccagaaauauaucucugaaaugagauuccaggcuugcuuaaacagaaaaaagcuuauuguaugaccaacuacuugaaaggaaauagcacugcaguguugauugacuguggaauugcaggagucuucucuuccucuucaagguauauaugcacagaaucuaacaaucccuauacguguagaaagcuuuuuacaauugaaacaggggacugggggugugacugacucaguugguacagugagugcuuacccagcacacacaauccccauacuguauucagccugcacgguggcucuuuauggggauagaggcaggaggauuggaauggaggguaaucugccauauagcaaaugugaggucuuccuaggcuacaagacacugucuagggaaggaaggagaucaguguguuugcuaccaccacguuagaaugccugucugucgugaccccacuagacuccuguugcugacugcugucaguguguuguggugggagguauguuguuguuuuguucuuguugauuugucacauucagcgauaaggauucuguugcuccuuugaacagccuaucucgaaccucucaggaguguucauaggacucucacgaucucuagguguguguuucuggcccaugggcuagucuagcacugugcuuucuuggugcuuguucaggagacccgcuccugccauagucuggcuccugugcugagcucucuucugcaggacgugggcuuuugccuucuguccuguucaguugcugccuuucucaguuuccacucugccugugaaguauuuccuucaguagcuucccaggagaugagucauguuguagagaauuuuccccuguaagaaacaccugcaucuguauccgaccucccaauaguucuguggguguaggcgugggcuagcggccauugucccuagugaacgcaucacugagaaauggccaauauuguugaauccuuggaaugaggaucuauuuaaugcuacauauugaaucucuuuaugaagcugaauguuuaucuuuugccuccuuuaaaucuguaacagcuuaccuaaccuuaaaaaauacuuuguuuuuuaaaaaaugauuuuuuuguuuguuuuuguuugcagugcuggagauugaacccagggucuugcacauguuaggcaagugcucuguuugagcuguguuccuggcccuuuguguuuuguuuguuugcuugcuugcuugcuugcuugcuuguuugccuuuaagauguaaacacuggcguguaugagugcuugccugcauaugugugugcccagugccugaguaggccagaagagugugucagaugcccuggaacuagaguugcagaugaugagcugccaugugggugcuggaaacugcucuccucuguaagagcagccagggcucuuaacugcugaguuucucuccagccuauacuguaugguuggauugagacccuacuguguagucuaggucagucuugaauaacacccuuagagaguuuucaauagaaacaguuuucaggugcguccccuaacuugugagagugcagccacuuccccagucacuuggccuugauugccacgggcucagaguugcugugucagcuguaagccgccaguguuccuguguuguucugaagcaacucucuug

SEQ ID NO: 121 - RNA, 4448 nt, Mus musculus
agaugguuauaacaacguuuugaagcaaagacucaguugaggucuccggaacagguaguagagaaccauuuguaguuaagguuguagguggggcauagccccguccuugaggagcaggacuucaucuuauucaggauagagcuuaguuugucuuuucuacuagaugccuuuuaagccuaaaauggaggcaagcugguucuucagaaggaaggaaggaagggaggaagacagacagacagacagauagaaaugggcaaucucaaacuccagaacauccauagcaauuugucaaaggggcugugcuguagaagcagacuguaacuguaggaucagccuauaggaaagagagagcaagaaauucccgugaucagggacuuuagaaaccacaggcucacaccuaaucagcacaagagaggccugccuuuucucaacaccggguuccuaaaccuuucugcggagugaaauaguaaaagcagcuucgcuucugauggccucuuuaauuuguuucaaaaugggggcuugcuucucagcuucucugcuuccacagaacucagacucauucagucugcccccacgucccacagccucgugauccaaaaagggaguguucuuucauuucuuacuuaaaagucuuuuccaacucaaucaguucagagguagaauaaugcucccugacucucacgauuuucugugcugggccauucauuauuaaggccccaucugugugcugacucauuguuauuuguccucucuauuaaaggugggaccugggcuaucuuuugucacuuugccucaccauccaaucaauuucuccccuggguuccaaggcuuuagauuucaggaaggggucuuuaaauagaucuagcuugugcccucuuuuuccuuuagcaucccagcuguaagaaacagaaaacgggcaccucugucucauguucuccuuuauccaguuuaagcaccccaucaaagacugaagccgaggaugccagcugcaucuccauuucucguuguacguuuuccuuuacacacacaaguuccugcagagcagccaucugggccucggacauacuguugugggaaacugaggcaggaaaaccucugugcaacagguacacaaaguggaggguccgaagaauuuguuuugugugugaguucagugaagucgccuccauaaccccguguaacugcacagcaguucuuaucgugcuuuaagauuccgcaguggggcugcagagauggcuuagcgguuaggagcacugacugcuuuuucaaagauccugaguucaaaucccagcaaccacaugauggcucacauccauccauaaugagaucugacucccucuucuggugugucugaagacagcuacaguguacuuacauauaauaaaucuuuuuuuuuuuaagguuucucagcaucauuuuaaacuauuacagcauuaguaggcugaaauagcuaucagccuuagguuugugcaacuaagaucaaacaacaagaaauucuucucuugugguaaggcauuuuacaggagcagaccaagacugcagcggguaggauuguuuuucuuuacaaugggauaauugcaggcagguguuuuaccagcuagcuguaucuaaccacuuccuccaggcggacuuuggggcuguguuccugccuuuugucuuuuucugacuuuauuucccccuucaguaucucuuagaguauagaagcgauggccauaaagccucuucagcaguugccaacacucucauuccuucuguguuacauuuuaagaaugguaaaauuuguucuaaacccucaucuuuucuaggggcaucuccauaucccuacagcagaccccacucaucaaacaggugugcaacuccauaccgcauaaaaauggccacccugggauuuucuagaaagaaacuccagcucucaaugguucagguuuaauuauauuucucacuaccaauagcaagaaccaugcaauugccaccauagcaaaaggacucaccaaacgccaggaucucccccuuggaugccccacacucaggcugcucagucagcccuuuugugccuugcuacccaaagcuaggaccacucaauugcucuucccaaacucaacugccuugcuacacaccaguuuguccgauuaacauuuacugagagaugcaaaugaacacccacccuaccccacccccgcccccagauggacacugaugacagaccuaagcaggauuucaccaaaguccaacuuggugaguccaaugauuuuaucagacuuucuuacagagcauuggcaagggguuacuuacaggaaugcggauggacacaucccacuaaaagguaacugcauccauacaaaaugccauuccguuauggguggcaaccucguagaagcugauuacggaacuccaucuuuaaucagcauuucacuuuucuguguguucuagcaucuuccaagaucucuugcaguuggaguggaaggagcagaaguaauggcugaacucccuaucugguuccugacccguccaccuucccacccacccccaacccccacccccgcagggaaugucaguggcucccuuaccuuuacagaaguucuagcugccacucgcccauucugaucuagucuucuuggcuaugaggcaaaguccaagaaucacaccuuauuaugcgcagagaggaagcaccauauaacacacacacccuuagguacucaugaauggauggaucccuccauaacugggaaccugaggguaucaguaacuuuucuccucacuuccaugagauaccagacaaaagcaauuaaggacuggaggucugucauguccuacaguuauggggcacaguccaccccagugacaguaacaugaggcagcaagaguauuaggcaacugcucucacugcaugcccagucaagaaguggagagggacagaggcuggugcucaacuugauuucucgauuuucuugagcccaggaucucaggcccuggagagaugcugcccacacuuaggguggaucgucccccucaauuaaccuaagcuauaaacugccucacguauguacaugccaagagaucgguuucccuggugauuauaaaucccaucaaguuuauguuccaauuccuuucugucaaacuugacacaaacuaggcaaaaucaagaguccccugagaagaggcacucucaauugaggaauugccucugucggcuuggccuccuggcaugucaguggagcauucauuugauugacgauggaugcagaagggcucagccuucucugggcagugccaccucuagacuggacagguagcucuggguucuauaagaaaggaaaguggccaagcauggagaucaagccaguaagcgcaguccuccauggucucugcuucaguucuugucuccagguuccuucccuaaucuuccaucauuaugaacuguaacuuguaaaucaaauaaacagguucuuccccagaguugcuuuucaccaguguuccaucacaucaucggauagaaaacaaagucaggggaugaccaugguugaccaaucacagucugugggcguguccugcuugaccaaucacagucugugggcaugucuugcuucuacccacauucucugcaagacuauguugaaggcaaaacccagucaccuacacagagaagguaaguggggcuucaaaucccacaggaaacgcucggcagcaggauggcguguucucgggaggaggaaacuaucaggcuaggccugaacccugggaaggaggcaccacuaaccuaagggaaauauuacgggugucaccagucacccaccaggaccuuuacgguagcauaucuccuuagaggaggacucucuucugagucccuugggacaccaauauggcucacuucucuguggagagcagaacccugagcagguccauguuguugacaggagccagucaggucaagcacccuagccuguggaaaaaauggcaaagcuuuccccacaaggugaggcucugagggaugauaagaucuuuccucuggagcaugugugccuguugaugguguaugcagaaaaugucuaccguagcuuccuaaucccagaucuucaccacaugaaggcuacuccccuacagaaacugcuccugccaagauaagcuaagguaacuccuggauccagcuguaugccaugaaccugccuccuugguuaucugugugugauaauaacccugccuccuuguuuaucuguauaccgugaacccgccuccuugaucaucucucuauaauagcuucaccuuucuguucaacucuauauaauacacaccgagaucccagagggcugcgguuucucaaucagagagaucuacucacccacucccagcuuuuuugucuccaguguuccugugucuguguguccgugugucugugugucuguccauuagguccauccccggagcccuguuggauguggcacaucuccaug

SEQ ID NO: 122 - RNA, 825 nt, Mus musculus
ccucugcucuugcuuccgugccuccugcuucggcguuucucuguccugauggacuuguccuagaacuaugagccgugauaaagccgcugcuuuugucugagcauuuuuaucacagugauggaaagguagcuaaggcucugaggagcccugaucugggggcggggugucuaacagggaagauacaguaggacagaaauuuggguggggguuguuggcagagacaaagaugacaggaugccccuggccucagagaggagauaggucucucucacaaguagugagaaguguaaagcgcauuccagacagcccagccaucgcaaaagcuucaggaaaacacucugagaaaccaucuacagcaaugguucuuagccuuccuaaugccacaacccuuuaauacaccucacgcuguggugaccccccccccccaaccauaaaaugauuucguugcuacuucauaacuguaauuuugcuacuguuaugaauuauaguguaaauaucuguguuuucugauggucuugggcagugccugugaaaggggcauugagaagugcuguucucgacagaugaacacaccauggaagcuuacgugucuccugcacaaaucaguggugcccacaucauccagagaccauggauaggaagacgcagcaugcaaagacaaugggaauuuuuucagccaugaagaauaaugaaguuguaucacuugcaggaaaauggaugugacuagagauacucauacuaagagaauaaaggcugucucaggaagauagcaugggcuuuacuuauauguaguuccuugaccuuauauagauauacaaaaucgca

SEQ ID NO: 123 - RNA, 104695 nt, Mus musculus
gacaggguuucucuguauagcccuggcugcccucgaacucacaaauccguuugccucugccucccgagugcugggauuaaaggugugugccaccacgcccagcaugagcuucuucugcuuuuugugucuugaguuuguguacguuuauuuaacuugagaggaauaaauaauaaaaauagggagaaaaagguugaaauaacuaucugccggggcgguuggacugcgccuugaagcucaccugcuugaacugggucuucuaggaucuuaaauucaggaggcgagcuggcucaaccaggagaggggaggggccgagagaaggggcgggucuuaugccgguuucauggccgcugcgggacucucuggcaaacccccgccgcacucgauagccggaagucguccugccuucgccucuaggaagcggaagugcaggggcagcuggcaacuggguuauugcuuugagaaaccggcuugugaggagcggcgggaaaggcgcgugucggcuucucacuggcgcagccuccccggcgaucgccgcugcuccgcccugcccaggcgucguugcagacaccggaguggacgaagcgcggcccgggcaugugcagccggggggaugcgaacacugcggaugccgcggcugcgcggcgggugacagguaccuuggguggcguggggaggccucgggaacaggagaggggccagcgcgggaggcgaccgugaguccgagucaccuugggcuuccucuuguacucugacucgguuuucccuccaguguucucuccacgagcgccucaagucguccccagcggucuucuggggacagaguggcggcgggcucacuccagcaguccugacccuguuugaaguguaggaggaggaagcgcccccaggacuuuagaccaagucugacccuaaguagguugagaaucagcauuuugcaugauucuggagaaacgaguuggcguuuuuauagguuucugaguucaggugaugcaucugugggugauaagaucucuuggcgugaaauuggacgguucacuucacuuuuagcuugugaucugugcaucuccaaaacauugugaucgugagcucuucuugcugcugggcugaaagcucucuuguucugcauuuguugccagguuugaaauggagagaguguuuuguuuguucugagaccuaugaucuugcccuugcagugccuuggaaacaucugugcccgugcaagcuuauuguaguauaaaguucuuuauuuccuaguaauaccuuguacacugccaaacgcaugaagacauagucaugucuguuugcuuguccuaccccuuuggagguagggucucaggaucauaggcuacccuuggaaucccggccaccaccagaucugcuuggagacauuuuacaaagcuaguuaacacuacaaaacuggagcagauuguagccuuuccacuugacuuguuuuugguaaacuuagcugaaacuuuucuuucuuaaauaaaaaauuuuauuuuguuuacuuagauuuuguuguguguauacaggacaacuuaguggaguuagcuuucuccauccaccucuguguggcuuucuuuuuagggcucaaucucaggucaccaggcuugcauggcaagagccuuuacccacagagccaucuugcuaaaacuuucuuuuuugcuuucuugagggaggaagagaaagggagagaggaucuagauauagagacacaaauuaaaugucugucucucugucugacuguuugucuauaucaagaggugggagagagaauaugaauuuguuauguagagaccagaagacaacuuuaaaggauggcucucuccuuccaccaugggggucuggggauugaauucaaguuuucaggcuuuguagcuauugccuuuauccauugagccaucuccccggacccaaaauuuuauuaaaagagguaaaacaauacuuuguaaaguagcaggguaucuuagugugcauuuaacuauuggggaauagauggagcuaaggagaaaccuuaguuagaacgucucuggugggagccaauccuuugcauucauaugaauaguaacuuguuggaguggaaaucaaauggauguuucacagagaagagcuaauagggauggauguaucaaguuuagcuaauuucuucucacuuggauuggguguuuccuguuauuuuucuuugcuauacaccacacacacacacacacacacacacgcgcguugaaacucagucugguagauuuauaguugcagauuuguuuugucuuuuuuuauuuuuugccuuuuuucuuuuuaagaguucuuuaacuuuucuuuaaaaauaacaaggcagcugggccugugauggugcccuccuguagcccccggcacuugggagggagguagagacaguaggauuuggaguucaagguugucccgugcuaggucaugacaagaacccguuuugaaagagaaaggaggaguuuagugguaacuuaagaaucagggagccugcucugcuuuccggaaagugaaagcguuugucgcacacaccugucacguucgguuuuaauauuuuauuguggaucagccaacgggccuuagucuaaaugcucuaggggcucaugguugguugcucguagacucgggccuagaacuuguuagaaugccggcugguuguccgccaugcuggccagcguugcccuuucaguggcugucaacucagaacauuuaucuucauaagcagcucaaaaggcccacuagagucagagugcuaguggagcuuauauaaugaaagaaagcguucucaaacagcauucucugcuucagagagggccuucccuguuucucuggacaggucacuuaugagguggaguguggggucugauuugcaaagcugcucuuuacuguauagcuuucaucuuguucccaucugcaguggugcugacauagcaaggguguauacuuucucuguaaaauacugcaagguggggcgggagacauggugcagcuguugagaaagagcguguacuguuuuugcaggggacugauuucuguccucugcacccacaacagauaguuuacagcccccggaacucuaacuccaggagauccaaugcucucggccuguuugggugcccguauauacgugguguauauaaauucacucagcuucacauacagacauauuaguaguacuaauaaauaagucuuuaaaauauugcaagaguaccucuugguauguagcuucucccuuauauccuucuuacaaucuuaaucuuuugugugugugugugugugugugugugugcuuuucccuguguguuugggaggugcauuccugggugugugaaggccugaggucauuguugacaguccuccucaugggccuggagagauggcucagugguuaagagcucuggcugcucuuccauccuugauucccagcauccacaugucagcccacaacuguccauaacuucaguuggggggaccugacaccccuagucuggccuccacagauucagauacaaauggggcacacauaccuacagacaaguaaaacaccaaaacacauaagaaaaaaauaaaucuuuaaaauaaaaauauuauuagaaaucuaucuaucaucuaucaaucuaccuaccuauuaaaagagucuuccuuagucucuacuuuauuuaauuacuuuuaaagcaauguuuuugagauagggucucaccauguguccuuggcuggccuuggaacguaccauguaguccagguuaucuuugaacucauagagaucuuaguguacaacaagaauguugucaaggggauuuuccuuuuuuuuuuuuuuuuuuugguuuuucgagacaggguuucucuguguaggccuguccuggcacucacuuuguagaccagacuggccuugaagucagaaauccaccugccucugccucccgagugcugggauuaaaggcgugcaccaccacgcccagcgucaaggggguuuucagauucauuuucugacauuaagugaccaagucuggagggaagucacaguaaccacuuuauuccuuugggaugggagaggcccuaagacugaggucuguuugguuacugcuggcuuggguauuuaaagauccccuggguccucuucuuucuccuauugguccucuuaagauaccugccccaaugccuugcagcuguuuccccuugaaaugucuuccagaaaccagaagccaccaugucaguggcuucccucuguuucuugcccugcccgucuguauacugucacacccuuugggugcugcugugcacuagccccgagguccuggucuuuguaaaucguagugaaucugggcccacacuccuucucuguugucuucuuaaucccuucaugaaugagccagugucuaucccauuguuagugccuccuguguucauccuaggcacgaagcccacagcagccucaacucccugugcuugaggaggccgugcuuagccccagaagucagccuaagugugaaccugucaggggguuggguggauugcccugugccgguuuuagggccuagucccuucagauugacacaguuccuuccaagauaugcccauaaaaaaccaaaccaaaccaaaccaaaccaaaccaaaccaaaccaaaccaaaccaaaccaaaccaaaaacuucuuuuggggggagggguuugauucagggacucuaccauagcccuagcugcucuggaagccacuuuauggagcaggcuggcuucugacucagauccaccugucucugcugcccuagugcuaggaccaagggcaugcaccacaccugacucagaaaaaccugcaccugccuuuguucuugagagaauguaguuugcucaguuugagucugcagagaaagcaccaucacguccccuaaaacggauaggaaauggauagcaugacacuguagacuacuaacacugaggcauagcggugugcccuuaaaaucaaaucccaggaagcgccccggcuccaagcagccugaguuccugaguaagacuuaaaagcauacaaaccuacuaauggaacaaagcaaggcucugaucucugccacuuaguucccucaucuccaagguaaacugcucucacuucccucgucuuacuucucaaauggggaugguggugcuuccuuuguaaggcacaucuguggcugacuaccgaugugccaaguaccacgcuguguaacaagcagacacagcugcuucccuccaaaguuuuggcccuuuggucauuguguagagggaccaaguaacagggugcaugcgugugugagacgcuuggaccuuuauacccacgucacagcuccugcccguuccugcaccgaguccuuccuuaccccaaagcuuagccuuccuuguucuuugucuacuguuacacuauacccacacaugcauuuguugauagauauacucuaguuuuuugucuaggcuuugcauauuagaaagacaauacagguugguuuuuuuuuuuguuguuucugucuguuugugugaucuuaguuaauauuauacaucuaaguccaccuauuuuccugaaaauuugauuguuuuucuuuagagcugaauaguauucguguguguguguguguguguguguguguauguguaauuuuccuuuucuguguauuuauggacgacgaggcuaauucuaauacuuugugguauggaacaccgcaguaguaaacauggaggcacaugcauuucuaugccaggguguggaguuuuucuggauaucuaccuaggagagagguagcuaggucauagaguggcucugcuuuuaauuuauugggagaucuccaaugucaucuccacaauggcuguauuacaaaggcuguauuacuuuguguccucaccaacagggacuaagaauuccucucucuccacaucucugcagcauugguugucaguuugucugcugaccgucauccugacuggggugcgguguuaccuuaaaggaguuuuaauuugccugauggguagugauagugaaagacuuacuggccauuuguguuucuucuucugaagccuauucguuuuauuugccccuuuguugguugucaguuuuauguccuugcuacugaauuucugcaguucuuucugaauucuagauauucuuccccugccugcagcguagcugagaccaucucccauucugugagcugguugcucuguugguuguuucuguugcuguacagaaagucuuugguuuugucuccuccaauacuugggguuaguuucugugcuacugguauuccuuuaaaaaagcucuugccuaucaguaucaaacagcauccccuguuuucuuacaggaguuucaggcuuuauuuauuuauuuaaauugcuuuaaaaauuaauuaauuaauuaauuaauuaauuauacauuuuuauuuauuagugugcaucagaagagggcaucagaucccaucacagaugguugugagccaccguauaguugcuggaaauugaacucaggaccucuggaagagcauccagugcucucaccagcuuacugagccaucuuuccagcccugaaguuucagguuuuaaauuaagguccuuaacucauguugaaugguuguuguacaggaugaaagguaaucugaugucaucuucugcagguagaaacucagcaucccagcgcuguucacugaguucuuuuucccaguauaugucuuuggcucuuuguaacuuugucauuuugugucagggccucuguucuacugaucugccugucugucuguauagcaggaccagccucucuuuaucacuguagcucugugcuguaauuugagguugggucuuguaagaccuguagccacguucuuuccucuuuuuuugaaaaauauuuuucuuacaguauauucugauuauucuuuucuucccuccaauuccucccagauucccccuaccuuccuacccauccaauucuguguccuuuuuuuucugacucucuuuaaaaaaacaaaccuggcaugguggcucacaccuuuaaucccagcacucgggaggcagaggcaggcggauuucugaguucgaggucagccuggucuacagagugaguuccaggacagccagggcuauacagagaaacccugucucaaaaacccaaaccaaaccaaaccaaaccaaaccaaaccaaaccaaaaaaaccccaaaaaccaaaaaccaaaacccaaacaaacaaaaccccccaaacaagaagcauacacuccccaacaggcaaaaccuaaagaugaaagacaauggaaaccaaguuauacaaguaaaagaccaauaagacagaaaugacccaaauaaagcaguucgaaacaaacaagcaaacaaacaaucuauagaaauacauuuguauuguguuggccguuuauugcugggcauggggccugcccccgggugguuaauaugcccagguaggcuccauuuuuuucuuugcaagugggcuccaggugcagguagcuucuugguuagggaugggagcccguguccacuucccuucucggugcugagccugugcagaccccgugcgugcugcucuugucgcugaguucauaugugcauuaguccagcugugucugggggacacuuuccgaggugccagccaucaccucuggcucuuacaaucucugcaggcucucugacccugaggagaggauuugaugaagaugucguauuuaggacagagugcuucauuaacacauggacuguuuaguguuuguuugguuuguuuguuuauuuguagagaagguggcugggccugaacuuaacagucuucuaaaagacauauuuuguauuucuauacuuuauuuuguuucacuuauuuuuuagacuuguacauuguauaaaguaggcuucuucuucuuuuuuuuuuuuuaaagauuuauuuauuuuauuuauaugauuacacuguaccugcuuucagacagaccagaagagggcaucagaucccauuacagaugguugugagccaccaugugguugcugggaauugaacucaggaccucuggaagagcagucagugcucuuaaccacugagccaucucuccagccuuaaaguaggcucuuaauauaaauaguaucaguuaaaaaaaaguagauccuaguugucucacucaauaucuuuuuuuuuccccccuuuggcuuuuugagaaaggguuucucuguguagcccuggcuguccuggaacucuguggaacaggcuggccuugaacgcagaucugccugccccugccucccaagugcugggccuaaacaugugcagcucgcucaaugucuuuugugucuaucuccauuaggagauuuuaaccugggucaaggaauggauguagccaggaagaacccaccauaggcuaacauagccuaaccaagcaccagauuguuuaguacuggcaucuucucauccucacagccccacccagaauuaaaugcuaaccuuccccccgccccccaaaacaggguuucuguguguaccaucacuggcuguccuggaacuggcuuuguaggccagguuggccuggaacuuacugagacccaccucccuuugccuccugagugcuggguuaaagguuugcaucacccuggccuuuuuauuauuuauuuuuuauuuuugguuguccaggcuguaaaucugcuuucagcccagcuuccugagcagcuaagauuacaggguugagucacccggccugacuuucacuuuuccuugugaggcacuggugaggagugggcacgcugagguaggcagggguuucaccccugagccacuccuagaugggcucaggaugcugaccuguauguagcucuguggugggguggggugggguggggugucugauuuaggaaguucuuuggcuuuggacaguggucuggaugcugucuggaugcaggugucaguuugcuuggagaggcugcggaugggaggcucugugccacuucccaaggaacuuguauucccuccuuuguaggugggagcugauggcaugacaaacuacugaacucuuggcagauugcaaauccaggcuuugaguuguuacucuugaaacacacuacauuguuuucuagagcuuaaacugcuguggcuucuggcaguugaguucauugucuuccaguuuuucggcuacaaguccucaguugagguguggcagcucuauauuccccucgccucccugaaacuccgagggaggacuuaugcuugcaucuuucaguuucugauagcaucagagccccagguacuccucgacuugugguguaguucaguguuugcuucucugcucacagguacucucucugggucuguucacaauuucuuucucccucucuuaacacuagugguacuggguaacuguccugaugaccaaaauguuaucuaucgccuuguaaacacccugucuccaagucuguuuccauucugagguagcgggguuuugacuguaacgcaccccuccuccacuggagagcaugauucagccuccaguacgacuagucauuuacaaucugucuuggaguuguuuacccucagacuuuaugaaguggcaugcagccugcugugugaccaacaucacccuucaggaagggaagugguacccuugcaggaaaggcugcagcugaccagccagcuuuaacucccgauuuucugacuuuccucucuucaggccauccugguguuaagugcuguuggucucagaaguauauguuucuguuaucugugucucuaaguaacaacauuuugagcuuccucauggcauuugaacgauaccuucucuucuuuuucccuguguagggcuccguuacaacaugagacuccugauugcacuggccuuaccgugccuguuuuccuuagcagaagccaauucaaaagccauuaccaccucucucaccacaaagugguuuucugccccacugcugcuggaagccagguaaggaggguucucuccucagauggaauucucuagaccucgggucugcagugaaggacacucuguucauucgcauguguuaacuguccguaaccgugcccacugugcucuguacaugcgcgaggaugcagacucugccugucagcugcacaggcaggguuagggacagugcacacaagaacaagacucuaggagaggaaaauggggguggaggaggcaggagcugaagaacccaccaggucuuccuguuuaaagacguuccuguuccgcuucguaaucccccaaaucuggacacuuccuuacguuuagagguuuuauuauuauuauuacuuuauguuuuacuuacuuuuguaguaagucagaucuuacuaauuuauaucagcauauauauaaauuuuagguuuuuuuuuuaccacauaguauucuauucccuugcauagcuaugcuuguccuugacgcuacauaagccaaucgggugaagaucacacgccuguaaucccagcacuugagauguugaggugggaggaucagggguucagggucauccuuugauauauauagaguucaaaauccgccugugauacaugagacaaugcuaaaaaaaaaguuaccuugaagcugggagugguaacguaucuguagcagcggcuaagaugggaggauggguaaguuaugcagacacuaucugaagacaucagcggcacccagcagcuuagcagugagaaauuggggauauagcucagugguagaaugcuugcuugcccgccaggugugagccugugcucaguccugaaugcugccccgccccuucuccaaagauagauauagccacgagugaugguauacacuucuaaauccagcacauggaggggcuaaggucggagaauugugugcuuaaggcugcacugggccacauagugauccuuugacacaaacaaacaaauaggcuauacauuaauuauauaagauaauuaagucuuaaauugauaaaauauauguugagugauuuuuuuuuucuuuuaauucuuggguuuuuguuuucuuuugucuuuaaagaccagggucucaugcgucacagacuuggcucaaacuuacuuuguagccaaggaugaccuugaacuugugaucgucuugcuccuaucuacucaguguugggaugguagccaugugcuaucaugccugguuuaugugauauuggggauagugaacccaggauuucagccaugcuaggaaagcacucuuaacaucugagcugcauccccggccccuggagggauccuaggacagacacacgcccacagaguugagaaagcacaucugaaacugucagcucuaauuucucaauuuuuucuccgguuucuuugaucacaguugauuaagucggcuaugauguuugcuucaccagguuccuuauuacaacaucuccccauuucagggcaucucuggcaguuuaccauuuugagcuguuacuuucaggccccuucuccaguagguguuggcaaacagguugucaaggugauggcccaucugaaggagcucccuguauuugaaauuacugcaguuaccgcuacaguuugccgagggcacugcucuucccuccugucucugaugguggauuccacacugucuguggaugaggauguaccagggcauguggcuguuaaagaucuuguuuuuccucccgucuagcccucagggaccuaaaacauucauguguauaauuuuagaugugccugaugauuaugaagggauuuuagcgucauaauuguccaugaaaugauauauacauuuaauugaaguaaaaucuugaauauuuugagcagcuauaguuacuauuagaaguauguaaauaaguauuaucauuaaaauugagagcaacaaacauuuauuaucagauauuauaauggccaaaggcuauugaaugauagaguuauuaaugaguuacaaaucaagucuacuugaauuuauauugacuacuagucuaagaaaauaagcuuaccaccagauucacagauucuggaggacagccagguugcuuguaggaauacauacucucucucuuucucacuccucgcucacagugugugagggacagagucuuacuuuauagagacuaggcuaaccucaaacuugugauccuccugccucugucuccuaauaauaauuauugggauuguaggcaugagcugccaagccuaacuagcucccuuuuuauuuuguccauagaugaagacuuuagcaaguuccuagcagcuugcucauuuggagcaugguuguaaucagggugguuguaagcagggugguugugaucaggguggcugugaggacuugcaccugaguaaggguucuaggugcacugagaacagacccccuaugggugucuuucuuacucuuccauuccuguguuagacucauccugauugaucuucacaauagcaaaggagacagagagguuuuggguauuuuuuccccuuaguuuucuguauaugaagacuuuguguuaugauguuuuaaagguauuugccaauaaagaaaugguguguguucuuugcacgucacucauguaauucaugauuaggacuggagguggcuuuccuaggugcuucuguagguuguuggggcccuaaggugcacacccagugccagagagcauuaagaaucccauccucuucuucuccaacugaaaagcaaauucacagauacuuuuacucacuggcauaggaauacaaagcuaaauacaacaaaagaaaaggcagauuuaauuguacuacacaaaugauaccauuauauguaauaacaccuucuauucuuuucuggauuacuucaauggguuuaauaguauuaaugagaggauugcgauguuaaaccuuugcagugggauagaaaauguguuucaggaagcuuguuugugauugugugagaaggguuuagccugagugagugcuugcauuguuauugcugucgaguauuguauuuuucucuuagcucaugaguugguggucaugugcauuauugugacugacuucuuauuaucuguuauuuuagaguauaagcuauucuaaggccacucuguuuauaucacuuaucagacagcuaagaaaaauauaagucucauggaggcacugaauuaucuguuaauaauaaugggcaagucuugaaacccauuuucagagaagcugugcauugccaggaacuguuucuaacuuucccauauuucuguggcuagccguggcuagagugagagcuguacgucccgguguuggcgaguaaugggcgggccuugcuguggcuggggacacugagaucuaggucaccaccacacugggacugggcuucagagugaccauccccaguguacaggagucgcucaggcauggugugcauuucacuucaggaacuucaagccucuugaaggaaaggaaauucagaaacuuuaagggaauaguguaauaguaaaagagauagguucuuacauuuguuuuuguuagauggguacugauuguaagcuaaaauuugaugaucuugaaaauuuguuguuuuagauguuaaaagcuuaacaaacugcuuuuauccuuccagaaauuguucugggguucauguuugcuugggagaaccucuagcuaacacauuaguucuucaaaagaucucucagaaaggauguggguggaacugcacuagaauggccaguuccuaauucugcugucacggcugaugaguucugcuaauggcuuucauaagucauuuguacauuagggcuucccuauuaucauagcauuuuuauuguuucagguuucuuaagaaauagcuacugagugaacacauuauuaugcuguuacuaauagcuaaggaaauaaugaagcuuacuucccauuaagaaaauucacauuauguauaaagaugcauaauauauauauguguguguguguguguguguguguguguguguguguaaaagcgaaaguucagacauuugggaauguaaaucuccuuuuauucucucuaguaauacaguuuguguugaaagguuuuauugucucauugcugacaugucccacuuuucuuccagugaguucuuagcagaagacagucaagagaaauuuuggaguuuuguagaagccacucaaaacauuggaucaucagaucaucacgguaaaauugaagccaauacuuguuugacuuuguggucuggggaaauguuauaagaaaauggucuucuguauauaauacauguaacauggcagcuaauagaacaccuuuucguuaaugacgacaguugccaugguaggaagauugaucuuagcccagugcaugggaaacccaugcuuugccacugggcuauucccaaacccuccugauuuagaccaacacauuauuuauuuuccuuuugaagagaugaggucucgcuuugugaaccggcugauuauacaguccuacugcuucaaccucuugaauagcuaagguuauuggcagauaccauuguguaagccacaaaucauuuugugugugcacacaguuuguaacugugacugcaaaccauucuuuucucccauugccuuuacucugcgcucuuuuguuaaugugcuuugggacuacuuaauggaaauacauuuuauuguagaucauuuaguauuaaguuuaucugucuguuuugguaugaacuaauuacacaacuggucuguuuguguuaaguguguugucacauguuuuuccgauaugccugccggucaaugaaugcuggagagucaagauaucaaauuaagauguaucuuaucuugcucaguuuuaguuuauggugugcuuucuugaacauuucuaacacgaaagauguaguguaggcuauagacauugcuagccaaagaugcugagagaggagauacucacacaccaccuaaugguguucuggucagggaugggccacguacacgagaguggugccauaagaugccacaagaugccacccagugagcucuuaguugucaugauuuggguaaguguacuuuauugauuuaccuaguaacagagucaccugauaguguauugcucugagcauaucuuccuucagugacauaugacugucauuaaaauauugaacaccacacggacaagucuugcuucuuacaggaucagaaaugguugggaaccgacuacuguuaaauggaauggguuacuuugacauuuuugcuaaaauagcauuucaauagccaucugaauuuuauaacaggagcacauacagauuuugaucagcauuuguaaguuuuagacaugcagucauguaacuuagaacgaacgagaauuguuuauaacaaauuauuucacagagcuggaaacacagcucagugguuaugaguguguaugguuuucaagugaccugaguuuaauucccagcucucauuuccagcagcuugcugcugccugugacuccagcuccaaggggauucgaugccucugguucugagagcagucaugugcauguuccaacacacacagacaaacacguuacuaaaaacaauaagacaaaucuaaaaacacauuuaacuuuuaugauuucauguaauaaauggguuaaaaccucaggucuuaacauuuaaaaugaaaaaauuuuuuuaaagauuuauuuauuauuauaucuaaguacacuguagcugacuugagaugcacccggaaagggcgucagaucucuuuacgggugguugugggccaccauguguuugcuaggauuugaacucaggaccucuggaagagcagucagugcucuuaccugcugagccaucucgccagcccuaaaaugaaauuuuaauauaaauauucuggauaauguuacagggaugugaauugauaagagcauguucauuguuucauuauucauaguucuacaaucuaaagauugacauuaauuucugugaauauuuugagguauuucuuccuuuuuuuuucacauaugaugaugcuaaugugauauggaaacuuuuauauucugcuuuuaaaauguaaauacugggucuaggaagauaacucagagacuaaggcacuuguagugugagugagccggauggccaccguucagauccuggaaccaugcagagccaggcagacgcgauagcuaccugucaucuuagcacugauagcuaccugucaucuuagcacugauagcuaccugucagucagucaucuuagcccucgggaggccugagaaagggauuagcagagccagcuggcgggcagcugcaccuggcaaggucccggggucacggguggagagagguugagaaagaugcuugguuuugggccugcauacacauguagacguguucaugucuccuugaaacaaguguguccauacacauacauguguguacaccacacucaacaugccaacucaauauuuuuccaauuugaagacuuuaauuauuuuaguuacucauauagcucauacugcagucaaaguuauguaaaaacuuaggugucuguuucuuguauugugcuugcuuuugaaagccauuuaaaccauuuuauugaauauauuuuuuuauacuacacuaacacgcacauguacacacaugcauauacaucuuuaugucacagucuuggcacaaauaaguacuuguuauguaacaaguguuguaccgcugcuucucauuuauuggaggauucauguuugcacacaggugucuuuuucuucuaagcaacuuugccuaccuuuuuugauuaaaugcuuaaugucauucuauugauaucuuauaaaucuuguugggcuccuuaguguuucagagcacagauagaugucgucgccccugcccauggcguucagucaguaauaggcacuuugauauaugaugugguagacaaagacauauucugggauccgagcagugauguagcuggucuguggaggccaaguagagaagucuacuuucucgagugagccaucucacagcugagcucuucagaggacuaggucaucucggugaguagggaaacagcaguccaggaagacagcuuaacucagagggaagaaagaagugucugucuguucugggccucaguaaauucuugucacuugacacaaguucauggugguacacugaaaacaguucacccucugugccuucacagcacugacuugugcuuuauggcuguccuccuugcuugucguagucaugccugucuuccggucgcugugcuuuuuccacagauacugaucacuccuauuacgaugccguauuggaagcugcguuucgcuuccuguccccucugcagcagaauuuguugaaguuuugucucucucuccguuccuacucagccucaauucaagccuuccagcagguaagaagaccucaugugucuaggggacagccuuuuguaggggcauggcauggugauuucguugcuugucagacauuuauuuuuaaauaaugagcaaaacugauguuuuuaaaacauuaaagucaaccgggcggugguggcgcacaccuuugaucccagcacucgggaggcagaagcaggcggauuucugaguuccaggcuagccuugucuacaaagugaguucuaggacagccagggcuacacagagaaacccugucuugaaaaaccaaaccaaaccaaacccaaaacauuaaagucuuuaaaucuuagauguuuccuucccucucugguuuuggggauggaacacaggcccuuggacaugcagacaaauuaagaaaucucacuacugagucacaucucaccaaucacagauaaauaaauuuuauuuuacuuuucuugcuuugggacuggacuuggauauaaaaaaauuuaaggaaugauuuauacuuauuuuuauauaagaaaugaaaagaaaauuguuacaagagggacaaccagguacuguuaggcaagacugucuggaagauguaaucuugcuagacggugaacuugaaucuagucagagccucuggauguaaaagcagagguuacaagagauaggaagugucaggcaaagucaagggaauguagugcaaacauguaggaucagagagccauuuuaguaaagugaucugguuuacucuggauaaaugaaaaggcaaaagaaaaagacuucaaaaugucagugcgaggaucuuguuugaagagaggggcaugagagaaccagauguauauauauuaacuagauauuuguaugaaagaaauguggauuuuuaaagcuauccuguauuauaaagcgaaacagggagagaagcccacugagagcagccagagcaugugggugcaucacugugaggugagcaccuuuguaucacuugccaggccaagaugugcaucggcugcugccguuuacguccuccauguacacugucagagccacuguuguccuccaaaaggagccauggggccauuuccugucagaaucaccucuuagaguuuuguuuuuauauuguuuuauuguccaagaauuuacucuauagaucaggcuggccuugaacucacagagauccgccugcaucugucuccugagugcuaggauuaaaggcaugcaccacuguuuuuaaacuggguuacuuguuuucuugaugcccaguuuuuuuaguucuucuauauuguaguuucuguucucuaccagguucuauacuugguaaagacuuugcccauuuuguaggcugccacuuugcucucgguugauacugugucucuguuucugcuugugggccaagaugugagcucacagcuguuccugccacuguaucuuugcuucuccaucacaggcucucagucuaagcccaguuagacacuuucuuucacaaguugcauugauuguuugucacagaaauacaaaaguaacgaauuuacuggcccugaacuugguuggcuguguagcugcugcugaccuugcccaugcuaagcaguacuccaugguugagcuacauccuugggcuccuauauuaauauuauagggaaccacaaaccgcuuugcauagugacugccccauuuuuacuguacacccacaaaguccaaggguucuaguuucucugucuuccucaauacuuccuuaguuuuuaucuuggacacuaagggugagauguguagucacagcuugguucuucuauuucuuucccuuuuuuccuuucuccucuuucuuuuuaaacagguucgcuuauacagcccaaaccaucccagaaugguagaugucgugccucagccacuaaaaccuggguccucugcaagagcaguaaacucuuuugacuccagugacccaucuuuccagcccacagauugcauuuuuucucuuuacuccggcuguauauuuaugaaaugguuucauugacuguagcaguaugcuuuacuguauuaguaaguauuagccuccugagaggugaggcuauuuagauuuaagucaaaucaagcuaaagacagacuuuacucccucauuugcaccagccauguucaccugcccagaagccacacguggcacguggcugugaauuucugcaguugaugcaggugacuucugugccuaaaguaaccaccuggauguggaguuggugugagcagaugcuacucugcucccuuuuauuucuuauaauaauuaguugguuuaguaugggcuuugaauuagagacguguguguguguguguguguguguguguguguguguguguguuuguguguguguguaucuaaaguagaugucaggugucuuccuuaggccuucuguauagaaguagagagucuuacugaccuuggagcuggccuuuuggcuagucugauuggcuagcuuguucuggggcucuccuuacuguguugggcuuaggugggggccgugcucacaugacuuguuagguggguuuuggaaucugaacucuggcccucauguuuugcucacugagacauuuguucgcccuauagagauuuacauucauuuugaugugugcuuaauuuuucuuaccuuuuuagguuagccuagcucccucuucuguuggauuucuguagugcuaaggaaauaccuuaguauguuccugagauuucuugcuuguuuucuugcauuuaaaagugguguuaguggcacacgucucuacacucuuaaccccagggcugccucuccagcucuagccuucugugcuuuuguguggauuuuucucuauuaccucuguccugcugaaguuuucuacuucagaaguuucuccuuaacauggggccgugucuuagaagggaguccuggcuugggauuucuguaagaaacugaacaaguuuacugucucagcaccucugaccuuucugugggagccugcucccugccugaugcuaagaguggacagaaggcguuggccuucagugcaaacuguuguuucuucuuuggcuuggcuguuucaggguccuuaccucuugguuucugugcuaguccuagacuggcaauauucucuccucugccuucugauuauugaaguuacaggugugagccacugcgccuggcuuguuucuuucgauuccauagaauuuguacuuaaaucaggagcuuccuauuauuuuguauuucaucuuuaauuaggacagcauaguuuuaccuuggcauuuuauuuuugacauuuauuuuauauauauaaguguuuugcucauuucuguaucuguguaccaugugugucaggguccuguagaugucagaggagcuugucagguuuccuggaacuuaauuugugcaugguuauggacugccauguggguccugagaguugagccugaguguucugcagguguaguuuuauacuuuuauuaugaauuuuagguuuuuuuuuuaaccuucauuuccccuuuuuguccucuucucuucauggaacacuucucaacacaucucugcuacuucugugucucuuugaguguggugcacugaguucuauuagagcuucuucccagagcguagguaggaagugauuuauuggagcagggaaacuucauaguacguccaucauuaaagaaaaugucaccccuccaccagcagccccuaacugccaguaguccugggaguugggggugagaccuuguggcucuuccuuuguccaugacaaaguuugaaggacguaaucauguauagacgugugcagacagccacagcugcaguuaguuugaaacugccguauguccagaagaaagacuucuuuuucugcacaucucccugacuucuggcucugacccuuggaggaggugguaauaguugucccauuucgggcugaguccucugaccucaccuaucgcuggcacuuuugccaguggcgggugucugugggaagugcuacucacugcaggcagaggcaucuccagcgauggcgugcgcuugcucgcucgcucgcacgcaccuguggcuauaaacaugggggaauauuuagaauguagucugaccccacaaaguaguaagaguagguuggcuccuaggauucucccagacuuacagaaccagauacaaguuaccuuaaccuucggaguagccucagguccagucauugagaaagugguuggucacugccgugacauccaugucacuaguaggacaucuugccccacaggucaucauuguagccaaaaaaauucacaucugagcaagacuguugaaaauuuucuuucucaguaggcugcguagcauauucuagcagugugaaggcuagccuguagggagaaagcugcuagcuuagcuccaguuugauucucuuuguccugugaucaacaugugugguaccuguagaaauagaauauuuuuuuauaauuuuaaauuaugugugcauacaugcaugugugcgugugugugcgcgugcgugugcguguguguguguguguguauguguguguacguguguguacguguguguacguguguguguauguguguguguacguguguguauguguguguguguguguguguaugugugugugugugugugugugugugugugugugugcacaugaguauagguuuccacagugaccacaguugucagauccuugugcuuaggaauugaacuuggauccuuggcaggagcaguaugucuguccuaaccauggagccaucuuuuuagccccagcaguggaaugcuaccgucaagaccugguggcaccucgcucaauggcaguagcuucuguuguuuugagggagagacucuuaugcuucucugcucggcaguucagagggaaacaguccacaaccugcacuggggaauuuuucuuuaauaacccaagacuucugguagaacuacccgacucuuucaaaaagaaaugcaguuuuuaaauaagcuuguaugaucauagguuuccauucucuuuuucugcccaccccgcuguguagaucucucuccccaggaucucaacccugccccuucaccucugacccauccuauuaucucucaccucucucucuuggccccuuuccguugcucugacauuucucaacacucacugucaaacagaacuuuuuuuuuuuuaagauuuauuuauuuauuauauguaaguacacuguagcuguccucagauacuccagaaaagggcaucagauuuuguuacggaugguugugagucaccaugugguugcugggauuugaacucgggaccuuuggaagagcagucggcgcucuuaaccgcugagccaucucgacagcccccaaacagaacuuuuaacaauugacauggaaaauuuuauuauguauuuacuuauuauuuauuuaguguacgugucucucucugugugugugugugugugugugugugugugaguguguguguauauauguaugugugugcucgcgcauacacuguggaggucagaagacagcuuguagcagucaggggaccccuucuuccauguggaucccagggauugaacuuaggugguuaguuggcauuuuaaggggcuaaagagauaguuuaguuggcaaaaugcccuuauaucaggguauagugcccuacacuuguaaccccagggcugggaguuagggggacaaacagggagaucccugaaguucaucaucuguucauuuuagaugagcuggugcagcugagcuucagguucagugaaggaggcuaucucagaaaugaacuggaagaauuaaucuagaaaagauacuccauguuaacuucugaccucagcgugcauauccacauggacagaugcacagacagacagacagacacacacacacacacaaacacacauacacacccugacauuuugagccaaggguuuuugaagguacaaccuggauuccuagaugucuuuugauaagucugagaaaagauugaaauguuacauucucuugugggauuauaacacuagcacugaacugggcugauauaggaggaacugaguaacgauuggagcucuggcuuggaaugcucuuaccaccuuggcccacagugggaguucagcagauuuauugaugguggauugucauuuaacuacauguucauuacaacauacauuucugucuugucuuugauuagaauguguauuucucuuccugacagauagcaguugacgagccuccaccagaagggugcaagucguuucucucagugcauggaaagcagacuugugaucuagacacucuggagagccuucugcugacugccgcugacaggucgguuguguucuucacucaaugugguacaugcuuugugccuuugcucuaucacaugcacucugaguugaguuuuguuuucuuccuuguuuguuuguguguuucagauacccucacuugguaguccuggccuagaacuagaacagaccaggcuggccucaaacucauaaagauuggucugccuuuccuccgcggugcugggauaaaaggcauaugucucuauugacgccuggcugauuuuuguuguuuguugagaaaaggcaugugauacaugccugguccucugaguuuuuuaccuuaccaucugcacguauuugagaauggcuacuagcuagagacugaccagaugugaacaucagcuccauuacuuaaaguaguuuguaaaaugaugaaaauuaguuuguuuucucauguuucaaaauuagaaguacuugauauuccuguuuuauugggugauuuuuuuuuucugagagauuuaauggcuuuguuguuagcuuaucaaagaauacugucuguacaaaaagcuggcgccugaaguagcagagauuaauaauaacgaucucuuaggauauuaugaccaacaacagacaguauuuaagcgauauuacaaacuugauuugaauaaugaaaguacaguuuuuuuugugugaggaggcugagguuuccaacaguggacacuuagcacaaguaugcaucuggcuggcuggaguagcagccucucuguaccugcucuaggccaugugaugaugacucuaccagaaacguuaaugggauuuuugguuauggaagucuuguguaaugacauugucaaacccguaacaaauucucugcccaacacauggcacuagucucucucucucucucucucucucucucucucucucucucucucuuucagagacagaguuucucugggcacuagugucucuaacucagaaugacaauaguaaagucacuguauuuucagguagcucagcgucaggguguggguggauauuugagaauggcagcaugguagagcaaugcuuuccuggguggaauguaauuggaggccuggcagugguggcacacgccuuuaaucccagcacuugggaggcagaggcagucggauuucugaguuaaaggcuagccugguccaguuugucuuagucaggguuucuauuccugcacaaacaucaugaccaagaagcaaguuggggaggaaaggguuuauucagcuuacacuuccauacugcuguucaucaccaaaggaagucaggacuggaacucaagcaggagcuaaugcagaggccauggagggauguucuuuaauggcuuguuuccccuggcuugcucccugcucucuuauagaaccaagacuaccagcccagagauggcaccacccacaaggggaccuccccacuugaucacuaguugagaaaaugccuuacaguuggaucucauggaggcauuuccccaacugaagcuccuuucucugugauaacuccagcugugucaaguugacacaaaacuagccagugcaauugaccccuugucaacuugacacacaaacacaucacuaguaagccucaacccuuaguucuuauucauccucaagaucuuaaauaacuuuaaaagucccacagucuuuacauauuaaaaguucaauccuuuuaaaauauccaauaucuuuuaaaauccaaagucuuuuacaauuaaaggucucuuaacugugggacccacuaaaauauuuucuuccuucaagaggaaaaaauaucagggcacagucauaaucaaaagcaaaaauuaaacuccaacuguccaaugucugggauccaacucacgaccuucugggcuccuccaagggcuugcgugacuucuccagccaugcccuuuguagcacacacguuguauucuaggcuccagcugccuguacuccaaugcugcugcuguucuugguggucaucucaugguacuggcaucuccaaaacgcugcugucuuccacuguaacuaggcuucaccaauagccucucauaggcucucuucauggugccaagccucaacuccuuugcaugaccccuacaguccugagcccucaauugcaacugaggcugcaccuucaccaauggccuuccauggccccucacagugccaaaccucagcugcucugccugaccccuucaugccuucaaaaccaguaccaccuggguaacucuuauacauuaccaaguccagccacagcacaagguacaaccuuggcuaucucuggaacacagccucugugcucucagaaaacuucccagaagaugccaccucaaugaugcuggucucuucuuaaucacagcuaauuucuuagcuccagcuaaccagcaucaauagucccaguaauucacaguuuuugcuuuaguaguucugguaucuuguuaaucacagcugauuuuucagccccagcuaaccagaaccacagaaucuucacaaucaaaacagcaauggcccugaaaagagucuuaaucuucucucugaaauuucacaagccaggccuccauuuucugcaguguucucaacauugucuuucaagcuccuacacaacaucucacagagcucuuaacgccgaauggaucuucuggccgaaaguucuaaaguccuuccacaguccuccccaaaacauggucagguugucacaggaauaccccacgaugcugguaccaauuugucuuagucaggauuucuauuccuggacaaaacaucaugaccaagaagcaaguuggggaggaaaggguuuauucaacuuacacuuccacauugcuguucaucaccaaggaugucaggacuggaacucaagcaggucaggaagcaggagcugaugcacaggccauggaggaauguucuuuacuggcuugcccagugaguuccaggacagccagggcuaaacacaaagaaaaccugucuugaaaaaccaaaaaaaaaaaaaaagaaagaaagaaagaaagaaagguaauuggagacacugugguucuuuuaaaacuguauugaguuuguuagagcaacuguguagacuuguguggaguggugucuccucuucugaggguggaacugcuuuuaauagucuacuguguaucauuuuuauggcuuuaaguuugcacaaguagguagguauauaucuguugagagacaucuucccacuuuaugcauguagguguacuucaguauuuuuaacacccgcauaaaaauguccugcugcagguuuuuagaguuguuuugaauuuuggaacuuuaccauuaugaagaauauauuuuucauaugucauugcccucuguugcgugguuuauuagaacagggauugguggguguguuaguuccuuucuuuuguugcuguuacugaauaacauggugaaaggccacuuaacuuauuuuacuguaagauuucuaucugucuuugcuuuuuauugugugauaacacacuacuauuaaaagcaauuuugggaaggaaggguuuauuuggauuauagucuauccucaggggaagacaaggcaggaaucuggaagcaggggcuggaguagaaaccauggaggcauguugcgugcuagcuuguccagccugcucucuuguagaaagaacccagaccaucuauccucggguggccacgcccacaguggacucggcuuucucccaucaaucaauagucaagaaaauacuguacagacucaccuacaggcgagucucaccaugggggcauuuucucaguugagguuccccuuuuccagauagcucuaauuucugucauguugacaaaaaaccugagcagcucgguuucaggaggcuagauguccaccauggcagagcaagcaaguaggagggaacagggagcugaggaucaugccucauucucacacagggagcagaaggaggaagaacuggagugugccgaggcuauaaacucuaaaagccuguccccagugagcucuuccucuguguuccagaguuucauaaccucccuccaaacaguaccacaacuggggaccaaguauucaaauacaggagccuguaggggacauuuuccauucagaccaccacaguagaucauauuuuaagaacuuuuaaugucuuuuuuuuaaagauucauuuauuuauuauauguaaguacacuguagcugucuucagacaauccagaagagggagucagaucuuguuacggaugguugugagccaccgugugguugcugggauuugaacuccgaaccuucggaagagcaguugggugcucuuaacccacagagccaucucaccagcccccaacuuuuaaugucuugaugcugauuuuagaaaguauggugguuuuuuacucuuuugagaaguuuaaaaaaauuaaggggcgguggcagcacacuccuuuaauccuagugcuuacaaggcagaggcgggcugaucucaggaguuccaggccagccagcccauacagacagacagacaaaagcauuguaggaagaucacaguagcaaacaugccagagagggagacuugcuguagcucacaaguuacuugcuuaaaguuuuaucugcugcucgaauuauuuggccuuaauuuucagauaaaauuacagucacacuccacacaguacaaaaauaugcuguagauuuagugcugugggauuugguaugcauccuggcuucccuucuguucuuuuuaaagaauugaugauauuuaauuuaacuuaguauuuuauaauuaauauucauguaauauacuuuauuuauauagccaugaacgaguaaaacucauacuugacaguauucuaaaugcaaacuguuuaagauugugcugcucaugaagauacuuaaaaccuuuacuaaguuuuuaaaguuguugucaaccaguguccugguuuuucuuuaaaauuuuucuuaauugaauauuuacuuccagaccgaaaccauuauuguucaaaggagaucacagauaucccucaucaaauccugagaguccaguggucauccuuuauucugagauuggccaugaagaauuuucuaauauucaccaccaacuuauaucaaaaagcaacgaaggcaaaauuaauuauguauuccgacauuauauaucuguaaguauugacuuauuuuacaauuucuugaauauuaauuuguuuaaaaugacuuuuacaaauaacuuaauuggaaauucuuuuuuuuuuuuuuuuagaaauccaauacuuuuaucagaucucucucucucucucuguacuuucuuucacuuguuucuuucucccccccaaucucccuuccucucuuuaauuuuuuuuuuuuuuugaaacagggucuuacuguguuacccuggcuagccuugaacucacucuguagagcagacugaccucaaagucauagagaccccccugcuucccaagagcugggaucaaaggugguuacacagaacauucuuaaauuaauuaauguucuuacuuucuugauugcucuccacucauucuucuccauucacugagcagucucucaguugaacugaacaagcugcacccagcuagccugcuugcucaggguuuccuuguuuccaccuuccacagguuagaauuacaagcaagcugccacagcagucugggugcuaaggauuugagcguuggccucuugcuuggguggcaagggcuuaccugcuacggcacuugcuuggucugcaucagaucucuuacuugcacauggguggugccuuccuugcuugcuuuuccaaagaaacgucaaaaaaauuacacuuaaaaaaugggauaaucaaauuguuuugauuuuaaaaugaacugcagugagcuagguaugaugagugauuccuauaaucucagcacuugaaaguuugaagcaggaggauuacugugaauucaaggcuaucuggagcuacgaacugagauccuauguccuuuaaaauuaaaccaaaaaacagauacuaggaauugugcaaacuuuuguauguuaacauuuaagauagucauccaacuguccaugaaccuuaggcuauugaguguugagcccucaugucuccugguaagugagcucuuagccuccugagcuguguccccuaggcucuccccuaggggaccuguuuggaagcacagucuuguugaguugucuagguauuguugaguuaucuggguggcuuuggaauccuccaggaagacuuugaacuugcagucccccugccucagcugugaccacagguccaauucaccaggccuagcuagaagugauuauugagaucucuguguguauuugagcuuauauguuuguggggugugcgugggcagcuguguucucuucugggguccacauuuuccacauuuccacauuuucuuuuugagaucuuuuuuuuccuuuaaagugucuugacaagaaaauuuugacucuuguucaagagggugugcuccucccaagcagaagagcagcacucugggggcaggagaugcaccagauucuaaugcacucaugaccgugucuguucccaaugccugggcugccuugccgucugucacaggagacuuuaaauguuuuaauagaaucagggcaaaaagacauggaaagggaaagcaggucggccgcuuuuagucacuuaaguuccaagaaagcagggcugaucuguaagcaugacugggguggaggggaagcaaauucaaacauuugccucagagucuuacaaagugggaagauacugguaucuucucccagacacagugcagugucugauagcagagacuaauacuuuaucuuacaagucccuccucuuacuguacguguucuguuguuuacacucauuaggaagauguuggcucuuucuccauccuuucuuagaguaagaaacugcuaugggaagggguccuucuuuagugauagcugacccaguaagucugaguuaggacucuaauacaagaaaguaauuauuccaucucuuucauuggcauggccucccuggggguauuuggccagagguugaccuugucccauuggaguguuaagccuccacccaggcugcuucaugaccaggaagaauuuuucuuagcaggccuucauuauuacuuuaauacccacaccccaagagguaaccuaagaaucauuuaggaacuagauggaaggucagagccccagacacuuggccuuucuagucucuagcagggaugggccugccagggcucccaaggauguuucuggauuuuugcuaagagagaaacuaguuguucucauugagggcuuuuacccuaaacugugcagccaguucucuaucuccuguucucaucuuccuucgcucugaagagguaacucuaaugccaucguagcguugggccaaugacccaucucagcugauuucauacagcugaauuuggggugucagagucacaguuuugggguaccccuccagggagccuaucuaaaaaaccucaacuguuagauguagggaggaaagaaucauugacugcugucuggaaagaugugagggagcuguguuacccuaggcagggagaagccagagacauugggcucacaagaacauccgucuguuggguccuucucaugguucucuuggccuccacggcugacuggacagcgaugaaaccaagaucuguuuucaugcacuuugaaagcuguuggacagacuagaaacagugcagagucucccccggauccuuccagagggacagagagaagacauuuagcuagcauuugauuuuuuuuuucucucuuuuuuuuaaagguuaaaacaauacugagccuuucuuacuuggauagucauugaaguguuuaauugagccaaaaucugaggucuuauaucuggguagcuuuuuuuuuuuuuuuuuuuuuuaauuaagaagaaaaucacugggcuggagagauggcucagugguuaagagcacugacugcucuucuggagguucugaguucaauugccagcaaccacaugguggcucacaaccaucuguaaugggaucugaugcccucuucuggugugucugaagacaaguacagugugcuuacauauaauaaauaaaucuuuaaaagaagaagaagaagaaacucaccaaugagacacaaucuagguaacagcccagauaguuuuaagucuaaugucugggaacugugagccucuggauaguuacaaaaccuaacaaacacacccaucauuuuaguuugggguuguacuuuugugauggguguuucagacaauguagguggccagaauuauuuuuuucuucuuuuuuuauuuuuauguuuuaguuuuuuucgucuuuauacugucagguugagggucuaguucuuggguacccgugcuugagagagaccucugguuccuucucugccaguuucucugugugagcgucagccggaggccggcgugacccugccuuugcuuggaagcagugaggaaauccuuuacauugacucuccucuucguagauuggacacugguuggugucucuucgggcuccuugaacaagggaacaggaaguucuccguguacuuacaggccauuuugaaagcugcccgccccauaauccccugggagcuaguuguugacugaucuuggagggcaacgggaguacauucucccuguuagucugucuggccacauuaguguagcuucugaguaugguuauuaaauaugcagaggauuagcugcacccuuuuaacuacuggauaguaguucagaaacuaggcgugucuacauaaauguugaugagacauucuuuuuaaugugcuuguugaacuuugaccuuacucuuuugguaucuuuuuauuugguggaaguggagcguuucuaaagagguagaauaaagcagaauuaauauaaaauuaaacguguaucauaucauugaguauuuaaaauauggaagucuuuaaaguuugugugucauauuguucaguaauucaguaaugguaauuguuaaguaugugcuaagagaauaaaaauuccaaaagaaaauuugauggaguagagacagauguauuuaucagucccccccuuuuuuuuuguucuuuuauauuuuugagaccaguuucaauauauucuaggcuagucuagaaguccaaauucuucugccccggucccccccaaccccccauuagaguuaaagccuuaugcuaccacaucuggccaaaguccaguuuuugacuacuccucuccugcugacauccccaggccuuggauuaugaccagguucauagggaucaauugcucccccuguggagcaagacguuugagugcaugucugagaaagcagucgauuagcccuuuguaauagucaugcuaucuauuauagcaccaguaguguugucuugccucgagaucagugcugaguauauagcuaauaacauuauauauauauauauaaauauaaagacaauuaaaaaguguuuacaguggaauuacaucauuccccuuucucucuccagccccuccuauguacuccgacuugacuucauuuaaauuuauuccauuuuucuuguguuguuaaacgcacgcaugcauauaagcacacacauauccacacacacaaccugcucaguccauaugauguuacuugcacauacguauuucagggcugaccauuuuguauuggacggccaauuggugugcgcuucucaucaguguggcugccugcacugagcaggggcggccucgagagccaugccaguaaggaggggccgcugugccucaugccgggccagguggggaugguggaacucuugcucuauuugcagaaucccagcaaggagccgguuuaccuuucuggcuauggaguggaacuggcgaucaagagcacggaguacaaggccaaggaugauacucaggugaaaggugaauuuguaaaaauaagaccaugcuuucucuugccuuuacguaugaguucauggggaauuggcuugucacaucuggguaggaaccuucagcacauuuucuaggccuggauuuuuguccucuguaacauaugggcagugauagguucuuuuucaaggaagauaauguaugucgagaauuugggggguggauauuguggugugugcuuaacaaucucagugcugaagcaggaggauuauagcucaaggcugccuguccugucccccaaacaguaaaaacaaggaaggguacaccgaaacaaaaugaagcccacgagguugcgugugguguuuuuacccaggugaugugaucagcagcagcaacuguuguugauguugugugugucacagacaggccuuacugugacuccgguacaaaacucuaaauauccuaggccucaugggucauuuuuguuuuuauuauuuuuguacuuggaacaguuuucuuuggguucuuccucccauauuaugaugugguuuuuuguuuuuguuuuguugagacagauuuuuuuuuuccauguagcccuggcuguccuggagcucacucuguagaccaggcuggccuuaacucacugagauccuccugccucugcuucccaaguacugagacuaaagggaugagcugccauacccagcccugaaguaauuuuuuuuaaccacaaguuuuacuugcugucuuuuuuuuucuuuaaaaaucacuuuauuauaucuuuuuguacugugugguacugaguucagagccuugugugugaugaugcucguccuccguuaucucaccauugagcugcaucugcauucuuuuuaauguuuucguuuguuuguuugcuuuucauuaaguuauccaggcacacuaaacuaucuaggccagucuugaacgugagccuccugucucagcgggaauuauggugcaugccauuacauucucugcacugcuuuuaaacaugaaaugauggauuugaauagugaagcaaauggaaaauggugugcugcucucucagugaugguuaggauuuuuuaaacuguaaauucuuuagaauuuaacugugaaaaaauauuucauaauauuucaaucuauuaauuucaaauuuuuuaauguaaaauuuucuaaggcuugaaagaaaauuuauucuuguucagaaacacaagaaauauaaaaccaccaucgguuuacaggcccacacugaaguguuacuugaagccuucgauauuucuuuuaaucuccagucugugguggaacccuuacuucuauucugagcuacuagacaugccucuacuaugucuuuauaggaacugagguaaaugccacggucaucggggagagcgacccuauugaugaagugcagggauuccucuuuggaaaauuaagguauguugauucauguugcugugcaccgcccuuuguuccugugucuuucccguugcugucugaguugcagcucuacaggacguucuauacagaguccaccgcggagaaaccuucucacuugcagucagcguggccguuuuguucuagugaaacgcacugcucuuggauggcacuggaguuaccugcccaugcugaagcggguuucuuuuccucucaguugauagcauacaguuacagauccuuguuuugaguagcggaaaagaucacauucuauucucuucuucacaugguuggaaguagugaaugggguuauuuucuuaugcugagcagaaucugaaaaaagaagccaaaguguauaguaaguagacuuaaaaacaugcaauagagauaguguuccaucagccaaugggaaguuuuuucuuuaauauauauuuguuuguuuguuuaguuuuuuuugagacaggguuucucuguguagccccaguuguccuggaacuugauuguagaccagguuggccucgaacucacagagauccaccugucucuugaguucugggauuaaaggcaugcaacaccaugccuggccuauguuauugguauuguuugagugaggucuuccuuuguaguccugguuguucuggaauucucuauguagaccaggcuacccucagucaugcagagaucugccugcugcugcuuccuagacgcagaucaaagacaugggugaucauaccuggcagaaaaugauuuuuuuaauuaacuuauuuacuuuuuacuuauucacuuuacaucccacucacugucccccuccugauaaucuucucccacaacccuuucccaugccugcuccccucuccucugaguggguggggcuccccuguaucccugacccuggcacuucaggucucugcgaggcuaggcgccuccucucccacugaggccggaaaaggcagcccagcuagaagagcauaucccacagauaggaaacagcuuuugggauagcccugguuccaguugcuugggacucaugaagaccaagcugcacaucggcugcauaugugcagagaggccuagguccaacccguguguguucuuugguugguaauucagacucugagacucccaaggguccagguuaguugauuuuguuggucuucuugugaauuuccuaucccccuggggccugcaauccuacagaagauuauuuuaaugauggaauuuguuucauaauuacacagaucauuuugugacaacaucauaauuuauagcugaacauuauucuugacuguggugacuugauaaauuuuuuaagagucucaaauucugcugugugggaauuucaguuagaaauuuugcaguguguugcccuuuuaaaaaauaaaauaaaaugguuuccaguuccagcugcggugucuucuucccuuuggguggauuacuguugguugacucccugccguggacacuugccugucaucucuuucagcucuggcuauagucaggugccacuuuuauuugaucaagauuuccagagucucuuuuaguacucuuucuaugcuuuuuaauuauauuuauuuauuucgugugugccaugggaacagugccugaguccaagauaugcacacggaccuaguucucugauucccgcaccccagcccugggaucugagucagguugucagguuugguggcaagccuucacugcugagcccuuuuguuguucucugggugaugcugugguuuuaugcguucauagcacaaaagcuucauguagaauauacaacacuaauguacuuuuagaggacagcuguugugcuuuaaaaucuuuugcccguauugaggaaaguuucuuagguuugggagaggaaaauuaugaagauuaaauuggaguccuuggcuaagugcacuaugagaacacagugagaagagucgguucuguuucuguagagaacuguaccccgccuuggaaggacagcugaaagaguuccggaagcaccuuguggagagcaccaacgagauggccccccugaaagucuggcagcugcaagguaaugggcacucagcucaccugaguuguggugcugcguucugugguguuaaaagacugcagaccucgggcuggggauguagcucaguuguuagagugcuugccaagcugcacagagcccuagauuugccucucagcaccacacuaaccgggauuuguacuggaugccuguaaucccagcacuguggcuaagacaggaugagugucaugcguuccagaccaacuugugcuauagaaugaaaccuugucuuggggcaggggcagggggauuggggagugcagagcuugaauaaaaucuacuagauucuaaaaguaccauagaucaugacaugcacaccccuacacacacacacacacacacacacacacacacacacuuuuaaaauugaaauauauuuauccucuccccuuauaccuucucaaauucauggucucuuuucuuuuuaauuauuauucauauauauaauauauauaauacauacauucauacacacauauauauguguauauauauauauguacguauauauauguauguguguauaugugugugugugugugugugugugugugugugugcaugaauagauaaugugcugaauuguguagcguugcuuguguauguauaccuucagggcugacuaccuaguauuggauaaccaacuaggggcucacccccugguaagcccaaaucuuuacuuuuuaacaugcuuguuguugguguauaaaaucuauugauuuuucuaaauugauuucguauccugccauuuugcugaaauuguugaccaacuuuugaaguuuucugguugacuuugggauuucuuuuuuuuuuuuuuuuauagauuuuaaauguuuuuuuuuuaaagauuuauuuauuuauuuauuuauuuauuaauuauauguaaguacauuguagcugucuucagacacuccagaagagggcaucagaucuuguuacggaugguugugagccaccaugugguugcugggauuugaacucuggaccuucagaagagcagucgggugcucuaacccacugagccaucucaccagccugggauuucuuaugcaucauaucguaucaugucaucugcaaauaguuuggccucuuuucuuaucuuguccccuuaauuucuuacccuuaccuuauugcuccagcuaguguugugaguccuuuauugaaaagguguggggauaaaggacagccaugcuccuuuccuaauuuuaaugugauuuaaguuuuucuucauuuaggauaauguggguuugucauauauagucuucauuguggugaggcauggucccucuaggguuacugccucuagacuuuuaucaugaagccauguuggaguuuuuuccuaaauauauugagaugaucauaugauuuuuuuuauuuguuuugagacaaggucuuaucauguccuggcuagcuuggaacucacuauacagaccaggcugaccucgaacucagaaaucugccugccucucuuucugagugcugggauuaaaggcgugugccaccaugcgugccuggcuagcaaugguuauaugauuauuugucuauuuaugauuuauuacauuaccuacuuauuuauguugaacuaucccuguaacauggggauaaaguuaacuuugucaugguggguauuuuuugcuaucugccuucaugggauucaaguauuuuaguaaggacuuaugaaucuauuuccaucauggauauugcccuggaguguucuuuucuuguuguguuuucauuuugauauugaaguacuggcuuaguagaaguuuggacauacuccuucuguuucuauuauuuuaaaauaaauuuaagaaauauuggcucuagaucuucuuugaaagucugauagaauucugugugauuccaucugggucagaacucuuccauuggaaggcuuuaauugcuguuugaaaucuucucacuuguuacagguguugaugauuuuuuuuuuuuuuuuuugguuuaacuuugguguuuugcauggaucuagaaauuuguccauuucuuuuauauuuuucagcuuagaggaauucagguuuuuaaagaauuuccuuauguggcucugaauuucuuguuguaauguuucacuguucauuucugauucuguucauuuuggcuaucucauucuuucuuuugguuaggugggccaaggguuugucagccuuguuuaguuucucaaagaaccagcucuuaagauucgcugguucuuuguauuguuuucuucauuucuauuuuauuacauucugcucugaauuuuaacauuuuuuugccaucuucuggacauggguuuugcuuuguucuuguuuuucuugaguuauaccauuaagccauuuauccauacccuuucuaauguuuuuuaaagauuuauuuguuuauuuuauguauugaguacacuguagcuguacagaugguugugagccuucaugugugugguugcugggaauugaauuuaggaccucugcucacuccggucaauccugcuugcucgguuccugcuugcuccagcccaaagauuuauuuauuauuauaaauaaguacacuauugccaucuucagacacaccagaagagggugucagaucucauuacgggugguugggauuugaacucaggaccuucagaggagcagucagugcucuuacccgcugagccaucucgccagcucgucuuucuaauuuuuugauguaagcaccuagaacucuaagucugauugauguuagugugccgcagggguuuguuguacuguauuuucauuuuuauuuaguuccaggaacuucuugaguucuucuucgauucauucaucuuucgguaaugugucuuugaaucuccaugaguuuguguacucacuagagauuugucggcuguucauuuuaacuuucauugcguuguggucagauaggauacguggugguguuucuguuuuucugaguuuguuaagauuugcuuuguguccuaggauguggucuguuuuugcaaagcucccaugggcucauaauagaacguguauuauauucucugguguuuauggaauaguuuauaaucuguuaagaucacuugaugcaugacacuguguaauucucuugcuccucugcuaagucuugucauuuugagagacuauuauuacuaucauuagguuggugcuacucuuugucuaagauuuguuuaugaaauugggggugccagaaugucguguguguaugcuuaguuacaauguccucucggcucagugucccucgaguaggggaauccccuccugcuuuggguuaguguagucuggagucucggagagccguggcugcuugcuucucggcccuucugucugcagugccucuccucauccucucuugcugagauggugccuguguucaaagcugauaaagcugaggugaccuuagacacagcacagacauggauuuugcuuuuucauccagucagccggucugcgucuuuugauuucauccauucagcccgucugcgucuuuugauugggcaauugaggccauuaauauuuaagguuacuauugaaagguguguguugauugcaaucuuuuuuuccucugaaaguuuuguucucaguugugcuuuuuguuucauugauuauagcaucauuuguucuuucuacagacuugcagauauaucauuauucauccuuucagucugacauuacugcuuguaguagauauuaucuugaggguugauuuuguaaauaggaauucuuuuaauccuuuuaugucacagacaguuuugcucucuccuucaaccauggcagauacuuuugcuggacacagucgucuagcuuggcauccagggccucuuagaacuuagugggcgucauuccagggucuucuggcuuucaaagcuucuacugagaagacagcuguuacucuuucuguggguuucccuuuauuugucuugcauuuuuuucucuuguagcuuucauacuaugggaguguuuucuggucuugucuuugguguucuauguacuucuuauauccgugucuauuucucuccuuaguuuagggaaguuuucuucuaugaucuuauugaagaucaucuggucuaugccauugaucugggauucuucucugucaucuaugccuaugauuugaagauucuaguaccucagauuuuaaagacagaauggcuaagggaagaaaugaaauccucuguaaacauaguacuagguaggcugcagugauacacacaccccuuuuugggaucagauacauaacuuuacaauacaagaaauauguagcuguuuuuauguuccucuuugcauacguuuuaaaaacccaagugacaguuuuuaauuuuagguuuauauauuuuuuaaaaauagugcugaggguuagaucuaggcucucacauugggcauacacacuaccacugaucuauaaccauggucuugcaugcauuuuacaauuuauuaucauuguguuuauguaggcuggugugcuauaaugcccauguagugguuagaggacagcuuuguagaguuugguuuguccaucuuuguuuugguuccaagaaauugaacucagucaaugaggcuugcauuauauguagcaagcaccuguacucacugagccuucuagcuggucuccuguacgcauuugcacacgucuucauugugcaucuauagaauguuaaaggcacggaagggcagaauauaugugcacuuuucuuuucuaaaggauauuccaaaauuuucucaagcuauuuccccugaggucauuggguaaauaaucuuaaugcucuauuuuauaauacauuguaaaucuagacaacaacaggauuugggcucaaguucaucugcuagguguuaguuaccacacagccuaggacuuuauggauggagucauggacaacguaguaaaagcuccaggguccaccugaacgaggucugagcuaagccugggacaccgucgggaauaguuccauucuauggcgucuucacccucaauggauuguggguaguguuggggacauugucuaccaucauuaccauggauuccugugcucuaaugucacaugugccguugugcagaucucagcuuccagacugcugcccgaaucuuggcugcuucuggggcauuaucucugguggugaugaaggacauuagucagaacuuuccuaccaaggccagguaugugcuaagguuuugguacaucccucuccuucacauuguucccuguuguuuucauguuugcacagaacaugaugugacuaaaauguaaaaaugcuuggaugugaaaccuauuuguaaguacuguugcgaucagugucuucuuucuaacacgugacagcuguuggcugugugguugaagagagagggauuuagaugcucuuggcacugccccacuuaggccacaucagcuaauccacagucugguccauacugccauuuuugaauccuuaugaagaggggcuuugccuagggcucagugacagaacacuugccucaugugcacggggcuccgggcuuaauccucaguucuucugaaaggaggaggaagagagaagagggauucaggguccugacuuagaaacagacucagggagacugacuuguucauaguaacagaaugaauuuccugacauugcugucuauucuguaguguuaaucucugacuaugaaugugaggcaaaauugucuaaaagccaaauucuuagaaacuuuuccagauguugucuuaaauaacuaagguuaaauucuuggcuaagaguuuccuaaguaagccccuuuuucaccguggagugccuauggaagauuucuuaagccauuacgcuuaaagccauuaugcuuaaagccauuacgcuucuggaagacacacaggguucagccuccacgagaggauuuaauaggacuagcagucagccggaguacguuucugcuggcuaguuaucugagcagcaaaugucacaucaggaguagggccacacagucaagaaaucggaagccaccagacuugucacguccugccaccaugcggcaucugcagggugaacacguuugccaguucugcagcugugagguuuacuuaguucuuauuuuuauaauuuauugagucauaugguucaugucuaaaaacaggaaaacugaagaccuuuauauggaaugcuaagcuaaacacugaucacacuuuuauccuuuuuuagagcaauaacgaaaacggcugugagcgcgcagcuuagagcggaaguggaagagaaccagaagguauugcugacuguuagaaaguacuccacuguuguagaagacacuccugggcuguagcuuuaaaaaauggagagacuugaauuaaguucguagcauuuaguaguauuccucuuaguaauacuauuaucauacaguacuuuuuaucagauuuguagcauuuuguuuaggagaggcuccugacuggagguugggggugcggucaacagggagugugggccuccuaagucuuuaagccuuucguuccugccuuuggugcauuccacguggaagcugggcucuuguccuccuuuccugucagccccacauguaguuccuggaggcugccaggaugcucacugcucccuccuaucccuuuguuccagaauccauccauuggccuagagcuguggguguguucagcuuauccaucuaucuaccugucugucuguccauccauccgucauccauccauccauccauccauccauccauccauccauccauccauucacuuacgguuuuucaagacagggcuucuguguuccugauggucuuagaacucuguagaucagguuggcccugagauugaccucccucugccucccaagugcugagauuaaaggcgugcgccaccacaccuggccucaauuagccgcuuuuaccccuagauuucauuauggguaggacguuaguuaauuaaguagauuugagaaagaaagaaaccaaauacuucacacauauuuacuaaauuaaaaacaucaccauggguggugguaacuacaccugcaaccuccaagugugagaguagagguaggagaacuggaacuucuugguccauccauucguggcuauguagugaguuugaagccagcuuggggcacaucagucucuguuucaaaaaaacaaaaaacaaauaaaaacacucaauuuaguaauugcauguacauuuauuuuccagaauagcaguguuaacuauaccuuugaauuuacgauccccuguuuacugcacuaagggugguggggucugggagaauaaagccugaaaaugaaguggacuaaagucucaugcuaagccagccuuacucagagugucagacaguuuguacucucaggguuaagaagagucacagaguaaaguauccaguccuaagggcaaaccacaugcggcaaagccauguuuuucuagagaggugaguaaacaaauaacaauagccagcuguauugagcagccugacgugacucaccccuauccaccacaccucagaggagcacagaaacaaggacaauucuguauuuucgaaggaacggaggucacaagacucuuguuuuguuuucuuagaguuuucucacaagcacuuggaauuucccucacaugacuccauucauucuugguccauguucugacaguuccacaugccagggaggcagaauauuaacuuaugugagcuauauugguauuucuuggauuuuuaauguuuuugaguaaagcauguuauuuaaaaaugcuuaaauacaugcacacaaaauucuuaaagaugaaacacaagugugcaugaaaucuuaaauccagugugaugaguuuucucacugugaaaucuccucuguguuucagaucuugaucuacauuggguuguauguacaagcucagaauuagucuuucuuaccaucucagaggcccaagcgagcagauuugaaacuguccuguggagaaaauuccaauucuuuucuauuuuauuuuaagugugucugugugcgugcgugugugcgugcacauauaaguauaucauggcucacuauugaggucagaggacacuuugaggagacauucuugucuuuucccuugcugaggcaggcucuacuuguuucugacgcuguacuguaugcuccaggcugguugugcuguaggcuggguuaacagauguauguacacugccacgucuggugucucacaugcacucugggaaaugacuugagcuggcuugaaggcuagugcuucugccugccugcccuucccugguuuggaauuccaguccuuagcugcuucagcuuuccaucauuucugugguuuuguuguuuuuguuuuuaagcaaauuuuguuguaguucauauuuaaaaccuuuuauguuuuuuuuugagguuauaauauaauuacaucuuucuuucucuuccuucccccucccccucuuuauucuuucagauauauagccucuuuugucauugcuguauauguagauguguguuuucuauauuuuuguguucucauauuguuuucugauugaugcugccgugucugugaagcaugagacacaacagcuucucacuguuugguuuucccaugcagugcuagaauucagaaguauaccuuuuccuaguccucugaguacuggaaagugaagguguucucagaguucauccaaaauucuguuguugguaucugguaacuccuuuugcacggcacucuacugucuagcaauauuguaucacuguacugucucguguacuguaccucuguccugucuagagaacuguaucacugaacugucuagagaacugaaucacugcacugucuagaguacugcaccacugcacugucuagaguacugcaccgcugcacugucuagaguacugcaccacugcacugucuagaguacugcaccacugcacugucuaaaguacugcaccacugucuagaguacugcaccgcugcacugucuagaguacugcaccacugcacugucuagaguacugcaccacugcacugucuaaaguacugcaccacugucuagaguacuucuuccaguccucgacuuuauuaaggggcccuuguguugcuugccagcucagcuuugauuggcaucacaaucaggaaaagcaacagaaacauaaaaaagcaaagcuuaugcacuguagucuagcauuugcagacagagguagggggaauuccagagcccaugugacuugauagaagugagaaucuuccugagacacugacuguagauagcgucugccuucaguauuaaggagauaauuguaaagggcuuucuaaggcagugaacaaacauguacauuccauuggugucccgcauaaggcagaacuguaagcuuuaguucuuuguaguccagagaauuauuggaaaaggaacucaaaagaauaaauaucuuacuuauugugggccaagaagaaacauguuauuuuaaaaauuaaauagagauaauauuuguucaguucguccuacuuauauuauguugugugugagggaugcauguauguauguauguguuugaguguuuguggaacacauuuuuguggguacguauguauuuggguggauguguacagagccuggggguugauguugggugucuuucugauuugugcccuacuuuauuuacuaaggcagggucucugacugaaccuaggacucacacauucagcuuaucuagcuagccagcuuguuuuuggggucccaucucucccacagugcugagguuacagauggaucuccaugccugccuaccuggccuucccguggguagcucuggggauuugaaccccaggccucccucuugcaugggaagcacuuucuuuauccacugagccacuuccuggccccucugguuucuuuccugauacgugacccuugguguuccugcuccgcgugcccaauguuauagaaaucaucuugucauuaucagaauggagggaggaggggaggaugaaagaugaagacccaguaaggcagugucuuugcucauugcaguaggugcucaggaggggaggauguguggagaauauagaagccagucuuuuguuuguuuuguuuuguuuuuguuuuuguuuuuugaggcaggguuucucuguauaacccugguuguccuggaacucacuuuguagaccaggcuggccuggaacucagaaauccgccugccucugccucccaagugcugggauuaaaggcgugcaccaccaugcccggcuagaagacagucuuaaccuagccuaggaaugucaagauuuaugugggcaguaaagcccaggaagagcaagcuuugcuaagugugcucucccugccuuugugugugcuuucaguauuucaagggaacuauaggauuacagccuggagacucagcgcucuucaucaauggacuucauaucgauuuagacacccaggauauauucagguuuggaaaauauuucuauucucucccugcccccucccucccuccuuccuccuuuuucucuccuccccccucccucccucuucucuccccucccuuccuuagguuuuauaacugacgugcucagguucauguuucugcucagcguggcaugagggaaggcucauagcucaugaugcucgcuggagcugggcucaugcucugauggggugugcagcaugaaucuuccugucuuguggaucagggcaugugcaaggcuugaguguuuuuaaggauauaucuuuggaguuguaguuaucugaugugaaccucuauucuucacccacauaugcaugcauuugcaaacauguaaacuacauauguacacauacauguacugcauacaauaugaaguauaaauaaacaaaggccugugaaauauuucagcaguugacaucacaugacaucuggcaugcaagccugacagccugaguucaguuccuggaacccacauauagguggaaggggagaacugcauccacgcacaugcagacgcacucuuuuuuuuaaagauuuauuuauuuauucuauguauaugaguacacuguaacugaacagaucguugugagccuucaugugguuguugggaauugaauuucaggaucucugcucucucugaucaacccugcuugcuaagucccugcucauuucaucccaaagauuuuauuuauuauuauacauaaguacacuguagcuguuuucagacaugccagaagagcaucagaucucauuaugggugauugugagccaccaugugauugcugggauuugaacucaggaccuuuguaagagcagucagugcucuuacccacugagccaucucaccagucccgcagacauacucuuacacauccuacacaaaguacaugcaauauuuaguaaauaaguauauuuacuaaaacacaaaacgugguguagggcuaggagauggcuuagucagagaaaugcuuaggccugcgauccuacuuaauaaagucuaggcuuugugguauacaucuguaauucugcugcuggggcagugagacagggauccauggggcauucugaccagcuaguauugauggaucaguaaacuccagggucagugagagacucugccucagaaaauaagguggagagcaaugaagauccugucacugaccgcuggccuccaugcucacacacagggguacaugugaacacgugcaugggcacacacuccuccacucacauaccaugcaguauaaacugagggcuauuucauuacucauacagagguaaucuaaguuuauacugagagaugcucugcauguccacugaggauuuaaaugagcaggaccaggaaagcacaugaagccacugaccugcagccucuggccagaugaaaugagggaagaagaacuccguguguguguguguguguguguguguguguguguguguguguugacuguugugaauugaauccauggcuucauaugcuaggcaaaugcucuacucuugacaagaaaccuugcuuuuccugcagucuauuugauacauugaggaaugaagcccguguaauggagggucugcacaggcugggaauagaaggccuuucucuacauaauauuuugaagcugaacauccagcccucugagacugacuacgcaguagacaucaggaguccugcuauuuccgugaguauucauucugaguggucaugaggcauucuggucaggcacuuuacagcuuuuuaauuuguguuuuaucaaagauuuacaagugcuuauuaugugagacuguaucucugcaauaagaugggcaugcgcuuuccugacugucugucuguaugucugucugucugucuuucucuggguuuaaaggcaugcacuaccacucugggcagaagauagguuuucacaugcccucagaaguugucuuccaaccauugugaggaagaagcauucuuuccagggcuggagagacgcucaguaguuaaaccauacacugcucuagcagagacccugaguucagcucccagcaucugcaucugggguuuuacagucaccugugacuucaggucugggaugaucagauaacuaaccccaggcuggcccucaugugcacauacccacacgaaaagucaaauaauuaaaaaaccaugaaaauaaauuuuaaaaaaaaagaagaaaagcauucucugucuuguguauucauaggauuuacaugaauaucuugggaagaguauguacuuucccaauugugacucaguuuucugugacucugugacaacaugcauacuuuaaaccuauuaguacagcauauauuuccaguuaguagccuuauuuaaaaggaccuuauuaucugcugugugaucucgaugucaucgguaaaaagaacguggggauaguggugccuugucucccuccuuggcuucuguuugcauuuauucuggaggcauuuuauuaaaagaaaggugcuaugcugugcaucagacaugcccauccuacagccuuucagccgcauguaucccaggacagccaccgcugcagcccaguguaugcguagauguuagcacuugggcugcauauggguaagguccuugucugcauucugucuuggugauagaaccauugcguagucugaugcacacauaccguuugauuugugacuaaaagguuuugcuuauaaaggauaaggaaaauaacauacuauggagaucagugaccacaugacugaucgccauucuuauggaccacucucuguguaaucauugcuguuucuguugaagcucucucucucugugcuccuuccuaguuaccuccuccccuucaggcagccuccuccagaggcugggguguguuccucugucucuaauuguauaucuuuauugcuuuuuaaggguuuuuaaaguauuuuugacagucuggugcuucugugggugucucauuccauaaccccaauuuuauuuuuguaaccacgcguagggucuguucuccacacucucuuuauagaugccaagggcccagcauguagcaaguaauacuuaaagucuucuuaaaucaggcaauuaagaacauuuuaauggugguuuucaauuauucauauugcuggguguggaagcccacaccuuuaaucacagcacucaagaggcagaggcaaguagaucucugugaguuugaagccauccugaccugcauagugaguuccaggcaaagcuacauagugagacccugucuuaaaaaauaaaguaagcaaucaaauucgcauggguagguaauguuuuuacuugacaagccuucucuguaaggacugagugaggauggcaucaucagcgcuggagcauucgguggucugcgaggucuucagcuguguuagguuaacuagacacugacauuguaggagcauuccugcuccuuggguuuuuaacauuuuacuuauuuuuuuaaaaaaaagcaucauucagggggcugaagagauggcuuagugauuaagagcacugacugcucuuccagaggucuugaguucaauucccagcaaccacgugguggcucacaaccaucuguagugggauccgaugcccucuucuggugugucugaagacagcuacaguguacucacauagauaaagucaauaaaucuuuuucaaaaacaaaaaacaucacucauacuuuuacagaugaaaauugaaguuauacagugguguuuuagguaugauuucuauucugagaugaaacaccaugacuaaaagcaagcuagggagaaaaggguuuauuuggcuuauguuuccauaacauugucacugaaggaagucaggacaggaacucaaacaggacaggaaccuggaggcaggagcugaugcagaggccauggaggcaugcugcuuacuggcuugcucucccuggcuugcucagccucucuuauagaacccaggaccaccagcccaaggauggccacaccuacaaugggaugaacccuuccccacuggucacuaauuaagaaaaugccuacagcuggaucuaguggaggcauuuucucaauugagguuccuuccuuucagauaacucuagcuuguaucaaguugaccuaaaacuagccagcacaggaggcauaugguaauagucuccucaccagccaucuuuccucucagaguggugagcaggauuccuguguguccuuccagagcccucugcucacauaagcaggagcaugucuugauuuucccugcucucccucauccacacgacaggugcuuauugucucugugccuucuuuucugccuuccugcuguuggagauucuuccauguugggucucugugaccugucuuccugcacacaugugagaggucgguugggauggaugccuggauguggaguacuuagugguucuaguuagggcuuaaugaguauugcagacaccacuguggcuggagggcuccugugugcucuguauuuuugcccagucuuaggcauugacgaacuguuaacuuuuuccauuuccaauuuaaugaauguguaguuuccuuguguaucuguuuacauuucacaaauguaguugugaaauguguaguuguaugucuuguguuuccuggcugcuuaugauuccuauauagacuuacuaugcuuauuccugucuaauuuccuguggauuuccuuauuuuuuuaaguuguauuuguugcuaauggucuuuaguugcuuguguugauugcagcuaagcuccccuaguucuugaccgugcuauaguuacucauuuuucuauuccaccuuuguguauuugagaacagucucgccuugugugcguguguguuuucuggacacaaggucuuguauagcuaguguuggcaucagucucaguguggucaugacagaugguuggauacccgauucuccugucucugccucccaaguguggcauuaaaggccugugccaccaugcccaugacugugugauucuuagucucauuaguuaccguuuuucaucagugacuaauguguauguauuauguuguguguuuuguuuuuguuuuuuaucauucaagugggucaacaaccuagaggucgauagccgauauaacucauggccuucaagcuuacaggaguuacuccgccccacguuuccuggugucauacggcagaucagaaagaaccugcauaacaugguaaguagggcgcuugcugcuguccuguagcacugaccgguaguuggcuuccaguagccgccauucugugacugucgcuccccacagcccucucucuuccaucacaaguagcauguugacauuucucccuaucugugcacagaguucaagcacaaagggcuuuggaauguguucauguuucagcaccgugacagcgaagcucccaggcgaggauuacagauaugcagcaccaagccugguuuauguagugcuggagauugaauccagagcgucuuguguacuuggugaacauuucaccagaugagucacagcccaguccugagcgacuucauuaugugagagaacguauacaagcuggguagcauauagugaugauuuaauacgugaucacuauugcuccgacuuaagagaugaguucuaaauugacuguuaauucagggagccuuaggaacaaacacaacuaaaaggcaggcuccgugucccacggugggagaccugaugacacagacauuuguugguuauuguagaacaggcaucagcaguugggaacaccagugaaauccaugagaggaaacaucacaucucuucccaccaccacggucuuugcauguuguggguggcagcugcuguuuuuauuuauaacccccuuauuugugguucagugguauuuugagaaagauuagcuucaugugugacgauuccugucauuuuucuuggcccaggaauacuugaaugucauuucauggguucuuuuuccuuuuccucugacagguuuucauuaucgauccuguacacgagaccacagccgaguugauuagcaucgccgagauguuccucagcaaucacauaccgcuaagguaacacugcacucauuagccaagcguugccuuguugcuuggauuacaugucugguuccauugaauuguauaauuaauagucagacucacuaaugcaguuuuaucgucuucgugguaagacgccuaugccuuuugggacugagaauuuaauuccaaacacauagaagcuuaccgccauugaauuauuaacagcuggcugugugaaaauaguucauggucuucacuugcuuccuauuggaagggggcauuucuagauacgugcccacauagccaggccagcucuaauuucagcagguagugcuuugcuaggggcuuuuguuagguuuucaagaacuaaaugcuuuagaauguuaaguagccuucuguagauacagacagauacaucuacguuaguuguauuggcaggucuacucacugggcaccagguagcuagguuucccuguucauuucauagacaauaauauaugauaauauauauaaauauauauaauauauaaaacaauaguacauauacagggcucuggaaggccuauacaaacuaggcuggccuugaacucagagauccacuugccucugccucccaagagcugggcucaaaugggugugccucuauaccagcuaagacgugaguuuguaaaaaugaagggguuggagagauggcucagugguuaauagcaccugcuacucuuccagaggaucugaguucaagucccagcacucaugucaggugucucucuucugccugaacuccagcaggaggccggguagaaauccccacucccuggucuggcauccaccaccacauauacaugacauaggcucauaagacacaugcauaugacuggauaaauaaaaaauaagggucuguuuuaaaaagugaagaaacuaaaggacaaaagagcuccuaguaagcaaacauugcucaguguucacugcucagcccucacugaguugugcucggcuuguaugaacgcucuguccucuuuguugucucuuggaacagcuuuugcaaaacuuuaauggcuguaagaauguguuugaccgagugcuuuaggaaacugggagcucuguggggaggacccagguuucccaggggcuuugaagaaaaggauuaucaagaucagaaaaagcagagcugauugagugcugugaaaucuucauuuaaacacagcaugccaucuguauuuaaacacaucuuuuaacacaacuuuccccaucugcuguguuuaaagggaaucugagaacaugugagcugguucacaguacacaguggacacuaacuaaacuuuuguguuguacugagggccaggaagauugcagacguagggaaagaaggcaccugagcugcgcauugaaggggagccuagaagauaggcuggcauuucacucuuggugagggcgaucugacccugccccguggaaagcaggaaggaagcuaaggcagagacuguaggaaugcuucuuacucgugugcuuuuuguggcuugcucagcuugcuuuuuuauauuagcuagcccauuugccuagugauaaaccacccacagugggaugggccuuucugaaucaaucaacaaucaagaaaagucauacaagucugucuacaguccagccuggcaggcaguuccucacuugaggcucccucuuucuuguaucacaucaacaaccaagauuagccaugucuuacacauagguauacucuuaugccccucuaccccuguguguguguguguguguguguguguguguguuauauaaucacacaaugaaauauuacccaaugauuaaaagaaauuaggagacuggguuugguuacacauguuuuuucuuucaguauuugggagguagaagcagguggaacucuugaguuugaagccagcuggucuacagagugaguuccaggacagccaggguauucaguuagacacuggcucaaagucaacaacaaugaaaaccaaagccccacuagcugugucugcugacaccggauuagauucccagcacucggaaggcacaggaagcagaauccugaguuugagaccagccuggacuuuacaauguggucaguguagguuacccauauucugucucaaagaaaccugauaaauaaauaaaaacuaagucauguuaauuagggcuggcaagauggcucagcggguaagagcacugacugcucuucugaagauccugaguucaaaucccagcaaccacaugguggcucacaaccaucuguagagcuacaguguacucauauacauaaaauagauaaguaaaucuuuaaaaaaaggucauguugauuaaauagcuagggcucagugguagagcauuugauuuacaugagugagacucuaggcuuaccaaaucuauguugauugauacagugucauuaaguaagcuaucauagauugugguucauuguugcuguggcucauguuacagugcaguaucaacuauuuacauuauaguguccaccaaauaaaacucuccucugccuccuguuugcccuucccgccauuaacuugaaccuucggacacuacugacuguuaacuaugauuauagguuuuuauccuuuucaggaugucauauaauugcagcuguauacuauguagcacuuuaggaggacuuguuucaguuagcaaugugauaccuagguuauuaaguugugagaguugacacauaauaaguccaucuaucccugcauccauccauguaaucuaggcugguuuagaacuccugacucuccugccucagcuuccuagauauagagauuauaguugugugccacuacugcagccuccuaauuucuuuucaucaauagguaauauuucacuaugugauuauacugcagauuguuuacccuucaccuaugaaggacauuguuuuagucuacuuccuguugcugugauuaaacagcauggcagaagcaacuugggcagaaaggaguugauuucaugucacaguucccaguccaucaugaaacugaagucagggcaggaacuccaggcagguaccuggaggcggggacugagaaaagccauggaggaauuuuuucuggcuugcuccuggagucuugcucagcuugcuuucuuauacacccaggaugacccaccaagggguggugcugccuaggcugggcccuucauaucagucaaaaaucaaggcugugcucacaggacagucugauggagcuacuucuucaacugagauucucuucccaggucuaacuagauuucuggcaaggugacaaaaacuuacuggccuaccugauguuuagcuuaacacacaaauaugucacuauuaagucaaaaccuucccuuuuuuguccccaagaucucauguuaauauuaauauuacagcacagucuaacuuuuaaaaauuccagucuuugaaaauucuguuauuuaaaaauucagucuugguauuuucuaugccguguguguguguguguguguguaugugugugugugugugugugcgugcgugcaugcuuauccugaagcuuauacauguccaguacagauguuugugugggcaaaguucuguugacaagauuuguagauugugugaugaguauaugcuugguuuguaaggaguagccacagugacucacaggguguugaaccauuuugcuucuucacugacagugacuuggggaccccuguuccuugucagcagcacuugguuucuucugccauccuguagaugugcagccacaggucaugugcaacucaugauucuaaaauggcauagggucuuagcauuuuauuuugugagugucuauccagaaauugucuauauggaccuuuugaaacaggaccuugcuguguagcccaggcuaccuaaaacucaauauguagccugggguagccucaaacacacuguccugccucaguacucccaagugcugggaguauaagugugugcuacccuucccagcgucuucagcccguuuaaaacccuuguuguuagauggauacugaguuuuaagagucauuguuauaucucucagauggguguuuuucacuagccugccauuuucccuuuccuucauugguagucuccucuccccccucccucaaagcagguauuucuuggguuuuuucaagauaggguaucucuauauagcucugcuugucuuggaacuauguguagaucaggcuggccaagaacucacagagauccaccugccucugcucagugaacaucuucauacuaaccugucugugugauauaagacaauuguuuuucauuuugcuuuccauuuauuauuguuauuauuauuuguuuauguauuuauuuuugguuuuucaaaguaggauuugccuuaguuugguuuuauugcuaugaagagacaccaugaccaaggcaagucuuauaauaaaggacaauauuuaauuggggcuggcuuacaguuucagagguucaguuuauuaucauggugggaagcauggcaguaggcagacauggggcuggaggagugagaguucuacauguugauuuaaaagcagccaggagacuuacuuucuucauugggcagagcagaguauauaugaaacccuaaagccccgccuccacagugacacacuuccuucaacaaggccacaucuccaauaaggccauaccucuuaauagugcuauucccuauguccaagcauucaaauauauaagucugugggggccaaaucuauucaaacuauugcaggguuucucuguguaauagcuuuggcuguccuggaacucacuuuguagaucaggcuuacuuugaacucacaaaaacccaccugcuucugucuccugaaugcugggguuaaaggugugcagcaccauuccuggcugccuuuuguauugcuuuaguuauaguucacuuuucuucaguugcuagguuuuguuuuguuuuguuuuucgagacaggguuucucuguauagcccugacuguccuggaacucacuuuguagaucaggcuggccucgaacucagaaauccgucugccucugccucccgaguccugggauuaaagaaacucccgugccugccaccaugcccggcaguuucuagguuuuuaaaaugaauuuauuuauucucagugugauugugccugcuugucuuuaugugcaccaccuaugcacaauauguacaaaggcuggaguuggacaucacaugcccuaaaacuggaguuagaggugcugcugagccaucguuguggaugcugggaauagaucccaggugcucugcaagagcaggaagcacuccuaauaauuaguugagaucuuucuccagcccuccaauuuaaaagcagagcagaauuacuaccuacaauagugguauucuuuguguuaguaaagaaaucuauucaggauucugaaacagacauaaacuguggaaaagccuaaccuguccugugaccugacucuuguguucuguaaacaaagcauguguacuguugcugguccugcuuagagugggaagugagcugugcuucuugguuggggauggacacuggggcucugcccaccucaagcggguugccuuauaagaugccccuuuuucugcuccccucugcaggauugguuuuaucuuuguggucaaugacucugaagauguugaugggaugcaagaugcuggagucgcuguucugagagcguauaauuauguggcucaggaaguggauggcuaucacgccuuccagacucucacacagguauguuuuuaccccaaauggcaaaugcuuaguuuaacugacucugguuugugguaggagaagaaguagauucucauauauacucuggugcuuuauacuucaggguuccuuaugcuuuauugugucacuggugagaauguauagauugcuaugguuuucuuuuucuuuuguaugcuuggaauuuauuauuauguggggcuuggcggagucagggguguggaggcugcaguacuggugggagguugaguacaaccuucagaauggguccucgccuucugucacaggaucuagggaucaagcuugcugagccuuaaugcuggccguuagaugcuguucuuuaggggccuucugggauauuauagaaugcccucugcuuauaugaaaucaccacuuaaugccuuugggcaaugugauguucucuccuuguuuuuaaaacuacccagucuuuucucuuuugagacuaucuuaugcuuucuuuucucccuucccccucuucuucuucucuuuuuuuuuuaauaaagauuuauuuauuuauuuuauguaugugaguauacuguagcuguauuuagacacaccagaagagggcauuggaucucauuacaggugguugugagccaccaugugguuguugggaauugaacucaggaccucuggaagagcaauuggugcucuuaacuacugagccaucucucuagcccccaccuucccccucuucuuuucuuccucucucucuuuugaagacagucagucuucuauagccagggcuaaccuugagcucuugacucuccugucuucucuccagggcuggccugucaggugugcagcaccacaccugcuugcuugguuuuuuguuuuuuccuuuugagauaauaaggucuuucuguaucugugccagcugucucagacauguucuaguacaccuggcuucuauucuuaaacauuguuagccccugcacuuaggguccaaaguguuuaugaacugaugggaccauuucaagaaaucuuuaguuccugcaaucagguggaguggcaucucugaguucaaggucaguuucaucuauauagcauguuccaggcgagccagggcuucauggugagacacugucaugaaaaaggaaggaaggagggaagggagagaggaaggaaggaagguagguagguuggucggucuucaguuucuaauuauaggcaucuugugagagauauugaaaugguaauguugcuaagaaguuuccauuugacuuuuaagaaaaguggucuuauuuuucuaauguguuuagagauuucaucacauuuuaaauguggauuugaaggugugguugguucccugcuuuucuuuccuuagaucuauaacaaggugaggacuggagagacagugaaaguggagcacguggucagugucuuggagaagaaguacccguacguggaagugaauagcauucugggaauugauucugcuuacgaucagaaucggaagguaacauguucuuuggaacuucuuauagccgugguauuguuaacuugacugcagccucagacucuccuucuugggcuauguggugucuauacugggguguugaugcgacagaccacuuuuuaaucuuggagacaggaugucacugugcagcccuuggcuggccuugagcuggcagagaugagcugccucuaccuuguguaugcugggauuaaaggcaagcugcuaccacaccuggccucacuugucagucuuuggaaagugagucuauuucagaaaauaguacuuaacaacuuguauguuaacuuuaaaucagaaaacaauuacuuuucauaaauuauaauugugcuuguauaauguguguucuggauaaaaccuauuggaaguauagagccaggaggugguacagggaaucauauguauuguaguaauuuuacaucauugcucagccuccagauggguauguucuaagaaauguaauaacuagccggauguggugaacgccuucaaucccagcacuuggaggccaaggcagaagagaagccuucaacuuuuugugaggugacagaaacccaaguacuuugugaccaguuaguacauauuuacauaccuauaaugaaaaagacauuuauuuuuacaucgugagaggcguuagaaaacacuuugcuguauuuuggcuuuagaaaacaguaauuauaacuacaaaaggucuuggagguuggcaagcacuacaagacucaguucccuuuagcagccugccuggugugggaagagucucucugcacaccgcuggucacugaugccuaagaggcccauuucauucagcccuuggaguuuauuuucuuuuuuaacugcuacuguguuacaguucucuggggaccccuuugccuucuugacuugacuccgcuggcugucaguaagcucucuauuguaaagaggaauguacuuucaacaauugcaaauauauuuuagaagccuggagggaccuuccucacauauagauaaacauguacacacuccauagucuguaaaguuuuugcuucuuagaauuuagucauuuaauuccacacuuaucaaguaagguauuaacuaugauaccacuuucuuaagaauuaacguacaaaguagaaggcuucccuaccacuuaaaaaaauaagaaauagcuuuagucauuucuuuuuguuauguuucuguuuuuuguuggugguggcuuuuuaaaauaauauuuauuuguuguguguauauuggugaguacauguguuccgugugugugccggggucccugcgcuaacagaggggucugacgcacaggagcugcaguucuagguagugagccaccgugugagccaccgugugagccaccgugugagcgugugcuggggacagaagaggggcucugcaggaccagcgagugcgccuaaugacugaguugucucucuagcccuucuuuuguucuuuuuuaaaguucauuuuucuuucuuaguauugugcgcauauggacguuagaugacaacuuuguagugacuguuacaugaguucuggagaucaaauucaaucugugggcuuacaccaaaagugucuuuaccuacuaaguuaucuuaaucacccugcuaauuuuauuuuuuuuaaaucuaagauggcauguaagaauauauguuuuuguucuaugugugucaugagggggaaaugugugcucucucuuuuucuuguccuuuguuuucuaggaagcaagaggcuacuaugagcagacuggaguaggcccccugccuguuguccuguucaauggaaugcccuuugaaaaggagcaguuagacccggaugagcuggaaaccaucacaaugcacaagaucuuggagacaaccaccuucuuccaaagagcuguguacuuggugagugauauucucacaugagcuuugaaagccaguggcuuaugcuagcuuauguagcaggcaguaaaauucuguaugaugacaaggguuuauuucauucaugucuuuacuugccgugcugggaauggaacucagggccucaugcacacuaguuuaguuaagucuaccacugauaccccccaugcucuagguuaacuucuugagaugugugagcugaugauucugacaacauacauagucaucaccaucaccucugauuacauaugacaucaccagugccagaaggagccacagcacauuuugucccucucuuugccacuggcauuugacuugcuacaucugugggcuuucucuuccgaccguuucuguagauggaagugcaggggucugacugcuccuagauugcuacgaugcuccuucacauuccaguccuccaucucaaacccgaguuacuguguuagcguaaacuaagacuggcugugcauuuccuuauguuuggugugaucugagaggccacugaguagcaaggaugcuucugucacugccugagaguuacaucccagguucuagggacuaaaaucacccagauuauuugcuaucuacuauccucuuucuuagggagggcuggacggacacauacacacacacacacacacacacacacacacacacacacacgauugaaugagagagagaaaaagacccucauaggaugcauuucuuaguuaaauaauuuacuagggcaugguuauacuacuuuuaauucuaucacuuaggaggcagagucauaugcaggcagaugaguuugggaauagccugguccacauagugacuuucaggcuaguugggguuauauaguaagacccaauaucuguccguccaucuguccguccauccacccauccauccauccauccauccauguaucuauauacauacaugcagguggugguggcccacaccuuuggucccagcacucgggaggcagagccagacagaucucugaguuugaagccaaccugguguacagagagaguugcaguacagccagggcuacacagagaaacccuguaucaaagaaaaaagaggaggggaaaaaacccacaaaaacaaaagucaaaaucuuacuugaaguaucuuuguguucauugucuguuuguuuuuauccugucagcuaacaucugcuaaugaacccuucggggacugugucaguuauuauguguauuuucuuuccuugccuccuuucuuuccuccuugacugcccaccuauaccuccaucaaucauuuuauguguaugugugcacauguuugugugcaugcaugugugugugcacacuguauguguguacauguguguguguuuauagagcuuuuuuguuagguuaggcugggcuccacuugccagucuucagccucagucuucugaggaccacuagaucugcuuuuuuuguuuguuuguuugagaccaggucucuacauguacuccagacuguguuugaacuggcaauccuccucuucugcugccagagaguaauaggauuauaggugugugccaccagcuauuuuuaacuccaauuuuuuaauugguucuuuuacuuauuuuauguuuuuauugacuguauuuauuuggcaaucuugaguuuuacacuucguucauggccauggcugcugcugcuguuggaguauacuaauacagauuauguaaguucuuuguguuuuaggucuacuguuuggguuuuuccaagcaugguauauauuggccacuuggauuuuguugauauuuugauuuuguguguauuuuuuuucuuugauuguuguaguauuuuucuuguucuaauuggacaugucagcuauaauaacucuuugaaucugagucuucacccuaugagggagacguucauucuugugcuguucguuguuguuacagcuguugcuugguuuauaaugacuuucuuaaauagauucuuuguugugugugaacucugccaauaucuacuuagcauauuaauuugcuaguaagugaacauauuuuucacuuauuaggugaaaauuagauggaaaauauuuccccaaguaucucaguugguucacauugggacgugacuugaauccucagcugaucuuaaccgccuuuugugucuguguuuggugguagggguugaauccugggccuuguguaugcuaaggaaacacucacucugccacaccccagcggcagccuucaguuacugcuugucuagauuaguuaucagagucgagggcucccuguggguuuuccuggccauuugugguccccuggauaucgugcuugagaucuggagaacaucagaaaauggaacuucccuuuuuccaacuguuuauuugaccagcuucauuuuagcccaucugauguguaauaauuucuccuaauuguguuugcaaauaucccagggaaaagcuacugagacauuacucagcucaaauaaagagaacccugggauuucccagaaccuauguaaagguggaaaaagagaaaugacuccacacaguggcuggccuccaccacuccacaccaugggaaagcuggccuggcugucuuguuccgagccuccuggcaccccaguguuucaauagaguuagaggcacuguguguguccauccauacucugcuuguuccugggcucacaugaacaucuguccuugacuguuaacaucuagccagcuguuacaaagcuacuaacuuucuauuucuagugaauuucauugcugauacuccuuaaacacuucugccccuuuucuuuuuucauacagggugagcugucccaugaucaagaugugguagaguacaucaugaaucagccaaauguuguuccaagaaucaacucuaggauucugacagcuaagcgagaguaucuggaccuaacagcaagcaguaaggaacauuucaguagcaacucuuggcuuuuggauuugugcuucacauucuuaaauuuauuagauuauaauauuaagaagauagcucaaaauuauggccuguccuucuaaacucacaagcauuuccuucuagaaaagauaaaucugggggcugaagagauggcucgguggugagaaguccuuguugcuuuugcagaguacuuggauaugggguccagcucccucucuggucuccagaagcaccagacucaaacauacauacaugcagucaaaccacucauacacauaaaauacacauaaaauacacauaaaauaaaaaucuuaaaauggcagucuagcuggguacaguauaugauggucuguccccagugggaaggcugcagcugugcagguggcuguaggagcuagagccugggugacacucucaggaguuuaagguggggugggaggcugccggaggagcaguguaauggcugugauggccagcaugggcuugugacgcuugcugagauggagaucugggugcuggagacuacuuacagagccaugagaauuuaauuccucauugaccuucaauucaguuccaaggacuucaacgauacuuuugccuuuccaacauuuuagucugucaaaauucccauaaaacagccccucacucagcaaagucucuuaacuuuaacuucucccugucacaugugagcuuagcucggagggcagcuuugauggaagucuccagcccuggagccacccagcucaacugcuucacacuuaacacaggauaaauucccuguacaagaaacaacucccguagccgggcgugguggcgcgugccuuuaaucccagcacuugggaggcagaggcaggcggauuucugaguuccaggccagccuggucuacaaagugaguuccaggacauccagggcuacacagagaaacccugucucaaaaaaccaaaaaaaaaaaaaaaaaaaaaagaaaaagaaacgacucccaugugaugacacaagaaagaauggcccgggcacaggagaaucccauugucagagcacaagcaccaccaaccgucuggacuguaugcagggaaauugcucaagccgucucagaugccgugcccaagaggaaaugucagucccaugaggccugcaaauacaguucaaaagauacaaacuuguuggcaacagugcuucuccucgcuguuuagggacagggucacucaccuacuggagcuaaaggcuuacaacaaagccgagcugcuugcucagcuuuggaaaaauggugucaaucgcaaacccagcuccuuuggagcaguucugcaacagguggcugcucugcguccuaaggcccuccuccccuugccuucaagggucauguguuuaaggagauucagugaaacugaccaggaugcagccagccagccagacagacagacagacagacagucagucauugagcugaugcccuguagaaagcuuagagcucuggcacaagccuuucagaaucuccuguaugcuccagcagagaugcugcugcgccuucuccuggaaaugcguccuugcauucagauuucauugaugauuuauugaacuagaaagcuugacuaucucacuugacaaaagagucccaccaacauuaaguggccauuugaaucccaccagugaaaaaucuuugcaggcuuccacucuucccugcagcugcugccguccccacgcaccugacccaggccuucagucccccugccugccucagauccgccugagacuauacaguacagcuccuguuccccaagcacuccagacggucagggcacaagaccuuccgguugacaguuuuagucaaaguggcagcaucuuugagggccagcgagacgaccucuaggacuugucuggaaccugccguuguuaauuaucugucaguuucaguuuuuccuguuuucccaccagauaauuuuuauguggaugacuuugccagauuuucugccuuggacucucggggcaagacggcugcuauugccaacaguaugaacuaucugacgaaaaaagguaacccacuugggcuugauuuggucccucauguuuauucuuuauuuaguauuuacaaauaaacuccaucugcaacuguaggaaaaaaaacauuuaaaauauaauucuguauaugucucuaaaaauucaacuauuuucuuuaaauuuuaugcuuaucauuaaaauugauaggaaaagcccuucaugauucaaaauggagaacauuauaucaaaaugguuuugccugacuucaguaucauccuagguuuacuuuuauuguagaacuuagaaacuggauucuagaaagccucgugugacucguuagagugauuuuaugcaguuacuuaguuaagcuacccuuguccacagucacugcuuucaucugcagcagguccuucccuagaggguagggggugguugacaauuaguauccguccagagugguucuagcaaagcuugcugcucuccaaagcaccgguugucauuaagagagauaauuuuguccagcuguggucuuccuucagagccuuugguuuccugaggacuuauaagcuuaugcaauuaguccacugugcuucucaaagauuuugucuccgagggguucuagagcagcuugaacauggcgggagccagagcaggaaguagcacaguccuccaucugccuugauugcuaaguguacaaaugaccuucucuucucuucugcuuuuuuuuucuuuuuuuuuuuuugccuuuguccaggaauguccuccaaggaaaucuaugguaacucacaacuccagaauguucccuucauuuucauaauuaauuuauaugguuucaggaccacuguuauucagaauguauugacauuccuuguguuguuucugaaaccuguggguaacaguagauaaacaaugugaauguuugcagacccuucggaaaguuguaaacuaacgcgauuggagacugcauugcguugcccacauguuucauuguauaugcuaacagaucgcagggcaguuaaucaaugcaugcuccuaguuucucacugagccacuuggaaggucccucugcuucauguuaguagagacauuuugcuauuuuuuguuuucugucucuaucguuucucuuugugcauguuuuucagaaauccucuggccugauuuuaauguuucgacauagacuaucuuucuuugcuucuagugaguuuguuguccuuguuucucuacagaugauucuuuuauuagaccagugacuuuuuggauuguuggagauuuugauagcccuucugggcggcagcuacuauaugaugccauuaaacaucaggcaagugucucagauuucauucugggggggggggggggauuguggagcgccugagcaccccugugcuagugugguuauuuuaguguuucuaguauuucuuugugugcugaggaaaaggaacauaggaaaaggagucuucagagggugucagcuccuaagaaaaggcgucuaagccuggagagcccagccccacuugaggggaauagauccuuuaagagcaaauauaaucaaauccugaauguagaauuuucugcaugacugcauguuccugcugcagggaucuugccauguacugugacaugaagagaggcucacacgugagacugagccacccuauagcuccagaucucuguuucuucucuuauacaugcuugcuugcauacguacauacuuacauacauacauauauaaauauauacacauauuuauuuauuuauuuaugggaaaagacauauacaugguacggugcauauauggagaucagaacacaucuuagggaaaguacuucccuuccacccuaugggucauagggauugaacucaggucucaauugguagcaagcagugccuuuacuggcugagccaucucacuguccagcuuauauucucaauauaaguccuccaucuucuucucuguagagucuguuuuguuagauaguuggccuuuacccaggcauugcugccugccggcauguagaaagaccaugugaaugaagguggaugcacaggaacccgaagaaaagauggaauacagaguauuaaaugugcugaggaaagacuaacucuuguuagucucuggugucugcuguauuuuauagaaugaagcuggaaaggaaggcuggggccaguuuauacaggauuuagcagaguugaccauauauaucaucugaauuuuauuuugaauacagacaacuacugaagauguuuagaagagacauuacuauuauggaacauaacuaauguaaauucgcucugguuguguagcccaggcuggccuugaccuuucagccaucugccugccucugccuccugagugcuaagaugaaggugugcaccagcaugccuggucaguguuaccuuuaagguucauaccauauagcauauaacucuuaucuccccuguuuuaaauagaaaaccaguaacaauguuaggauaaguaugaucaacaaucccagccaagagaucagugacucaagcacccccaucuucagagccaucugggcagcucugcaaacacaggccuccagcucugcuaagaacuucaucaccaagauggccaaagaggagacggcagaggcccuggccgcaggaguggacauugcggaauucucugucgggguaaggcucgcagguuccgaggcuagccuggucauucacguuucuccccugggcugguagauccucuucaugauuggguuucuaauagcuucugcgucucaggguauuuuuguuguuguugaauuagagucuuaguaagaaauaauuuuguccuguuacaguuuacuuuuaaacuugcuuugguuucaguaugcccguuuaaaauguuuguuccauuuugucuacucuuuaaagacaauauuuaauguauuuguaaaguaaaaagcagguuuaagaugcaauggguuagaaagucagcuguuccuuuuuccauuauucauugguuuaauguuacuugauuuuugugcuuuuuauaguuugaaauuaucugauaaaaucacaaauauauugaguuuccguuagaggaaaugacugucacuucaaguuaacagauuuaaaaaugaaaaaaaaaaaguugcugagaguagacuggcagguaaacagauccgcagaaacacaggaaacgggaugagcaguuuaugaggagggaggaaaggcgagcaaaugaagaacuaagguguugcguuaaucgggggacuuagcucuuacucuuugcaaaagcacauugcaguuuacucguuguuagcacuuggucaugugguuugcuuaauaacagugacuuuccuuaaaaaugauuacuuccuagggcauggaugucagucuuuuuaaagaggucuuugagucuuccagaauggauuucauuuugucucaugcccuguacugcagggauguucugaagcugaagaagggacagcgaguggugaucagcaacggaagggugagcacuugcugggcugugagccugccuucacaggucucugccucucgggcgccuuugagccucccuugggcugcacuggagcugcccuucugauggcugaugaggccucucagugcagcugcaugggauccugccugacgcuuauuuguguuuagacacugggagauagugaauguggggcucucagaucaggagucaggauggcugcuuacagaguaggucucacugcuguuugcugagaaccgaugcagacaauacuguaucucaugucagccugcuuagaaaggaagguaucgggaaacacacaggcucuggguucugagggauuuuaaguaaacauuagccgcaucuccuuaggccuuauuuuucuucuuagucauuuuacuaaggauaugcuucagggcaggagucauaaggugcuugcuggcuuaggucccagccuggcagaggcuuuccggcagccggcgaccgcugcccugcagcucugcccucccccuucuuaccucacagaucauugggccucuggaggacaaugagcucuucaaccaagaugauuuccaccuccuggaaaauaucauccugaaaacaucgggacagaaaauaaagucucauauccaacagcuucgaguagaagaagacguguaaguuuuauaccuaguaacgaguuagauaauaagugauaaaacuggcguuccgauuagaagcuaguucaugucacaggguuuuuauuaauuuuucuucacuggucaaagugagggcuacauauuaucaguuauauguccacgucggugggguuauuucccguuuuacuuaauacugcucaugucacuuagguuucugaauuauuucuccacuucaaaucuggaaccguugagacagcugcagaagcagaaggcugagugcuuccugcuagaugcaguguagacacagucuggugcucugcugguucacagucuccuuguggugggggaggaaaugcacgccgagagcuucuucccucugucugucugucugucugucugucuaucugucugucugacaaaguugguucucuugugggggaugaugaguuggguguggcugacuuaugauuuucagcacuuuaguauugcuuaucaacugcugccuuggaauauguuucacuucuguguauuugcuacauaacaaaagccaugcuuaugugcugucguuucugcguuagaugucacacagauguguccuuuaggaugccuuguuuaauguuuaaggaccugcugugauguuguccacgguagcugcaacaucuccauucuuaccaacauggcuccuggguucagucucucuccucccaccagcccuucugguuugcagguuugcuuguuucugucuuuacacaguagccauccauccucacgugaguggaguggaaucuccuuacaguucaguggugccccagaggcuguucuuaugcacagcauuggccacugcaugucugugggaaauggcuauucuagucuuuucaucauuuuaaucagguuguugggguuuuuuguuuaauugugggcacuccuuauauucuggaugucagucccuugucagauacuugacaguguuuucccuauuaccuuaguuuccgauuuacucugugcaauaguacagaguauuuggacaauauaaaaaauucaaguucuuuuuuuccuuuauuuuugucucguguugucacacugcaucuuuuuguaauguguuaucuuugauagcugucacaguagcccuuuugcccugugauaucggaagauuugggggccauggcugguggugcuaugaauggcggaaccuauauccucaccacacuaggaaaguugucuaccacugagcugcuucucuagacugagagaacgcucuuuucauuugacucaaugcugaggacaagauaaaguggccuccucuuccuucagcagcucaugaguggugccccuuugccugccugugaaacauuuccaguguccccagggccacuguauuuggaguagucccccuguuccgguuguagcuuucuaaggcuuggcugcauacacuuugaucuuagugcuuggugauguacuggaaauugcuuguucugugugccacaaguauucacuguugauacugggaaguugaacagauagaugguuaacgaugggauuauuugguucaaagaggaaaugugcaaccuugguuguaguuaagucuagcacagcugcuuuugaauggcuuaccuggcaggccagugagauagucacugaguacagguaccugcugccaaaccugacaaccuuaguugacuccugggacccauauaguuggaagggagaauggacuuauggaguuguucucugaccucugcacacaugcaagagcccaugaacaugcauacaaauaaauguaauuaaauuuuuuaaauagaagggguagguaaaacagggaguguuguuucauuuuguuuuauuuaucuuucaucccuuguaguuugugguuccuggcccaucuguagugugucugguguguguguguguguguguguguguguguuuuugccuggccucuaucagucccuuugucugccuucccauaacaaaagaauuugcucuguauuuauuaagcaacacagaaaguauugcaugggaaagaaugagagcuucuuuacagaguuuuacaagggaagaaguauguuuccugacccaggguagaaaacuacaaccagguguuaucaaccuauagacacauguugcuuccaacaguuauggugcguacuuguaguauaagguugcuuccaaucuguuagguguuucagcaaacacacacacacacacacacacacacacaucuauuuauguaccuaccuuugggucaggggcgcagaaggguaaaguuauauauuagcuauauaaaaguugcuugcagaggaaauccaaggcaauuaagauuacacuguucuaccaggguguggcggugcacaccuuuaaucccagcacucggaggcagaggcagguggauuucugaguucgaggccagucuggucuacaaagugaguuccaggacagccagggcuacacagagaaacccugucuugaaaaacaaacaaacaaaaagauuacaucguucucuuaaaggcagguuaaacuuaaagggcugagugcacaguugaauggcagcguaggcaccucuucuuagaugaucucaagggguauuguuaacuuugcugugagguuugccaaaaguccagucuuggaggucaagagauaaaaacauaucacuacaguuuuuguuucuuccccugcuaggaacaaacccaaaaauacuagauaggcacucacaaauacuagacagcugcugucaaccccagcuuacagguuugucuuuuuuuuuuuuaauuggacacuguaauggugcuucugauauugaauucauaaccaacauagauguuggauggcugguuagauuaguggauuuugacgcagcaguccugagagcaaucgcauucuuuaagcuaggcccugagccgggugccagcaugguuggccaguacaguguguacaacagccuugcagaguaggccguuccuguccuucacccacagagaaaagugccaucccagagaugaucaagcuaaccacagaaucaugcccuuuggaacucaguucaugccucuuugaaaccgccuuguuagcaugaugcuauucuauguuuaggcugaugcuauucagcaaugguuagaaaaucugcagauaaaguaaugcuaaaauuucguaacuucaucuuuuagggccagugauuugguaaugaagguggaugcucuccugucagcacaacccaaaggagaggcgaggaucgaguaccaguucuuugaggauaaacacagguacaguuguugcugcacuaacgcacaguccugaacucuuaggcuuucauucuuugucucacagccuuuaccuucccagauaagguuucuauucacguuguuagaaaagugaaaugaaguuucauauauaaaacuacauuuugugagaguugguauuucuaaauaaaccugaaguaauuguauauauucccuuuuaaugaaaguagcauuuaaugaaauagaccagauauaauuuucugauauucaggaguaauuggauugcuugacuauaccacuuaaauacuuguuucuuguuuuuuuauuauuauuauuuaaaaaaacuacuguuuccaaagggaaaacuacauuuaagauaugaaaaugucuuugccucuuuauccuucaguuuuuuguuuugaaguuugaacacggaugaaguuggaaaacucacaaagaauaaccaugugucuguaacuauauucaccauuauuggagugccuccugucuguaaccuacaagucuauaggccagauuuaccagcuauuggugugucauguucaguauuuucuaucugugugugcaaugugcauaugcacacugcaucuauuuaucuguauauuuguacacacacacauggcacucacaucucuuuuucuagcauuugaaaauucauugcuaacauguuauaaacucucuaaaguguuagcauguggagauuugguccccacuacugugaucauaugugaucuucauccaguaaugguaauacaaaccucugcucgaauucucugaugucccagaccacacauuccaguuauucauaugucuugaaucuccuuuaaucuaaaagagucuucugugccccaccccuuucuuuuaugguacugacuguuuaaagagcccaggcagauugucuuuggaucuccacaggguagguuauucccuuaauaguggacuaguuuguuuuucuggaguucuggcuccuuauuuaaaauauuuacuuguauuauuuuuaauuauguagauaugugcacuugugugcacugccuguuggaggcccagauaguuaguucucccugguacuggaauaauaggugguugugagauagcugauauaggggcugggaacugaacucagguccucugcaaaagcaguaugcacucuuaacuguggagccaucgcuccaagccuguaucuccucguuuguuaauaucuugcugucucuuucuuuacccucucaccccucucccgcuuuuuagccuagggccuguguaucauaagcagccacucucacugugcugucaccaguaggcagagccucaguggcccaggauaucccuucugguagcuugccgugggcacugugcugcgcacaugcccgucuucucuuucagcaucacgcugguaagaaguaacucguuaucucggucgggagcagcacaggagacagugacuaaccugcucuccuuucugccuccgcagccagcacaguagguccuccaugaagacggaguccuccagagcauucuuucuccaugagcuuguggauucugcagagucaaaauugcccuaguuacaaacucuguuacuauacaauagaaauucuuacuggagugcuguuagccaaggauuugauacaaggauuucucauuucuguuuuuaaaaaaaguuuuauccauuuaguuuaacauggaucuuuuuuguuuccaguuuuucaauaugccugaaacuugcuuuaaucaaauaggucccauuuaauuauuacauaaaaguaguuauuauuucugcuucaaauaaaaauaaccacaccaucaguucuaugauuccuuggugugagacuuaggcagccagcagcagguugucgccugggagccugcuucuuugucuuuggccuagagcagaccuauagcaucagugucugccuuuuagcaagauuccucagucacuccccugaacguaauuugggagagcaguguucuuggacuuuugcuguauucaucuaaagggaauauaugaucuucuguccuguuugggacauucuagaauuuucucucaccgguacuucaggugccuuucucugugacuuacuuccuugagucuuuugccccucacuauagaauguaggugugauuauuuuuuugaaaaaucuuaauuuaaauuuuugaguuguuucgccauguguaugccugagcacccauguucagugucccuggagagcagguaaccucuuguucuugcucuguaaaauuuucaucagaucaaaaaagcaauauaugauuuuggacaaggaggugguguuuuaagccuuugagagucacuacuuuucuucgcuuugccuuuuuguuuguaagaguguucacugggcgcgcugcugcaacacuagugguggugagcaggagaggucuauuccagacucaccucagaagguggcagagugugcuuauaaguucagaugggagcucuggcuugcuugugcucguggcuuccaguuccaccagccacaaaccucacaagucugauuauuuccuuuuccccaguguacaguuacccuuguaaaaagccguaggucccucuggggaagaacuggagaaaggguaacagcaaaaccuuugggugucuuaucaggauccuuccucagcggaaccuggccaccccuucauucaagggguuccggaucugcaaacuggcucaagucuggaaauugauucacuggccgagauugcuguuuaccacaaucuaauguagccuuucuuucauuuauuugagaauuuuucugcuuauacagaucaaacaaauaugcaguaggcuuccuauguauuucauucauggguauagcuccuucugcccaucaguaacuuuuuugccgauuccuuauucuuagugccguagaagauccugagucacugagauucagagagaggcacuguaccaggaagccuuaugggaguaaacagaugcugguccucucuugugaagagcaggagcaacaacugccauucagaaguacuggacaagcaagccugucucaauaaguaaaaugaaaaggaaaccaguuagcagguugacuuggcagauuaaagugguuggcauguaaacuuggugacugaaauuugauccuagaacccaugggaagauggagagaauugacuccaccaagucauccaaaagaacugcacacauaugccauggugcauacacacuguggcuucuaagugacccguaauacuaauaggauagaauuaaaaugaauaaaaauuugaaauauauauaacugaauccucucagugauaaggcagaauucuguaugccuuucucaucuguaaguuguuuuagguucugaggaaauugaauugacauuguguaccagccccaacaauucucuacucucaugccuaacucuucugagauuuuaaagagacuguauauggagaaggcuggaugcacaaacuguuuaaaggucaaaagccaucuaaaugucuagcaguaaaagauaauuucaguaauagauuuauagauagauuauaacagauuuacuugguaaacauaagacauuucuuauucagggugcuggguguauaggaacauguauacauguuuauauugaaauagugagagaagcggcacuugauuuauuuuuuucaugcagaugguagugauagggccauguauaggugaugcacaugugaaggucagaggacaacuuguaggaauugguccucuccaaacaugggggagccagggaucaaacucaguuuaccauguucuguaacaaaguucuuuuauccucugagacaucuuguggcccaagaaauuguuuuuaagaauaacuaacuuuuauacagcaucuaaaaagaaucauauauguauacagugaagugacuguaauagugagauugugagauuguuuuagaugcuuucuuuuuucuguuuuacagguuuucuagguuguuauguuugguuaauugaugguugguugauuacacucuuaaagauugaacccagagcauucuaccacugagcuacauccuagacacauuaucauuaauuugauuaaugauuguuuuuuguuuugugcuuuucuugccuggaaauaaaauuagcaucaugcucaguaaacaugagaaguaaacauccaguauauuuaguaguuggcuuuguggugcaagaauguacuagguacuugggaggcugaggcaagagaauugcagguucaaggccagccugggcaacauaguaagagcaucucaaauaaaaagucaaauagaacuggugauguagcuugguaguagugcucuugccuaggaaaggaacaaaaagaaagcaaaaacaaaaagcagaacucugcaguguuuaagugcaaugugaucuagcuuuccugucuucacacaugguuccgaucccucguguucaaggauuugcagcguaggcuguagcuuuagucucaugguugaaucgcauuuuaguuuguugguucucaucgacagauuuggaaugcuaagaugucugaauuguugauaaccuaugcugguaugcuccaccccaaccucacuguuuuccuguuuccucagugcuaauguuugguucuuuugauuuuuuuuuucucucagugcaauuaagcugaagcccaaagaaggagagacauacuaugaugugguagccguuguugacccugucacacgagaagcacagaggcucgcccccuugcucuugguaggccugcuguggagguguucacaccuuuaaccaaaguagucauggguccuacgauuuucugggcauuuccuuuguccauuuaacaucuucuagaggagaucgacaacaguguuuucauagggauugauuaaggcucauuuuucuuuaugaauugugucauggcuuuaaauauguauaagauucuacacuuuuauauaugcuuaaaaaaacccaacuaaccaauacaguacccuaacauuucauuuaagugugugugugggguguguguguguguacaugugugcacaugcuuauauguccauguacuaggggcuagacuuagagccuuacacgugcuaugugggcacucugccaaugggguguaucucuagcccuagcugggauuuuuuuuaggauaguaagaucaucuaaucuucucuguaaauguuaaucuacaugcuucuuacugugaacugaagcagcaagcucuuguuuuccuuuguagcuaaauucucaugguuuaccuucuguuuccucacaagagaguguuaaacuuugugugaggagcagugaucugcaauagccuuuuuaaaaagauacauauauucauucauucauucacucauucauucauucugucugucugucugugaguacacaugucacaguauguggguagagaucagagggcaucuugcaagagucaguucuugccguuugaguccugggaaucacacuuggguuguaaggcuuggcagcaagcaccuugacuuccugagccguuucauugccucuccugccccucuuuggaaccaggccuucuaucugugguugacucuacguuggagcucugaugcccaaaacuucuuuaaugcagaugcugcaacagcuguuuuguuuguguauguuccugagauguuaaaagugcuuugucuccuaaguaauugugaaacaauucugaagagaaaaccuaaauauuuugucaucugguuugcuguuuuagguuuugacucagcugauaaacaugaaucuaagaguauuuaugaauugccaauccaagcuuuccgacaugccuuuaaaaagguaaaaugccauuuaaggaacacuguuccauagcgguacuaaaccuaaaaguuagcccugcgugggaagacucgggugcauggacaggcucagugugugugugaaaggauguguacugacaguccccgcucugcuuugguuagcuguucugagaacacagcaggguuuagacuuagacgacaucaguacaaguugcuggcacauuuacagcucacuuuaaaagaacgguagcuauuaggucucauguaggaagcuuacucuacuuauucucgugcaucuugggggagggacagacuuggcugugggauggcuguuuguggaagucacagugacuauaguagcuuagcacaugcucuggccaugggugaugucuuccuuggccaugggugaugucuuccuuggugaggggcagaguucuauacuuagauucuuaauggauuccaacugucuugcugaggacugagcgagcugcagcucccacuguuuuuuuuuuuuuaaagauuuauuuauuuauuuauuauauguaaguacacuguagcuaucuucagacacuccauaagagggcgucagaucucauuacagaugguugugagccaccaugugguugcuuggaauugaacucaggacuuucagaagagcagucagugcucuuaacugcugagccaucucuccagccccagcucccacuguuaacugcauguuuaucacacaccguguucucagugcuggcaugagggcacaagcaucacuuagggcucauauuauaagacaaagguuucuccucagaggccagugcucaggauaaagugcuugugaccccgauggccauagugugaagggguggucuccuacaugccucccucucccuucccuugacuuuacagcagcccugggaggcagcauuagaccagcagaaggcuuggcuuauuguccugauuuggaaggcuacuguccaagccuaggguuuuguucacuguguggacgcugagacugcaucaagaaauaccuaacuaacacuugcguuucuuuucagcuuuuaccguuacgucuuagagccggagauuucuuucacugcagacagcagcuuugcuaagggaccgauagcaaaguuucuggauaugccacagucuccgcuguuuacuuugaaucugaacacaccugagaguuggaugguagaaucugucagaacaccauaugaucuggauaauauuuaucuagaagagguagggauguaauuguucucgacuaucgcaucauguauaaguuaaaucuauccaucauucagucaguggcgauuccugaacugagugguggagauggcgcucacaucacacaucagugcucccuuacguugaugcucccuuacggcagcugcuuuauucagaugccuucccgcucagaaguugcggugugugcguggacugcugcucccacccuugcucucucagcuuagucagcuuugguuguccucagaguuggucggcuccacgucagugucagucacuccucucauccucuccugauugacaggaagcagugcuagggaggggcauucauuagggcuccuaagaaugcagccuguggugcuagggaggaaguggccugaucugggugccaaccaggaagcaaagagaggagagucccaagggcuuccgccuuuuucuugucuaacucauuucaggauccccagcccacggagcagugcugcacauuuagugugggucuuuccuccugaauugauccucucugaaaggcccucacacaugcccagaggugugcuuccaagccuagucagaucuggucaucacaguccucaaauacccacucccaguuguccccggcaguuaggaacuguuucugaucugacacugugucuaaaucauuacccaacggguggucuucguggcuguagugggugguuugugacacauuccuucugucauagaauccaggauggagcucuagcccucagccucgguggcagccagugcuuucccccucgugauuguugcccugaccuggcagauuacauguguaacaguaauuacaugugucaugugcuuuaacucuggucuuucagguggacaguauaguggcugcugaguaugagcuggaauaucuguuacuagaaggucauuguuacgacaucaccacaggccagcccccucgaggacuacaguucacuuuaggaacuucagccaacccaacaauuguggacacaauugugauggccaaucugguaaguaaucaguuuaucgauaguacaacuuccgugaugguuauuuagacacuguaauuuaugacagaacaguuagcauucugaaccuuggugugaaauagaacuaacaauggacugcuguguaaagucccugcuugcucuccguggagcacugcaggcgccacugcacugcccugcugaggcucuuugccucuuagcuuauugguugguaguuuuuugguuugguuuguuuuacuuaccucugguuuguuaauuaucuuuuaaacuuucuuuaauuaucaugguaauaagacccugaguucaguaccuaguucaugagaggggaugggguagauaggcugucauauacacauacaugaucugcauguaaaugaaaauguaagcauucauuagaaacauuuaaauguaaagagaccugagccuguacucuguuuguguccuagggauauuuucagcucaaagccaauccgggagccuggauucugagacugaggaaggggcgcucagaugacauuuauaggaucuacagguaggacaaggagacggcuucauuguagagacugagcuuuaauugcgcauuaucugggcuuaccccaggcaucgugcguuauagucgaguucaugauaaagccaagcuucucagaagaguaagugugggagaaguuguaggggauggguugguuagcaaggggucuaagugcugaucagagcgaggucuguucuccauugcuuucccugucagcucuuaucagaaggaugcagauagcaggcaggagcucugaccacuugaugagagcugacuggaaacagcagggucgguccuguucaguacgcugaugggagguguuuaucaugaccccggcuguuuuguacaugcacagaacacaugagcuuugacuguguagucugacugucgguccuggucccugggcugcaguuguguaggcguacuccuacaccagccugucagugacaggaauugucuuaaaguucaaacgaaccccagaacaccauuuuaaaaauguggucucuauccuguuuaacacaguuuaaacucguccuuaguucugugccaguuuguguagggaaugguuuucauuaugguuucugugaacagccuaauguguguauuugcuuuggcuucauggccuuuuacuugacauggagaagcagugugguuuaguggguuugguuuugguuuuucucucacccacgcuugaacuggacucaagugagucuucugccuuagucuccuguagcugagaccucaggcgugugccuccauaccuagcuugugcagauuucuuauucaauaacuuagaauuuugugcuauaguaauguccuuauuguaaauaguaggcuuuucccugauucaguuauuuucccaagaaggcuucacagaauguuucuucuaugggcccuguccaucuucuuccuugccuggggcuguggugccguccucucugcugucuaggguuccugucuuccgaggcuucccaaauggacagccugugauucuggaaucuucugugcgccagcuuucuccucuccuuuugcugccugcugagugacagcacaugcaguggcuuccucacauugcugccuggagagugagaugaggaggaagcgaguacucacagucguccugcucugccuugugggccucggaccagagcggcugcacugugggcuuccuaccagacacagaauugagucugugcucuaaacuuggcugguugugccgccucucacacuguagccuaggcuggcuuugaucgcaguugaucucccugcugcuuccuguugggguuacaggugugagucaccacacucugccaagaguuaaacagcagaagcggcuccagggaugggccugagugugcagacugugagcggacaagcuuugucaugaucugaccagugcuuguccugccugagagcccauugauguuugccugcuguaggaaggaagucagcucacgucccuagccuagagauggagauuuccaggaacacuucuuuguccuguaaagguguuucuuucagacugugaggaaacuguugguuuuaaaaaguguuucuacaaugaagaugggcaagcacagcccaucuuguugucugaguauuuaccgcauuuugggauugugauuucuuucucugucuuacuugucucuaagccaugaugguacagauuccccuccugaugcaaacgacguuguugucauccucaauaacuucaagagcaagaucaucaaagugaaggugagucugcucggcuuugucagggaacagacagcagucccccccuguggccguggccagccacugucagggaacagacagcagucccccccuguggccguggccagccacugucagggaacagacagcaguccccccguggcagccgcugucggagguacuaacacuugugaccgugcuaggagagcccucucgcgguaguucauuaagacacuguuuuaauguucuguuuuguguuaauuacuguugugauuuuuaccuugccuaacuuaccaauuaagcauuaguacaaauagagugaacaaagcuguaauauguauacaggguucucuacucuuagaguucaugcauccaguaggggcuuggaaugucuccauuagaugaaguaggacugcugcauuuggaagucauuuugguauuccauuuggaaguggcuuuugguugguugguuggcuuuuggauuuuguuguuguuuguuuuaauaguucuagggaugcugcuuaagaaaaaugucuuagugaagauaagauucuagcuuucuucagccaacagauugucacuuuugguaaucucagagucccauuuugugcaaaauguccccacagagacuuuguguacuccccucuccauucugauugagacagggucucacuauuuagcccugaagcccugauugaccugggacuugcuauguagaccagguuggccucgaacucacagauauguuugacugccucccaaguaucaggauuaaaggcauugcaccuggcucagcuuugccauguuuuuuuuuuuaaguuuuauuuauuuauacacauguaaauguguuuaugugaauauaugacacucguauaccugugaagggcacaagagagcauugguaucucuuagaaauggaguuacagguuguugugaacuauucaguauaguugcugggaacugaacucagguccucugggggagcuguaugagugugcucugaaccacugagcuaucucuccagcucuggcuugggcgcuuucauacccacaauucauagaguuaguauuuuagucucagaagacugugggaaauuccacuggcaauucaacaguaagauuauaguuuuuauaggcaggauggugcacaccuguagucucagaacuggggaguuagaggcaggaggaucaggaauuuaaggucagccuagacugcauagugaguuugaggccaucuugaaugauaugagacacugccuacaaaaccaaacacagaauacaaacaggugauuuuauuuagucuuuucuuacucucuuucucuucagcauuuugaaauccuaaaguaaaaugauuguaggauaaguaacuguuacacaugguaaaaccuaaagucagccauugcgaggcugaacaggagggugauugcugcagggaaucuuuugugguagaaguccugagcauggaccaccugaugcgccucucucaaugguuccugugggccgcauucuucccuugaaguugucagcuagagaaguugucuucuggguuacucccucuguuucuaugagcuuggucuuuggcucuuuguacaauucaaagagauggcuggcuugccccugaaggcuuuaacgugaguguucugaugaacgcacugccacaguccugagagucugggugggguccccuuuaggagaauugguugauuguuuccuguugccagugcacuucagguuugcgccugucagaccugucacauacaauugcagguucagaagaaggcagacauggcuaaugaagacuugcugagugaugggacaaaugagaacgagucuggauucugggacucauucaagugguaagucggcaucauggugaacagcuuacauguacagggagggccagaggugugaaccaugcauccuuugcaauaugguaauuuuuucugggcuuccaaaccacuucaugcagcuagauuaagcccuuucaguuggagaagaggaaugcuucccuuucgguuaagagaaggaaaguguucuuccacggagggagcuucuggugugcucucuucccuugugguugguggggcccacugcuggcagaggugacggucauuggacggcuguguucuuuggaguagcuuguguucuguguauuccucaaugaccgggugccuuuggggagcauccuccuuauuaccuccuuuuccuugugccccaccuagcauccccuggugcucccacccagcauccccuggugcucucacccagcauccccuggugcucccacccagcauccccuggugcucccacccagcauccccuggugcucccacccaguauccccuggugcucccaccaagucuuaccucuggagcaggaaggcucaggcacugucccuuuccucuccugaaagguugugucagccccacauguaagugcuguuuuuaauuaugucaucacaggggcuucucaggacagaaggcugaagaagugaagcaagauaaagaugacauaaucaauauuuucucuguugcaucuggucaucucuacgaaagauuucuucgguuaguuuucacuauuuguuauguaaauggauuuguuauaguauucuuugagugaaaggauuugcuugcuaugguguguguguguguguguguguguguguguguguacacacacaaaguacucugagggcuguggguagccuaccacauacaguucuauuuguuguaugcacaccuuauagacuguuguugauuuuuuuggccaucaaauauugcauaaaccagaagcuagagaauuggcauagaaaguacagaaacuguguaacacuuggccaucuucugcagagccacaggccuuuaaagccagaccuuagguuuaugugagaacagcuuugcuugcaaacugagauuaaaauggaaggaguuugucuaggucaugcaacuggaagcaggacggaucauugcuugacauuguugaugugguuaagaggggagggcuuucgggaucccuuuguggaauccugaggucucagggugucugggagcucagcguugaagacauauuacuugaaagccauugucccaauuucacagcuguuuguccuuuuaguuuucauuauaaaucugauauagaaaauaauaaaaacaaugucauuugguuaauuucuaguccuuuuuccaauaaauaucugcucuaaacuaaugacaguggcaaugacuuuccugagcccaugcccuccccuuacugacuccagucucuccaggcucucgacagaggcugugcaugugugcaccguuugcucaguaccagauguugcugugccugagcacugguuuggagagugcuguaguccugacuaugaucuccagugcuagcuaacucaccgucaguugaugagaugggucauuuaaauguacagcauaauuagaguuugccucuaucuguugggguauacuuacagggaauuccuugucccucucucuuccagggacaucuuuauguacguauauguauacuuucccauuagugaaggucucugccuaacugaacaauggguuggcucugcugucaaucuugugaguuccuucugcuuaauguugcugagguuaaaaagcauugagaaauaauuauuuguuuuguuuggcagcaucaugaugcucucaguccugaagaauaccaagacuccugugaaguucugguucuugaagaacuacuugucccccacauuuaagguuuguucauagggaaaaggaaaaccuuguuaagggaauauuaacacuguaacauauucuuuucuaccuuuguuuuaucuauacucuuaauuuuuaucccuuucauuaggauauuuuaauuuuguugucuguuucuauauuguuuuuuuuuccagguuucucuauuugggguaauaguguuuaugaaucuaaacccaaaauuauggccuguuugaagcuggguaacauaggaggaaagucuuugucuuuucugagacaguguuguagcaaacuaacaguccuugcccugggagguuugcugucuccccuuagcuuaggaagcacagugagugggguuugggaaugguuugcgaaugaauacucuucucaugaggaaggggaggggcuacuuccccugugugccucguaguggguuggcccgacuuuccugcggucacuuuuccuguaguauuuacaagacaacuuuguauucaguguggcucaucucagaugagggcuuuccuuacuucugaucuccugagagcuggugucugaacacagaagacuaccugucaacgccaagagccugcucagaguucuggcucugccgugugauagcccggguuagacucagccuugagaagaccuuaauaucaagcucaagaguguuuuacuaaagucaaauguagauaaguaaaccuggagcuugugugccuuacacacacacaugcacaaguuguauaaaguuguaaaucuaaaagccuucaccugcagauuuccuucauuucuuguggugaguagaugucaucaaaaaguagggauuggaccagaguuuagaugugacuuccgugagucaggugaauuaaaccagauugugccagaccuuguuucagugcgaguguuuuaguuguacuguaauacuggcuaacuuaaaguaaggaucagucuuuuuaaucagagugaaugauuguuguucccugugucuaaacuaggaguuuauaccuuacauggccaaaaaauacaauuuccaguaugagcuuguucaguacaaauggccaagguggcuucaccagcagacggagaagcagcgaaucaucuggggcuacaagauccucuuccuggacgugcuuuucccgcugguuguugacaaguuccucuuuguggaugcugaucaggugagcucgcucggguggggguaacgugagucucagauggcagagcaccuguguuugcaucaguaguucaggaacaugggaagagaucacucagaugucaucaccuuuuguauuuaaguuccauuaacacaucuccuuuucuguaaaagcuuuauguuuguauacaauacaaugaauaacccacugcguccaguuggagcagcccgugggugcaugggcacagagccauccacuggagcaugggauccuauugguguugaugaaucuccuucccucgaguccccacugccagggaugccucaguaacggggguccagucaucugcacagcgccugguugaucuuggaucuuggucuuguguaggugcccacagcugcucugaguuuaggagugagaugagcagucauguccagaggacagcauccacagcauuccuccccauccuucccagcucacuguccucagugguccccgagccuugggaugcagauccccauucagcucugagcaucagucuccuccucuuuuuauuuugacuaguuugugucucugcuucccacugcacaaagaagcuucucugaccaaggccaagggcagcgugggucauaaguaaucagaagguuuuaacauaauuauuuagaagguaccuugagaguaucacuauuucagaaaauaaaauagcagguucugcucuguggccaugaccuccgcaguccugggcuuuuggccaugauuucaauacuaggcaugaaguuucccuccuguggagcaagccucagauccagucagaaagccacuagucaucccauaauagucacccuccugcacuagugccagcgcuuuucuccuacucugugggcuguuuacacacacaccuuuuucucuagauuuggacauuuucuucuauaauuuuauuaaaaauacugucuguucugugccuuuggaguaggcuucuuaucugcuaggauuagacgauucaguaguuuggucuuuccauggugucccaccucucuuccaugugcccaugcccucuccuccagcugcuucuuguugcccuucucuguaugauucgaaucccuucucuuccugcccugauacucuguuuuccacaugcuuuguucugugugcgagcuuuccaacugagcuuuaauuuggcuaccugaauuuuucuuuccagcaucaucucugguuuuucuucaguuuuuuuuucucucucucuuuugaauuuaauuuuuauaucauggguugauuuccguauucauccagcucuuguuuuguuuuguucucaggauauacucaugccuuuaaguuguugaacauaguuauaauuauucuuuuaaguucucuggcugcaaguucuuccaagccauuuucauuaggagccagaguaaugggguuagucgucucugaaggagacaugcuaccuucuuuugguuuuguuucugcucugaacuugcacaucuggaguuaguuuauugguugaguuuuucuuucuuuuguacguuucauuuuuuuuaauccaaaucaucucuucuugucuuuuagugguggcgguugcagcguucaggagaggacuaaauuguaacagaguugaggugcuauuuguucugugggacugguuuguagggacaaggugucucccucaugccuuccuuugagggaaccgucucgugcaagugugguuaucccacuugggucugcagcuuucucugaguuguggaacuuuccauaccugugggucuuaaccagagucaaaucgaguuccuguuguggguccacggcugucguggaagccacuccaggauguggaacugcguaauccccagacaguccaucccgacccugggucugcagcuucuucagaagcuggggguguuguugauccaaucuccacgccucugacuuacucuuugcaucgcuauacaauaaagcuaucucauaagaaguaugcacugaccccucacagucugaccagauagugcucagauucuacuuugaggagguagcuuguugacagggaaagcgcuuguuuauugcagccaugagaaaagccuuaggcauuuagauuuuuuucccuuaugauagggaagccucaaccaucauugggacauuauagagucccaaggauaucaacaugaagcaucagcuaucagacucuuuuccagacuccagaguuuuugcuuaugucuuuaaaaaaaaaaauuuucauuuucucauuucaagucaguuaaauauucugggggaaacaaaucacucauugccucugaccuuuuagaaaaaaaugcuguguugaaauacuguaugcaggcuuggucugaguuugcguggacuaugcuucaguauauuuauaaaugacgagcuuggauucugaaauuaaacuuuuuauuugcaauuuucaaaaaacaaacaaacaaacaacaaaaaaaagaagcuggaagcaugagccucccuauacaccaauagguagggcucacgaaauucagggucgacccugggucugcagcagcucuacagugugugcaguccuauaucuuaguauuaauucacuuaccauaaauaccugaguuacaaaauaaaugcuuaauauuacuuggucacuguguccacuaucugcccaaauguuagcuccuucauuguucauuuauuuacaguucauucauugauuuuugaaacagagccuuucucugucauccaaauuguucuuuugucucugucucuagaauacuaggacuccagccaggacagguguugcuggcaugggggguaauugauguucaggggcaugcgugguucugaugacaaggaacgcugcagaccacucugucagucggugcagaguucauaccuucuccacagugauggucuucucuuauaguacagcugcugucuucacacugcuaaacugugugcuuuuugauugauaucuuucuccucuccuguugauccuguucacuguacauacaucugacauacaggcugcagcauggauaguaagcacagagcuuauuaaacaugauaauaauacacucuugaaauuucccuguuaaaaucaguucaauacuuuugaauuaaacagucuucagaauagcaccacucagugaaaaacaugagugugugggaucauuucagguuacgugcaacacugggggaacucggcuuguguucuaagccugugcugucacccagugugcugcccuuccugcugccuggugaaggaucaugccacagggaaacuaccugugcgcugguuaacaaaccguuuguuuucuuuacugcagauuguacggacagaucugaaggaguuaagagauuucaauuuggauggugcgccuuacgguuacacucccuucugcgacagcaggagagagauggauggcuaccgcuucuggaagucaggguacugggccagucauuuggcuggacgaaaguaucacaucagguacugagagggugcccugcuuaugccucuuauacuacauauaaagagagacuuaguuuauuuguuuagcugcauauacugcaguauguucuucauaguuuuccugugaguguguccugauguauaaucuacuaaguacauuguuuugccuauuucaagcauauucguaaccuuuggguggcacaugccuuuaaucccagcacuugggagacagaggccagggaaucucugugaguuuaaagcuagcauggucuacaaagugagacccugucuaaaaaacaaaaaaacaccaaacaaacaaaacccacaaccaguauaccaguauaugcauuuauuacuucaaauggacacuccaugucuucuggaagaaggugauuuggaggcuaggacauauacaagaaauauuaucgagcuggagagauguucucugagaugaggaccacuggcuacuuuuccauagcaccaacacccacacccacaugggugcucacaccugccuauaagcccagguccagggcaccuuuuggccuguguaggcacuguuugcaugugauauacagacauagaugcagguaaaacacccauacacauuuacaaaaaaaaaaacaaaaaauacaucuuuuuuaaaaaaagaaaagauugacuuauuuuauguguaugaguauuuugccugcaugaaggccagaagaugucagagucccugaaacuggaguuacagaagauggugagccacugugugcaugaagggaaccaaacucugauccucuagaaggguagccagggcuccuaaccucugcgacaauccucagggcccuaaguaacuccuuguuaaaaugagcacacacagagaugaaugauggcugcggugacuucaguuuuauuccguguuucuuggcugcagagaauuggaacccugccugcuccucuccuguuaucuuaagaugucgucaggauagugguggcaaauuguuaucauuuaucaguuucagugaucuuuaucacuggaucuuuugaguuagccagauuucuuuuugucuuucuuauauuuauuuuaugugugugaauauacuguugcucucuucagacacaccagaagagggcaucagaucccauuacagaugguugugagccaccauguggcugcugggaauugaacucagguucucuggaagagcagucagugcucuuaaccaccaagccaucucuccagccccuagauagaaaucuugccucagaaauuaguuuccuuguaagacaacaaaauaaaaagcuggccaaagugagccgucagagcaggccauagccugcaggugugugauccucuuggccaugugcaugcgcccucugcggcaucuuccacucucucucugggacacuggccuguuccauccaugaccucucccaccauucaguuggguucauuguugacaucaauugaugguuugucuguaacaagugucuccucuccacucagugcgcuguaugucguggaucugaagaaguuuaggaaaauagcugcuggagacagacucaggggacaguaccaaggucugagccaggaucccaacagucuuucaaaucuugaucaaguaagugaccguugacauuacacauacaaguaugccauuugugucugaaaaugaaguaguguuugugugcuuucucagaacugaacuauuucuucauggaaaguaugugagugugagugugagugagugugugugugugugugugugugagagagagagagagacuugucugaucccaaaggcucugagacugucaaaaagcucagaauuuacacuaaaaaguaguaaaauuuucuagcccugacugcccuccaugucagaacuuucaggaaggcuugcugaauaacuuuuccaauaacaagcauuuucagaaguaaaauuacagguuuguuucguuuggguuuguguucuguuuauuugucuuuaugugcauggguguuuugccugcauguaggucuaugcacuguaugugcagugcucccagagaccaggagagggagucucaaucacccugagcuggagugacagacagguguuagagcagccagggcuccuacccucacccuucuccucagccccaguuguagcuuuaaguguuuuagauaucuacugucaaucugcugcugcagcugcuguuuugagaccagguagcacuuaguagccuuggcuggccuggaacucucuuuguagacagggcuggucuagagauccaccagccucugccuccguagugcugagauuaaaggcaugagccacaauacccagcuuguuuaaagucuuucuuaaaauauguuguuguuuauugugauauguagcauccauuaaaagaauccaucuucagguguaucaaggagucacuacaaagccaaggcuauaaccagagccccgugcgucaggagcaugucacuccugauagcagacugcugcccugcucccugacuguggcaggcaggaggcagcccacuugccacucuguagacucuacugagccugcugucuagccuggacaccaugcuucuauuuagccucuuggccucugcugaccuggggauguguucccucuacucacuuuccuuuguaguuuugugcccuucaccagccguuccccauucuaucucuuccuuccuguagagcuuccugcagcuaaccaccuucacucagcucgcccccccacccugcucaaucuuaguaguuuauuauuuuagucuuuuguccuuuguucuuuguguuuccugucuaguuaguuuagucuucuguuuguccuucauuuuaauuaacauauuugcuuccauuuuaguauuuuuuguuuucagucugugcuggaauccucuguccuuuaucuuuagcagcugucucaugcagagugacaguuugcacugccaggucuuugacccaccugcuggcucucaucucaugaccucugagcauaugacugcuuuuguucauguuuucucucagcuguuucuuuucuuuauuuuuuuccuuuuauugaaaauaauuuucccccucacauaauauaucccgauuccaguuucccguuccuuccccuccucacauuggauucaccugcuuucugucucucaguagaaaauagcaucuaagggauaauaauagaauacagaauaaaaagauaaaacaaaagcuaacacauucagaauugaacaaaacaaacaggaggaaaagaaaaggcacaagaaucagaaacccacucauuuauuugcacacucaggaaucacauaaagacccuaaacugggagccaugauauguauggcuguaagacuguguuauauuauaaaguauauuauguauaauuauuaucuucccgcagaguagaaagugcagguucagcaguaucuaaaguuuauuuuguugacgguuugaugaaggaaauugucucaguuacuuuucauuccuauuucugugagaaaacacuaugcccaaggccauugauaaagccuuuaacugcgccuaugguuucagagaguuagaggccuugauggcagggcaaaaaaaccacggcagcagaaacagcugagcgcucacaucuuuacuauaagugggagauggagagagauaccaggaaugguguaggucuuuugaaaugucgcagucugcccccagugacacccuuccuccaacuaggccauaccuccuaaccuguccccauacagaaagacgguugugagcugcugugugguugaugggaauaguuucaccaacuggggaucaaguguucaaaccuaugaccuguucucauucagaccaccauugugcacaagacuggagugauuguugcuugcauaacugaccuggucaugguucucagacaggaucucacaucgccacgcuggccuggaacucagugacugugaacacuccugccuuugcucccagagugcugggauugcagcgcauagcacuauacucggcugacuacacuacaucauuuuuacaagcgucacagucagucaguucuguuuauuuauuccagugguauauuggguuuuuuucuccccagaguguuaggacaauggaacauuuuauugugagagaaauuugggcuccaucauuugggagcgggagagucggugcuucuccucuggaaaacuauaaaguguuaaggcccaccucuucucccugcagaagugagcagagacugcauggugacuccucuguagucucagcacgugcgugcgaggccaggcaggaggacaagucccaggccagcgugggcaacagucucaacagagcaaaagacagcaacgggaaguuuuagaauuuacuuucaugcagugaaauguaguugaaucuuguuuguguugguuuugucucuuuuuauauguauauguguuugccugugugugugugugugugugugugugugugagcccagugcuggaggagcccauaaaagggcaccagacccccuggcacuggagauaaagaugguugugagcugccguaugguggggaccuacuggguucccuguaagaggugcuaaugcccuuaauuucauagucacccccuuggguccccaguugagggaguauuguuguuuguuuuucuaaguuuuaaauauguguacacaugucuauguguggguaugugcacauguguguaggugucugcagaggccagaaaggggcaucagaucccuggaguugcagguguuugugaucugcccauguggguuacauggguucuggggacugaacucagguccucugggagaacaauauauacucuuaaaugcugagcugucucuccagcacucuaguugaauuuuaagccuacacugguugcuuauuuaaauuucuuucugaguuuuaaauccuuguguuucauuuucuuuaccaaacaggauuugcccaauaacaugauccaucaggugccaaucaaaucgcucccucaggaauggcuuuggugugaaacguggugugaugacgccucuaagaagcgggcaaagaccaucgaccuggugagcugcccucccuacccugggaccugacagagccuggugguccucccugcccugggacagagaaccugguggcugcuggugcuguucaaauuggcuuucgcugaauuaugguuggagcugcagagcauguccuggucacuucagcagggcucuuccucacuugcccaggacgccagaucacaugcagcggucuaagaguugauuucugcugugucacccgugucuuccacuucaacccugugccuggacaggugucugcuuagccaguaacuuuguuuccuuugguuuugagagguuuacuguguaacccaggcuagcccugaaaucccgaucucccauacuuagucucacacaugccugcuggaggccuguggcaaucuguacauaggguguaccuuucuuauagcuccacugaggugugcuugugugcuugcaguguaauaaucccaugacuaaggagcccaaacuggaggcugccgugcggaucgucccugaguggcaagacuacgaccaggagaucaagcagcugcagacccucuuccaagaggagaaggagcuggggacccugcauacagaggagacgcaggaaggucagugugaagcugacugaggauaagucaguccuggcuacuaauuuguugcugaaacaauguagggguccauuucccuagaucuugaucucauccagggucuauuucccauugugcccuucagccagucuucuaaauagcacauucaauguaguuuuguaguccuccccccaacacuuguuuguuuagucagaagaagaagagaugugugugugugugugugugugugugugugugugugugugugugugguggggugcacacaaguguucauauguaccaccgcaugccuguagacgucaggacagcuugcuuucagcagccagugcucuccuccuaccaugggcgucuguauacuuacaauaaccuuauagacuacuggucaaauuaggugauuuguggucuuuuauuuucaaagccacuaaagcuuacaaauaaacgucuaguaucuuugucuguccaugaaagucuggacgguuuaugccaggcugggaaucaagaggaccagguguuaaacucacuuccaccuacagagugcauuugagaccagccuacaagaacagugaauaaauuggagucucgauuaaauauuucuccuccuuuaaacucauccuaagaagcaagugcagggaccuggagagacuugaaagucuguucuggagacugcaggcuagaaagugucauagcuaguagguuauagucacacacucacuaaagauuuggagcaggagagccggcuuagcuuuaaaaacacugucuauaacuccaguuccaggggaucugaugcccucuucuggccucugugugcuuagcaugcaugugauauucagagacauaagggcaaaauacccauacacauaaaaaaaugaaaauaaauacuguuuuaagaaguuaaauucauuauguaauuacuuauagauaaauggacaaagaauaugaacagacuauucaaaagaagagccauauaugaggaauaaggauacagugaugaaauuagagucaccauuaauaucugauaugucaaaaaaauacagguggagugguagugcaaugcauuagggggcaggggugagacuggugagugagccuugccgaaacuguccaugugucuggaaagccuugcuuuaaaagcagcaggucucuuacaaggagccuugaaaaugcugcaccaaugggccagagagguggcucagcaggagaagugcuuacuucaugacacgaguccucauucccacgucucuugucagagcaaaggagagaacucacuccacagagcugcugugagcacgcaugcacaccauagcaugugcacacagucaugguaaagugcaagugcauugugcaagaaugccucuacugaggcugcaucuuagauaacuccaggaaaagcaauacacacggagagauguacuuuacuguuacguaccgaucagcaaccuuaaaacaguuuaaggaucaaagaacagcugcccuggcucacagaaagaauguguaagugcagaagauuucugcacacagcaguguguggcccagagccagcucugcccugcuggagaccccgagagccagcgcugcccugguggaggccguguauagcccaagggcgugucaguucuuagagcuaaaaaugucuucuucucuuagguucgcuuucaacccuuaauacagaaauagccaacaccaagcuucuacagaccaucugaagcuacagugcugugcugggggcagugucacacgcuguuuuaugacguaagucucacggucuguguucuucccccaggcucucagaagcaugaggaauuaugaucucuggaggaagaugggaaacccaccuugacaguuuggacuaacugcuguuuucucugaucuuucgauacgacugcugaugaacggauugggcagguguaccacaccuauugaucugagcauugauuuagacuacugcacccuagugggugcuagauccuuggggcuaaggcucuguuggauuuguaccucagaggaagacaaguggcuggucuucugggacucuucuucucaccagagggagaaaugccggcagcaacugcaagaagcccaguccuucggugcccacagcccagagcacacacugcugugcuggcccagaagcugggcagaaaggucaccauguucuuccuuaccucaguuuaccugcagcccuugcugcagugcagaugcccacccuguaccaggucaggccggcagaugcuucauccaugccucaaggucuacgccaacaugcuucucacgucucuuccccuccccaccccccuucccaagcacuaggcuuguuguuuaauggagcccaaccaauaaucaugugucuucaggguuggcucagugcaguugcuaagcaaaucagucuucaggagaaacggggugguguggauaaggcuggaagaaauggcagguaguggagaguguugggguguucgauggaagacaaaaacaugggccguucucuucagucuaguacccagugaacuguccagguaauuguuuuguaaacaauuuuucuauuuaugaaaaugugugcuuuuucuucuuacuuucuaaaaagcuguugguuaucaguuuccuggcugggcacaggcguccugagucccucagugaccgcucucagcgugcucagccuccgucuggaugcaccauacugucugcccuuucccuuguagaguuuucucucagacccaggggauaacuuuggguguuucuucccccaaaugcucucagaccugugaccaggaaugacucugucucuggaacucgguuuccuacacucugucuuucccuugugcuuuggcucugaggguccccuuuggcuuucgagacuugccgaggucugguccaguucuaagguacugcugcugucugaagcagcacccuucacugcuuuguguucacagccacagcccagcaucaccucgggagcagccugggcugaggagccuuccacguguuguuaaccuggcuggacagguguggguguguggugucaucucugcccaggacucagggaucuacagcagagaguuaguguugcugggcacaggguguggcucaguggcagacagagugcuugucuagcaagcccaaggccuucugucugguacuguaucuccccagccccccccccccaaaaaaaaagacugaauaugaggaaugaguacuguggguaacuaaguucuugccuguccaagcuagguaauauguguguuaccauggaagaauggccuacaggagccgugguuagggauuugagugggcaauuguuaaguaauaaguagagacagaaaacuggauugggaauucagagaaccagcauuaacccccuuaccucgucagcuggagcucccacugagaguccugggcagagcacaaguguccccucaggucaggaauccacauaagagaacaaagagcagcacuaaaaacaacaucauuuaguucggugcucacgacaccccagaaacgagcuggggggcugcuaccaucggucggucagcaggguuuucucccucucccucugcaggcgcuuggguagcaaggacaggcuguagcgagcccucugaccuuggaaaggugucugggaauaaauuacuucccagcuguuucaagcgauguauuuugacucuuggauuaucaaaguguuuugucauuugucauaaagucagggaaggggcacacauccccagacaaagggccauggaggauacguuugagacaaacauguuccauagcuucuuagcuuaacuagcccuugacauuuauugauacaguguauauuacaacaugaauuucaaaaaauaaaaaaauuaccacacauauaucaaguaauaucucccccccccccauuuucaaaucuaaaaguuagcuuaagagccagccuuuguucaggcuucauguccacccuggauuaagcucucagggcugcugcgcccgacugugagcggaagcugucuucccagugcccugggagccuggaguguugagcaggaauagucagugcucugagaugcuggcccgguggccaggguccuucucuuaccaaauuaugugugccuccucugaggaagaggaaggcaugggucuccuauggcccuuuagucccucgugggucacuacacugacauaagucauauucagagcugaugcuggcuaggccagacccuaaacuaaacccuucuaaagcuguccaggcccccccuuuccugguccuuccuugcauccuguggauuaaaucaucucuacaaacuaagccacugccacaaaugggcugcugccggcaaguggcccuggaagggugucccugucagauuucaccugacauucucacuacgaaaaagcauguugugacugaaaagagagaugagcuauucuccaagaagcaggaagugacugagcagacagguuauugaggcuccuggagagcucaccgccauucuuggccugcgaauaaaugguucuuugaccuccugucauauagcaguagaguguuuccuuucugaaucacuaggguagugugaccugugacaagucagacugugccgaugugaauccaugaaaagcggcccuugacuggaccuggggcuguggggcacagcucuccagaguccuggguuagaaguauccuggaugcacccaugucgagagugguaaugugcugguuucauaagauaguuggcguuguuacccgggcagaggcuacauuucugguugagcauggucgucucggggcgugcaugugugcaccgugcagggccugucuggucaggagcagacuucauggcagguauguuaccuggcucucgucugaguugcugaaagaugagcugagagcccagugcuaaagaaggaagaaaagaacaagcaaacaaacaaacaaaaaacaggaaacaaacuugacuggcauaguuuaggacuggucagauuuggucaccaguaugaagucaacuccucuuguccgcguguccuccauuaaauuacccuucuaaaauuacccuuccuaguuagacccgcaugcuucaaggaaaugaugcaccugaggcguugggaaggcgcucacucccaugcacuuuucuggggagaguucauggaaggcugccuagagggacacgugcuggcaguacggagcacgacuucuuaagagaguuguugaguccguggcuuuaugggauauuguaugaugaucagagucaaucaaacggcuccucacguucuuguuuacuaaguaggggagcaguuuucuguugaaauuucaugaacucccauuuucucugccuuaagguaaugaggacuucucaaaugcuggaucaagcucaagcacauuaaacauugucacucaggaagucacuaaaauuuccaagugucuggaagggucucaccccucccucauugcugguguuuugugucuccguguaauaacagaaagcucuucuguguuacauagccaugguggguuggcggauccuucucguggagucauugcaugcugacugccaagagcagcugagcgucggugccaggcaucagcguggcacagggaaguccaucaggucggggacagaaagcgggaggccucuuccuagucucccggguccuuagcaguguggaggguccgugaccgaccguaugagcagggcguggagccguggacuuucccagccugugcuuucugcuugccuuacuugaccccggugggcucaacaaagaagugggcaccauucccuuagccagaugcaaacucuacucacccaaggucggcagugcaacagagacuaccaagcacucuguuuuccuacccaaaaaaaggggaaauggagagagagcuuagggguuuuaaagaaacuguguccuacucuguccauucaaaccaacaccucacuuggcgaugagguuaaacucuguggaugucuuaguccacgcggguuucaccgugagaguaagaucuguccaacacaauaaaauuccuccucucuucuuac

SEQ ID NO: 124 - RNA, 9132 nt, Mus musculus
gugugguggcgcacgccuuuaaucucagcacuugggaggcagagggaggucaaucucagggccaaccugaucuacagaguucuaagaccaucaggaacacagaagcccugucuugaaaaaccguaagugaauggauggauggauggauggauggauggauggauggauggauggaugacggauggauggacagacagacagguagauagauggauaagcugaacacacccacagcucuaggccaauggauggauucuggaacaaagggauaggagggagcagugagcauccuggcagccuccaggaacuacauguggggcugacaggaaaggaggacaagagcccagcuuccacguggaaugcaccaaaggcaggaacgaaaggcuuaaagacuuaggaggcccacacucccuguugaccgcacccccaaccuccagucaggagccucuccuaaacaaaaugcuacaaaucugauaaaaaguacuguaugauaauaguauuacuaagaggaauacuacuaaaugcuacgaacuuaauucaagucucuccauuuuuuaaagcuacagcccaggagugucuucuacaacaguggaguacuuucuaacagucagcaauaccuucugguucucuuccacuuccgcucuaagcugcgcgcucacagccguuuucguuauugcucuaaaaaaggauaaaagugugaucaguguuuagcuuagcauuccauauaaaggucuucaguuuuccuguuuuuagacaugaaccauaugacucaauaaauuauaaaaauaagaacuaaguaaaccucacagcugcagaacuggcaaacguguucacccugcagaugccgcaugguggcaggacgugacaagucugguggcuuccgauuucuugacuguguggcccuacuccugaugugacauuugcugcucagauaacuagccagcagaaacguacuccggcugacugcuaguccuauuaaauccucucguggaggcugaacccugugugucuuccagaagcguaauggcuuuaagcauaauggcuuuaagcguaauggcuuaagaaaucuuccauaggcacuccacggugaaaaaggggcuuacuuaggaaacucuuagccaagaauuuaaccuuaguuauuuaagacaacaucuggaaaaguuucuaagaauuuggcuuuuagacaauuuugccucacauucauagucagagauuaacacuacagaauagacagcaaugucaggaaauucauucuguuacuaugaacaagucagucucccugagucuguuucuaagucaggacccugaaucccucuucucucuuccuccuccuuucagaagaacugaggauuaagcccggagccccgugcacaugaggcaaguguucugucacugagcccuaggcaaagccccucuucauaaggauucaaaaauggcaguauggaccagacuguggauuagcugauguggccuaaguggggcagugccaagagcaucuaaaucccucucucuucaaccacacagccaacagcugucacguguuagaaagaagacacugaucgcaacaguacuuacaaauagguuucacauccaagcauuuuuacauuuuagucacaucauguucugugcaaacaugaaaacaacagggaacaaugugaaggagagggauguaccaaaaccuuagcacauaccuggccuugguaggaaaguucugacuaauguccuucaucaccaccagagauaaugccccagaagcagccaagauucgggcagcagucuggaagcugagaucugcacaacggcacaugugacauuagagcacaggaauccaugguaaugaugguagacaauguccccaacacuacccacaauccauugagggugaagacgccauagaauggaacuauucccgacggugucccaggcuuagcucagaccucguucagguggacccuggagcuuuuacuacguuguccaugacuccauccauaaaguccuaggcugugugguaacuaacaccuagcagaugaacuugagcccaaauccuguuguugucuagauuuacaauguauuauaaaauagagcauuaagauuauuuacccaaugaccucaggggaaauagcuugagaaaauuuuggaauauccuuuagaaaagaaaagugcacauauauucugcccuuccgugccuuuaacauucuauagaugcacaaugaagacgugugcaaaugcguacaggagaccagcuagaaggcucagugaguacaggugcuugcuacauauaaugcaagccucauugacugaguucaauuucuuggaaccaaaacaaagauggacaaaccaaacucuacaaagcuguccucuaaccacuacaugggcauuauagcacaccagccuacauaaacacaaugauaauaaauuguaaaaugcaugcaagaccaugguuauagaucagugguaguguguaugcccaaugugagagccuagaucuaacccucagcacuauuuuuaaaaaauauauaaaccuaaaauuaaaaacugucacuuggguuuuuaaaacguaugcaaagaggaacauaaaaacagcuacauauuucuuguauuguaaaguuauguaucugaucccaaaaagggguguguguaucacugcagccuaccuaguacuauguuuacagaggauuucauuucuucccuuagccauucugucuuuaaaaucugagguacuagaaucuucaaaucauaggcauagaugacagagaagaaucccagaucaauggcauagaccagaugaucuucaauaagaucauagaagaaaacuucccuaaacuaaggagagaaauagacacggauauaagaaguacauagaacaccaaagacaagaccagaaaacacucccauaguaugaaagcuacaagagaaaaaaaugcaagacaaauaaagggaaacccacagaaagaguaacagcugucuucucaguagaagcuuugaaagccagaagacccuggaaugacgcccacuaaguucuaagaggcccuggaugccaagcuagacgacuguguccagcaaaaguaucugccaugguugaaggagagagcaaaacugucugugacauaaaaggauuaaaagaauuccuauuuacaaaaucaacccucaagauaauaucuacuacaagcaguaaugucagacugaaaggaugaauaaugauauaucugcaagucuguagaaagaacaaaugaugcuauaaucaaugaaacaaaaagcacaacugagaacaaaacuuucagaggaaaaaaagauugcaaucaacacacaccuuucaauaguaaccuuaaauauuaauggccucaauugcccaaucaaaagacgcagacgggcugaauggaugaaaucaaaagacgcagaccggcugacuggaugaaaaagcaaaauccaugucugugcugugucuaaggucaccucagcuuuaucagcuuugaacacaggcaccaucucagcaagagaggaugaggagaggcacugcagacagaagggccgagaagcaagcagccacggcucuccgagacuccagacuacacuaacccaaagcaggaggggauuccccuacucgagggacacugagccgagaggacauuguaacuaagcauacacacacgacauucuggcacccccaauuucauaaacaaaucuuagacaaagaguagcaccaaccuaaugauaguaauaauagucucucaaaaugacaagacuuagcagaggagcaagagaauuacacagugucaugcaucaagugaucuuaacagauuauaaacuauuccauaaacaccagagaauauaauacacguucuauuaugagcccaugggagcuuugcaaaaacagaccacauccuaggacacaaagcaaaucuuaacaaacucagaaaaacagaaacaccaccacguauccuaucugaccacaacgcaaugaaaguuaaaaugaacagccgacaaaucucuagugaguacacaaacucauggagauucaaagacacauuaccgaaagaugaaugaaucgaagaagaacucaagaaguuccuggaacuaaauaaaaaugaaaauacaguacaacaaaccccugcggcacacuaacaucaaucagacuuagaguucuaggugcuuacaucaaaaaauuagaaagacgagcuggcgagauggcucagcggguaagagcacugacugcuccucugaagguccugaguucaaaucccaaccacccguaaugagaucugacacccucuucuggugugucugaagauggcaauaguguacuuauuuauaauaauaaauaaaucuuugggcuggagcaagcaggaaccgagcaagcaggauugaccggagugagcagagguccuaaauucaauucccagcaaccacacacaugaaggcucacaaccaucuguacagcuacaguguacucaauacauaaaauaaacaaauaaaucuuuaaaaaacauuagaaaggguauggauaaauggcuuaaugguauaacucaagaaaaacaagaacaaagcaaaacccauguccagaagauggcaaaaaaauguuaaaauucagagcagaauguaauaaaauagaaaugaagaaaacaauacaaagaaccagcgaaucuuaagagcugguucuuugagaaacuaaacaaggcugacaaacccuuggcccaccuaaccaaaagaaagaaugagauagccaaaaugaacagaaucagaaaugaacagugaaacauuacaacaagaaauucagagccacauaaggaaauucuuuaaaaaccugaauuccucuaagcugaaaaauauaaaagaaauggacaaauuucuagauccaugcaaaacaccaaaguuaaaccaaaaaaaaaaaaaaaaaaucaucaacaccuguaacaagugagaagauuucaaacagcaauuaaagccuuccaauggaagaguucugacccagauggaaucacacagaauucuaucagacuuucaaagaagaucuagagccaauauuucuuaaauuuauuuuaaaauaauagaaacagaaggaguauguccaaacuucuacuaagccaguacuucaauaucaaaaugaaaacacaacaagaaaagaacacuccagggcaauauccaugauggaaauagauucauaaguccuuacuaaaauacuugaaucccaugaaggcagauagcaaaaaauacccaccaugacaaaguuaacuuuauccccauguuacagggauaguucaacauaaauaaguagguaauguaauaaaucauaaauagacaaauaaucauauaaccauugcuagccaggcacgcaugguggcacacgccuuuaaucccagcacucagaaagagaggcaggcagauuucugaguucgaggucagccuggucuguauagugaguuccaagcuagccaggacaugauaagaccuugucucaaaacaaauaaaaaaaaucauaugaucaucucaauauauuuaggaaaaaacuccaacauggcuucaugauaaaagucuagaggcaguaacccuagagggaccaugccucaccacaaugaagacuauauaugacaaacccacauuauccuaaaugaagaaaaacuuaaaucacauuaaaauuaggaaaggagcauggcuguccuuuauccccacaccuuuucaauaaaggacucacaacacuagcuggagcaauaagguaaggguaagaaauuaaggggacaagauaagaaaagaggccaaacuauuugcagaugacaugauacgauaugaugcauaagaaaucccaggcuggugagauggcucaguggguuagagcacccgacugcucuucugaagguccagaguucaaaucccagcaaccacaugguggcucacaaccauccguaacaagaucugaugcccucuucuggagugucugaagacagcuacaauguacuuacauauaauuaauaaauaaauaaauaaauaaauaaaucuuuaaaaaaaaaacauuuaaaaucuauaaaaaaaaaaaaaaaagaaaucccaaagucaaccagaaaacuucaaaaguuggucaacaauuucagcaaaauggcaggauacgaaaucaauuuagaaaaaucaauagauuuuauacaccaacaacaagcauguuaaaaaguaaagauuugggcuuaccagggggugagccccuaguugguuauccaauacuagguagucagcccugaagguauacauacacaagcaacgcuacacaauucagcacauuaucuauucaugcacacacacacacacacacacacacacacacacauauacacacauacauauauauacguacauauauauauauacacauauauauguguguaugaauguauguauuauauauauuauauauaugaauaauaauuaaaaagaaaagagaccaugaauuugagaagguauaaggggagaggauaaauauauuucaauuuuaaaaguguguguguguguguguguguguguguguguguguaggggugugcaugucaugaucuaugguacuuuuagaaucuaguagauuuuauucaagcucugcacuccccaaucccccugccccugccccaagacaagguuucauucuauagcacaaguuggucuggaacgcaugacacucauccugucuuagccacagugcugggauuacaggcauccaguacaaaucccgguuaguguggugcugagaggcaaaucuagggcucugugcagcuuggcaagcacucuaacaacugagcuacauccccagcccgaggucugcagucuuuuaacaccacagaacgcagcaccacaacucaggugagcugagugcccauuaccuugcagcugccagacuuucaggggggccaucucguuggugcucuccacaaggugcuuccggaacucuuucagcuguccuuccaaggcgggguacaguucucuacagaaacagaaccgacucuucucacuguguucucauagugcacuuagccaaggacuccaauuuaaucuucauaauuuuccucucccaaaccuaagaaacuuuccucaauacgggcaaaagauuuuaaagcacaacagcuguccucuaaaaguacauuaguguuguauauucuacaugaagcuuuugugcuaugaacgcauaaaaccacagcaucacccagagaacaacaaaagggcucagcagugaaggcuugccaccaaaccugacaaccugacucagaucccagggcuggggugcgggaaucagagaacuagguccgugugcauaucuuggacucaggcacuguucccauggcacacacgaaauaaauaaauauaauuaaaaagcauagaaagaguacuaaaagagacucuggaaaucuugaucaaauaaaaguggcaccugacuauagccagagcugaaagagaugacaggcaaguguccacggcagggagucaaccaacaguaauccacccaaagggaagaagacaccgcagcuggaacuggaaaccauuuuauuuuauuuuuuaaaagggcaacacacugcaaaauuucuaacugaaauucccacacagcagaauuugagacucuuaaaaaauuuaucaagucaccacagucaagaauaauguucagcuauaaauuaugauguugucacaaaaugaucuguguaauuaugaaacaaauuccaucauuaaaauaaucuucuguaggauugcaggccccagggggauaggaaauucacaagaagaccaacaaaaucaacuaaccuggacccuugggagucucagagucugaauuaccaaccaaagaacacacacggguuggaccuaggccucucugcacauaugcagccgaugugcagcuuggucuucaugagucccaagcaacuggaaccagggcuaucccaaaagcuguuuccuaucugugggauaugcucuucuagcugggcugccuuuuccggccucagugggagaggaggcgccuagccucgcagagaccugaagugccagggucagggauacaggggagccccacccacucagaggagaggggagcaggcaugggaaaggguugugggagaagauuaucaggagggggacagugagugggauguaaagugaauaaguaaaaaguaaauaaguuaauuaaaaaaaucauuuucugccagguaugaucacccaugucuuugaucugcgucuaggaagcagcagcaggcagaucucugcaugacugaggguagccuggucuacauagagaauuccagaacaaccaggacuacaaaggaagaccucacucaaacaauaccaauaacauaggccaggcaugguguugcaugccuuuaaucccagaacucaagagacagguggaucucugugaguucgaggccaaccuggucuacaaucaaguuccaggacaacuggggcuacacagagaaacccugucucaaaaaaaacuaaacaaacaaacaaauauauauuaaagaaaaaacuucccauuggcugauggaacacuaucucuauugcauguuuuuaagucuacuuacuauacacuuuggcuucuuuuuucagauucugcucagcauaagaaaauaaccccauucacuacuuccaaccaugugaagaagagaauagaaugugaucuuuuccgcuacucaaaacaaggaucuguaacuguaugcuaucaacugagaggaaaagaaacccgcuucagcaugggcagguaacuccagugccauccaagagcagugcguuucacuagaacaaaacggccacgcugacugcaagugagaagguuucuccgcgguggacucuguauagaacguccuguagagcugcaacucagacagcaacgggaaagacacaggaacaaagggcggugcacagcaacaugaaucaacauaccuuaauuuuccaaagaggaaucccugcacuucaucaauagggucgcucuccccgaugaccguggcauuuaccucaguuccuauaaagacauaguagaggcaugucuaguagcucagaauagaaguaaggguuccaccacagacuggagauuaaaagaaauaucgaaggcuucaaguaacacuucagugugggccuguaaaccgauggugguuuuauauuucuuguguuucugaa

SEQ ID NO: 125 - RNA, 3654 nt, Mus musculus
agaggaaacaaagacagccuuugaagcggucaguccacucuauggcagaagccaacugccuggcauucuccuccuugggcuugcuccaguaggcaguuugggggggggggggggacaguccuaccaagagccagccuugaggacagcuggacaggagucugaggauccaggacacagcaccagccacagcccacccucagcaccucugccaagcucuguuagcggcuagagacaagcugagaguccuaggggcugcauaaaggcagagagggguguaggggcaccagguaugagauuccagacuccaacugcccugagagagcccaagagauccuacuccugggaggacugagucuucaccgccccacccuucauccauacguuugaugaaaauugcucucucuauguaucauuuccgguuuucccaccccaccuaugcugaaacaagcugcagagguugacucaacagaaggccaaaaccccuacacagggaacuuccggaccucacuuuuccuuucuccuccucuccucacccuagcacggugccugcuacacucguccaagaggcaaucuagaucauuacagaucagcuucccaccgagggcagcggaaggccacuaggaaagaagagaaagagcaaggaguuuuugaagccugguccucccucacugucagaccuuagucugucucuaugccucaguuucucuguaauagaagacggggugggguauauaauucuaggccauucugccucugucacuucaaguucuaggccaagcagucauuuaggacacuaacugcuguagagacagacccucuagcuuaacauuccucacccuccccugcccaggcauccauccucuuuagacacugagauccuuagauuugcaucaauucccagcagugcccgcggggcggggcaaggagcaccuguuacacucaucugaaaugaaagacucugcaaacuaggggauacagccugagcagcacaauuugggauuaauuugaggccuucccggccuacgguuggccccacugugccuguggguuaggugugggaugugaccccggccagggagcaacgccuggguagugagugcaaagggccacagaucgguggugugguugugccccuaguucgcaauaagagcaaagccaaacuuguucgucgcacucuggcagccugagcuucugcccucgguccacuaaacacccccaguccagggccaucacccugucccuuugaagagacccgagggaaaagagggaaacucagaagaucaggcggguaaaaagaaaccgucuuuccugcuggggguuggaaagaaaaagaaacaaaaagaaaaaggaaagagaagagagaaggagcaggggaucugaagcgugugaccgucaaaccaucagcaugucccuuggcagaaaagaggaaccguugauucuucaaagcgcauugagcaauuucuucaaaacccgcgcagucacuuucaggaaucgcggccgcagugggaagcgcugcgcgcggcccgggcgccucgguuucugagaagcgaagcgcugggcuggcacggggcagggaggggcccgcggccgagaagcugcugcugacagcugucacaacaaaugggcccagagcagcucgagauugaaaccgcagcaggaagugugggcggcucagugaauuucaguccagacucggagaggagaguuucgagauaaacgccugggaagccccuggccgccccgacuuuccacgagaagagagcacgcagacauucggguuacccugagagccacgaucgcucugggaccccagcccucugaccccggcgccgcccgccagccgcuuacccauggcccagcgagagcgcgcgucgcuaugcagagacccucuacacgcacagccguccugucccagcgcucucggcgcgacugacuaccggcgccgcucgacugccuccucccccgcggacccgcccauggacccgcccccccccagcgcucugggcgcccauuggugaauccuauuuucuagagcggagcagacuccgcccccuuagacccgaggacgucugggaguuguagugugcgcccacuuugcagcuaggggcugauguaagaaacucaagaaucaacugcugucgcaugucuguugguuucccuagaggcaaaacuagagucuuagaaaaacugcccgcucuuuguagcuugccaaagacugggugggguuaaauaaagugcuucuggcuuuuaccugaagugguccuggccgguuccauccuuuccaacuuuacacaguaaguacuguuagccuaccagaggccaaucuagaaagucugugguccaggccuaaugcccaaaaugcccaugucuacauaugucauguagacugagugaaagccacaagauggaccgugcaaagaggaagugaacgaguugagggugaauguggacaagauuaguagagagaacagucauuuggacccguguggguuauagaagaugacgcuaaaacuugagauuuaaaagcagaaagccuuauuagcuugaacucgaacucuguuccuauuauguaguuaguauccccggaaucaaauucuguugauuaacuauaauacucauacagcucggugcauuucauaccaucauuaucuucauuauauagagcaaaacaggccugggugauuaauuagcucauauuacuggucggugguagggcuagagaauuggggcacagaggaaggcuucauaguuagcccccaacauuuuaguguuccccuucacacugaacaaauggacagucugcauuugaugacuuugacccucugggcuuuauccauaagcucuggaauggcagaucugcaagcucagccuggagcagacaccagugagcuugguggauaauuguaauaaaccagugcuugccgaucugguaacaggcaauauugugguugauauuuauuaacugcucagaauaacgagcagaacaaugauuguaacagugccucccacauccaagauuacaaaccccaguccaccccaagagauccaagacucuagcagagaugcaaucuaccaagagauaccaccuggaaacuucacaggcuucuagucacuguguucauuugguaagggucgauugguuggguuagcuacagugccagguuagguauggagaucugcacgcugccuucaguguugcaguauagaccauccacuaccuccuggauuggauacaucuaucaaugaggcacucacuaccuuucaaagccacagcuaauccgaccucugaaaaggaggauccuaccguccaggcaggagagcucacucucaggcagugcuguuugugcaaagccucagcaagucaacaccugucucgggcaaccugcgaacaauaagaucuaaauuuaauugucuccugaggcaacucuuugcaacagaaaguaauuuacaacagccaauaaacccugcugaggaaugauaccuccauuugccuuccuaaaagcacaaacacuucaguugcucaagcuuuacacacuccugccccagcccacagccaccgcccuccaucacucuccauccauagaacaccagcucaggauagcgugagcauucaucagugcuuccaugguuugguugucucucuggcagccucca

SEQ ID NO: 126 - RNA, 16373 nt, Mus musculus
ugagugggguaggcugcgcccgaggcccagaagggguagcaggccauggcggcggcugcugcggcugugguggguugguugggcugggugcuugccgcguucugucugggcagcaccgcaggggaggcggcgccggcgccgggcgcgggacugcugaacuucugcacggaagaggacagcgcaccgggcgcgggcucccugcgcggaagggcagcgccagaggccacuuugugcuugcgacucuucugcuccggcuuggccaacagcuccuggaccuggguagccgccgagggcgcaggcugcccggagggcggacgggccacggagcccgaggaggcggccgccccgacgggcgaguggcgcgcgcugcugcgccugcgcgccgaggccggccacccgcgcuccgcgcugcuggcggugcgcguggagccgggugguggggccgcggaggaggcggcgccgcccugggcgcuggggcugggggcggccgggcugcuggcccuggcggcgguggcgcgcggccugcagcugagcgcgcuggcgcuggcgccggccgaggugcaggugcugcgcgagagcggcucggaggcggagcgcgcggcggcgcggcgccuggaacccgcgcggcgcugggccggcugcgcccugggcgcgcugcugcuucuggccagccuggcgcaggcggcacuggccgugcugcuguacggggcggcgggccagcgcgccgugcccgccgugcuggguugcgcggggcugguguuccuggugggugaggugcugccggccgccgugagcggacgcugggcgcuggcgcuggcgccgcgcgcguugggccucagccgccuggcggugcugcucaccuugcccguggcgcugccggucgggcagcugcuggagcuggcagcgcggccggggcgucugcgggagcgcgugcuggagcuggcgcgcggcggcggcgaccccuacagcgaccucagcaagggagugcugcgcucccggaccguggaggacgugcucacgccgcucgaagacugcuuuaugcuggacuccggcacuguccuagacuucagcguccucgccagcaucaugcagagcggccacacgcgcaucccaguguacgaggaggagcgcuccaacaucguggacaugcucuaccucaaagacuuggcuaucguugagcccgaggacugcacaccgcucagcaccaucacccgcuucuacaaccauccacuccacuuugucuucaacgauaccaaacuggacgcuguccuggaggaguucaagcgagguaaggggacgccccuguuagaaaggccccagaaagugauggccuuguaccugcgaaugaccuuuggaaauauuuaaagacccaccuuuuagaagcggaaggaagugcuaugggagucugaugcgggaggaucggaaggugguuacccuguuuguuaaauagaaaauuuuaaaaaaguuggggauguagcucagugcuugccuaacauacaugaagcccugaccauuacccaguaccacauaaacccaagcaguggccuaccuacuuagaaggauggaagccggccuggacuaaagauucugucucaaaaguaaaugaaugaauaaaaagauccauuggcaggcagcaagcaugccuacuuggcucuaaucccagagguuuccuucuccugggcuguauugugcacuugggcuuccuaguugccccagauucuuggauaguaacuaaaaugaugucaagaggguuagguaacuggaaacuguugucuuugccuuuuuagcauuaaauuagcuggaccuguaaugguuccuggcccuuucagauugugggauuagaaaggacucauaauacuuacuguggguacugagagaacuuccauuuuaaugucaucggaagcaacucaugaauaaugacuuaauuuuccuuccuggcuuuuuucucccucuuaauuuuuuuuuuuuuugagauuuuuauuguuauguuuaugagugccuguguuguuccucaugcaugcagugccuauggaagccagaagaaggcgcuagguuccuugagacuggaauuacagccagccacccugcugguccugggaacugaacccugcauccucuggugcucuugcuuccucucuuucauuuaaauuguuuuucagugcaugucagcuaccugcucuucccuaaccccaucuccauucuccccuuuuuuaccuuaaugucuccuuucauucuuuuugagcaaccccuauuuuuuuguuuuguuuguuuguuuuguuuuguuuguuuguuugaaacaguguuucucuguguagcccuggcuguccaggaccucacucuguagaccaggcuggccucaaacucagaaaucugccugccucugccucccgagugcugggauuaaaggcggcgccaccacggccuggcgaucagcccuuuuuuguuuuuuaagauguacuuauuuucugugugugaguguuuugccugcauguguuuauguacacggugugugugucuggugccugagacagucagaagagggcuucggaucccccagaacuggaguuacaaaugguugugaggcaccguaugggugcuggcaacaaaacccaggucuucugcaagagcaaauacaugugaacaucuaaaguugaaaguaaaaacuaugagccgcuccacauauuuaaauguggaccccuaggggacagguggcacauacauucagucccagcacuuaggaaagcagaagcaggcggaugucugagugcacgaacacccagggcuacacagucuugaaacaaaaacaagguauaggcuccucuauaacacuccaugcuccuccuugggcugcuuugcagagcaugggugcuccugcgcaccagacgugcuuccuuggaguggaggguggaugugcaccagggcucuggcuggauugggcugcaugauaggguguagcaaauggagcaagccccccugaagugggucucaggccccagggccugucagugauuucuuggacagccacugcaagaggcagcucucugaugugaugagcucgcugcucuuguauugaacucagcgugugccaggcucuugacgggcacccugcauucccagucucccuugucugugcaggagaccuguauauagaucaugaauaagugaacaggaggcuuaagugggcagcucugauugugucuggccucucagguguguccuggcuuuauccuagaucuuggucuugcagacucuuucuagggagugaguagguaguauagugucugggcuguugucacuucucacagagugggagccagcccugccuacuucgaguucccagguccuaggaagacugccacggcucucucgcucuguuaguuuaucaaagaagagagagagagacugagaucuggugugcuugucagucuagugacuccuuccugggagaugguauuuguuagcgcccagcaaauuagccuuuuaagggugacccuggacagauaggguccaucucuuccagaaucaucauaagccuucuguuaggagaggaguauaaggaccaucgcugucccuuugaugcuccaaagucucuuuagguuucucagucucaugaaggacaaugguguacgcuuugccagagcaaguucugguugaccuguaucaauaggaaagacaugucccagcugaggacagaggcaggaggagugugaguuugaagccaggugggaucggggaggggggugagcaggggagguauucaucauagugucccauuccucugcagcucagguuagggcgguggaagggcgaggggcaucccugucuggagagagcugaauuuaagcuuuggguguuaguauuggugugaaggacaacacagaugagagcuguuucucacugcagacccuuaguuaaaaguguucacagacaaaaaaaaaaaaaaaaaaaaaaaaaaaaaagccgggcgugguggcgcacaccuuuaaucccagcacucgggaggcagaggcagguggauuucugaguucaaggccagccuggucuacaaagugaguuccaggacagccagggcuauacagagaaacucugucuugggagaaaaaaaaaguguucgcagagggaagaugaguggagcccuugugugucagcuuguggacauggggugggucauuugaucagcagggcugugaaccaggagcacugccucaguguuuuauuuuuggagacagggucucauuguguggcuuuggcucccuugaacccagauccuccugcuuccaccacccaagcgcuugugcuaaagugcucagugcguccgucccacaccuagagugucugguuuuuacugaucgguggcugauguggacaccagugacucagggaagccaggucaggugccacauuggccugaggaggugacccagggagguguuaggaggugggauuuagggacugugcugugcuuggcuuaggacuguccagccagagguuguauuggagggagccucagagucuucugugugauuguguuuuggcuuccuuaagggcuggagccaggagcaggugaauauuuucuuacauuggcgugugcauaccaagggguagauucuuuacaggccucugauaccuacugcaaacagagugucagggcuaacuaaucuauuuccagagcuacaagagugguacagaaagcaggggagcacaaagcaugcaagaggauggggcuggaaaaguuggccgggaacagguuggacuguggaaggaaggaagagucucagaauguccugaaagcuaaggagauagacagcuuuguaagagaaggcuggguugggguauaaggagagguuagcagcgggauggccuuggcuuuuuccuuccaggugcuagggaagaaacccagagccagguacaugucagucaagcacucugccaugguaguuuugcccuugcucuuugguccuggggcugaggaguaauugggagaaugaacacggguggccuucaugcaccacaaauggcuguaaaguugagcccagguagcaguggacuagcacaggaccaaaggauggaggguguguggccgggagaaaccucugcgcuuggguuuuaggauaggaaaucgagcugguuccacucaacaugucaacaggaagaaaaugucaccaauggguccagccacgguguaggggcuucagauuuaggguggguggccucugaagaaccaagcauuccgaugcugaaggacuugggguugaaugccucacuguuuaaagggacuguuccagaggcugcucagugacugccuucuagaagaaguggcguccucucugucccuuugacauccucagucguguggugaaugaggauccuccuuggccucugcauuucuauguguggguccuuuuccucccaaccccuucauacuuuucuccucuuaagaacaaaggacaaggccgggcggugguggcgcacgccuuuaaucccagcacucgggaggcagaggcaggcagauuucugaguucgaggccagccuggucuacagagugaguuccaggacagccagggcuacacagagaagcccugucucgaaaaaauaaaaccaaaaaauaaauaaauaacaaaggacagccaugcugugauggcacacaccuuuaauacuggcacuugggugcagaagcaggugaaucugugaauuugaggcuagccuggucuacaaagcaaguuccaggacagccaaagcuauacgaauaaauccugucucaaaaaaaaaaaagaaaggaaggaacgaacgaacaaacaaagggcauauauuaauuacagucuuccugaugucacagucuuucgaucacuucacucccugccaagcaucugagucuggagucucuggcuucuugucccugcuccauguaaucaguugaaacagcaguagguagggaaugguguccacugggaaggggugccucuggcagggauuacuuuaugccugagagagagagugcuuuggagcugcagugacuuauguuuucuguaaagcaaucaaccccugcuuucuucccugccagcccacagcccucuugaagcagaggaaggguuagggguaagcguucacucagucucugccuucaccagccugaggugugguuuacugucguuugucagaagccaagugauugucacagugcugaugagucagaucucaguuaaugggaagaauguuaguaugugauuuuucucagugugcacacauacaugguugcuuuagaagagaucaaaggggcuugaggcauagguuagugcuggcaauagugggaaaacaugagguccugguuucuguucgcagcagagcacacacgcacacacaaacacacacacaagguaugcaucaugauagccuucccagccuccaaauaacuguuugagccugcuaacgaaagugaacauucuagagccuuuggucugguuauuuuagccucucauggcagucauagcugccacgguucuauggagcuggcccagccaaacuguccaucugcccugggggguguucaguccugucuaguggggacacaauguucaugccuagagccucccuucccguuccccugcugccuuggaaaggccuccugccccuucacacuuuguccuaugcuguagucacauguguggggccuucucccauuuauuauugacucauccuggcacagcaggccacagaauugugagccuuuuucagagaaguccaggagcauaggagauguugcuccuuccuguuagugguacccagagggacucacucuugcaaggagggagcugaguugaggcuucucuggguggccuuuuaaaacccagccuuuggguuugagaauucaaaacucccaaguugcacuuguggccuucccugccuggccucacgcguuuguguccuguggcagaucagcccaagugggaauggcaccugccugcuagcuccggccagccccagcacuagcagcaaggauuggagggaauuuagaaacccggcaggcacucugacucagcaguuaucagggggucccugcaggcugcaaaugagugucccucccacaggcaagucccaccuggccauugugcagaaggugaacaaugagggcgagggcgaccccuucuacgaggugcugggccuggucacccuggaggacgucaucgaggagaucaucaagucugagaucuuggaugagucugaagacuacugugaguuugacaguugcuucucucuaccuccgagcccuuccagcagccugcggggcgucuguaccagaggccugugggucuuaaugcugcuggagcuccagccagaccccaccuccccaccucugguauaggcuggugcugccccucccuccacacaagccacgcagaccgacgugcgguugaguuuugugauccugugugaacagagggcucuguaggcagcccuccaucacuggaagaggcugcucuuggcaggcccacauuccuuuggaugggauaugaagcucaguaguagaguauuugucgagcuggaauggggcagaguuugaucuccuucagcacacagguuuaaaaaaaaaaauccacauuaaaauaaauauuugaaaaaagaaauguugcuguuggcauuaaaauaaauauuuuuuuuuuuaaauuccacaugccaggcagaggcaggugaaucucuugaguuccuagccaaccaaggcuacaugguagacccugucuccaaaauaaacaaaaaaaugauuuacuaccaagccggcugugggaccuuugguagcuggagccucacauggccacuugggacccugcacugcuauguccgugucuucaguucuguuccugggcugaugcaggucacccgggucgcugcugccguuucugugggugaugggccugaggggcguucucuucugcaacccuagcagcaggagagccaggcuuccucugggcguggccagaaugugagcuggggcuucuuccuccaacucgggcacuaggaugauuggggcauggcagcucagugucuugaggaagcagucgcaagguuguuuccuuaggguccuagugaugucuucccugaagucccuggaccuugggaagaagggaaaauaggcagcagaagcacuugcgcgguuugugcucaucguucggugcugacaccugccugccuguucacgccaucucuuuacuaccccagcagacacaaaggugaggaagaagaccgucgcccugggagcuccucucaagcgaaaggaggaauucuccuuauucaaggugucugaugaugaauauaaaguaaaaaucucgccucagcugcuccuggccacccagcgcuuccuuucccgaggugagggugaagggugguccuugccccuggucucaccacccagagggucaagaaaccacccaggccagacaccaggcuccuagcgagcuggacagagcuaguuggugucuccugguaaggcguguucugggaaccucaucuggcucauguuguauguccucuuggcucucuuguguggacugccgcagcccaggggccacugggagagcccaggaggcagcaggaggcaggugugaugacaggccauuugggccccaguggacacugucccuuucucccaccguggggcagagguggauguguucagcccauugcgagucucugagaaagucuugcugcaccugcugaagcaucccagugucaaccaggaggugacguuugacgagagcaaccgccuggccgcacaccauuaucuguaccagcgcagccagccaguagauuacuucauucucauucugcagguaaccgugguuaacccaggccugaagccugagagugauccagacauacacccuuaaacacgggcugacggcuucuccguacucccccaugaugggagagauaaccuguccaccucuguugucuucccagggcagagucgaggucgaaauugggaaagagggccugaaguucgagaacggggccuucacguacuauggaguguccgcccugacagccccauccucagguaugcuaugggcccuuuggagcugaggguuguggauuggcuaacagaacugcccuugaugcucuagugccaugacaggucucugugucugcccacaggaacuucgggcagggcuguguuucugccuuguuuuucuugaucacccagucgaucccugcaaacgccccaggguggcucccccaucucccacauucccaccggccccucucaauggugacuugagggguaggcccugggagcugugccuuugucccauugggucccaccgccucuauccuuucuucugcagcucaccaguccccagugucuucacgccagcucauccgccaugacgugcagccugaaccagccgaugguacccgcuccugcacauacuguccugacuacacugugagggcccuuuccgaccugcagcucauuaaggugacugucugggcugcauguuggugcuccuuagcugccuuugugccuccaagaggcuagcugagcugaugagugugaggcuggagagugcacucagcuagagaagacaugcuugcccccugagggguggagccuccugcuccccugcacugcugggcucugggccugucuggaaaccuugcaccucaucucuuuguuggugauccugacacgugaccaaaaaccaaaaccccuuggcuuggaggcuuuuugccuuccaccaguuuaaagaccugccugucggaggucaagggugggagcucugcugucugucccucacagaggcuccugcuggguaauuucucuauucucuuacccucuaggucacacggcugcaguaccuuaaugcacuccuggcuacccgagcccaaagcuugccuccauccccagagaacgcugagcuccaggcuaucccaggcagccagaccaggcuccuuggugacaaguccagagagacagcagguaagcuccacgcuguguguugugaaaugguggggcccaggagucguguggaaccccacuucugcucccugcuucccuguauccuuucuguuucucucugcauccuuuuccuucuugcuuguuguagaaacuugaauuauacugaauuauagaccaacuggcacuccagauagaggccagcauuuucucucuguggccucuuaagagguggcauaauuaguucuugauaaguggaaagauguucaguuuagaaaccuucagcccacuuaagaucaggguaaggucuagagaaucagguuugccagggccagggcacacucgguguggcacugaguuggcacauguggacaggaaggucuguagagcugggagcagaaagcgcagguggggagcaguuugcauuguggguaggcacuggccugccucaugggguccaugguguggguggugaaaagccagggguuuucuguuguuucuugaguugaucaguccuuagauaaggcucaggauugccaagcugagccucagagguauucuggaaggcaggcaggccgccaccugucccucacuccguucugccaccugcaggagccaaguuguuaccaggcauuggcucugcaagcaccggguuuagagcugacugucuccauggcagagcugcccauccugagagaggugggaugcugggcuugucuagugcgugagugcccguggcugcagccuccgccuccaggaacuuagagcuauggucacuugagaucacaagcuuuuuuuuuuuuugguuuuucgaggcaggguuuuucuguguagcccaggcuggccuugaacucagaaauccgccugccucugccucccaagugcugggauuaaaugcgugcgccaccacgcccagccacaagcauauuuuuacaguagaaauugcuuucugaaucaggugauacacagguacaaaggacagaaauucaugauucugagccacagugauggcucggccauggccuauagcucucgguguuccugggagacagccugugaggcagaccuuguaguccuggcugugggcaugggcccccuucaguuucagaaagacauguuuagagcauguuacagagcuucuugugaaauaccccagaguagacggucacaauagcuuuaccgagacuuguuuuuaaaacucgaauguuuucuggcuccauccacuacucagacgguacagacuguauucagugugcagaccugagcugggaauaguagcucuccucugagggugcuuuccucuccgccccuccucccccucuguccugcccucccacuucgcuuccguccuccuccuccuuccaggcgcuugggggauugaacuuagagccuugcccauacucggcagccuccuaccauucgagcugcaccucuggucucuguagagaucuuuuuuacuccucuugucucugucuacucuuugggcuauccuacaaaagaguaauuuacaguggcuugugggccguuucuccuauguaacgguuuauccacccagcuugccaacaugauguuggcauuuucaccuaaauacgauccagugcuugccccauugagguuugccuaacucugcagccuuccuguguuugucccugucucagagauuaguguuacugcacagagcugguuucaguggaacacugauuaaagucgugcagagagacucaggcccuguggacuuggccugagucccugacagaaaagcgucuuuguugaaagguuugaaagguacaggaacuuuaaauugccuuacaucaggggucagcaaacuguggugccggagcccgauuuggccagcugccugagcuuauaaauaagguuuuauuagggccugcccaucugucuggguuaugucuggcugcuucugaguggcagaagugcagcugagugguugggacagcuggugacuugcaaagccuaaacccuugguccuuugccaaguuugcugagcccuggucucugguuaagaugguaaguccucccauaguaugauugugguccugcuuaccgggcagcccugugauugguggcgucccucugugaucccagcaacacuuguaugguacagagcucuccccagccuuccucacaguguggagcugaggugggucccugccacucaacagucuguuuccucuucucuuuucucugcucucuucagccuucccaguccaccuuucccucuuuggcacacuuggaaacugcaguugauaaaugacuguggacuagugagcauuuuuuguuuuaagaggacaccaagguaaauaucucccuccccuccccuucccuuugcuuuccuuuccccauccuuuagcuguuggccgacacugcgggcagcuucccaggcuggggugcgcuucucucacucggugggaggaguugggagacguacuauaucuuacuuuccuaguauuuacuuuuucuagaagacagggggacaugagacaccugguuaguccuggaacaauaggcuuccuuguagcuguagcacagggacucuugaucauccacagaagguucuuuuugcccagcauagcugccugagcuuccugaaguaaagacucauagcaccccauagguaccauggcucaugcauguaaucucagcaccccggaggaugaggcaggaggacugcccugaguuuguagucacucugcacuacaugguaacaagacuuugucucaaaacaaaacaagggcuggcaauauggcucuguggguagaggugcuuggcgacaagccuuaugagccaaguucaguccccaggaccuaagaacugauucucagagauggucuucugaccuccaugcacgucaggacacacacuuacccucguguguguaguauguacacaccaaaaucaguauaagagaagcuggcuuacuuugaagaaugaaaugaauacaguuauuaagucuaaaaguguggucgugcaccuuuaguuccaguccuuaggagauagagauaggagaaucuaggguucaaggucugccugcgcucuguaagaccuugucucaaccccuccugccccaaagaagggaaacaccacuccguagaccaauaacaggauagucuauagccggccuuuguccuucauggguggcaucuggccuugcagugaguuucucucuugaagccugccgaccauguuccuaaaggcuuugcugguuccugagguguucugaggcccaucuguccaggcugcugcugcuuguccuaaagguucaguacuuaguuuugcagagcccgcucccuugacaagugugaaugccauucuuuuuuccuuuuccuuaggguccaccaacagcagacccagcaucccaguggaggagagcccugggcggaacccaggaguguaacugcuugccggacagccccgagcuggaaauggacaagcguuuggggagcugggagagccgagcaggagcuucaugccagccuguccccaccuauccuggccacguuuuagauggcccuuguaagcuguggguccugagccgccucggugccagagccuccagccguccugcuguccuugaggagaugggguugacaaagcggcccuccagaagccuguuuccgaggggacaaaagaaacagcgucaucucuaguccccagcucccagcuuccccggugcuguaacagcacaguguguuuaugugucucccugagcccagggccaugcggguacagccacugccuuuacauggcccuggccugugcucauucugcuuuugguuggccaacccucugucaguggcgccacuuucugagcaagccaagagugcugaguuuugauggaaguguucaaauccauggcccugccguguacuucuuggcuuccccuacaaugccauauuuugauucauguaccccaguuucucaugugccaaaucuaagagcacagcuccccaauaaucugugccccgguuccgcucccuccuguggaggaagccccucuggcuccucaagucaugagcaggcuggcccagggucgccuugcauuucuuucccacuugggcacggcgccaccacaguauugucgauuucuguuugaggucauuuguggaaggccaaaggucaguguugacugaccuggggccguggcgccugcuguaccugucuugugcucuugcccugagcacccaggaaggugugcagcagugcaccguggagcagcagucagugaggcgguuguaagccugcaacguccuugucacuugcugagaagucaggguuuucucguaucucugaaauacucaaacucugugugcuuuugucuuuccagugauguuuuagagacacggguggaaagauucuuucucuucuaguuuaccuauacuuuuccacaguuucagcucugggacaauagauuggggugggaagggcggauuucuggaaccauucuuaaaagaauaugggcccuugugagacuuggaagcuaagagaacagugguacgcuugcugaaaaaaauauuauaacagaauguacucugagaacaaacccagguuggaaacaaauacuuugaauuaccugucuccaaaacagaauucuaaauuucggcugaaccucagaaucgaguuagaaccuuggaugcguaugcucaccuugaacccccagggcugugguccugaagugguuuuaaccuccuccuagaagaguccccuaugcccuuuaccaucaccuccuaaaguuaacguguuagauaaccuuguugcauuuaccagaacucaaauguuaacauuggaguacucaacugaggccuugauuuagaucucacuuuuuuuuuuuuuugauuucuggcaauuggaauccagaugccaggaugcacuuggagcugucgcuucuuuagaccuaacuacaguaauugcagguucauaggaaguggcaaagacgcagagcccuuguacccuuuaucuggcuuuccccagugcucccaugucacuaaccauagugugcagggcuguggggcucugcacucugccaccucuguagacccaaguaacugcuggagaauacuaacccgcuggacugucccucggagccaccugcccccgcccuaagcccugggaccauagacuguuccauagacuguuccucagcucugucauuuugucaugucaagaaugucguuugaggggcuguguugcgugcagcuggacuuugggauugacuucauccagcacagugcucuggaggcuguuccaggucagugugucaguggcucgcuccuccuugccaaaugaugucccgugguguauucaguguccugucagaggacaucuggguuguuugcaguuuuuggccuuuucaaaauaaagcugcuaugaacauucacguacagauacggugugaagacugguguccgccugggaugugccagcaacacaggugccaugacguuuaccuuaaaaaagaaccugccuggccuuggagcggagcugugcacaaguuuaaauuccuacaggaaauguaggaaugaucugguuucuccccaccccgacccaugggccaaugaccaucaguccuuugcugucugugguucuugucugcuuuuccuuggucucguccaugagccuguucguguuuucagcuuggcaacuggucuguauuccuuuccaugugucugugcaucuccaccccacccccaucuuuuuuuuuuucucuugggaacucucuugggaacucuucagauauuuagauuccaaaauccuucguuggauuuuugguuugcaaagauuaucuguguagugcuguauucuagaucugaauugugaccccagagcuuguauacuaaagauugaaucccugggcugcucuguuaguggguucuccugaguucaucagggcucugaccucugccauguucucccucuguaaaguguguggucuaaaggaccaagcagccacaggcucccaugggccuccaucucaguaacauuaacuguguucucaccgcaaggucuuguacagguggaggguuugguuggggggggguuguuuuuuguuguuuguuuguuuguuuguuuuugguguuuuaagccaagaguuugucuguauagcccaggcuggccucaaacucagagauucacugccucugacucucaagugcugggucuaaaggcaugcucugccacgccuggcucaucuuaaagguuuuugugauuaaagucucucucucucucuuuuuuuuguuuuguuuuucgagacaugguuucucuguguagcccuggccguccugaaacucacucuguagaccaggcuggcauugaacucagaaauccaccugccucugccucccaagugcuggaauuaaaggcgugugccaccacugcccggccugauuaaauucauuuuuaucaaau

SEQ ID NO: 127 - RNA, 11911 nt, Mus musculus
ggacucaugaauauuuuauuguauggcuuauaaaucauuacagauuugaggugguuacccgcacaguagauuaugagcacacacacugggugggcaggaaggagcagggucgugggcgaggcuggggccccgauaggaaaggauggguagcaggauacuguagagcauagacuuagacugacaagugugggcacgaggagcucagcaggaagguuccaaacacggguggcugggagcccauggugccagcaggacccugcacaggagcugguuugcagggccccuuagcacaggcgucuguguaaacuuugaugcugugaccacauggccgcacagcaucugcugcacacauuccugaucagugcuuuggccuauagcuuucaacacuuggcucugcucacuacucuuccacagugaaaacuugucaccuagcaaacgguuaauguccuuucuucagaucccccacaugcuaguccaucugaccucuuugguuuaugucacugugccacagaccaauuuaccuuccuugccaacugucccuccccagccugucaaagggcucucccuaaccacugaccaagcucuuacaaggcagcauggugcagcccuaacccuaacggccuaacacuguuccaaacuggcuggcaucuuucuccuuuaugaugagcccuuuguaucuuguuuccuccaucagccucaaucauguguugugcacuaugcacccacacacuaacaagcaagcuucucuacuugcugccugcaggacuccugcagauuguucuguuucuuccuguagagccugguccauucucaggcugccucuccuucuucuucuccugcuguaagcugcuaagccugcaucacugccagcaccugcacaccucggugggcccauggaggugcgguacacacaugcgaggcacacacagcagcccuagcaggucacagugggaggguacgaggcugcucucaccuguccugucgccucaagcuccugagcucugccaguguucuuucucucagcacucccagugaugggcgagcaaacaagagcacagagccccaagaaucagagccacacaccgggccuuguccauaauuauuacuauaaugauuuauaaaaacaaguauuuuucaggcaacuguguuaaauuacuguucagaucuggagagggaggggaggcccuggucauggugaagaccuuucuugauagagguaagcacaugccuucccuuugggucugaauccugauuaaauggcuuuccuuuagcaaauaaagaccauuaaccccuuccuguccagggcacggagggcacgaggagggaguagcaaaucaguguagugcuuugaaagagaguggggcaaaccacgagcuguggcugcccauggcucugaugcucugacucuuggcugcauucccucaguggauggaggacuguccccuagucaguccuaugcaggacauuugcccugccaggccagaaagaggaggcagcaucaaacaccacugugccucaccacccugaggggagcuccuggcugucccucccuucagccuacuccagagauccagggagucuagccccauugggagccugucagagcaaauggagcaugugagucuggucucagagcuucaaggccagagcaaggaaccacaggccacaguggcacugcaagagggucacucacaccagcucgaugcuggguuccucaguuccgaugcuccagcuugggacugccagccaugcagccaaucauuacucugugugugucuguguguguguugagcacagggggaggggaggggagggcuacaggugaccaugaucgcaccaccugcuccggggucagggcaugcaggggacccuaaucuuagaacaugaacccagaccaaaaggggucaagggcucuggcuccccuuuucucccucucucccaguauguccacccuccucgggcauuagaagguuuugcgaugaaucgcgcgggagccaucuucuucauauuccuuuuuggauacccacaucuucuugaagguauccagugaggcgaggauggagccucugugaggauagagagacaacauuuuugaguuccugugggcugggccaacugccuucccuggguccucggaucucacauuccuuuacuugggaaagacguccauccacuucccccggccagucccuccccgagcccuucuccuugagcccaaucucacccaauccacguggaguacagccguuccugaggagcagagaucuaggagcaaagaaucggauaagcauacggcugccacccucuaauccaagucuucgagaccaugagugguuggacacagugcagaacgggaaaacaggcucagcaggggucccaucuccuuagccuacacccucugccccagagguucucagucuuaccuugauuuuaacauccuucggggcaagcuucuuuacuucacuuaguaaccugucuccaaagccuguggauacaaggauggccaagccuggaccacagcccaccucuugucacaguggccuucagaccuuagcuggugcugucccucuuccugcaugucuccccugcacaacugaggggcgugacguaguacccuggcugugggugggcucagcuugcucagagacugacauggguguaaucuaaggccacgcggcuccaccugaccccguguccucuccgagcacugcaaagucacggcuaaggagcacucacuucacuuuagugccugagcauuguucugucucucccuuuuccuuuuccuuuuuucuuuuaauggagucucaucccauguaauccaggcuuggcacugaacucauguucuuccugccuuagccuccugaguaucaaaaugacagguguaagcccucaugcuggcgugcaacaaacuaaaagcaucuccuaucagaaaacuuagcucacugagaaccgccaaacaggugacagaaauggcacaccgcuggcuccagagaugccuuaccaccauccccacaacaguaccuuugaagaguguugagcccccugacagcacgauauuggagaagaguguccggcggagguccaugucagacuuguggauggcgaaggccagaacuucauggagucccucacucucauccccuaccaggucuggcuggaacagcaguucaggggcucggaagcgcgcaggccccaccuguggagaagacggcugaggcacagguucuucagagaagccaaugugucguucccccacacccccauggucggcauuagcuaccaccuuagagucaggccugacuacuuacaucaagcgugcugccgucuggaaggguguacugcaccuucucagucucgagagccucguccuuuuguggguugauggacagauagcaagcucgcuguaugggcagggcagacucuuaagcaggcuguagcagagacacuuguagacagagcuugcuuucauaucuuggccuccccagccccagccaugcccacaugcucuuuauccccagcccggccaagcccacaucccccccccccccccccgcccugccaccccccaucaccucuuugaugguccggaccaccucaaacucagcugagguguggaagucugccccuuccuugcguagcagcagccucagauaucgagagacgucccggcccgcaaugucaacccgcaugauggaguguggcauggcaaagcccucauagauggggacagcgugagugaccccgucccccgaaucuaaaaccacuccuguggugcguccuguugcguaccugccaccaggucaguaugcuuuuacaucagccacugaggugagaggaucuccucaaccccgcaagggacccugggauauuauuuuuacuaguguagaaggcauggaggggaccagaaggcugugccucccgggacaucagggcuuggggcacucacaggcuaagcacggccugcauggagauaaacagugcaggaacauugaagguuucaaagaagaccucugccgccuucucccgguucuuacugggguucaguggggccuccguuagaagaacaggaugcugugagagaugagggagucacacacacaaaacaggccaggccuuuaaagagcuuuccugggcuaaaagcaccacugagcagccaccugccccucuugaggacuccaucugaaucagcucuaaaccccaagccguggagcauuuagccuggcugucacuggguguacacacacacacacacacacacacacacacacacgcgcgcacacaccacacacaccaaacagaacaggacguucugucaauaggcagucagaaagcugggagcagggggaaggguggguaccacaccuccucagagaaggucugcagcugguccuuagaguagacguacugccagaugcguuccaugucauuccaaucccguaccacaccguguuccaugggguaucggauggucagcagcccccggugcuccuggaggacagggagaaagccaaacauaacaccugacccucacauguugcaaaucaugaagcuaccuccugccucugccugcuuccuaucucccugguguguacagagacucacagaacucagcuggcucagcccucucaggaccagggaaaaugacauguguauugaauacagguuuuugagccaaacagcagccauuuucaucagaucaacugugcuggcaagacaccaccacaaguaggugagggcuaacugaaggggagcuccaucacucauaaugggugggaccuuuccaggugcuucaggcuucccugcaaguagccccucaugcacacacugaguaaccucacuguuugcccaauaaccucacuguuugcuguaguuagaguuuggguuucuuaaaaacucaguuauaugaauguuuuuguuuuaaucccaggugugagaugagaggcugcuucacaacgggugauuaggauuugccuugugcacuagcaggggugugacuuugccaacugcagauaguuuaacucugggaacuauggagagggcauaaaugucagagucccgagagggauggggucacucugaagguggcuucccugccccaucccugguuguuguuguuugaagucggcgaugaagauuggacucacccuaggaacucuaugucccuaaucagcaggaaguaguuuacagaggucuacauuuccuuucccucuaaccuuccuucucuccuaccuaguguugaggggcucugucucugaagcccugagagaagcagccugugugaaagagguacugcaaugcauauauacacauggcuagaacccuccauguuagccugggauuuagacagaaacguggaaaaaaggagagugguguuggcuuaauuuuuguuauaggaaggggaccgagaagcacacaacucagaucuggguuaagaucuguuugcuguagugaccuugcugaggcccagguucuggcaccagugggaagcacugcguuaacaagaauggggcaaagaacugagaggugguguuuagcacuccagucgcuggacaagacaggaugguguuuaugggggcuuagaaggaaaaugacucagcaggguccuugggacagggauagggauggagcuucagugguguucauggcucauuaugccagcugcugguggagguagcuuuugggaggggguagagaucauaacagccacuuugcuaaugagguagccagggauaccuguagguguggaccagauaaaugccauccugucuugucuagaggacaggaagccccuugcugaaguaugaauuuauuggcucuccaauuauaugagccaggcaugguggcacacaccuuuaaucccaccacucagaaggcagagacuggucaaucccuguguguuugaagccagccuggucuacagagccaguuccaggagagucaggguuacagagaaagacccuguuucaacaccauccuccaccccuuaaaaaaaacccaagacuauuuaggcuuggguaggugcugggagcagguguuccuugguucuugguagcccccaagaauaccaaagacaacgagucucaggugauggaaaugggcuagaacaguacaggugaaaagaauuaacucugguuggccagaguuaggcaaccucccucucagugugcucucaaguccuuuuagcagccuaguguggcaaacagagaggcacugccuggcuguagugcuacuguagugccaaggauguaucaaucucaagucaagaagcugcagcccugagagguggacaggcauaagaaaucuguuccccuggccuuaggucuggucagcuugugccaucugagccacacugaauucaucaacaacaggaaaaugcaucaaggaccuaugaaaauuccccaaggaugaggaagccggaugacugguacaaacaggugggaucucuugaugcugugcugcgcugauguuuuauguuagugucuccucugcuuggauuucugagaacggaaacugccuggaauggacugugcauucaagguuaucuucacuucacagcacuauuggauggggaccuaggcucuugcuuugacguccugagcauccccgguaaaggguuuaaguauaaagaagacauaaugcuagccugcgugcuuuguagguuuggaagcccacguggaagacuuaccagugcaucuagaaggggcacagaugggaagaaaguugguucacagggugcucgggagucuaguacaacuauggaauucucaggggcuuuaugguuggguggagcacagaugauaugcacugugcuggcaagucuuuuaucuucuugaaacaagcuagaguuauuugaaagcaggggaccucaaucgaggaaaugccagcaugagaucagcuggcuguaagacauucccuugccacugguuagcuuuuacagcccuggagggugcuauggaagcugccgggagaauuauggcccaaagcccuaccugguggcagcccuugcaugcugcaccaugaaguggccguuagugagauauuggccguuauagguacaaccaacuuucugauuagacuuacauggccggcuccacagaugggaacuucauccucuacugugagcucagacagaaaugcucccuggauggggaaaguuauagacccuaaccaggaaacaaccauggucauuaaacaaaugugaugcuccuggcuaaggugccuuccaacuaucuguguuuacacccuuagguucuuucugcuguuagcuuccacuggaugucuuuauguuuccucuuucuccccuuuucuuacuuguuucugagaaggauaacaacaagucuauagacauggagagaugguuaagaugagggcuugguacccugcugaauagccagauacgcgucacccccucuaaggcccggggaacacugcugaagggagcguguguguguguguguguguguguguguguguguguguguguguaaagccuuuaagagcuggaagaagaggugcagcauuauagaaugcaauacuccaagcaaaagaggagccauuuuccucaggucagcuagaccugcuugccagaauccguuugaacagcccugcugagguucccuuaggagagguugugggaagggucauuggaccucccagccauuggcagggagcucuacccuaccugcauauggucucaaggucuugagaaguggugguguacagucuggggaaggcuacuggagaguuaaggcugccguggguuucccuggaucccacacuaaucucucacccaugcucugucaguaaagucucugguuccccaggaugaacucugguggaauccuagucugguuucucacuggggccuuagaaagaaccacuguuuacaucuacucaggggaagaauucuugaaauaugcccgccccagucccucuucuuuccauacacacguuccucgcucacugccuaggcucucuccagcaucucauuauacacuguccagcauccaucugcagcacaguagcccaugcucugucugcacuguccccccaggccaccugagcccaucauuccuccagaguacagcuggagcucugaccucuuggcccaacuccccaccugcccucgccugucugucuaggagacacuuugcuucucauacaacaguggcuggcuuucaucucccacagccucucgugugcccuucuauucaggccuccccuucccaggugccuuauuccccaggugccuaccuggcaccugccugugcuuggcugacacuucccccacacccuauacuggcacccucagagucugauucaaugugcaguccccagguaggccauccuagccagaauaagaaauggccccggccuuccucagagcagguaucagguccauaaaaccuaggugauucuaauucuuaacucacuuuuggggguggcugaagaagacuuugagcuucuggucuuccugucuccaccccucccaagugcugugaccuuaaucaguucuuucuccuauaguuuccaguuucugaaagcggacacggagucaaaccacgaguuccucaggaacguugguucauuggcaucguacagaagggggguugccucuacacacacacacacacacacacacacaaacacacacacacugaacugaagguaagaggcccaagaaggcacagaaaggaacagguugcucugaucaccagcuagaucuaugacugacaaacucaacuuagggacaguuaccucugcuuucgguccaaugaacaggucccccuccagggcuccagccauaacccgcaugugcuuuggccguccgacacugcaaggucacagaaggucagugaguugggcaggugcauggcugaaccuguguccaggaaaacuggaguccaacugcagagcucuagaggguggccaugcuaagcacugggaaguggcucagagccuagaccuauggggagugggaaagcagccuggcucuuagaagcacaagcacuuuggggucugaaggaacgagccucuccccagggagggcuaagugugaaugucaggaucccgucuuagccuggcucuagcaaggccacacuucuauagccacacugacuaagcccacccacccucuugucugcugauggauggaagacagcccuagaacucugaggcuuucugguguaucccucccacaguggccacucuuccacugccagggcuuccagaauagagaucaguucuuggcaagcacauaugugaugaguuaccauucuaaauugugacccacauuccccacagacugccaacagccuucccugacacccacccggaguuugggauggaaagcugaagcccucugugaguccaggcuggcuguagcucuuaaagccacucuagguuuccagcucugaucugcaggccacugacagauccuucaagcucugagaggugcuucaaggggaaccuucccagugggcagguaggacccaggcaauccucgaucuuugggacagaaccacccuguuaccauuggcacucccugggguguguggaaagggcugggcaggaacaguuccuagaugcuauacauaacugaaccuugaugaaaacauuucugggggcuggcgggggcauugcuuagaauguaugcuuaguuuucuggaggcuagggguucacccaaacuccacaauaaucugaaaaaaaaaaaacuuuccagggaggaagggguagcuguguacaccccccccccaacucucugugggaguuuagcucuuucccuggagagagguuccucuuauuccugcucccgccuuuaccacaccccauccccagggcaaugcuggaugcugcuccuaacaggcugagccagaaacaaaggcaagagacucugagacccagcaguuacucucagggucaccuccaccaaucugguguuuccucuuccagguagaggagggacuugccuuccaagagggaagcuguaacaccacaggggacgcauucuucccaaaagcaaauaaggggcuggggagcuugcugcccuccgccccccaggugacaggugacacuuacuaguuugggaaacaguacuuaggaaucuggucuccugcaaagccagccuugaucaccccugaacccugcaaggaaaagcaauguuuuagcuccugccaacgacucaagaugcagucaggguccccaaguggagagagcuggcaguucuaccaaggcuggacagggaggaagccagagaccugaccuagagaaggagaucacuugcaagcacuagcacaucaaaacuaggugugaggcugcauuuucuguccuggggacccaagggggagaugagaacuguuaggggcaucuguuggguggagguuaucagcaaugacuggccccagaugggcauccgugaagagagaccacagaucuccucugugaaugcucuggcuaguaccuguagggagaggaaaucagcuacacuuuaaagauagcuagaugcuacgccucagccuuacucuauucaagaacccuugucuucaccagcagacagagaccacauacuggguccauggaggggaaccacuugguggucuccaaguaccuuucuuggguaguaagaggagaggcagucccugucccugcuggaagcuggaccuaggcuuucaacaugaacuggacacaccuuccacuuaguaaaugagucaccuacucacacccuuugccuaccagucucuauuagggccaaaauaacauauccaaguaacaagcgagaggcuccaagcccaaacucagccaggcaggugccucugagcucauuagcuuguuggccaccaaacagguagguagccugauguacacuguagccugccccaagcacacccccaaaguccaggacuagccucucugauaaacaaguuaugauuuaagggagcccacaugggugcuccaaaaaaaggcagccacaaagaugccaucaggggcucacgugggaaggagucaguucccagaaagagaagugugucaccgucaaaagcuccaaggccuacacaucagcucugggcacagcuagagaaaaccccagccacgucaaggccucuaaggauagacagcuccuagggccacugaagguaagcacaacccaggcuggaagacaacgccccgggaagcaggaccucuuuucuuucaggcuugcaaacuacuaccccaaacugcuccguccuggggaaaguggcuacacucuccgaaaagaucauuuagagugaggggguuaguuaaagcggcaaagaggccaccaggugguggcugguggaaauuaacgugcaguguuugcuucugggugcagccccuugggaaguguuguaaagaucaccaggcccuucaagagauaaagccagcagugugcaagaagucaaaugucagccgaccuccaucaggcggccagagcuuaccaccaagcaaagggccaggggucuuaacuugcccagcgaucccaccccagacagacgcguucaccggccuagagcauuaaggaccgccugacugugaucagcuguaccgcacauccuggacuccgagggaggugcucccgaggcccaccccuggccccaccagcgugggccaccgcacgccgccugcgaccccgcggcgggucacaguccuucccccaccccccgcugcccggccucacauugucgaugaccacgggcugguuagcgaugaugucguaggacuccauggcccggccgagccggcccugcccagcaggcgggcugcaggaggaccggcgggcuacaagguucgcggggagaccuggacggaugcgacuccagacaccgcgccgcuccccucccccagugcgcugccuacgcgaacgcggccccguggccaaucacagaugccaaauga

SEQ ID NO: 128 - RNA, 11911 nt, Mus musculus
ucauuuggcaucugugauuggccacggggccgcguucgcguaggcagcgcacugggggaggggagcggcgcggugucuggagucgcauccguccaggucuccccgcgaaccuuguagcccgccgguccuccugcagcccgccugcugggcagggccggcucggccgggccauggaguccuacgacaucaucgcuaaccagcccguggucaucgacaaugugaggccgggcagcggggggugggggaaggacugugacccgccgcggggucgcaggcggcgugcgguggcccacgcugguggggccaggggugggccucgggagcaccucccucggaguccaggaugugcgguacagcugaucacagucaggcgguccuuaaugcucuaggccggugaacgcgucugucuggggugggaucgcugggcaaguuaagaccccuggcccuuugcuuggugguaagcucuggccgccugauggaggucggcugacauuugacuucuugcacacugcuggcuuuaucucuugaagggccuggugaucuuuacaacacuucccaaggggcugcacccagaagcaaacacugcacguuaauuuccaccagccaccaccugguggccucuuugccgcuuuaacuaacccccucacucuaaaugaucuuuucggagaguguagccacuuuccccaggacggagcaguuugggguaguaguuugcaagccugaaagaaaagagguccugcuucccggggcguugucuuccagccuggguugugcuuaccuucaguggcccuaggagcugucuauccuuagaggccuugacguggcugggguuuucucuagcugugcccagagcugauguguaggccuuggagcuuuugacggugacacacuucucuuucugggaacugacuccuucccacgugagccccugauggcaucuuuguggcugccuuuuuuuggagcacccaugugggcucccuuaaaucauaacuuguuuaucagagaggcuaguccuggacuuugggggugugcuuggggcaggcuacaguguacaucaggcuaccuaccuguuugguggccaacaagcuaaugagcucagaggcaccugccuggcugaguuugggcuuggagccucucgcuuguuacuuggauauguuauuuuggcccuaauagagacugguaggcaaagggugugaguaggugacucauuuacuaaguggaagguguguccaguucauguugaaagccuagguccagcuuccagcagggacagggacugccucuccucuuacuacccaagaaagguacuuggagaccaccaagugguuccccuccauggacccaguauguggucucugucugcuggugaagacaaggguucuugaauagaguaaggcugaggcguagcaucuagcuaucuuuaaaguguagcugauuuccucucccuacagguacuagccagagcauucacagaggagaucuguggucucucuucacggaugcccaucuggggccagucauugcugauaaccuccacccaacagaugccccuaacaguucucaucucccccuuggguccccaggacagaaaaugcagccucacaccuaguuuugaugugcuagugcuugcaagugaucuccuucucuaggucaggucucuggcuuccucccuguccagccuugguagaacugccagcucucuccacuuggggacccugacugcaucuugagucguuggcaggagcuaaaacauugcuuuuccuugcaggguucaggggugaucaaggcuggcuuugcaggagaccagauuccuaaguacuguuucccaaacuaguaagugucaccugucaccuggggggcggagggcagcaagcuccccagccccuuauuugcuuuugggaagaaugcguccccugugguguuacagcuucccucuuggaaggcaagucccuccucuaccuggaagaggaaacaccagauugguggaggugacccugagaguaacugcugggucucagagucucuugccuuuguuucuggcucagccuguuaggagcagcauccagcauugcccuggggauggggugugguaaaggcgggagcaggaauaagaggaaccucucuccagggaaagagcuaaacucccacagagaguugggggggggguguacacagcuaccccuuccucccuggaaaguuuuuuuuuuuucagauuauuguggaguuugggugaaccccuagccuccagaaaacuaagcauacauucuaagcaaugcccccgccagcccccagaaauguuuucaucaagguucaguuauguauagcaucuaggaacuguuccugcccagcccuuuccacacaccccagggagugccaaugguaacagggugguucugucccaaagaucgaggauugccuggguccuaccugcccacugggaagguuccccuugaagcaccucucagagcuugaaggaucugucaguggccugcagaucagagcuggaaaccuagaguggcuuuaagagcuacagccagccuggacucacagagggcuucagcuuuccaucccaaacuccgggugggugucagggaaggcuguuggcagucuguggggaaugugggucacaauuuagaaugguaacucaucacauaugugcuugccaagaacugaucucuauucuggaagcccuggcaguggaagaguggccacugugggagggauacaccagaaagccucagaguucuagggcugucuuccauccaucagcagacaagagggugggugggcuuagucaguguggcuauagaaguguggccuugcuagagccaggcuaagacgggauccugacauucacacuuagcccucccuggggagaggcucguuccuucagaccccaaagugcuugugcuucuaagagccaggcugcuuucccacuccccauaggucuaggcucugagccacuucccagugcuuagcauggccacccucuagagcucugcaguuggacuccaguuuuccuggacacagguucagccaugcaccugcccaacucacugaccuucugugaccuugcagugucggacggccaaagcacaugcggguuauggcuggagcccuggagggggaccuguucauuggaccgaaagcagagguaacugucccuaaguugaguuugucagucauagaucuagcuggugaucagagcaaccuguuccuuucugugccuucuugggccucuuaccuucaguucaguguguguguguuuguguguguguguguguguguguguguagaggcaaccccccuucuguacgaugccaaugaaccaacguuccugaggaacucgugguuugacuccguguccgcuuucagaaacuggaaacuauaggagaaagaacugauuaaggucacagcacuugggagggguggagacaggaagaccagaagcucaaagucuucuucagccacccccaaaagugaguuaagaauuagaaucaccuagguuuuauggaccugauaccugcucugaggaaggccggggccauuucuuauucuggcuaggauggccuaccuggggacugcacauugaaucagacucugagggugccaguauagggugugggggaagugucagccaagcacaggcaggugccagguaggcaccuggggaauaaggcaccugggaaggggaggccugaauagaagggcacacgagaggcugugggagaugaaagccagccacuguuguaugagaagcaaagugucuccuagacagacaggcgagggcagguggggaguugggccaagaggucagagcuccagcuguacucuggaggaaugaugggcucagguggccuggggggacagugcagacagagcaugggcuacugugcugcagauggaugcuggacaguguauaaugagaugcuggagagagccuaggcagugagcgaggaacguguguauggaaagaagagggacuggggcgggcauauuucaagaauucuuccccugaguagauguaaacagugguucuuucuaaggccccagugagaaaccagacuaggauuccaccagaguucauccuggggaaccagagacuuuacugacagagcaugggugagagauuagugugggauccagggaaacccacggcagccuuaacucuccaguagccuuccccagacuguacaccaccacuucucaagaccuugagaccauaugcagguaggguagagcucccugccaauggcugggagguccaaugacccuucccacaaccucuccuaagggaaccucagcagggcuguucaaacggauucuggcaagcaggucuagcugaccugaggaaaauggcuccucuuuugcuuggaguauugcauucuauaaugcugcaccucuucuuccagcucuuaaaggcuuuacacacacacacacacacacacacacacacacacacacacacacgcucccuucagcaguguuccccgggccuuagagggggugacgcguaucuggcuauucagcaggguaccaagcccucaucuuaaccaucucuccaugucuauagacuuguuguuauccuucucagaaacaaguaagaaaaggggagaaagaggaaacauaaagacauccaguggaagcuaacagcagaaagaaccuaaggguguaaacacagauaguuggaaggcaccuuagccaggagcaucacauuuguuuaaugaccaugguuguuuccugguuagggucuauaacuuuccccauccagggagcauuucugucugagcucacaguagaggaugaaguucccaucuguggagccggccauguaagucuaaucagaaaguugguuguaccuauaacggccaauaucucacuaacggccacuucauggugcagcaugcaagggcugccaccagguagggcuuugggccauaauucucccggcagcuuccauagcacccuccagggcuguaaaagcuaaccaguggcaagggaaugucuuacagccagcugaucucaugcuggcauuuccucgauugagguccccugcuuucaaauaacucuagcuuguuucaagaagauaaaagacuugccagcacagugcauaucaucugugcuccacccaaccauaaagccccugagaauuccauaguuguacuagacucccgagcacccugugaaccaacuuucuucccaucugugccccuucuagaugcacugguaagucuuccacgugggcuuccaaaccuacaaagcacgcaggcuagcauuaugucuucuuuauacuuaaacccuuuaccggggaugcucaggacgucaaagcaagagccuagguccccauccaauagugcugugaagugaagauaaccuugaaugcacaguccauuccaggcaguuuccguucucagaaauccaagcagaggagacacuaacauaaaacaucagcgcagcacagcaucaagagaucccaccuguuuguaccagucauccggcuuccucauccuuggggaauuuucauagguccuugaugcauuuuccuguuguugaugaauucaguguggcucagauggcacaagcugaccagaccuaaggccaggggaacagauuucuuaugccuguccaccucucagggcugcagcuucuugacuugagauugauacauccuuggcacuacaguagcacuacagccaggcagugccucucuguuugccacacuaggcugcuaaaaggacuugagagcacacugagagggagguugccuaacucuggccaaccagaguuaauucuuuucaccuguacuguucuagcccauuuccaucaccugagacucguugucuuugguauucuugggggcuaccaagaaccaaggaacaccugcucccagcaccuacccaagccuaaauagucuuggguuuuuuuuaagggguggaggaugguguugaaacagggucuuucucuguaacccugacucuccuggaacuggcucuguagaccaggcuggcuucaaacacacagggauugaccagucucugccuucugaguggugggauuaaaggugugugccaccaugccuggcucauauaauuggagagccaauaaauucauacuucagcaaggggcuuccuguccucuagacaagacaggauggcauuuaucugguccacaccuacagguaucccuggcuaccucauuagcaaaguggcuguuaugaucucuacccccucccaaaagcuaccuccaccagcagcuggcauaaugagccaugaacaccacugaagcuccaucccuaucccugucccaaggacccugcugagucauuuuccuucuaagcccccauaaacaccauccugucuuguccagcgacuggagugcuaaacaccaccucucaguucuuugccccauucuuguuaacgcagugcuucccacuggugccagaaccugggccucagcaaggucacuacagcaaacagaucuuaacccagaucugaguugugugcuucucgguccccuuccuauaacaaaaauuaagccaacaccacucuccuuuuuuccacguuucugucuaaaucccaggcuaacauggaggguucuagccauguguauauaugcauugcaguaccucuuucacacaggcugcuucucucagggcuucagagacagagccccucaacacuagguaggagagaaggaagguuagagggaaaggaaauguagaccucuguaaacuacuuccugcugauuagggacauagaguuccuagggugaguccaaucuucaucgccgacuucaaacaacaacaaccagggauggggcagggaagccaccuucagagugaccccaucccucucgggacucugacauuuaugcccucuccauaguucccagaguuaaacuaucugcaguuggcaaagucacaccccugcuagugcacaaggcaaauccuaaucacccguugugaagcagccucucaucucacaccugggauuaaaacaaaaacauucauauaacugaguuuuuaagaaacccaaacucuaacuacagcaaacagugagguuauugggcaaacagugagguuacucagugugugcaugaggggcuacuugcagggaagccugaagcaccuggaaaggucccacccauuaugagugauggagcuccccuucaguuagcccucaccuacuugugguggugucuugccagcacaguugaucugaugaaaauggcugcuguuuggcucaaaaaccuguauucaauacacaugucauuuucccugguccugagagggcugagccagcugaguucugugagucucuguacacaccagggagauaggaagcaggcagaggcaggagguagcuucaugauuugcaacaugugagggucagguguuauguuuggcuuucucccuguccuccaggagcaccgggggcugcugaccauccgauaccccauggaacacggugugguacgggauuggaaugacauggaacgcaucuggcaguacgucuacucuaaggaccagcugcagaccuucucugaggaggugugguacccacccuucccccugcucccagcuuucugacugccuauugacagaacguccuguucuguuugguguguguggugugugcgcgcguguguguguguguguguguguguguguguguguacacccagugacagccaggcuaaaugcuccacggcuugggguuuagagcugauucagauggaguccucaagaggggcagguggcugcucaguggugcuuuuagcccaggaaagcucuuuaaaggccuggccuguuuugugugugugacucccucaucucucacagcauccuguucuucuaacggaggccccacugaaccccaguaagaaccgggagaaggcggcagaggucuucuuugaaaccuucaauguuccugcacuguuuaucuccaugcaggccgugcuuagccugugagugccccaagcccugaugucccgggaggcacagccuucugguccccuccaugccuucuacacuaguaaaaauaauaucccagggucccuugcgggguugaggagauccucucaccucaguggcugauguaaaagcauacugaccugguggcagguacgcaacaggacgcaccacaggagugguuuuagauucgggggacggggucacucacgcuguccccaucuaugagggcuuugccaugccacacuccaucaugcggguugacauugcgggccgggacgucucucgauaucugaggcugcugcuacgcaaggaaggggcagacuuccacaccucagcugaguuugaggugguccggaccaucaaagaggugaugggggguggcagggcgggggggggggggggggaugugggcuuggccgggcuggggauaaagagcaugugggcauggcuggggcuggggaggccaagauaugaaagcaagcucugucuacaagugucucugcuacagccugcuuaagagucugcccugcccauacagcgagcuugcuaucuguccaucaacccacaaaaggacgaggcucucgagacugagaaggugcaguacacccuuccagacggcagcacgcuugauguaaguagucaggccugacucuaaggugguagcuaaugccgaccaugggggugugggggaacgacacauuggcuucucugaagaaccugugccucagccgucuucuccacagguggggccugcgcgcuuccgagccccugaacugcuguuccagccagaccugguaggggaugagagugagggacuccaugaaguucuggccuucgccauccacaagucugacauggaccuccgccggacacucuucuccaauaucgugcugucagggggcucaacacucuucaaagguacuguuguggggauggugguaaggcaucucuggagccagcggugugccauuucugucaccuguuuggcgguucucagugagcuaaguuuucugauaggagaugcuuuuaguuuguugcacgccagcaugagggcuuacaccugucauuuugauacucaggaggcuaaggcaggaagaacaugaguucagugccaagccuggauuacaugggaugagacuccauuaaaagaaaaaaggaaaaggaaaagggagagacagaacaaugcucaggcacuaaagugaagugagugcuccuuagccgugacuuugcagugcucggagaggacacggggucagguggagccgcguggccuuagauuacacccaugucagucucugagcaagcugagcccacccacagccaggguacuacgucacgccccucaguugugcaggggagacaugcaggaagagggacagcaccagcuaaggucugaaggccacugugacaagaggugggcugugguccaggcuuggccauccuuguauccacaggcuuuggagacagguuacuaagugaaguaaagaagcuugccccgaaggauguuaaaaucaagguaagacugagaaccucuggggcagaggguguaggcuaaggagaugggaccccugcugagccuguuuucccguucugcacuguguccaaccacucauggucucgaagacuuggauuagaggguggcagccguaugcuuauccgauucuuugcuccuagaucucugcuccucaggaacggcuguacuccacguggauugggugagauugggcucaaggagaagggcucggggagggacuggccgggggaaguggauggacgucuuucccaaguaaaggaaugugagauccgaggacccagggaaggcaguuggcccagcccacaggaacucaaaaauguugucucucuauccucacagaggcuccauccucgccucacuggauaccuucaagaagauguggguauccaaaaaggaauaugaagaagauggcucccgcgcgauucaucgcaaaaccuucuaaugcccgaggaggguggacauacugggagagagggagaaaaggggagccagagcccuugaccccuuuuggucuggguucauguucuaagauuaggguccccugcaugcccugaccccggagcagguggugcgaucauggucaccuguagcccuccccuccccucccccugugcucaacacacacacagacacacacagaguaaugauuggcugcauggcuggcagucccaagcuggagcaucggaacugaggaacccagcaucgagcuggugugagugacccucuugcagugccacuguggccugugguuccuugcucuggccuugaagcucugagaccagacucacaugcuccauuugcucugacaggcucccaauggggcuagacucccuggaucucuggaguaggcugaagggagggacagccaggagcuccccucaggguggugaggcacagugguguuugaugcugccuccucuuucuggccuggcagggcaaauguccugcauaggacugacuaggggacaguccuccauccacugagggaaugcagccaagagucagagcaucagagccaugggcagccacagcucgugguuugccccacucucuuucaaagcacuacacugauuugcuacucccuccucgugcccuccgugcccuggacaggaagggguuaauggucuuuauuugcuaaaggaaagccauuuaaucaggauucagacccaaagggaaggcaugugcuuaccucuaucaagaaaggucuucaccaugaccagggccuccccucccucuccagaucugaacaguaauuuaacacaguugccugaaaaauacuuguuuuuauaaaucauuauaguaauaauuauggacaaggcccgguguguggcucugauucuuggggcucugugcucuuguuugcucgcccaucacugggagugcugagagaaagaacacuggcagagcucaggagcuugaggcgacaggacaggugagagcagccucguacccucccacugugaccugcuagggcugcugugugugccucgcauguguguaccgcaccuccaugggcccaccgaggugugcaggugcuggcagugaugcaggcuuagcagcuuacagcaggagaagaagaaggagaggcagccugagaauggaccaggcucuacaggaagaaacagaacaaucugcaggaguccugcaggcagcaaguagagaagcuugcuuguuagugugugggugcauagugcacaacacaugauugaggcugauggaggaaacaagauacaaagggcucaucauaaaggagaaagaugccagccaguuuggaacaguguuaggccguuaggguuagggcugcaccaugcugccuuguaagagcuuggucagugguuagggagagcccuuugacaggcuggggagggacaguuggcaaggaagguaaauuggucuguggcacagugacauaaaccaaagaggucagauggacuagcaugugggggaucugaagaaaggacauuaaccguuugcuaggugacaaguuuucacuguggaagaguagugagcagagccaaguguugaaagcuauaggccaaagcacugaucaggaaugugugcagcagaugcugugcggccauguggucacagcaucaaaguuuacacagacgccugugcuaaggggcccugcaaaccagcuccugugcaggguccugcuggcaccaugggcucccagccacccguguuuggaaccuuccugcugagcuccucgugcccacacuugucagucuaagucuaugcucuacaguauccugcuacccauccuuuccuaucggggccccagccucgcccacgacccugcuccuuccugcccacccagugugugugcucauaaucuacugugcggguaaccaccucaaaucuguaaugauuuauaagccauacaauaaaauauucaugagucc

SEQ ID NO: 129 - RNA, 152404 nt, Mus musculus
cauggcaguggccagagacacgauucacaaagccaggaggugagaagaagggacagcugucaaagaccauggugagacagauuguguagcuuuuggagccaucagaagcucuuuggcuuugacccugagaugggaucucugcaggagugucaaguauaaaacacaggccacccaaacuacacagaugcauacaaaucaaaggcacuuguuggagaagcaguuuguaaguugggaaaagucaaggaaaagauggaagacagagggagggaggguggucccuggugguuaugcuaauugaggauaaaaaauuccggguaggacaaaauaacaaugacagauccuuuugcucgcaggacuggaacaagucugccauuggaucaaauaaggacccauaguggggucacucagauuucugguacguuccuugaucagcuccaguuggucagaaccagguauugcagcagcgcauuccaaggugaugucucaagggcugaggccaguaguaggaauuuucccuuuuccagguggaugaggagaucuauccugcuuuagcugaaaugcagggagauggcagagcccguaaaggagcccggcaggagaggccacaagcaguuugggacugaacagagugcaaugccuaguuuguuuuuuuuuuuuuuuuuuucacugaacaacuugagggcuggaguugcccuggagauaagaacagugguggguggaguaggcuuggggaagggaagauuagaggucaucccaguuuaagaugacugugagacaagugcguggaaacagcagcggcaggaggcaggcugguauguaaagcugcaccuggagguguggguagcauugaguggcagggaaccgugugcaagugugcaucauuuggggagccagagacacaggacuccagggaucccaacacuaucuuccuuccugcuucugucuuugugcgugugugugugugcucaaauauauaagaacacuaauacacacacacauacacacaagggggguaaucaaugguguguuggugaggagguggaggugcuucagggagcagccagagacacugagcuacaccuugccuagaggaugcaggaggaacagccaucgaggaccauggugagccuggauguguggagcugugggagccaucaugagggcuuuggcucugaccugagguggggauuccccuuaaauauucugggguguauuuuggaguauaaauugguuaguguuuuuuuuuguuuuuguuugcuuguuuguuuuuuuaaagacuuacuguuugauauaguguuuuggaaacuggauacucauuaauaacuauuuuugugacucuuccuugagccagacauuauaaguuuuacauauacauuuuacucuuauuuaaaauacaaacaaccuauaauuugggccugagagagugcucagcagguaagggcacccugcugcuuaucuaaaugaccuuauuucugucccugacaugccagaggaggggagaacugaaccaaagguauguucugaccucuacaugugcacuacaguaacacacucccuccgcaaaauguaaaaauuguuacucuuggggcugugagauggcucagcaaguaaaggcacuuucuaccaaaacugaugagcugaguucaagucucaggacccauggugguaggagagaagcaacuuucccaagauguccucucaccuccacacacacacacacacacacacacacacacacacacacacacacacuaaacgcaauuaaaaaaagaaaaaagaaaaagaaaaacucuagcuauugaccuuuccaagcuguagacauuagcauguaauauuuuuggacaugcauugaucaaguccacccacuuuucuguccuuccucccaccucuuccaaacuguuuuuucuuacaacauacucugcuuaauuuuuuaacuuauuaggcagcucauaauacccauuuuacagaucaauaaacagaagccagcaaaacugaguaacauucauuagcaucaauagugcuaaugaaguggagggcuccaauguaaaccaacaugaacuggaaucccuugaccugcugucuccaguggugauucccuaauuuggguagagaacaaaaaugaacaacaaaagauucagagacuccacaaccucaagggcuaauaaauggugaguuuucuguuuggaggaugcaucaaaaaucacccagagaguugaugacugagcuuauccuguuuagaauguuacagaccuuggguauagcaggauaauuuguauuggcaacaaguugccugauguggcagaucccagggauaagaaccaguggcucaagaguuuucccugacuuuuaccagcaaguagccuccaccugcaauguuccagaucuugcuaacguccaaagguuacucuaguacauuccuccuggccuugucauacccucuggguaugaugcugccaaugucuaucaggcacagggaagauuuucacaguggugaguccuacgagaaccaucuuggcaaagauaaucuaaaaggcucuugaaccacucccuuuggcaaucagacuauucaaacgauggaccccaaggaauuggaauuuccccagaaauaucccuuugaaggaagugaaaggcugaggccugggugccagccucaggagaaaccugucucccaggaagagauuugccacaauuuggauagcuccucagaucacauugcaaggagacuacagaaagaaaugggcaggggcaagccuugaucaagacugcuuauguaugacuaccucuugcccucccuccguuuaaacugaaaccuguguuaaacacugcuaagagcgggcuggggaccuuuaacccuccucuucccacuguggccacacugaauaaaucuccuugcccugcuuuucacuuaauugucucuuuaauugguguuagugacaggccggccuaagacuaccuugccuguuagggcugccccugcccaaaugcugacucuaaagagucagguaaaagccuguucaaguauuccaaggagccauuuaaaaaaaagaacacagcucaaaaauacacaguuagguauagggucuuggaaagaacuuguguuaagaaaaagggcccacugcagaggcaguagauucaugagaagcugaccucugcugaacauguuccuauauguucaagugccaaugacacaugcaaauuguuucccaaggggcuuuugagccuaggguuaauauggaaugugguugaugccugcuuuagagaagugaacuuuucaagguuggagggacuugcuugccucgaguuuggcaguggaggaaggacuauugccagcacccuggaagcuaaacuaugacccagugaagcacuuacauuuccuugggcuuaauuucucccaguguuagaaaccuuccauauaaaucucuuaccuuaggcacauuucaaaagccaguuuagagauaauuauugagauuucauuacauuaagaagaaaauuuaagcccuggguuggauacccagcacugaaaaccauuaacuuaaauucagugcuaguauucaaaaaauuaauguucuuuaaaacagcagucagggaugguggcauauaccucuaaucccaguauucuacugacuuuuaaggaacacaaugaguuccacuccagccugggcucacagugaguucuaggucaaccuaggcuacagaaggagaaugccuuggggguggggguggggggcaaaccaaaagccaucgggggugaggacgccuucaaaauguauuauuaauuuacauguuugcuucacaaacaggacgacagcagaaggaagaacguugaguaccuuuuaaaaaagguuuucugaaaucccauuuucuuuucuaguuuguucuaagacaugcaauaggcaaauguggccuuuuaaauagaucgacuaacucaaccaaaagcugagaaaagcaaaaaaagacucuggggcuaggcucuggggggaagugaccaggcuaccaaacugugacaauauccuuccuuccccuuccccaaagggccuagauuaagacuuguaucgagcaaacagacacacagaaaaacacacacacacacucaaacuuuaaccugggagacaugaggugcuucuuacaggagacuaagacacaccaucuuugauuuuggccuuugaaaggaguaugcgcauagaaacauauugaucauuccaagacagagaaaacccagucugauuucuggcacaccucgccuuguuccuccaccccgccccaacuaaugcuuuuuacacacaugguaaguuuccaaauacaagcaagcaaagaaacugcauaaaaagggcuuccugugaacaagagguacgaagguuccauuaagucccucuuggguacgcuuuggaagacacaaauguaaagagggcgggucccccguucuuaaggaagcacugcaagaaauugaaucggacccugaacacuucccacgucaaagccaccgagaggcagaggugcgacccgagaaaucacuggcacggacugucggcgcugggcuccggaugcgcacucagcccucugaaaggcucggacauugcaguaccacuagacccggguuugucccggcgucggaggcgcggccgggccccgcccacgcaccaaagcggcugcgcagcguggcuacccuaucucccacgugacugccgucauugccuccgugaagcuccggccgccaucuuaacuccuggccggcccgggucccucucccuccuucucccgggccgugcggcagugacagggugcgguuggccgccccggcccguccggucggugaagcccgugugauucugagggcggggcgaggagccggagcucacggaguccacggggagcacgcgaaccggcgggccgcccagguauuggcacggagggggcgggccccugcgcucugccccgccccuuagaggccagcgccggggcccgcggcccuugcccguuuccaguauggccgcccgccgugccugacccgcggccucuccguuccggcucuucguaggcgaugccgaugccgagacugugacugacacucucgcucccacgcacgcaccgacccagacccacgccgggagcccgagcucugggcccacaaccgcucucuccucgggcaccgcggccauagcccggaccacggcucccgcgccgcugccgucgccucgcggagaagggucgcgcaggaccucgagcucggcggcccccggcccgccaggauggggaagcgggcgggaggagcagccgccgccgccgccgccgccuccacguccuccgcggccgggcuggagcccgcggcuggccgaggcggggguccucggagcgcagccgcgggccuccugggagcgcugcaccuggugaugacccucgugguggccgcggcgcgggccgagaaggaagguggguugccggcggcgggcggcgggcgacaggcggcagagggaggcccgcgacgggcgccggcgcgaaguugcugggucgagccccgucccgagccggcgacucgggguucggcgagcugccgcgucggccgcgcgccgcggcucugccgcugcuccgugauuccuuuccccucaccgugucccggucuuucccucgucuacugucagugcccauaaaacuucccgagcucucuuguagguucuugccacuuggcccgcuaugcgaggaggcaccccgcuuuuaggcuucuugguggcuccugcuaggucgaucgcgggacgcuuuucuuguuuucccuuugucagguuuuaauuugggcaugcggaccgagcucacuuuaaaaugcggugguuaaaaaagaagaaaaaaaaaaagcgagacugguggaaaggcuucaauacacggcuuauaaaauuucuauuugcugggacaucucuuugaagaggcucuuguuuccuuaguauccuucuucacuaucccuuugcgguauggaggaucguuuguuauuagcccuaaauagacucucauuugccucuaguaagcuacuggaagccgguuuccauuucugcuuuaauauccucacguaauucggugccuuucucuuugaugugugagcccuuagaaacgaaugucaaguucccagcuugcacacccuucaccuguaacucacaauugaagccgcacuccaguuuuaauaacuccucuaauauuguaagguuguaaaacugguacuuugacaagaucagaaauuacuuugcagucuugaagacuaauuuggggguggggguguucuggacuaccuguuucugaacgugagcccaaggagaagugugagcagucacagaaccuucaugaauuaauucacagugaaugcugcuuuuuuuuuucccuaagaagaaaacuaguuagauuauuuuuguuuuuccuguauaaagucgcuguuacuggcuagcagcuguaaaguaaaccagauuagccuuaaagugcaacucugugucaguuuauuauuuauuuuccuuagaaacauuauauucucucacuuaacucuauaaacagagucagccugguuaacaggcaagcagggauuuggcagaggcaagauuauuuuaaacauuaaaaaaugcugcuuuaagauggucaggccugggauugucauaguucuuauuauuuaugauccccuguuaguuuaguguuguuauggguggccaugguagccaacauuugcccauguguguugagugaaccuuuuauagugugauaauugaaugggcauguguacuugugugcuucacugugaccuagaggggcgcuggcuuugcuuugcuauugauugccuugugugguauaggcgccuagcuaggugcuuuugagucucacgaacugggaacugaaguagugauugaaucuaaguuuucauuauccuucuaaaguguauuauuuuucaauugucauuuuauacacuaauuuuggggguacaguuaaguaaauaaaguuauuguuugaagacauuagucuaaaauauauuuguguauuuccauuugcauaauuuacguguccaugcaccucucuaauauucauaaauauauauaagggcugagccuguagaauagcugccagcguguuaaguaugaaaggaagugauugaaucagccacugggccuggcugaaucagacagcuuuugugguuaugcaguaucagggggaacaguuuguauggaccaaauaguuauuuaaguaagauauuaggaguaauuauauuaauauagaucauaugacuuagucucucauaaguaggucugguuuuaaucacacguuccaaaaacguucucaauaaauguucuacucucaaaacaugcugcuucuagaucaaauuccagucauguuuuuauuuugaauaaguagagaaaauggaauugauuuucacccaggacugugacacaaugucuuuggccucugauguggcacuaauauaacauuugccccagugcuguugaguuuuugguuuuuguuucuuguuuuuuuuguuuuuguuuuuguuuucaggaaguuuggucagacuuauaaugauagcuaagcuuaguuuaucucuuuacucccugaggaucuucugugucaaguaauauagcuugaccuuuccaagaaggggucuaccagcaaauucagugguaguucucuggguauuuuguguguuuguauauuuuucccuucauugcaguagaauuuccuagaaaaucaagacaauguagaagucccugucuccuaagggaaagcugcaggcaaagcuggaucgcccgaugggguucugcguguuugaaccacgugaccacaggagccauuccugucuuaagauaggacgaguaucuuagcacacaucuuaacagaucugugaaguguguuaucucuggucuagaggaaagggaccuuugauugcgcuugaauguuuguaaagacuuugagauaguugucagacagaaagucacuauaauuacuacagauaacuugguuagugucacgaguuuucuugagaguaacauuuacauacugaaaacagaaaaucucuuucugucugucucucuguaugcacggugaagguacauauauguuaugacuuuugauggaaucuuuuuuuuuuuugauucgagacaggguuucucuguauagcccuggcuguccuggaacucacuuuguagaccaggcuggccucaaacucagaaauccgcuugccucugccucccaagugcugggauuaaaggcuugugcuuuuuuuuuuuuuuuuuuugauggaaucuugauuuauaagucagucauuaugguaagcaagcauuuuuuuuuuaaguuuuauguguuugaauguuuugccugccuguaagcuugugugcuauaugaaugcucugugcuugacagaagaagggguaagaucccuuggagcuggaguuauggaugguugugagaugucugaugcuugucuuuagaccugaaccugauccucugcaagagcagaaaguacucuuucccugcuccgcccucacaugcccagcugauaaguuguuuugucuuuuuguccgagacaggguuucucuguauagcccuggcuguccuggaacucacucuguagaccaggcuggccucgaacucagaaauccgccugccucugccucccaaguacugggauuaaaggcgauguuuuuaaaauaucuuauucauuucauuguaaaguggauuuuggaagguguggugccuuuugacuuacucuaaauuuaccauuuacuuaccuaguacauaaagcuuggggcugauuuuuggacugcuucauucggugacagcuugaaucugaaggccucguguguuuccauuaauugguaguuaaaggcaaggccaaguuuguaguguuauuaagacacuuauuuauuuucugcccaugugugauaguuucaugcauaacuuuuguuuucagcuguauuugugucauauacagaaaaugguauucucuaugcaaagcauaagaacccacugcuuaggacugaaggcccgaagaagggagauaaaagccuguuagugauuugucugucuugggcucauagaaucgauuagagagaugugcacuuucuaauguaaagcuacauuuuaaggagaguggguguuuuguccucuggguggaauggcuacguuuuaauuuagagccuguuaaauagggugguacagaacgagcacucuaugagugagcuuguuuugcuuuuucuaaaagcuguuuaguugucagaaacaucggagcccuauaguagggaagugugcccuuuguuuucugagaagcaucuucuccuccuuucaguaucucucccuaaauucuuacagugaguccucauaggcaccucugaagagaugagcuuuggaggcaguuguaaagucaucuaauuuguuacccagacucuugauaaaacauguuccucucggcggcacaguaaauuugucuuuacuggguucucaguaucuuagaaaugcucucccuuguggcuugagauuucuuuuuggcuugccaaaccaaggggucagaauucucuauuuugucuguugagagcgcuugugccuuacgugaggaauggacuuaguacuucuugguuguuacuguguccuagccagcugucacugcucugcaugugccaguuggauggugucugucugcaucugugugucuggccaacagcauacacuaaagucuaggcaggauuagcuuacacugccuuccauuucccaguuguuauuagugccguguuauucuucggccccauugaacucagucuugacccuuuacuaggugccaaugccugugaccccuccuuuggucagcucuuccuacgaccuccauuguucggcucagggugccugagacacagccuccugccucucaguguuugcuguucgugugcaguccuguucuuuucaagcaugugguaucuauucauucauuuuauaucagcagucaguuaagugaucccgcagccuccuucuccuggacuagacucugugaggcacccgcagcacggacauaguucugaaugaagauuugcaugaaaugaucucaccuuccuuuuuuuuuuuuuuuuuuuaaaaacugaugacuuggaguuuagagucaaaaauagguaaaaacccucagauguaguuguccuuaggaaacgugacaguaggauauugggugacaccauuuuuccuuucccacguguugcuuccgcuuaugacuagaaugaguuguuauacuuaucugacccuuccuucacuccuggggcuggagagauagcucaggguuaggcauguguauacucuuguggacccacauuagguuucagucacccacgugggaggcucccagcuugcuguaacuccuccccugggagauuggaugcuccccugcauucaugcacagcaccccacacagaugcacagcaaacaaaugauuaaaguaaauaaauaauagaccaucgcugccuugacuccaggacuuuuaacauuuucagauccucaaaauagugagacugguguaguacucagggaauagcugguaacuggcgaggcuaggauuccugcaagcauuguuucccugagccaaaccaugugguucccagugagcacgcaugcuugcaugugggaugcuaaguucucacuggagaaagagcgagcaugucagugcaccaguuaguugguuuugucauuuucuacgacgaggucucccugacugucauggaacuaacuguguagacuggucuugaacuggaguagauugcuuguuucugccucccgagggcugggauuaaagcugugugccacuacacccagcuaauuccuugaauuucaguagucauauucugucaacuuggugaacauuaaaaugcucauagcccauucuggaucaucagaauucuuaaaaagaaacuuuccuauuaguggauaguccaggguauugaauauuugcuauugguagcuacugauuguuguauuugaugaguuagaagccuguuuuuguugcuugaguuaaacaauauugcauucugcaaauucucccugucucuuuuuggaaugacggguugaucuagaccugggcauuauucuuggaaguuuguccuagauuaaaacguacuaaagagaauccaaaggcugggaguaguagaauuugcuguguuguucacuguuugacuuugagauagaguccuaacuguguuacccagguuggccuccaacuucuuauucuccugccucagccuccugagugcugggauugcaggcaggcgccaccauggccagagauuuuuuuuucuaaagauuuauuuauuuauuauauauaaguacacuguagcuaucuucagacacaccagaagggggcacccaaucucauuacagaugagucaccaugugguugcugggauuugaacucaugaccucuggaagagcagucagugcucuuaacugcugagccauuucucuggcccggucagagagauuuugcuuugcuagaaaacuagauaacgaagucucuuugagacgugaguuugaaccccaggguuucagcagaagcuugguucuaaugcuuugguuuuucuuuuuuucuuucuuucuuuuuucuuuuuuugguuuuucgagacaggguuucucuguguagcccuggcuguccuggaacucacuuuguagaccaggcuggccucgaacucagaaaucugccugccccccccccccagugcugggaucaaaggugugcgccaccacgcccauuuuucuuagcuucacuuugcuucauucagcuugcuaccauacaugggacaaagguuugaaaaaugucuaagaucuaagaggacccuugacauguucugucaugauaagaguguaaagcuugcauuguuuguaugucuuuuuguaaugaaaucccacaaaauuuauauuaaucguuuuaggcauucaguucagguacauuaaguuuauuugcauguugugcaguagguccccagaacucuuucaucaagcaucauuggaaacccuuugccuauaaacaacucccauuucucuccacuacuaccccauccuggccacagugucugaauuugaugagagcugcauaacauauaaguggacucccacagcacugucuuuuuggcuuguuuuauuuuguuuggcauaaugucugugaagcuuguguuguagcaugugugggaauuuccauuucucccugugugggccaggcuggccucagacuuaggaccuccuuuggagacuguagugcuggaccccuaggcaggcagccacaguuucuccuugcuuuccucaguacuagggauugaacccauagccgugguggugcuguguaagugcccuguuacucagcuguacccuggcucuuuuuaacuuguauuuugacugugucagggucucccuagguugucuagguuggacuugagugugcuagguaacuuagcuaagccuugaacuuggaaccuuacuguuucagcaucccaaauggaauagguaugauucuaggcauaugccauuauguguggcuuuuuuuuuuuuuuuuuaagagacagaaucuuuauagcccaggcuagacuugaacucagcaaucuuacugccucagcuuccugagugcagggauaauauuugucuucagccauguucagccugguuucuuuauuauucaguuuuugaguguacaaaauaauagguuucauuauaacaucuuuaaaaaauauuuauuaauuauauggaaguacacuguagcugucuucagacacuccagaagagggcaucagauuucguuacggaugguugugagccacuaugugguugcugggauuugaacucaggaccuuuggaagagcugucagcgcucuuaauggcugagccaucuccccagcccucauuaugacauuuucauacacagaugucauguuaccuuguuacuauuuacucaugcacaacccucccucucccuccuuccccucugcuuuuaugucaugugcaggaauuuuaguacuauguauuguugaugccaauaugguagagaauacauaguauauagaagagaauacacaguauauaguagaggauauacaguauaugguagagaauacacaguauuugccuuuucuacccucucuuuacccucuagccuguuuuuuuguuuugguuuuuuuuuuuaaguaugugcaguuauguauguguguggaugugggcauauguggaugugugcguguagaaguuagaugacgacuucagguguuauccuuagguuccccacccugacuuuuuuuuuucccuccuuuguuuguuugagacagggucucacuauguagcucuggcuguccuggaacucacuauguagaccaggcuggucucaacucacagcguucagacugcuuuuggcuccugagugcugggagugugcacuaguaugcuaguaugugcuccucuuccagacaccaagcugucugugguuucuuaaccuucaaaggcagaguaacacuccuuaauguggacauacguccuguuucaucuguccccucauccguggacacuugggcugccccugccuuuuagguuucaugacucgcgccacgaggacaggugugcaguaccuccuccagcuuccuuucacuucuucacguguacccgaggcaggcucugcaucauaggccagcuuuauuuuuaauuuuuuagugaaugcacuuuuuuuuuguaccuagguacuaauuucagcacacuggugguaacucauucauucauucauucauucacucacucauucacucguuuugaauagugaccauuguagaaagugugugaugauaggcuauuguguuuuuuauuuucacaucucuggauauuagaucugugggcaucuuuuuaugugcuuguuguccuuuuauucauauucucuagaaugaugucuaauuaagucauuugccuaggcuuugauggggggguguuguuuuguuauaguuuuguacauauuacggguauuaacuuuuauuugacagaugacuugcaaauauggucucuuguucuacaugcugccuuugcauucuguuagugcuuccuuugaugagcuggacauggugguguacaucauggaagcaggaagauuacuacaagucaaggccagccuggucuacauaguaaguucuaggccaaccagggcuacauagugaaacauuaucuagcugucucaaaaaaacaaacaaacaaacaaacaaacaccccaccaacaacaacaacacaaacaaaaauggggagaaagaguaagagugagaaagagaagagagggagauggacaggggcuggggaccagagaggagagaugccugcaugggcugugugccccaugugugugcagaugccugagggccacagggugucugauccccuggagcugcaguuccagucaggagccaccugguguggaagcaaggaacuaaaccugggucuuucggagagcagaaagugcuuuuaacuguugaguuaucucuauagcccuagcagauauguuuuuaaaaaugaaauuuuccauauagcuauaauacuacauuuguggcaaagaaugcacuagcuaaaagcugccucugcggaaagguuugggaguuugugugagguaacuucaguguaacugacagagggggagcagucuguacugaagacauaguaaggacugacaggguuuucuugguugaauaaugaugguaaagggagcgauacauuuuuagagggaguuuguuaaugcacagaugugcuuugcauaucuuaccugcauuucuagaugcuuugagaugcaguuugucauuccaaaauugguugagcagggugcuuucaggcagcacucagguaaagcuggaccacuuuuuacauugcugcuguggauccagguuccucugaaaugcugcuccuugguuagcaaguggaauggucagcacccagcaggccagggcauggucuagaugcagagaguuucuuucugggagugcaguaguggacaugguuauguucuagauacagggagcuacuuuguaugcguacuugugguuagcacugccagcaggcaacaguggcguucuaggugcagggaguuacuuuuuguugaguagcuuugguuacugcucaggagcuuugcuugggcuguugucugggccucugagaagguuauuaagaaucgugccacagagggagaugugagaaagaagauagaggcugggauucaaucccgucuuacuggaauccuauagauucuuauaagagaacauuucugaauuuugucaauucuuuccugacugcaucuggauguauuuauaguuagagaguauugugggcuucuugagguuaggauguguuaucacuacccuagcccuuuaaagggguuccccacacccaggcauggugguacaugccuguagucuuagcacuaagaaggcugagguaggaaguucacauuggaagccagccugaggugacauagugggacaguuggccucuguguuugugcaggcauuugugcaugugucgaguucugcauuggaguaaauuuuuguuacucuaacaaauacuugagauaagauuauagauaaaaagguuuauuuuggcccacacuauggacauuuugguccguggccauuuagacucauugcucuuagguuuguggcaaagcauggugggaggcuguggcagagcagagcuguugagcacguguccaugacacaccaagagcacaggucccaguuuuuuccacucuuuguugcaccaggggcgcugucucugggaccuggaccuuugcagcacaccugaaucuaagcugagggagaagccacaaaacagugacuauucaagguggcccagaguguagagaaagugcuucuaaauggaugcucucuuuacacacuugcuuuucagcgcuuucgaacugugugucaguugaacaugcuucccugauacuccugcuugguagcuauucaggucuccugaguccuuucuugcucuccaguguggugcuguuuguauugcagaccucagcauauuuaguccucacaagaugacagccucccucucugcuucauauuuguuuagccuuggcuagaguguaccugugguguaaggcccagugcagugcugcuggagggacuugugacaauuuacucaagauucuagcuuuccauaaggagagguggugugauaugugugagcucuuuccaugcuuacagcuuacagcuugacuuugggaguugcaucucccacacccccaccucccagacagggucucucuguguauccugucuguccuggaacucccuauguagacuaggauagccuugaauuuagagaucugccugccucugccucccuaaugcuggaaucaaagguguguaccaccacugccugguuguuuguuuuuuguuuauuuguuuguuuucuuuuuuaaaaaauuaaacaaaauuuauauugauuauauaacuaaaaacagaucaucaaauaaaguuuaauaaguggugaaagauugguuugcuuccuuuccaugagagcccacaccuuacuguaucuuccgcuuucuuuuuuaaaaagauuuguuuuuaugugucuugaguguuuuacaugauauauaccuuugaacgacuugugugccugguucucacagcagcuagaugagggcaucagauccgcuguaacuggaguugugagccaugagcucuggaauuagugcucuuaaucucugagccaucucgccagccccucuguuucccacuucaaaaguguauauugccagauugccuaugaagaaaacuauuguuucaacauacuguaugagggcagccacuuccacauacugacuguuaccauuuuuuuuuaaaucacuaagucacauugugaugaaauaguuacuguaguaagagugggcacuuuaaaacauuugcuggcuauuucuauuucuaucugauuguuucuuuuguuauuuucuccauugacauuugguuuuuuuuuuuuaacuuaaauguguacuuaauuaaagacaguguuuuuccaagcuucuauuuguuuuggaauuauuuuuuauuuuucuauuauuuuuuuuaaucugucaaaucugcagcucuuguuuuucuagcuuuguuguuauuccucaaaagccacacaaagcccuguguguaacaauugugugcucacuagaauuucaucuucaugcaucuguuuugugcugcagaucauaaaauucguacacacgugugucuguguguguguguguuuuaacuugugcuauaggaaacuggcauuuuuauagguacaagugauuaaauagcauagcgguuucucuaccuaauauugaucuguauuuuuguaugaauuacugcauuggcuagaguuugagaacagugcuggauguaaggaguuaaaaaggcaccuugcuuuauucuagucacuaagguagucacacgccuuagaugucucacuuccaaguuugauugaaguauuugauuaaaaucagauguucucgauacaguguucugaaauacuuuacuuaagcauuaucaggaguagagguuacauuuuaucuggugaggugguuugguaguuugauaguagugugggcccugugagggacagcaagcagcagccucccccugagcuccuccuaagacuguuuccucuggagaaccuaucagccuuuccuuucaguagaggugugcccaggcugggcugcccgugcuggccgcugcagcuuacauuuucaccugcucagugcgcuucuccguauaguguggcuuuuuaagcaaguguagccuuaaaauaguuccgacacugcagggagcuaucuuuaguguuagcagcaacaacaaaugccugaagaccaaacucuaagaaccaggaaaagcguucuugaaggacauaauagacucagugaaagacacuugugcgcuaggaaacacaauuuaagaucaguucucucuuauuuaaucugauaaaacuuaaacguguaaacaacuuuuuauggcauuagaaaaguugauaaaguauaaguagaauguggaaaugcugggugggugcugaagcaugacggaguugcaagggcguggugggcacaagcagguauugggccuaagggauccauuagugggcuccagucaggagaguaauggaccgaagucugggugguuccuguaagaugacuggcauucugacagagguguccaugugaucagcucuaaaugaauaccuuugaacccauuaucagcuuccaauggaagccuugcuagguuauaguuucagcuauaguggcuuuaaacaacacaaaucauucucuuauggugcuuuuuauuuguuuuuugcuuuuuuuuuuuuuuugguuuuugguuuuuugagacaggguuucucuguauggcccugguagucccagaacucacuuuguagaccaggcuggcuucgaacucagaaaucagccugccucugccucccaagugcugggauuaaaggcgugugccaccacugcccguucuucaugacuccuuuuaaacaugagccaugagucccucuucauccugccuggccucuuguuucuguccuuuucucuuuaguuuccugucaccccuuuucagacuggggaaguuuggcuugaugacagcuuuuaacuucuguugugcguuuggagaugauuuuucucuuccagugaggggugguuaauaugaauugccggccuggcaguucuugcuuggucaucaggguuauccuuuaaguguauuguugacucuguuugauucacauuuguuuaggaauuuagugucugguucccaggcucacgucuguuuucuuguaacaacaguuugaacaccauagagucagacuggccccguagucccuguugacaggguuuuguuuuguuuuguuuuguuuuaaucauuuacuuuggagcaguuuguaguaccacgaaaguuaucuagcccugggauuuucuucuguggauguuuuaagguauaauguaaauuuuuagaacauagaacuauuuaguuuuuuuccuaccuuggaugagcuuuggugacugaaccuuuaaaggaauuuggauauuuuauuuaaguugucaaaguuauuaacaaaauuaguccuaauauuuccuuaugucuuuuuacuauuuacaaggccucucuugcccuugguguuuaucauuguucucuugaugaguaucauuguacaagcugcccuugaagaccccuucuugaagagucugccuugaccuucucagugcuaggcuuauuucugaugcauuuuuauuguuugauuugcuuuuuuuuggcuauacuuugcugucuguauuuuauuuguauuuuauggguuuguuuguugguugguuuuaaggugaaaacugauuuucagccuuuagguauuuauugaagauuuucuuggaucuguagguuaacaguuuuuuuuauuaacuuuaacacaaauuuuauuucuuaggauugcuuccugucuugccccucccuacuccauuuuagaagcucugaauagccuuguaguagacaggaugaaguugaccuccagcugaccuuucggguugggcucugugcugagcaucacagggcugugcuggcuuaccugcucgcuggccuuacuuuccuagggucugauacuguuacauccaauacacuguucaucuauagaaauacuguuuuguugugguuuuucuguauuugauuucucuuguaucuacuucuuuuuccaggcuagggcucagcccaggcccuuggcaugauaggaaacacuuacgcagagcuacaaucccagccucgguuuucuacuuuaaaaauugguuuuuggacagaaggcugaguccagggucuugcauguacuauuucaacuuuccacuuugagaugguguuucagugaguucccaacugaccuugcacuuacaguguugcacaccucggucaguucucagugagcuguggcucacugcucuuguauguuuuccugugugcuggguagccuugggcugagugcugagagugggggaggccuacauugguagguacuguuauggcaucuuuuauucuccuauagugacugucaucuccaaggcucacugccuccaucugcugaccuaggccuaguccuggaagcuucucgucuccauacaaucuuauccaggccuagaaugucagccucugaaacuuauugcugaauaagcucacccuuucuaguucuuucugagcucuggcugguugguucaacucagccguucuggcccaaacuccucuccaagcugacugauugaaucugacuuuucucugccacuccugaauggcucugcuugaccucaaacuaacuuuggcaaucuguucuacuggcuccuucucauuuucuggcucauucugucuucaccugugucuagcuuguucuuucucuucaaccugucucuguaccacugucccaguaaaaacucuucucugucucugcacuguucucuuuaguagcuucccuuucuucucucuuaucaugacaguugggcauaucuucuucugucaaaucuuucucugauuugucacuuugccauucaguuagacaucacuuucaaacauggcugcuuccuucuccaaacuaacuuuaccuucauugucuuggauuaaagaugugugcuaaguaaggcugagcugcaccacaauuggaaagagguuuuuguuuguguguuuguuuuaguaaauaacacaaucuugggguucacagugcaaucagauaucuugcaacaagaugcugguaucuuuauuccuuguaacuguuuugagcuacgguggaagaugcaggaaagugacuuggaaaugucacuccauugaggucuugcuuguucuuguucuucugugcuugcuuguuucuggugauguuggccuuggauaagcaggcucuggcccuuugagcugcuuccccgguuccuugaggucugcagcugggcgccucagguuuggauuguucucuagcaacaaggcaugacuucuuggucuacccuccaguuuucugugagucauagggcuuaguuauuguucuuuaguuucauggguuggaauagauggucuuccugacucaugugaacgccagacaagguggcacgagucuucuuuaucaguuacuuccccagccuuagguaccucagguacauaugugaucagcauuuugcugagagcccaguggagaaccccacccucuaccccuuuagagaacauuuguuacuuuuucacauuuauuuuuauuauuucuaagggguguguguguguguguguguguguguguacacaugggugcccucagaagccagaggugucaauucccuuggagcuggaguuagagauuguuaugagucaccaugugggugucaggaaucaucaaacuguggucuucugcaagagcagccagugcucuuaaccacugaaccaccucuuuccccauuccugaggcucccugccacagcucccugcccugguuuuuuucucaggaguccucacugccugcugucugcagucucagcuucuucucagcuuagacuuggagaauucacugaguucuaguaguuucuccugccacauuguggccagcaacacaaggugagcgaacuccaccucaugcuguuucuugcuuccaguuuucaaggucuugagcccacccagacaggucagaugcaucuuaaaagcaucugaguagaaucuugguuucuacugcaccagugguugccgcuccucacaugaucuaccacauucacaggguauugagauaauggcggaaccugccagggaagccuguagacauuaucauguucucuacagauggacagcuuggagcaccuauguccucugccucagacauuuuccucuauagaauaaagaaguaugauuuuuauagagaauuuucuuacucugcauacaugaaaccguauuagaaacagcaaggcuguaaaccugcuuuucaguaugaugauuuuguauagauuuuccucuguaaauauaaguuaggguucuuuauguagcuuucacuguccuggaacucacuguguagaccaggcuggccuccaacucagagauaacaccuguugcugcugcugccucccaagugcugggaucaaaggcguguaccaccaccccuggcuggacguauuuauuuaaccagguguaacucucauuuuuauguugagauuuuucucaggguuuuguguuuguuaauuucuacaaauuuuucaagcuuaugaaaaaagacuaccacaaauacaguuucaggaacuaugucagcugacuuuuuccucuuagaaaucauauaaagguugcuuccgcuuaucacacugacuuauuuguugcuuuugcuuguuuaucaaacagagcaagugcuuaugugccugggccguuuccucgcaggccuucagcagugugccacaggccagcgguuauagacucuguagcagguguugggauuguaggucacacaggcuccucuucgaaggcucuguacacucucuauggacaagaugauuuaugugcauuucuaaacaguuagguucucacagcugcuuccaccgauggcauugucacgugucauuucacauaguugcugcugcagcgaucucugggcucaguguuugaccucugucuucaaauguuuauaucgcagcugauaaaacucuuaaggcagaccucacagugcauggggagucagugaugucagucagucauucucuguccucuugucuuucccccaucagcugcauuacaaacuugccgcaucagagagggcuugagagggcuuugaugcgggucagugagcuggaggguggcgguggcgguggugcuggggcuggggcugguuuggaagugcgcagguguugguggcaccugcugcugcuuuacuuucuugugcuuugcuacugcacguccagggugaaaaugagccacaggcccagaagggcagacuuuuggaagcuggucaaaaugcuugaugaugcuuugucuuuguggcagaacucagucugaguugucauccucucugcuggcccuagcccugggacccagucagcaagcacguguccuuuuauuucacccggcugguuucugccuaaauucauugucugcugaauaggucagagguucucagaugaaugcucuuauauauuaguuugucauuuacuaaccauguaguucccugcauggaaauuccaaaugugggcuuuccuugacugaaauggacgugccuaugcuucuuguauucucaggcacuuugucuagguugaggaauguuaguguccgguaacuuuuuacguagagacauucugcccuuuguucugucuucacuauacucuuaacuuuggcuugcaucucuacuuacaucuuuuuacccuuuuuuacucagucaagcugcauaauguuauugcauaauucaucgguaccuuuauucuuauugaacagucacaggcagaguggagcuaaggauggaccccagugaaucgguaggcauugcuuuaaggugguauuuuauuugaauaguguaugccaacuuuucauuccauucccuugcauaguguuccaguaggaaagcaaguuuccuaguguauccccuggaggacgagucucuugcuuucuacuuuuagcuuacagcagcacuuuuccuggcaacauuucaguucuggccauagcugcacuaggauagucauucccaguccacaggaggagagguggaccacaccagccgcccgggaucuuggauugcagaggugacuggccuggaggcagaugccccgaccccugcagagcuccaccccagacaggguguuuccaaaggugcugagcagaauuuagagcagugacuaauuugcauuauaugauaacaucugguagguagcucuggaaucaaagaagggaaaauaugagccagcuacauuggggagugugaacuuggagcauucucuuccugcuucugguccugaaguaucuugaagauacacacauuagguuguuuuccugugagcagacugucuauagagaaggauggaacagucuucaccagguggguguggagauagauucugacucacugcaggacugcacucagacucaauggcagccuaucaagaggcgugccagcccagagauaagcauuggagauagcagagaaggcuugaaaggcucaguaaugaggaucuguaaaggaaaugguuuugaaaacauaagauaggcauuuaagugucugccuuaagagaagggggagguaaccggcuagcagaagccaggaaacaggacccaaacaaaggcagccuggccuagugccugggaggaccuggugcuagaacagcaguguuuguuuauccaggcacacacugcugcuccucucaaggggcuggcucgaaguccaaguucugggugaccucagugccuguagcauuggagauaaaagcuuaaccuagauauacccaguaguuacaaauuguuccuuagugagugaauuuaucagcuaacuaacauaaauguugccauauccucuuuauuguaaugggaguuccuuagaaaacugguuugaguggagagcuguagauggccuguaguccuugauaacaguagccaggacgcuugcucuggccaguaucugucugcagcauaugggacagguggaggcuguugagaguuccccuugccuccugcacuuccuguaagccagcacugcuugacugguugugaagauuucuguuuguaucuaggcagcuccucugagggugggacuuaacucucagaggccccauugcagugagauagagggccugcuaguuuaucugugguacacauggcccauggcaagggcucaguaauucugcuuaaccacaagugggacuggcucaugucccacucauguucaccucagaacuuuucgcugcuaucuuaaagucuuaauauacuaaauauacuuaauauuaaaaugccaccugaauuuucaauugacuuuuuuacauuuacuuuguguguauauggcacaugugugaaggucagaggacaacuugugggacuugguucuuuccacugugugagcucugggacuagaacucaguaguuaggcuuagcagugagugccuuuaccagauauuucaucccacuggaccuuuuaaauauauucuauuugauuauauacagauucugugagccccuaucuaguaguuacaucucauuuuuugucuugauuuuuuuuuucuuuuuuuucuuuuuaaagacauggccucagguagcucagcauggccuguguagucagagaugacucugaacugcugcccucuuugccucuaucuccuaagugcugggauuacagauguguaacaccauacccuguuuauuuggugcugggacggaauggagggccucaugcauacuaauuagacaacacuguaccagcugaauuguuuccaccccuuuuacaucucucuauucaggcuccagccagguuagacuggacccugguaaguuuauucaugaaguuuuauucaguaguaccauuuccuaagcuagaccuggaaacagucuuuuaucugauggcugaacagauucuaggcagacacuugcuuacuggugguugcugugaugggccuggaauugggggcaggagugcacuggggacguuggggaaggcacaccucaggacacacucagugugagucagucugugugucuccuauaaugauuauuuucuuauaaguucagcuuuuaaaaaagcuuuugggauccccaaauacacaaaugccaucuaaagcugucauuguucaggaugagugacccauuugggagcuuaggcaguaagacacuguaucuuuguuacaaggcaucuuugucugcagacucuugaauuucuuuuuuugccuucugccuccuaccuaaaaaggacaaaaccagaacaaacaagaaaagauagccacaggaaacagugguggaaggcauugcugcaggaggugggagagaguguguuaggauuagagacagcagcauugagacuccaggacugacugacuucgaccaaucaaggauccugagucuggcuucccuuagacuaaaugggaacaacuuuaguuuaaagauucucuccgcuacccaccuuuaccuucuucucucuccacuggcaacucucucgaaaagguucucaaugcaguauuuuauuuagcagguauuauuuuuuacuauaaucuaaguacuuauuuaaauaccuuuccauuuaaucuuacuauuuuuuaaaaauagguguuugugcgcaugugcacacauaugugugugcgugccugcaugcgugugucaggguccacagaggccagaagagagcauugguuccaaggaacaggacuuagaggcaguugugagcugccccaugugagugcugggaaccacacuuggcuccucuggaagagcagcaagcacucuuaacugcagagcuguuucgaugccuuuauuuuuauguuuccucuuuuugaccuggucuggaacugaaauaaauggaaccuuuucagagagcugacuucauggccacauaugaauagguuuagcucucacgcuguguaaugauccacaucauccuuaccccagugcuuuuaauaugcugcuguucuuagguagaauguaaggaagacauauagucauuagcuucuaauauguauauaaccuauauauugaucagcuucuaauggggagaauagucauggugaaggacuuaggguggaaucaagcuaacucaguuuugcugagucaaagugaucugggacucaccaucuuccugccucaguuucccuaauacugggauugcagguguaucccaccauuuccaacuauaaguaugccuuguuuuguuuuaaguagugggcagaucugugaacagucuguggaaagcuuggucagagcaagcauguuuuccugauaaaugauucccuuacucuuguguaggagacaggcucuuaucucuuguagagacuaagcauacuugggaggcgggcuugccucugaccuugggcaaguguuguagcccucuugucacaccuaccugaucugcuuggguggguaccauggaguacucaccuucugagguguucuaaaugauggugaauaggcuuggcaggcagcaggaaguacuagaucuggauuagcuguuacauauucauaguauguuucagugggaggugcuuaugcaauaccaggcaagucacauugcuguuauuuucagcuggacgagaccaguuucuuggucugaagauaucccauguauucaguugagcaaacauucauugaggaucagugugcuagacauuggguuggucaucagcaccccagcaaugaagggauccccaacuucuaggaacuugcauuuucuuugugguguucuuugucuucccaaagugcuuucaagaucaggacacaauuugaaaagcaggagaaauuccaaaaaucgggggagccauccacccagucacccagucaccuaccuaccuaccuuccuauauuccauauguauugguguuuugccugcauguagucuguaaaggugucauccccuggaacugaaauaacagaaaguugugagccgccacaugguugcugggaguugaaccuggguccucuggaagaacagccaguuuucaacggcucagccauugcucucuccagauuccuuccccccccacuccccaaagaagacauuuaggauagauuaaaguacauugucccuccucagauguugcuguuaccacuccaggaagauucugucugaguuggaugugggauuccauauuggcuuauucuugcugaauaugcugcggugaaagcagccaacuugcuucguaagguuaacauguuuuauggauguguugucugcuucaugacggugaaaaauauauuuguccguaucagauagugauagcaaagaaauaaacuugguaacuuuacauuuaaacuuuuuaauuuuuuggaguaggguguaguaguguugccuauguucccagcguuucagagacuaaaacaagauuguacauuccuuugcacauuagacuacccaguaggauuuauucucuucuugcagugguagccgccgaccgaacuguuacgucuccucuucagggguuuggaugacagguauggaucuauaggagcagucuuuuuuuuuuuuuuuuuuuuaauuaagaaaaauuuguaucuguaugcaugcauaugggcucgugcccaucugaguguagguaaucuaggaagccagaugacguguucaaauccucuggaacgggaguugaggcugacauggguguuggcaacagaacucgggucuucugcaagagcaguacacacgcagcugccgcucuuaacgccacgccaucucuguggccccugcuguucuuggucagaaucuuccuuuucacuggguuuucuucucagagccugcucuucuccuaaguuguuuuugcguggcccuucuuucuguacucauuaaaguuuuaagaucuggcuaaaagaaccacagggcggagguccugggcaacugccaucgacuccuaacucaucucaacucagaaucacacuuagaucauguauucauagcaggcagaggacagaaaauauggcagcuuuuuagguuagccuaggcgaagacuaguuuauacacuggagaauuucuuucauacuguuuagaagcaguuuuaaauaaucuacgcuguuugggagguuaguggaguugugccagucuuucugguuuguuguuguuguuguuguuuuaauuaauuuauuuuuuaagacaggcucucacugucuugacugucuuggacucacuauguagaccaggccugccugggccuccugggugcugggauuaagguguguguuauacaacgccugccaguugugccagucuugacccagcauucccauuguccacuacaugcucagcagaggguuccauggccaucccugacaggaguacuugguagguuguagcucucuccugugucccagcucccucauguauguagaugaggacccaggucuggccaagagccaguguuuucccuaguuuucuuugauaggagcuaauagcaaaagguaaacuuacuaucaguuaaccaccccaaacccaaaacugaaaauucagaaugcuccuaauuuugagggcuuauaugcugccacaaguggaaaacuuuauacccgauuucaucugagaggucacaggcaaaccuagguacauagcuggggugcggcucagagauggagcacguggcucccucacucauguuagagcuugugcucagcgcuguaaaccacaggcaccgaaugcaugcccacucagaauacucucugaaauuuccuucaggccauguguauuccuauauguaaaauguaauuuuuuuguuuguuuguuuagacuugggucucaucccuaaaagcauuccagaaucugaaaaaaaaaaaaucugaaaucuaaaacagucuuucuguuuguaauuguuugcaguaugugacacucaguuuguacuugguaguuuauuccugacuuaggaauuucuacccuucuucccagggaauuaagcuaguguauacucuuuacccagcagcacagagagcacauaguaggugcugcuagacauuuguguucguguuaauuucuucugguuugcugugaagguggagauaaggaaaagacucuacaguggaauugacuuagaaggacaugugucugcuguauauuaaaaagcuuaguggauaaaaguggaccuauucuuagcuacaugggauucuuguuuuccucaguaacauuuauucgacuauuuuaaggaaaucauggaaaauauugacuuccuuccuaaugguguccccugaggcuuccugcacugccacugagcuugcuccacacgagugguaugugacucuggaccuagcuucagaaaugggaaaugacuugagcaacaauugcaaggaaguagaggucagaggucagcauugagaaaacucagcggaagaguagaauguuguagccguuucccacauuccuuagcaguguuuugggcauugaagcucuuuuaauugagaaaggaaacgaggucuuugauuggcagcugggugauggggcugugcgguggaggugcagggaggcuucugucuacagagaaacuuccaggaaugaacacuggauuugcaaguuucuuagaaguagauuggacuaucagaauguuccuauacgcaggcuacuuugagcuuguggggagagaaauggauuuuggggaaacauucuaauuuaaaaaaauguuuuauucuuucagauguuacuucaauccuaugcaaauauuuugaacuuuaagaguaauguaccacauguacuugcauaggucuagaacuuguaagaaugugguauagcauuagcauuaccugguauucauucauucauuuauuuuuauguauagucccagcuggccuuggaauuugugauccuccugccucaaccucacagguucugguguuagaggcauguacuaccaaccacuccuaauucguuuuucugauuccaaacuaauguucuaguaaguauaguuucauuguguuuccuuuccuuucuuccuuccucuuuucuuuguguguguaugugugcgugugugcgugcgugcuugagugcgcauguguguguguauuggagucugaacucagucuccauacauuuuacucaugcucucccaccaugcuucccuccaacccuucaguaauauaaagcugacuagguacugggaucuuaggguagaaaagccguugaaauacauacagcacauaagagaucgugaacagaccaaaaguaaggggcagcuguguuugucuucagagugugaaggcuguggcagggguguuaagagcugcccucugugcugggcgguagucguauaugccuuuaaucccagcacucgggaggcagaggcaggcagauuuaugaguuggaggccagucuggucuacagagugaguuccaggacagccagggcuacacagagaaacccugucucaaaaaaaaaaaaaaaaaacaaaaacaaaacaaaaaaagagcugccuucugagggaccuuagcacaucauuuuaugcaugagaccuucuucuaggggaaaaauaguauguugacugaguuuuauggauugcaucccaccaaacucccuccgcuuauuugcuucauaggaauacuuauugugcaguaagcuucaccaguuuuaaguauucucagauuaauuuuaaaaacgugcagcuguggaaacaggaacguucauugucuugaaaguccguggcuucuucuucacaguuaguaucucccucagugggccaggcagcuacuugucgucuuucugucacggacucauugucuugucuagacuuucagauaaauagaucauuuuguauggaguccgagagguuugacuugauucacauagcuuaagcuuucgaagcccuugugcugcgugugugugguaagcguuuauugccgaguggagagaucccucuguaugauguaaugguguguuccuuaccuacuggugaacuuaacuuugcuuuucucccuauucuggagccgugauguuuaaauuuuuuaugaauguccaagaagccuuuuuuaaagguauuguuucuuucuugaaagcaccuagaauagguugaugugucugauuagguggugauguuuaauuuuaauaaacugucaagcuguccucagccaugugagaguucuaccuccuuguguaggauaucuuuguucacauucgacauuagucauuuuguaaguggguagugcuguguuuuguuacuguuacuagaauuugugaaguggcuagugguaggcaagggccaucuucuguucucuuuggccauuuguagaacuccuuuuguuuucagucagaucuucucaauuuuuaucgagcugucuuauuaauuuuugaaaguucuuugugucauagaugcaaauguuucauuagauauauaguuuauacuuuuucuacuauauagucgguguucucauuuuugucuuuauuucuaaaaaauggagauggggcuagagagauggcucagugguuaaaagcacugucugcucuuccagaggaccuggguucaccaaaucuuaguacccacauggagagcuacaucucuuuauaacuccaguuucagagagucuaaugcccucaucuggccucugcaggcaccacacauucacauggugcacagacauaaccugugagcaagacaugcauacacauaaaaaauuaauaaacaaucaauuguugguuguuggguuuugagauaaaguaucacuuugggucucacauucucaaucuuguccuugugacuacaggcacacaccacacaccuagcuauaaacaauggcuucugagaauaaauguuuucaauuuuaaugaaguacaaauuaaauuuuuuuucauuuuugauucuguacuuuuuguguccuauaagauuuuuuccccugaaccaaagugacaaaaauuuacaaagguuuguguguuuguguagaauacacaggcuaggaguagacuguuguuacugaggucugaaaugcacucugagcuaauccaguguucaguggacaucaacagucauuauuugcauaugccuauucaucuguuucagcacaauuaauggagacuaucucucaccaaauugcuguggcacucuuuuugaaaauaugucaaucauaugugcacauggcagugcuuuagauugucagugcuauucuuuuucggguggaggucaaacuuauucaugugggcagguauucucccacagaccacauccucagcucucugucacacuuguccuuuguuuguugcagcucaucuuuuguuuauugaaacaggaauaugucauauggccuugaacucuuguuucuucugccucagcuucccgagagcuggcgaggauugcagguggaaaccacccuaccuggcugcuuuucuaauuucucugaaugucccugaauuuuaaaccuaugaaauuaaagcuuauaacugacucacaucagugagaucacaaaguagccugucccuucccuaucaucugagcuagcuggugcuucuguuuauagcuaggagcaaacaccaacaaugguacuccaagcuuguacagcaacagcagacuagaggggagugaugcauugugccugcuacuagacaggacaauacagugaugcuuguaugcucacaaagcaaaagcuagagacuaugaaacuuacaggaacaguaaaaccugcuguucagagagacaggaaguacuuggauuuagcccaacuuuugguuuggggucuuagauuagucuuagacacuaagaaccugcccaaacccaguagugucuuuuuuucucuuuguaaaaucucucacauaugacuaucugguuuuauguuaagauucuguugaaugguucuucuaacuuaaaauuuaucagagauaagcuguuaaagacuggcaaugaguaaaacuauugagccauguguuuaaaaaguauguuuaagggcuggcgagauggcucaguuguuaagagugccgacugcucuuccgaagguccugaguucaaaucccagcaaccacaugguggcucacagccauccuuaaugaaaucugaugcccucuucuaaauacauacauacauacacaaauacacaaauacauaaauacauaaauaaauaaaacaauuuuuaaaguauguuuauagcauuaaaaguuugguuuaaacuauguacuaaagaaauauauucuuuaaaucucuuuuucuaauuauaguacacucucaauuuaauauuaaaccuacagaauaaaccuaaaugaggcccauguuuuucuaacuacuuggagucauuaauuucacuuaaaaccgauuuuacuuuauaaaugucugcuugugcuuacugcaagccuuugcugucaguagcauucuguucuggggcuuucuuuuuaacuuuaaagaguacaguucuuacgacgcuuagacgugauugguggaugcugaaggaaaggaguacuuauuggguguauggucucauugguccccgucuggaagauuugagucaugagcauguuuggguacauuaaaaugaagcuuuaccuccuuggcucuuuauuaaaacuucauuuuuagguuuuuggguuaguuuguuguuuugauguuuuguuuuucacaacaggguuuucucuguacaaccuuagcugucuuggaacuugcucuguagaccagguagcucucaaaucagaacucaaagaucugccugccucucugccucucugccucucugccucucugccucucugccucucugccucucugccucucugccucucugccucucugccucucugccucucugccucucugccucugccucgaguguugggauaaaaggcgugugccaccaacgcccuggcacauuuuuauguuuugauuguugagcaguuuucuuccucacugguaagaaacuuaccugacucuuggcaggcagaggagugcaugugcuguacacacucggcuguagcgucugcaugccuggcgcccgcacacuaugccccacuccccucuaaccucaacuuguaguccaucugggaggugccaugaccucaaacagaaaauuccuccuaaguagugacagugacugcuuuugcauucucuuuccccccgaagggaaauggccuccaaauaggccuacucuaguaggugcaguagugggaaaaugaagggccaugaugcuguuagcuacuggacagaugguuggagcuguagaaaugcagaagagagaggagaggugaaauucaguauugcuauucucagguuugacuaauguuuuaauggaagugugauacacauuuaaaacacauuuuagguacauggcuuuugaauuauaugugaaaauaucagugaacacuccuaaguaaaauuuuauuuuuaagauuuauuuguucuuauuuuaugugcauggguauuuuuauguauggauguuuugcuugcauguaugcuuguauuacacaugcauucagagccugcaaggaccagaaagaacuggcauuauaguugcguauaguugugaggguucugggaacugaaccuggguccuuugggaaaacagucagugcuccugaccacugagccaccuccagcuucccaaguaaaaauuaauagacuauccagcuuugccauaauuuuucauuggaaaauacauuaguaaaguaaccaccuuuaucaguaguuauugucuuggaaaguacauggauauguguguuuucuuuuguguccuugugcugaaaguuugaauauuccacaaguaaauacuuucuaacuuagugacugaggguggaugccaucacauggcauacuucugguuuucugaaggggcgaguacuuccaaauaguaagccaauuggauauguggacauuguguauugggagaaaaugccuccuguaguugauguaagacaguuacuuggacucuuccuaaaacuuuugcauaaaaacaaccaaagaaauccuguauagaaugugggaaggaauauugacuuuauaaaaacugauauaucaaaauaaaguuaaugaaggacguuugaaguguguaguuggagcuggcccuugugacugccccagugagguuacagagaugaguauccucuccagucucuuugucaucuuuuggcaacaggucuugccuuucucuccuugugcuuacuuaguauauucuaacuuuguaaauuaacauaguaauuaugugauucauuugucagauuguauguguugaugauugcuuuucuuacugcugcacaguagucuguugugggauaguuaucacacaguugccagccacuugcccaggggcggaagugugguugucaccuguaagcaucuauguagaagucacugugucugucuuguagagaucccuaggaauggcauguguagguauagacguauacuuaaccauuucagaaaguacaacuuguuuuucagagcggcugcgccaguguacacucguuuccacacggugagccucagucaggugacuauaaagugcugaugucuagcuuggcagguggguaagcucauuugucagcucacaaaugacuagcuuuaguugauuaguucagucaacuaaacuaguguggccuuuucucuagugacgggggaucuuuguuguuaacuuuugagacagugucauguaguccaagucuugggcaguccugccugggcuccacgugcugggaugacagucaugugacuagcaacggugagcgucuugcccugugcucacuuugcugccauucagacugucuuuaccuaagugcucaucaaaucuucucuggagguucacgguugaguuuucuuaauuuaguugaaagcuguauuuacauauucuagauacauuuguaucuaaucuaaauguaucucaaguuuguuuugcaaauaccauuucuagucuguggcugguaucuuuacuauagucucuagaaaacuuuauuauuauuauucacuuuaaucauaucugacuuuucuuucaguuuauggcugugcaggcuuauguuccugcauuacagcuucaaaccucaggcucacuaacauuuucuccuagguugauuucuaguuuuagaauuuuagcucucacauaagcuuuaguguugaaguugaugccuauaaguacugagcucuggaaauuuccuugucuauauggcuauucaucuucguaugguucauugaaaagauuauuuuccccuauugaauugcuacaucuucaucaaaaaucacuugaccucaugaggugggguuuguuuucugaagucuguguuaucuguuguguuuauaucaguguuacaacuggucauaaugacuauggcuuuaagaagccaugagaagaguuaagacacccacucuuuuuuugacuuuuuucaaaauucuuuuagguucuuuacuuucccacaagauagaaucaucuuuuagauuucuaccccccaaaaagcccguuaagauuuugaaaauaaauuuuauguuauuuauuauguaugugacuauggaggagugcguguggcuccuacauggaggucagaggacaccuuguggacaggccaucaagccaucaaacacccuaagcucugagcgucucacugcuucccaaagcucugaagucaguacugcauuucuagguaacaggugcuccuggcguuuacauacuggugggcugcauuugcauauaggauugcacagauguggcagugaccccagcuuuucuugugucuuuggaugaaucauugauucagaaagggguuggggacuuuguauucuucuggcuucuaguagaguucauuuagaugauuuuuuuuuucuuuugagagagggucuggagagagagcucaacaguuacgaguaguacugcucuucaagaggacccagguuugguucccagcacccuguggugguucacagcaucuguaucugauguuuccuucugaucuggaaggaaacaaggcaugcacauaguacacacacauagacacacacaggcaaaauacuuaagacacaaaguacaacacuuaaaauuaaaaaaucauauuuggagaaauucaucaugagucaaaguaggccuggagguaguuuguuuguuuuguuuguuuuguuuuucugagaaggcuuuuaacuacaaacuaauuguauuugguauauaugggacuauucaaaauaacccuuuuuuuuuuucugaguaaccuuuggcauuuugagucuuugaaggaauuugcccauauuguaaccugaguuggugaccguauugacagaauuauugacauugcugcuggucagccuugucacaauuguggaaguauagcugacccuggcuucccuuccuucgagcauggcgugugucuuuucauuuccacuguccagucuccuggaagcuuacccacuuuaucacucuucccaaaccaaaagccauuuguaacauuugcgucuucuguuuuccgcuguuggcuuucuuuuugugaugcugaacauugaacauuaugguaggcauauacuggccugcaaccaagcccaauuguuauuuauauuauuucuucuguuuugaguguaagcuacucuucauuucuacuucuucagucauuuguggaggggguuauagggaaaacaugcaggauauggaucaucucauguuuagaauauaauuuuacauauuguauccuguucauuuauguaacauagauauuacagcucuagaacacaugucuauuuauuauuagauauuguauaacacaauaaaaucccccucuaguagcuaaauugacauaaguggaucauuuaacugacacuuucuggguuuuguuuuguuuuguuuuuaagaugggcucucuuaugaacucauuguagaucaggcuggucucaaacucaaagagauccuccugccucuaccuccccaagugcuggaguuagaggcaugugccaucaugucugacuuuaacugacauuuuaaagauagcuguaauaccacuauucuuacauauaugucaaaagcuuauuauuuuuaacuuuuuauaaaacuauuuauuuauuacuauaucuaaguacacuguagcugucuucagacacaccagaagagggugucagaucucauuauggaugguugugagccaccaugugguugcugggauuugaacucaggaccuucggaagaacagucagugcuuuaaccauugagccaucucuccagccccuauuuuuaauuuuuuauugugaauuucccaucaagcaccuuaaucccacucaucucccugccccuccauauccaccuuccacccuugcaauuuccucccacaaaagaaauaaaaauaaagauaaaaacaaagcaaaaugucauguggaagcuguggugugucacacaguaaacccuuuguccacacuucuuuauuugcagaaguucauugcagugggucccugguuugcuuugaguccucuggcuucugcuacaccaucaauaccgguucuucacugggauuccucccagauuuccuguugcccuuugucauggaggucccacagcuuuggaucugcagucccaaacccuucacaggcucuggcaguucauagaugguguagauagauguuggggugaaacaguucagaguccuggaucugggccugggugguggcugagcuggucagccugccagcucuccugcauuuacaccuccagggccugcucuccagcacugcuccaaugccccacuggcuagcugggccagcaagagcuguagccugcucuucugcccucaugcccucagggccagcauacccacuucccccaccaccagggucagcucuacugugcugcccagugagauucgggguucauucucccaagggcugcuaccauugacgggugggaccaaaaaguuuauuauuacuguaacaguugugguagcaguaaggacacuagucaccuuuguaaccagcacuucucacauggcauacuuaagugaaucuacugcaccuugauaugccuuguaaaaacacauguagcuaucuaguguuagauuuuuuuuaugucuacauaagugccuuuucuuuuuguaaauguuuuuuucuuccccuaucuuucccuguuccccccuucuguagcaagaauuuguaauccuccccuucagccuccagagugucgggaauuacagguguguuauacuauuacaccuggucuaagcuuguuuggaauaauuucaaacguuagaaguguauggggaggagcaugcugggcaaguagaugaccacaguuggcaguucccuuagcggcuuuguuugcgccucacuucccucaccacacaugcaggcaguauugacagauuguaugggcugugggcuuggugagcugugccuugccagcaugagacuauaagucacucacuccccagcacucauguaagaaagccaggcacagugacacacgcuugugaucccagcaccagagaggcagaggcagaucuggagcucauugccaaccuggcuuauuuggugggcuccaggccaacgagagaaccugucucaacaacaaacacccaaggugcaugucucccgaggcacaccaucugaggcuggccucuggcuugcauguacaugcagacaaacccauacaaaaagaauuuuuacacauaaaagagcuguuaaguaugaaguucugggauauacauuaucuuaccccaugcuuauauaguauugaaaugcaauuaagguagauuuuauagaaaagauuuagaaaacagaacaaaaccuggugcuguccuuuuguuguugacuuaaaauuuugagaggcuugcgcugccacucagugguaaagagcuugccuaacaggggcauggucuuuaguuugaaacucaccaccaaacaaugucaucccacccacccucucucgagaucaaacagaacuuccuuacacauacuuguaaucccagcacuugagagguugaggcccgaagaucaugauuucaaggccagcuuaaucuacaagaugagcucuuucuuaaaacaaaaaagcaaaacaagcaaacaaaaacaaaaccccaagggccagugauguaguccaaaggcaaagcgagcuggauucgcucuaccucuuggguucuggucgccugcucccagagagccacuuccuugaugaaaaguugcugcaguguguaugcccgggcaggugcaguguguaugcccgggcaggugcaguguguaugcccgggcaggcugugcuuacagggguuugcuuucugaccuuggcuuuuuucaggguucauauauucucuuuuuacucauggucuuguuuuaaaauggagagcaguacaagggggugggagucguggguggagugugugugugugugugugugugugugugugugugcgcgcgcgcgcgcgugugccuguauuguuuugagacagggucuguaggccuggguggacuagaacucauccucaccauguagagcaggcuggcuucucuacccauuccucugccgagauuaccagugucuggcacugugccccaugacuguguugucaaggcucucauuuguaccagugggaggauccccuccagcccugagcucacacuguuucuucugguucuucugcauccuucagcacuugugauguucucagcuucagccucugguccucuugcuguuguggcuuccagggcucugcugcacagccaagcuuguguaaacugcaaaacuaaacuuuuauuuccuuaaaagacaaugauuauuuguguuucuuaaaaaugaaauggucagaagauuuaaaguucuggaaggccuaugaugucauguuggaguuacagcaggugaugggcaucaacaaaagcucuguacugccugagggccuccugcucaccaccucuguucucaggccuggccucauagggcucugcagggucuagggagacauaggaauacgcucgcagccauccucggucaggggagcugugugcuuugagaauuauucccaggguccguuuggagccagcucucugcagguaacagggaugugugugcggaggaacagcagccaggcucucucucugccuccuuuuuaggcuuguugcugugucgcaguguuuuacaccagcaaaacaaggcucagucuuuaguaaaaaugucagaaacuuuucccuaauaguuauuugcccuacaggaugaaaucgguuuagauuaaaagcaaaccugaaacaccuugaucucucugaccaauguuccuaggguccaaacuuucuauagauagacagcucugugucagaucaaagcuguccagguggagccucacagggacucagcguacaggucacguagacagcucuuuggaagugaaccuuugaaggccugccaggccuuccugccucccuggugacugccaggcugguucccacuguggaggugacuggugauagaguugccacaaagccagagagaagagaaugggagaggagccagguaaaugccaccaguuccgcuggguauuuuuggugucuuuuagaaugugagccagcacucuuucaauuguuggucgcuuuuugugaaagaaaggcuuuccagagcucuucaaugauaccauuuucauacucgcaucaaaccuuuugaaagucaaaaaauacugucaaguuagucuguguguacagaaagcuguccugagauuuucauaggaucuaaugaaaagauuggacauauuuacauuucucagccaaugaguauggcauguuugcccauuuagaccuuuuauuuguuuguuuuguuuuguuuuguuuuguuuuguuuuuucgagacaggguuucucuguguagcccuggcuguccuggaacucacucuguagaccagaaauccaccugccucugccucccaagugcugggauuaaaggugugcgccaccacuccaggcaguccauuuagacuuuuuaaaaguauuuuuccaucggaaaauauuuucuaaacuuguuugguuucuugcauguagauagugcccuucaguuucuuucagccccugucgucauugcucucguccaccccuugcaggucccgccaaacucuuuccuccuagcaaggccguugucucccacuccccgcccgccaugcccaugcccacgugcaccauaucuuguugcuuuguggcccaccaaguagaguuagggcuacuuucaagauggguggugagcuauuacuggagcagggcagcuugccaguagcugcaucacuaauuauggaggcuuugguuuccuuugucaucuuuuuguagauuuuaguauaugugugcuauacagcaccuaaguauuucauuaaauuuggauaauuucucacauauuuauguuaauauauagaaauaugauucuauuuggggguugaguuuguauuugcaaauuugcgaaacuuacuuauucuaaguaauucacuuuuucuuuuuuuaucccucuuuguuauuacaaacacaauuaucuagucugcaaauggagacaguuuuauuucuuuggggaaaaaaguuguuuuagucuucuugugugcaggguuucugguaguauguugaacaaagugccgucgagagccugugcugcacaagccccagagagugcacugaagccuugcucagggccgccugaaggcgagcuuggggcagucucaccuccccaccuugcagacaguucugcugggaaugagcacaggguuguucaggacucuuucaguucuucugacgaucgagaguuacauguuaggaugguugaguucuaaguuuugagacaguuuguauaccugaacaaaagccuugguuauugcauggaaucuaucugucuacauugcuagauucaguuuguuaauauuuugcugaauaauauguuguauacauuaaaauuaauuuguucuauagauuguuaaguaacauuuaauuuuacacuuguaaguauuuuaagauacauagucugguaacauuaguguuacauagacaguugcuaggaaaccaucaguaucuacuucuaaaaguuucaucaccccugagacuaaauaagacuaaauauuuguuaagcaauuaacuuacccccaccacccaguuucuaguacuuuuauauccauuaauuugccugcuuuagauacuucauguaaguggaauuagaauauuugaacuuguguaucuggcuuauguccuguacguaauguuuucugacccauauuuccuguuucuauguuuguguuuuuguugguccauucauuuuugguggacacuuugacuauuccugcuugcuuggugacuuugggucuucuguuagucccuuccuuagcaggcaaggagccuacucaccucacaggucugaagcugcuguuguggguggugggauccgugauuuucaaagccacucgagugccacacggugccgcuucugccccugcugauucagcuccuggcagggucagggagguguaacagccuaaguuucugugugcuggugauucuccugguuagggugcuaaaaguagugguuuucaggaauucauuuuauauauucuaaauuaacuuuauugauuuucaaauguuaacuaaauacuuuaaggucaagugaaaauuaaauuaugacauuuaacagcuauaaagcuauucuguaacacauuuugguuugggcauguucuugcuguguagccagcgcaggucucauauccaugauuuuucugucucauccuucauagugugugauugcagggguucacuggaaacgucuauuuauuuaaguuuuagauguauuaaauccuguacauacucauuauauaggauuacauauugcauuuuaguaaacaauauagagaaucgccuuucuuuaagaagauggcaaugcugaggguuuugauguggauuucauacccuagcuaugugcauauguaacaguucaaucucgugcaacaauugaugggugggcccgcagggaagugagcggucagcacucacacugggacccugaucccagugcuuauggaugaacuuuacgguagcacagguaacccaggcucacagauagucacugugcuacaaacccaacacaguagaccaugucuguaauccugacacucaggaggcagaaucaggagaauagcaaauuuaaggcccgugugggcuacuuauagaaugauagucaaaccuugucccaagaguaggggguuaggaagauagcucagucagugagaacuugccacacaugagaaccucaguucagucuccagaaccuguguggaaaagcuggagugugguggcaugcacugugucccgauuaggguuuuuauugcuguguugaaauaccaaaagcaagcuggggaggaaagguuucuucuaccuuguaguccauuauugaaagaagucagaacaggaacuagagcaggggcagggcacacacacaauuuacacaaauugaauuuguacuuuaaaaauuguuuuuauuauuguugugugugcaugugcauauguacauggggaaugcacacaugucagagcacacacgugaaggucagaggacaacuuuguggaguuacuucuuauccuaccuguaugagggaacuaggaaucaaacucagguugcuaauauugauccugagauuugcuggagaaaaaacaauuccacauuuuuggaucaagcuuuauuacacauuuuugaaguaagcuuuauuaaauauuaaauacugaccaagagauggacuuuggucaggacaacucccuggaacuuugugcugagugcccucaagacauguguugcagggguuuauaaagagaaacccauaggccaccauacuuuuccaugaggcuuuuguuauuuucccagaacuucaauuuccagcaucucaagcaagagguuaccugguccuugggugauggggcuugcaaguuaauuuuggguacuagauuccccccuugugucuugggucaaauccuuggcucugugaugugugcucauuuauuuuggaucuagugaccgucagcuuaacaguacccaguagggauuagcauuuagcuauugugucagugagguaagagucacuguaauuagcaaaagcaagagggccaacgacccugcgauggcugacaucagagcuacugucuagaaagagccuggaauggguggaacaccagucaugugucucggucuccuuuuuauaguguuaauuggcuacagccauauuauaauccugaagguuuguacaaaaacaacagguuuuuuaaaauuauuuauuucauguguaugaguacacuguagcugucuuuagacacaccagaaggggacauuggauuccauuacagauugucaugagccaucauaugguugaugggaauugaacucaggaccucuggaggagcagucagugcucuuaacugcugagccaugucuccugcccccagaaacaacaguuuaaaaagucacauuauacuucuuuguucuauagaacacaggccaagugcccuauaauauuguaggacuauuuuaguuaacaaaccuaccaguugacaaauccaggcccacuuuucugguauaucaguuggcuuacagguagccauuuugucuuguaugucagggaguuuccuuuugucuuagcauuucagccuauggugguggggggaugauuacucucuuugguaacuacuuccagcugacauuaggacauuguugucagagcccaggaaggcaaggcaaaggcugggcaauggggcauuugucagaagcaucagaugagcugauccagcugaagagacugagcaaucacacaggcuagacugguuuacaucagcuuucugcaaaguccagagcucagcacuucgcaguccacaggugaucccuggauggagccugacagcaagugaaaaaucuguugagacaaguagacuagggacagaguuagucuucuaguaacuggggaaagggagaacucucaggaccagugggaaaucccguucucaggacuagacaggugcagaaacuuaggcuguacuuaacuggagacugaccugugacaggugcaucaagucuuaggacuucuuucuccccugaagguuuacguggguuuuuaguuuacaaaaagagauaucuuaguguuaaauuguacugaaaucuacauuguagaaaaggcuguuaacagguguuuguaaaacagcaggaauagacccaagccgugggucuuggcaaaagcuauagcuuuaggcuaaaaagcaugaacaucuuuuacacucuuuccucucuccagagagccuauaguuggacagagauguuuuagcuggaugaaaagcaucuuuaaguucauauuuaaaagacaaccaaagaaaacugacacugugugcuugugaugauccgcagcagccugugcuccaucuccaggcugcagagcucugcuggugagugguagagcucugaaccuuugcaccucagaggaagagaaguacaggaaggcaaggauggagaugcuuuuauaguuacuuuacauaucuuagaguauguuugagacuuauuaagcuuuuauuguccuaaaaccuucauauaucucagaacaauuuuuaaaaaucuaaccauuuaccagagacgugaauaguuauuauugaaaacagucauuguaaagcauguuccuuuaguggaaaguuacaccugaaaccuguugauucuuuaaaaugaagccugugagcaaggcaaaacuguaucuuucucuuagagaccuaguaacuuuaacucaugaacuaacaagauggcugcagccuugagggauggagcugacagagcuacagucaucuuagccaucaaugugaucagggaucuaagaaggauaaauuauaaucaaaaugaccuaugugucaauuaaaaugauagacuaaucauuaccuacacagucaucccaggcuccuguggucuccaugacauuggggcagucugauccacugguuagcacuaccacauuccuugcacaguccuuuguaacuguguccuuugccuucuuggaaaccuugggcaucacuguuaggaucuggaaaucugucauaguaaguuuaacauguuaaaugccauauucggcagaucugacaggugugagggcaguuauuuaugaaguguaucugagcuaagcaguccuuguuuguuuccagguacuugcuuuaggguauaccuugaaaacaugcauagaaagauggagcucuuuucuguaauuaauuacaucaauacuuagcacgacuauaaguauaauucugagcauaucaaagcuuaaucaucuuuaacaguuuauaauaagauagcaauuuuugaauugaagcucuuccuguaucaagauaagaguuuuaacucauaagcacaguucauagaggcugggaacuuuucuaauccucccaugguguaccauuauaaaauacagcaguuuacuucaugacucagcuugccaaaauagcuagagcuuauuaacaaugcugcagaaggaaggagguugggcgugcauccuuaagucagucucuguuagccugaauagaccuuaaguaaggagaaacauucucuuagccagugcuucucaacuuuugugugacuguuuguugugacuguuuaacacgguuuuucauguugugaaacguccaaccauaaagucguucuuguugguauuucacaacuguaauuuugccauugagaugccauuguuaugaaugucaauguaaacauccaacaugcagacaacccuaggcuaccccuguggaaaguguucuuugacuucaagggauccugaccauaggcugagaacuuguuccuaguucuuugucauccugcuuaaggucauugucuuacuguaacauaagauagaaauacuucaguuucuggugucuagcuguagccuuuuguaaaaauaaaucuauuuauuaagaucacuuuuuuucgagacaggguuucucuguguagacuuggcuguccuggaacucacuuuguagaccaggcuggccucgaauucagaaauccgccugccucugccucccgagugcugggauuaaaggcgugcgccaccacugccuggcuaaaaguuguuucuuaaagauacccaguuuuaaaaaauaauuuucugugaaacuccaaaacuuucuuuuaaaguuuaaaaucucucaacugcaugcucuuauacaaauaaaguaccuuuuuaaagaguaaagacacaaagcacaaucauaauuuucagaauucaagaccaagcucuaacaguacaaacaauuuaaugucucuaaaaucaauaccaaguggguuacucuuacaaaguuuuaagacaggacagaaauuacauaaaaaucuuuugcaaucuaaaagcaucucuggagagguuuccuuuguuggcccauaucauguggcuacccuaguaaagaggggggcgaagccauggacacccaccuucucuaacuccagcaaagagggcaacuagccaugcaggggcugcuguccaugguggcagcaagccacguguuguuuauaucccagaauggaaugaugucacauagccccuuuaagauuaucuaagcacagacuuuuaauuaccaaccacaaguuacaaauuuuaaguuaacaauuuguuacagauauuagauuuuuaaccauauacaauaacuuauaagccaauaauuccuuuaguuucugacgccagacacagacuuuaaaaucaggccuuggucugaaaaggggugagccauaaccuaguuccagagccagcuucucaguaaaguagaacagacaaaacaacuuuuaaggucacacagucaaacaaaugcaguggcugacuguaacaguagcagcauagcuguaaccaagacacaaggaacacaguaaacucaggcauucaagggagaccagucagaaacaagcaugcagcagccauauacguuucuacauuuaacugagccugaugcaguucucacuuagcuccauguuugcaagaaaacguacaggcacaucagaagucacagaucuaucuacacauagaacaugagcagacaaaacuuuuccuaucugcuccacuguuggaauuucaggggaggagcgccuugcuaguugcugaaucccauuuucucaugcacagugcugcuguagcaggauuggcugcuggcuucccuacaggcacucuggguuuuuguuuuguuuuguuuuguuuuuuuuuuaaagcuguucucuggucccaagcauugcauuuugugaaucucaugcccccaaagacuccaccaauuuaggagugacuuuuccaagagcagauaguuaggcccagccugacacuagugagacccaggcaggagguagagccaugggugcgggcucucuuuugccccaagucagaacacauaaagagaccagacaagacaugaccagacaugacaguuaacaguuggaguccucggcuucagagguucacuaguccuuguugacugguaggguaccaagcuuuuugagcacaaaacuuucaaaacuucguuuuuugucauauuuuggcucccagucucaccagggggucaccagggagggacucuggugggucugacugaacucccuaauuaaccagaaauaaccaggagccaugaggucauagaccucaucaggccagcccaugccagauugggauccaccagaaccggaagccaggcagacaggugccauagaaggcuaagauaaccaaaggcuuucaugacuuccuaaaaagggaggccuccauuaaaaacaaaacgguguccacaaaguggaaagcacuucccugaggucucugggucagcuagguuaguuaucuaaccaggguuagcacuccuggguagcucaucccauaaugauaagauaagucuucauaagugaagagcaaauuuuggguagcguuaucucacuggggccuccaaaugagauuugcuggagaaaacugaacucuaccuuuuugggccaaauuugaaagaagcuuuauuaaauauuaaguacugaccaagaguuggacuuuuuuguuuguuuauuuguuuuguuuuguuuuucaagacaggguuucucuguguagcccuggcuguccuggaacucacuuuguagaccaggcuggccuugaacucagaaauccgccugccucugccucccaacugcugggauuaaagacaugcgccaccacgcccgguggacuuuguguagaacuacuuccuggaacuuccagcugaguggcccagaaauaaacacauguugcauggguuuauaaagacccauaggccaccauacuuucccaugaggcuuugauugauuccaagaacuguuaacuccccggaucccaggaaguuaccugguccuuaggcagguggggcuuacaaguuauuuuuggauauuacauucaaggaguaguccugaccaaagcccaucucuuggucauuauuuaauguucaauacaauuugccucaaauuuggaccaaaauugcggaauugguuuccucaguuucccacugagccacuucaucaguccagcuuuguauuaaauaugcugagagauaaguuuguguuuuaucuuuaacauaauaaaggacucacuacugaaggagcauccuuccuaccgaagugcuccacacaaaccagugaauaaacauuuguguuugcccagcccuuucuugaagcaaaaucuugaacaaacagaacuuuuaagaagcucggaaggcuauucacagugaguguagcaaaaagccaguuucugccagccgcagcuuucacucuucagguuguccuuggggcacaggguugauuaauaagcaaacuagggacuggcagauugcggugcguuaacaacgggcaggcacuggggcugccaacugugugugugaauggaggagacaguccugugacaggcaagaugggcuccugagcccugcauguguggcuuuugucuucuugguuuucauagaggauuuaacuccccucuuccucuucagccaaaagagaccaugaucugaauguaaagacugcucagcauauacuugugugcgcgcacacacaguuugugucucuggcgguuauuuacauugcuguuuucaucaaaaauuuagaauguauuaagagguaggucaaccaauuaucaguugcaauaguugggaaauuuuuccuucuucaaaaauuauaguaaaagcugaugauaguggcacaugccuuuaaucccagcacuugggaggcagaggcaggcagacucugaguuugaggccagccuggucuacagaguaguuaccaggccugucauggcuacacagugaaaccuugucucaaaaacauaccaaaaaaaaaaaaaaaaaaagacuugccuuuauagcauaaaugucacccucccccuucaauucugggaauuaaaccccaagugugucuaagaaauuugacugaggaagagccacucagaauguugauagcaccaccccgagcugcgguuccagccuaggaaggggagaaaggacagugagugcuucucugccuucugacugugggugaacuguguugggcuacuucauacuucuguggccgggccuugccugccacagucuaagucuaagucuaagucugucugucauccauccucccucccucccucacucccucccucccucccucccucccuuccuuaaguuguuucuucucagacacuuacuuggucauagcagcaaggagaguaacuacuauugcauuuccacugugcugcugaauaugaacuuauuguccccccacccccaaacccccuuucuuuugucuuuuuccccccacuuuaggagacagguuucuuggcuaguccaaaacucaguauguagacuugguuggucucaaauuuuuagaaaucuaccugucugcccucugaguugugccaccaccccugacacuccagagugcacuuuguuuucucguuucuugguguuuuguuuuguuuuguuuguuuuguuuuguuuguuuuguuuuguuuugagacaaguucuagcuguguagcccaagcuagcuucaaucucagaguacucuuuucuuugccuccugaaucuaaauaaaauaaaauaaauaaaauaauaacuuacaauggcaucauaguaucugauucauaacuugaaguucaauaacaauaaaugcugauaaucuaaaguuacuauaauuggucaccuagggccaaauauccuaauuuuguuucauuaaauaauaaauucuauguaguucuuuauaauuaaagaguguugauuauguguaauacaauguuuuucuuuuauggcuauucuagcuucugcuguuaauuuucccaguugauaaaauuuacaguguucuuuuaaucuccuaauuaaaagcauaguguauucagguuacugcugcuguguucaugaguuagaugguuguauggcccuguugaacaguuguuaaccacaggcuccagaccuagaggccccaugucuugcugcucuccucugcugacgagguguggagcuguuaaggaagcuccuguugugugcacauuuggagccgcucccuaguuaagccauucuuaacgaguccaguguucuuaugucaguuaaguuugucuucagaaauauaacagaaauaccuucuggauggucugaacucaccuuuguguuaaccagugagaggcuugaagaauggaguggguaagcugggcacuuauggugcuggagagguagcugguagcacugcuggguucauugugcuuucuucugaagggucugucgcguuauucaaagguucuugugcagaaugcauggauaucaguucugagaugagauuauaaacuaggacuagagggaacguaacuaggaaaggucgacugugccagcacagacuccagcacugccacccaagccaaaagauggguuucaucugcaugauuaauauuuauauuggauuuguauuuaugcugaggacuggaagaggugaucagaaauagaacaguuuggcucugugauugaaaaaaaaaugcagacaaugccugggguuucccaaaauaacaucuuugagauugcugcaugaaggagucuggagugcucagggagcaggaaacaccaccauccugguaggcaguguaaucagcuaauuucuuauacugccuggcuucccuuuuguucucuuauagaagcuagguuguugagguuuggucuugcuaucuauuguaaugcuaagugagggcccccaauaccugggcuuggagugggggggauccaggaaggggagagaggugauaauggcccccuucucucuucccaaguauuuauuuaguauaguuuccuuguuuuggguguucuaugcuggguuacagcccugugauacuugguccacugcuuagacugcucuagccuuggucacuugggacucucuguuaacuguuacuucucuguacagauucucaucagcauguuuuaaauaguuguauuguuuuuguuuuaguacugucuacuuucugaggaugcucugcuccuauuguguaugucuuaucccaauccuagaaaugggcauuucucuagaagccccaauucauuccauuggaauagucucagaacgugggcugugggugaaaauguggucauuacugcuggggaggucacugguuaagugaggaagaaguauauuucguuauucuaacagcucuauacacaucucacucucucccuuaggguuguuuuguuuuguuguuuuaagauuuguuuuuaucuuucuguguggguguuugcauguuugucugggcacuauauauauaugcaguguauacagaggccagaagagggugucagacccccuagaccuggagauccaggugguuguuagcugccaugugagugcuggaaauccagccuggguucucuggaagaacagccaguucucuuaaugcugagccaucuuuucagccccauaccugcguuucuauuuguagcaauuagucuaucucgacuuuaugcugagccucucccacccuuugcuucuauguaaacucuuggcccagcauacuuugauauacugacauacuuugcuuacaucuuacuuagucauucaguuccaguguacaguacaguggcaucagacucgcuaacuccuauggaagcugccuucauacauuuauaacacagcauaaaagaaugguuaugaauaaaacugcuauaaggaaugucauauauauauauauauacacacacacacacaccuguggacagcuuucagaugauuuuguuacaugcuaagaucaucauuggcauauuguacaccacagcuacuggccuuugcgucugcccucaagacugugugccuuagucaucugccuuauuuagugugcaucauuucuuacaguagaguaagcuuuguuugcuagugccucuaugaucgcuuagguggaaaacaaaugccuguacacaacaggaucaugugcagccggaugaucugacuccaccuuucucacaacagcaggcguagauagguauuuucaaggcaccuugcacagcuggguuauugaagcugucuuaguauugaucaugacuacauagcaaagcauuucagaguugcuaaaguucugaagcauucgcuguauuuuccucguaaccauuacucucauacaagcaguguuuccuuggcuuguucuggaugccagucuugaccucagggcccucacaaaugcuaauuacucuaccuaccauuggucuacauuccccaguaagcaauauauuaaaauguaaaauuguauuuacugcaaggcaaacggugaaauuggguuucuguuccuaucagugauguuugguuuguuuucuugacagcauucauucagucggagagcauaauagaaguccugcgcuuugacgacggagggcuacuacagguaauucucuugaguaauaugacuauucuucuuuccugccuuggaaaccaguguaacugguuuuccugaaguauguuuuaugaacuguagacagucaguggaguuauugcaugaaccuccuacuagaauuacuuuuuagaguaaacauuuuucuaaacaguggacucccuguguaguauggaagcuguagguaaguaagucagaguuuguguccuguggcugugaggguauguaaaaaaaaaaaaagccaggucaaaugagguugggucugugagcucucugguuguuagugcugagugaagcacuggcucaguguguguagcuucagcauuuaccuagaaaagaacuucugugcacagugcaagguuuaugucucgucuggcuggcugucacuugccaugcuaagcuauaucuuuaacuguaguaagcaugacauuagaauguggagucugguaauacucugccuuuucuuucaagccuaguucagauccucugacaacucauucauucgucagcuagagaacaagaacugcagagcugaaaggcauugucacugccaucugccucaauuggcuuugcugagaagggucuggucuucuggccuugucuuguccguccguccuuccuuccuuccuuccuuccuuccuuccuuccuuccuuccuuuuaauagcccaguaugccccaagauugggauccuccugccucagccuccugaguaguaggaguacagacauaugccuuuauauccauuucagcuuucugauuuuucuuuuuagauuaaauuuguucuuugacauuugcaucccuguaagcagugcauucugguugcucucacccgaaacugucuaucgugugcuuccuccaaccccauucuuguucucaaggguggacccuuuaauucuuguguguguuugcccaaggccauguccgugagcacggguguggagaccuucacuggcauggugcgggauuacauaccugcacugccucuuauggcauagguuaugugucuaaagcugaaauguuuuucacauuuuguucugcauguauguuuguguggcugucuguggaagucaggacaaccaguggggguuugagcuguuucugcugugugguucaagugggccugacgguagaugccuuuuccugccaagccaucuaugucuuuguuuuuaaaagccagugacaguaguuuuccaauuuauaaucccaucagagggaauuucuugauuuauauuuaaagaccuuggcacagcccacuagaagcccccuccugucucuguuguauccugucacuguucuuacuugaugcguuggucuuuugacuuagauaauugugacuucaaauaaacagaauuucuuuauucaugaaguuuagcuugucagcuuuuuguuuuguuuaguaugucuuaugucuggcugaagaaccagguuaugugguuggaaagauagcucaguugauaaagugcuugcauagcaagcaucagaacccagguuagauccccagcacccacgugaggaaguugagcauagcugagcaaaaucucagagcuggggaaguagagacagaggauccuggggcuccuuggccagccagccuagcccaucagugagcuucaaguccagggaagagacuaucucaaaaaaccaagugaaugacuuccuagaaauaauacacccagggcugacccucggccuacauacauguacacuuccacacacauaugugcucauccauccauccacaagcacacuauggaugaucguaauuuagaauuuuauuuggcugcucuccuuagguacagcuacaguuccuaaaauaacuuucaguggaggcagagggcagagcucccuuguugcuguucaguuguuucauguccuuugcuggguguccuccagaacuuuguuacccacuuacucugaagugacagugucuccuggucgacugcuggugugagcuggagcuggcuuucuggguguccugagccuguuugucuuugcaacuacacuuuugaaaguuuugauucucauuuccuuccucuuagauagacaugguccuugauaaccuuuccauguugugcuauccaugugcaccuguaaacucugugugugcugggugguucuuacacucgaucugaagaucagguuggagagaauuacaacucccugggaaauuaaaucaguuauacugugcaaaauaguaauagcacccugacaaguacagugugcagaacauuguacuagugcuaagggguagaucacaggaagcuacuaacaccuuucuuacuccugagucuuggcauguaucauuccuguagggcaccccuuuccuauggugaugggcuaugugcacagagaggccacgucuaagcuuccagcucgcagccagcaccacucucccuccugugaaugagcuucauggacaaccaaugaacacaucugacgcuuccuacagauguagcacaaaggcaugaaugagaacgagcaacuggggguucaccagccccaggaugggcaguaguaguaaacugccuuaagccacugugcuucagaggccugacuuugcagcaguggauaaccagagcccugcugugaucugaaaccugccugcguuguacucauuuuuuccccauuguuucagaaauccccuuuuguauaucuuuguaaugagacuccagucaaagcucugcacaccagagcagagcuauguucuugguagaugaaccuacauggcagggaagugaguguccugaugacagacaccacagaucuguguucaggucacuauuccuuuagcaacaaacugaaaauuuucaguggaguguuguucugagcucugugagcuguccuggugaauaagagagucaggggaucauugacagccuugcauuuauagcugauuugucagaaauacagguggccaaagugcacaacuguguauggagugagggcacagccagcaucuggauucucaccugacucugacugcuuagauaguauuagaggauaguauuugaguccaccaggaguaguauuuccauuaugucucaugugaagauauguuacaugaugcugucguaggaaaggcugccguauguagggauuuagugguuuuggaaguggggcacuaugauacugcuuuuuaccaucuaagcaagaaguuagcaaucguucuguaaggaucagacauuagcugucugaggguucaggugcuagcagucuccacuuaaccacucaucuacuguuacugugguacaaaagcagccgucuaucccugguaccuaggaagcaagcauaaaaccaguagcagaguggcuuggucuguggguuguagguggucaucuccucugaacagucuugggagugggcucucuguucuguuagggaaagggaagggagaaggagcuaggaucaacuuuuaugaaggcugagaauauucaucucuauaaagagacauguaaaaguuugcagaaguuuggaaagcauagaaaaguaauacuauuggguauugccuaggcaugcuuuauuuguuauuguuuuugcucuggaaaucagucuaagagucuugugugugcuggacaagcacuuuguugcugagcuauagcaccggccuccaaauucuuaagugaauguaauagacuuaggcaagcagcuuaauguacagaaaucaguaaauuaaccaaguaagcaacuggugagugacagaaccgagccuuccuguaaagcuucccucuuagccacugugcuuuucgcguagacuggagagcagcgcucugaugugaugcagccuaaugccugcauucauuucuauggugccuguucucacuaagcauaguuuuguuuucucgcacuauagacaguucuauaacauagcaauuaauuuuauaucacaguagccauucaucaagucaggggccacaggaaauauucauaauugguaugacagcugaacacuuugaauuauagugcaagaagaugcuacuacagauaaaaauuaagggggccggaagguggcuuagccagcaagaugccugcucugccugaggacccgaacugggauucuaaggcacccaggcauggugcacauguaaccugagcccugggguaggggaaacaaacccuuggagcucacuagccagcuagucuuggcaaauuugcaagccccagauucagugagaagagacccuugucugaagagauaacaugcagaauaauagagaaaaacauuaugugccugugugcacacaaauaaaaaugaaaacuauaauuaguaacaucauaaaguucaggaaaauuuacaucuugagccaaguaguucauuguuuggggagucagggaaacuguccugugcacuuuagaauggucauucgugucuuuguuuucuugaugguaauggcaucugcuuuguaacaauucaaacaucucuuaaggucuggggaaguaguuuagugauggugauggccuagcaugugcagggcugaacucaggcccuagaccuuuacgcucagcccacagggaucccugugaccuugcugaggaaguugagcuauugugagcugcauuuaugaugagaacugacacauuacauaagugcuccugcagaggccagugugguggauugaaauagucugcuuuccuccugugaauccuauugagagguggggaaccgucuaaaaaguuguguucaaauuggucuggaauuggcagcccaguggugagcacugcaugcauguggugugaauugcagggugggaaggagucugauggccucuucuggaguggcaggacagaaggauaaucuggguucauuugggcauuaccauguuucucugauucugagaacuuucuuugaaccacuagugguagucauuugugauagaugguuuacaugauauagauaguuucuaggacccagaauucugcuaagcucugucguggaaugugaugggccaaaugucccuucaaucagcugguaaaauugauuucucuguagagauguccucuuuaaggaaguaaucucuuuucagacaguuguggcccauuuacuuuuucccucacgcguguguaggugcaccacuugcaugcuucaugcugugcaggucaaaagcaggcaucagauccuccccacacuggacuuagggaugguugugaaccauccucagcaggaacaagugcucuugaccucugagcuauuuucuccagccucugcuuuccuggagugaauuuccuguucuuguucuuuguuuacauuucaguccccacccccuuucuucucacugcuuugugagagaaacuuucccauuaugaaaccccuccugguacaguuacucagggcagggcauuugcuugcucuguuacaugguuuugcggcuugucuugugucuguuccuccugacaugacuuguuugugguuaagcucuagauucugacacuuuuaaaauagauuuugauuugaccuucaguguacugaaggcgaauuuggucucuuccaccuaauuuuuacacuuucuguugugcugcccuguguuuaggcccaauguuaagauacacguaaagacaaguuuaagauuuuauuucucagauuaccucagagccaaaauagcaucuccuuucaguacuuggggcacaguguuugccugcugugagacuuuauuauagcuaaaugauuguuuuguugugucugccuuauacuucaauaagaauuuauuuguucuaaucuuauuucuuauugaauaucagcuaauuuuucauaagauguugucuuagggcuucuguugcugugaagagacaccaugaccagggcaacucuuauaaaggggaacauuuaacuggcuggcuuacagguucagagguucgguccuucacuaucaccaugcugggacaugggcauaugcaggcagacauggugcuggagaaggagcugagacuucuacaucuugaaccucaagcagcagaaggagacuguguccacacugucuguagcuugggcuucugagaccucaaagcccacccuaacagugacacacuuccuccaauaagaccacaccuacuccaaauguuccacaccucuuaauagugccacuucccacagccaagcauucaaacucaugaggggcucuuccuagucaaacuaccacagaggguuugcaguuuaucauccugaauacuuuugcuuuuguccuugggaucuuuugcuacauugucuuuaugauguuuuauuccucaaaaaguacgcagggcaauagauuucuugaguuuugcuucuguuuauacaggagcauagcuccuuaugcucugauguuuugaucacccuuuauucaucuaugaacagcauacgguguagaugucuaaauuacacauugaaaaggcugcaugcuguuuuauacugggagaucauaacuacaguccaguagugagcacacccagcucccuuaaggguuuccugugcucuuauucuccaucucuaggugaccucugcucagcuuccagucacuggguuccaacauucaccaucauaauuuugagauuuacuuaugauaucauauauauuaauaauuugucuuuuuugcugagaaauagucuguuauauuaguauguuacaguuuauguucccauuuacauguuauaagaacuuuggguuguucuaguuaaaaaaaaaggcugugugaacauucaaauacaagucacuauguagauaaauacuuuuauuucuagaaguuccauagagcuauuauauuuccuuagacauuucuuuccgaaauuaauuuguguacauuauauaaaauaggguaaagaaagguuccuguuuccucgcuucaucaucugguuguugugucuuuugagcagacauugcguuaucucuugaaugucaucgaugccuuugcugaaaauuaagagauuguauacauguccauuucuagacuugccgaguuucauuaaucugucuuuaugccacuacuacugcauugucuugauuauuaaagguuuuuuauauguauuaaacaugggacuuagacauagaauugccauuuuuaaguaugcaguucagcagaauuaagucugcucacacuauucuacagagaccuccaccaucuaauuccagagcuucuuccuuccaaguggagguucuuauugagcagugguucccagugccuggcaucugugacuauucuuucuguccaugacugagacugggucucugcaucugcucucaucagcugcuggaggaaguugugacuucuuagcaagguggacauccucuggcucccaccuugccuugcagccuuauuuucugcggucagugcuuuggauguccuguguuccuccucuuuacuauccauguggcuuccaugucaugguugcuaucaguucaguguaagcaucaucagcucuucagaugcucuuuccucgugugcaucacguuggaacuccuuucagcauuucuguaaccaguucucaguguguaaguauuuguuacuuaaaugguuugcccuuugauucccacuguaucuucagcuccuccauaauggcagcagcuagagauaccagcaccacacuggcaguugggaggaagggaacacucuggaguguaugaccuuacaucagagauuauaaagacuucccuacaggauuuguauuguuugccaaacguuaggaaaccaguagcauuaguuugugguguacguaagauugaaccaaauuguucucucauucuaauugcauagugugaccuauucuuuuaugugauuuggaaccaggucuaaccugaaaaucaaggguuggaauggguugaaaauaaaagacacaauaaaauauguugauguuucuucugucuguaaugugcagcuuuggcuuuagcaguuucauucuuguuuucuuccucuuacagacugagacaacacuuggccucgguucauaucaacagaaaagguaaguaggacucacguggcaucaucaaacaugcuucccuuccuugggguccugauaaacacgcaguguugaauuauaaagacauuuugcuguguuuuucuuuucauucuguuguuacuuguuuugcuugauuuuggccaagaucuuacuaugugacucuggcuguccuggaacucucuauguagaucaaguuagccucagacuaucuaugugccucugccucccaagugcugggauuaaaggcgugcgccaccacaccugguuuuaugccacaucuuuguaaguacuauguuuggaaaaccaaguugaagugaauuccccugugguacaguaauaagcacauuacucuggaauaguguccgagacuguaaccaagaccugggguaaugaacuggcaaagagaaaaggucuguuugacucacaguuuugaaaaucgcacucccagcacagcauggcaacaccaacuccccucaucagagagauagagguggagaaagggccacggucccacaggcuccuucgagggugugcuccuaaugacagaaagcccucucucucaccaaguccaaccuacuacagagucuggggaccaagcucccaaacaugagccuuucagugacauauaagauuuaacuguaggucugucccugucauuuauaaagggucuuuacucagaacagagguaccccugucuugcaagaguaucauaagguuugcaaguccuuugggagcucuaggccugacacauccagaaaggcacaccccuauucuagcagauuggaaauuagcuguggaauuauacuggcuguaguuauggagcugauauucaucuggagagcuggcucaguguaaccauuaagagcaccucugcucuugcaaaggaacuggguucagcucucaucaccuacauggcauagucuuccgacuugacaguccagcauuguauucucuuugauuugucucauaaugauauggaauuuugcauauuuacuguguuuucucuguggccagcuuuccuagcccucaggaagcaggggcagcuagaccucuaaguuugagguuagccuggucuacagagcaaguuucaagacagccaggguuacacagagaaacccugccucaaaaaaacaaaacaaaacagacaacaacaguguggagggggaggggaucuacuugagguguugggaaagaaagcugucaugacugagaggaacugguaaggaagugaggugaggguuuaucagccugcucgccauaucuuagcaucuucuaugagcuggguuguagaugccccucuuuaggaucuuggaggauagcagagauacagaucugaaagacucuaucuagcacacugggagaaaguauggaaaucgguggcugccgccuuugcuguuagaggguauggcacugaaaacacaaagcucuaaaugguaucugucauccgcacgguuaaccucugaccucagaaccugugaccucguacugacuuacuguugccugaugugagggcacuugcuaugcauggucugcuguuagggugcacagccuuugugggagaguaggaaucaguucaccaagcugagcaaaauuuuucuuuaccaacugggauagugaagucaccauauggcauauauuguauauagugaaaggcaguacaaccauaaaaggcuguuuugaaaugaaauaacaaacauuuaugcagguacuaacagcuugcaaacucaagcagcugacugaaaguugugggguuuaugauucauucauucacccguucagcaaauauuuauuagaauucuuauguauagcagacauuguucuaaccucugacacucauucuccauuguguauaaaaaguuaucaauacucuagcagucuuaaaaacaggauucuuugaggucagagucaaaacuggcuaucauccaaagcugcagacuagaguuugggcacguuugguagcccaucuguaacacagugcuucugaacaggugacaggauaucugaggcaagcugacuagccagauuagucauauuggcaacuccaaguuccaguaagagacucugccccccauacacaugcacaaacaacacacacacacacacaugccccaaacucccaauaaggugacaucauugaagugucacauggaaaaacugccauuguaaaauaaacuuuaaaaaugaagacauuuccagacagagguaagaaaaaugugggcaagacagaaacacuugucuagcaaacuuuaggaaauguuagaggcugaaggguaauuaagccauuccagguagaaacauuuaacaaaagaaugaagagcaucagaaaaguaaaauauguugauacauagagaaauguuuucgaugaagauuuuaauuagcagauguauagaaacaaauaguuggauguuaggagacucacugcauggcauguguccuguauguaacaguagaacagaagacuggagcgagcaaaagagucgagcucuuuauagacagugauaagaugaauccugcaacuauuaagacuacuuuaaaaacaaagacauagcuaauacacaagucacagagggaaaaugguaacugagaauauucaauucuucuguuuuuaaaagauagaacaggagaacaaagggaccaaaaagcagucagaaaaaaacccgcaaaaaacaaacaaacaaacaaaaccuagaaagcaagcagccacgugguagaguggagcagggugagugauguacaugaccugucugagcaccaggcgucacacucacugugcacuugcucugcacaacaacagcguugcuuuaaacuuauacucaauacuuuaccuuuuaacaauaguuuauuuuuggagaauuucacauaguauguuuuaaacauguuuaccucuugucuacccucccauuccuucccacccuacuuugggauuauuauuucuuucccccucccuuuccccacggaaucuaguuuguguugcucagcuggucuggggaguggcucuugcccugguucaagguauauacccaguaaggaccacaucauaaagagaaccgacucuccuuccccagcaacugucagaugccccuagcucaccuaguggugggauucugugcccucccucugcccaccucugugcuguccaccuaucagcacagagcuuguucagaccugugcaugcugucacaauagaugugaguuugugucugcccuacagugucuucagacacgguuuccuuuguuuucuaccaccucugguucuuaagaucuuucugcuccccuuucugagaucugaacucgauccuuuguguuuaugcagccaguccucauguuagcccuugacauguaauucuuggauacguuaagucaguugucacauuaaugucuucccuuguguuucuuuuccugacucuuaaauggaauaaaugauuugucuuucuuauuuuuauaaaugacuuuagaaaaacaaaucaaauaaaaagaagcagugucucccuuuagcccagaccaaucuccaacucauuuauuauggacaguaaugaacccauauauagaagcugaaaguauaaaauacuuggaauaaaaugucagucuuucauuggaauuauuugcaaccugggcaaauuuuucuuaagauaccaagaacguguaccauaaagaaaaaugguuaauuagauuucaucaaaauuaaaaguguuugcuguucaagauucagcuacuaaaaaggcaaggggaauguguugucugugccagagugccagaauguccauaauacacaggcagcccauaauucagacagcagcucugucuaagagagguuagaacagaccauuuaaaaaagacaagucauuugauaaauaaauggaaagauauuugguaucauuaauaucauuaguuaguggaauccauaucaaaacaaaauugugucugauauguguucuauauuauucagggggaaaguccuguuaucuuaaguaguugcucaucuauuguaaaagucguuggcaacuacuuagcuguggaugguuguuaacuuuuuaucugccccuccaccaucuguuucuuaaugaucuuugugagucagcauacaaaauagugugcaaaugugagagauugugcuuaugaggucagauuucucagcuuuguaauacauguaaugaagcagauucugaagaugggcacucauaauuugcauuuccauaggaauucuaugugauuggguucaaguggaccacaguuuuuucuuuuucuuuuuuuuuuuuuuuaauacugugucuagguagcaccuuccccacucccuguucucacccccacuccccuaccccuacccccacccugcuguaaucucagcauucaggaggcucagguaugaaggaagaauagagaucuggggcuagccugacuacagaaugagacccuguuacaaagccuuccccauacugagucagaguaccuuuuguuuaguuaguaguugauucuaagcagacaucuguagaauuccuaacaaccccucaggaccaagaaaguccuguagauuucauuuggaagucaccugcuuaauuuuaacccaacugguaaccaaaccguagagcucauuucuccaggauuucauuguuuucuagcugcagaucagaaaagucugcguuucugucucuccagaucuggagggcgguauguuccuguguacaagagagaaagacagagagggagagaaggaaacacagacagagauacagggaguuugucugucuggauguuuaugugcacauguguacaugugaaggccagagacagccacagauguugugucucaggcaucacccaccuuuucucuucgaggcaggaucacccacugcccuguaguuagccaguuagucuaggcugauggaccagcaagcccccugccaucugucuguucucugucuaccuaguauugguaucacuagugugcuccaccaugcuggucucuacucauguggguccuggaguucagacugaagucuuugugcuuguaaggcaagcauuuuacuaagauagcucccuaguccugcaaauaauuuuucauaaaaauuuagaagacaauuguauugauaauucagagcaaauaauugcugaagaaagugaaaaagcuaugacaacaucccagauuggcuugcauuuguaauugacaaagggauauaaaccauuuuucauauugucuaucccuucaauuuauuuuuuaucauuucuaaacauuugcacucuguuaguagaguauuauugaguagugucuugucauagacaaauaaacaccguagaauuguuuuaucaguugcagauaugugacagcuguguuacuauauuuuuaguuuuuuaaaacaaggcaauauuugugccuguuugugccaacccacuugaauuuuucccuuggccguggcucugcuguugucgugaaaacacacaucugugaaagacucaucguccacuccacuccuccuuucucaccgugacuguucucacagucccaguaaccguggcuggcugcugcuccugccgaguuuacaggaggcuugagcacagggcacuaaaaccuccuccuaaggaggugccaggaaaggaagggagagugucccuugcagaugauuugucuacagugauuguccaggguuugggcagcacauauggagacaauuggaaaacugaagacaaggcccugcagcgggaccagaacuuggcaagaaggucuuuuauauaagcagccucccagguuuccugcuacugcuuacuuagcuccaucuagauaugauacugaauuuaaaugguccaaaugaugcucuucaacaacuuucaugcagcccuucuccuuuuagucuacuauucacagguuguuaaagucugucagucauccuugguucuuucucuccuagucccgagucagugugacugucgugcaagucccaggcuuaggaagcagucacugucccuuccucugcuugggcugcuguagcaacgcccugcuucccgccugaguuucuguucuucacacugcagcccacaagugccccgguacacaacacugaauccugugacuucuuuguuaaagcacugcuguaguauguaacucuccucauuguugucacagaguccuuuacaagaaacaacuuaagguauacaguugaggggacauaguccugucauggcagaacuaagaggcagcuggcauugcaucaucaaacagcacagagugaaaggaagccaggccagguuacaaaaccacaagguccagcuccaguggcccaguuccuccaguacgcucggcuuccugaaaguuccacaacagugccacuagcuggggaccaaguguugagacacaugagccuguagggaacacgcuggagaggguguuucuuacauuuggaauaauagccacacuccucacuugaccuugcccuuuccucuccuuucacucagagcuuugccacucacauuccccugucuacccuugaucuccaccacccuagcuuuguggugcccuccucacucucugguuaaccuacugugcuggauuugugugcugucacauuugugucaaaugcaugggcauuguucuuuucagucaugccuaccacuucaaaaguauucaugugcaaauuucaaggcauauucuugguucugugagaggaagaacuauaucaugaucuccucugucccucuaacacugagcauagaugugugugugugacuagugacucaccauugugucaggcauuaccuuuuccuuuccuuaacuugguaugguuuuagacuagcuuaaguuugaugcuuaaaacuuaagcuagucuaagugggcuggggagucaguuaagagcacuuguaaaggagcuggguucaguuguugccacccauacggaggcucaucaccuccuugggcaccaggcacacauguugugcacagacacacaggaaggcaaaacagucauacacacaaaauaauaaaucuaaaaaaaccaaacagguuugccaaacaugucuuauuuuaaaguagccaagaaugcugacacucugucauggcuaaggacagccgccgcagcugucuuacaaagaacugugccucuccuccuagugucuguaguuuugucuuagcacaguaugaucuugagauaugcuguucuuucuuuccuguuuuugucaucuguguucagcaugcauauguagaaagagggaugcuccaauagcccagaagaaggaugcuccagaucggccaagcucagaacacuguggagcugauugcuuucagcucaguggcccagucaguuuuuaguguauuuccuggaucuauugaaugaaauuacaucguuugaaaacuugaguucuuaugaauugugcacgugaugagaauacagucguuuuagauuauguccuauuucuucaaacaaaaauaucagaauucauuuugaaaguuacuuuaguggcugacugcauuucuuacuucaugguaucuaaacauaagacuuuagauauguaagcaccaccugcucccaaaagauccuugauaaucuuaccuuacauguugggucaggauaucugaggcuugccaugccaaauccuauuuuguuaacaaguucuaguagcaagucaaguagacaugguacuugaacacuuagaauagaacauuaguguaaugaaguccaauuguuugaaaguuccaggcccagauuccuuaugacugggucuuugccacucagcuggaaugugguuguaauucuucuuguaucaacuuuguguaauuguauuaacaauuuaucauauugugucaaaaaaaucuaagaaaaacauguuaaacuauauuguuaccagugauaucaaucaaguaaauauuauuagucuauugagaaaguucugcuuuacauaccuuucuguaaaaaaaaaaaauuauuuuuuucuuuucuuuccuccuuguuuguuuguuuuuccucguuuuguuuuauuugagauaggauuuuacuccguaacggaggcuggauuuaaagucauaagccuccuaccucucuaucccaagugcugacauuguagguucuuagaguuauaggugucacuacauuagcuuauuuacuaaaauucacucacuuucuucuaacuuaaugaagagcacuagguucuguaauguguguguguguguuuguguaugcagguugcucuuguuucuugagaggccagaggacaaccuuagcuguuguucccagguacuauccaucuuguuuuaagacagucucugucauuggucggaaaguuaccaaagagucuggaccaagcuaccuagagaaccuuaaggaccugccggccgugcugcuggccuugcugccucuaagcuugcaaccauacucagaggauuuugguuuuugguuuuugguuuuugguuuuugguuuuguuuuguuuuguuuuguuuuguuuuguuuucgagacaggguuucucuguguagcccuggcugcccuggaacucacuuuguagaccaggcuggccucaaacucauaaaucugccugccucugccucugccucccaagugcugggauuaaaggcgugcaccaccacgaccggcuuggguuuuguuuuuaacgugguuuuuacauucagcugcuauccucacacuuuacccacugagcugucacuuugucccagauuccuguucucuuaaaaugcuuucuugugacagaagucaagcauccaaccaugauuuacagaauuaaagagcugcuuuucacacuuuuucuuuuucuuuccagcauuucucuguaccgggguaauugcaggcccauacgauucgaaccgcccaugcuggauuuccaugagcaguaaguaacuuggagcuauaggacaguuuuacguggauuucuccugcccuuugcuguauuagcugugugagaaagcuacaaaccuuaacaaagcaaaugauguugaagccuuugaaacuagaaucugcuaagaaucugacauaacauaaacuucgaaagucugaacauugcccacacgcuacacccugguucagaggaucccacccagcgugagaaguggucuucaccuggaagccucaucugauuagcacuuugucucuggcauuuaaagucaccuuauugauaauuugcaugauauaaugcucuuaaagugcaugugucagcaugucaccaguaauauggucacugaccucgugaaaggucacagcuaaugccacagauauaucugagccagucgccuucugcuuagggacucuggauucacauaucucagggacucaaggaaagacaaguguuugcccuguugggcucaguugcagugggugaugggggcaucuuguaucgucaccugguauagaagaauuuucaaaggcucaagagcaagcuguaaauuagugucuguaccaggagagcauguggccuagggucugguucugugcaugugugcauuuguuagugugcuuuucucagguguggguggacugcaaguuuaucuugauuucucagcaguaaguuaagcaguugucuauacuauaagccuguucuaaauggagguuagauguuauacauauucuuguggguuuaauuauucuucugccccugggaauauaggcccguccuuccuugccuccuuuccucccucccuccuuccuguacuacuacaguaaguuucuaagcaaaaggccaaaguuucuguuuucaauuuugagacugauagguaaauagguaguagauauuagacuccuaugcuuugcugggucaaaguuucuagcugucuuacagggccauguccucugccagagaaucacuguguucuaccuucuuagacguuuuauuuuaguuaucaauguuuuaggucucuucuggcuaagcaaacaaagauuagaguguugguuugucaccggcagcguuuacucagcugcuuuugcuaugacacacacagcaaggucaagugucuuuuucauaguuucagauacagaaaucgaauguaucauuuguuuuuucugaaguguggcuggguaguuugccugagagucaaaagacacuugguagccugucugugucugaugauggucuucuugcagaggugcugaguugaggggcuuaggcaugcagagaaaagugugugcacuugagaaucagccacuguauaaguaaaauugaccucugugcuauuuaguuuuaaagaccauaacguucagauagggaauaaauguuauauuguucugagacagguuuaaguacuguuaggacgguaaaccucaggaggagguaggcucucccagagguaguuaaggcucaggguaccuaccucucccacacaauaccugcagcaguguuagaaugugucaggaaggccaacaccuugauuaugaaccccaccucccaccccccuagccuugcagaacuaaaaggaaguaaguuuauuucuauguauacauacauaaguauacacacacacacacacacacacacacacacacauuuaaaucucugugugcacaucugugugugccuaugccauaggcccaugcagacacaaagagaacaucggauccccuggagcuggaguuagaacugacugugagccacccaguguugguucaggauacugaacucagguccuuuggaaagaggaaaugcucuuaaucacucaccuaucucuccagcccauguucacacccagggccuuguguuaccacugcauaguguguguguguguguguguguguguguguguguguguguguguacaucucacaggcccagaacuucuguuuauggauuaugcagucuguuacagcagcacaaaaugcacuaagacagaugcagugauaagaugcaauaacagaguucuuaauuaacagaguucuuaauucaguuacagaauauaucacaaucuucuuuuaaaugaaaaauauuuagugaaaaggggcauguauuugguguuuaucaauauaguuaauuuuuuuuuuaaauaaaggcuuuucuuucucuaguaaaauuaccucugaguguguucuuacgcuaauuuguugagcuccaugccgcacugcaacuuuagauagugucagugcuguucucagguguggacucgagaaugaagaggacugcacagcaccaaagcuguagucaccaucagagacugcucuugaaacucacuuucaaaagucucaucuaacaucuaguuguguuuucuccauugguguuuguguguguguguguguguguguguguguguguguguguguguguguguguguauguucauauguguagcuagagauggaugucagaugccugcgcuuggugucuuccuccauuacuucuagacaggaggaauuccacagacuggcuagccaucaggcuccugggaucugucugucuccugggaucacagaggugugccaucacaccuggccuuuuacauagguaccgagauccucaugccuucuccccagccuuugguuucuuuauugaggggauuuguaaauuucauuucaagguuuaaacaaaaaaaccuucaguuauagaaaaauaccggaacugaaacuaaaaguucauguccuaauuacuuguuucucaagucugaguauuguccuaccuccaaaauaguagaaauugggaugaaguuaagcaagguucugaaaaggaugauuuuaguguguuugggagauguuagcuucuuugcuuucugaaucauguauuucuuuaggaaagaauggccccucuugcuuucuuccccuaaaacacacaguugcacaggagaguauucaggaggcugaagcaggaucaaaaaguugaagacuaaacugaggccugucacaaaagccagaguagugaggcauguucugcaugcugugacacuuuauagauagaugccuccuccagaguucgucuguucaucccucagagcuugaaaagguugcuaaucacuguuauaaaacuggaguucuguuuauuguguugagugguauauagucaccguaauaaauuuauaaacaaaauacuugugaggacaagaacgagaagaacugccacagucugaccacguagaaccucuacauuugaacugucgucucuuauggccuccuuugcauuuaauguuauugagucacaaaagcacaaccauguuuuauaaacauacuaccuuuugacuugcuuuucaacuuaauauauugugaacuuuuucuguuuuuaugugguauuagcaucaaguuauauggauauauuuguugaauucauuugcuaauuuuauuuguuugcauauuuuguuuucgaucagugcugaaccugguguguuacauacaauucgacuucccucaagagaguuucaauuaaaggacauaaagaauauuaaaguuaaccuuuaauauccuuuauagcuagagaagaauuugaugccaugaacuagaggcaacuggugugacaguaaagucaucauugacuggaaaggaagcagauaggcguucuuacugaggcuggcccaggucauagagaagccaaaaacucgugggcuaagagaagcuucagcuuccugaauguaggugggaggacagaugagcuucagcagggcacaaacaaggcagguaacacagugaggagaacuauuggaagcacaggaaaggggcuaauccugaggguagagaccugggcuccgggcuccaaagacagaggagcaacacaaaggagccaggugugcucugugucugguguuugcacccuccagcucucuacagagaaccuccucuuggagcuugcgauggugugggaaaguggaggcucugcaaagcaaguagggcacaagggagagcagagcaucaggaguaggaugcugccaggcugcccagcccauuacccaccaggugaguggacagcaagaagacaccacaaaggaucccacuagaaccacaaugugcuggcucucucuaugcucagagguuuuggcacuggaacagugagaaagacaagacuaguggauuuaauccacugaguguauaucaucuuauuacauuuucuuaaauugccuaacacauugcuuuuccauuauucaaaacaccuagucuaagaacauuaaauggaguguguuuuauuucauaaagaugaaacugggguuacagaagguagguuuuuuuugugggccaguggggaaacaugcauaguggaguucauuuaaaaaucagaacuugcugggaaucuuaaacaugugugccuauauguuuuuagcuguuuguuugggcauaugagagguuuggcuuaugguguaggaacugguuaggcacauacugaggaagauuucgaauagcuggaacugugaggcacguggaacaucuuuuucaggcagucggcaggggguccugagcuagagagugcaauugaaaguccaguuggcuugagagcucccuuugauggaagucagcugauaggggauuuaauuacaccugcagaaucacucccagaaacaccuacauuucaauagcuugggaagguauguuugcuacagaauagcugcuggcucucuuccuaucuucaauccgcaggagagacuuucagaagugucuguacucuuaagcucucaugaaugagaaaugcacuaaaaaggaauccugaggacuguaacuuagaccagccugaguguuaguauccagccacuguagggauauagacaucaaaauuccuaacuuuagugcucuugucucaaaaaaggaugcucuuuugcuuaaaauacuuuguuuggcaguguagagccagguucucaggagacaaaaguagcuucaugacaagaaagaguuauguuuucacgauagaaaguuauuccuaaaugaacaaaaccauccaggaucuaaaaauggaacuagaaacaacaaagaaaccacaaagggagacaacccuggaguuagaaaaccuaggaaagagaucaggagucauggaugcaagcaucaccaacagaauacaagagauagaagagagaaucucagguguggaagauaccauagaaaacauugacacaacagugaaagaaaaugcaaaaagcaaaaaguuccuaauacaaaacauccaggaaauccaggacacaaugagaagaccacaccuaaggauaauagguauagacgagagugaagauucccaauuuuccaacuucaagggccaguaaauaucuucaacaaaauuauagaggaaaacuucccuaaccuaaagaaagagaugcucaugaacauacaggaaaccuacagaacuccaaauagacuggaccagaaaagaaauuccuccagucacagaauaaucaagacaccaacugcacuaaacaaagaaagaauuuuaaaagcaguaagggaaaaaggccaaguaacauauaaggcagaccuaucagaauuacaccagacuucucaccagagacuaugaaagccagaagauccugggcagaugucauacagacccuaagagaacacaaaugucagcccaggcuacuauacccagcaaaacucucaaacaccauagacggagaaaacaagauauucuaugaaaaaaacaaauuacacaauaucuuuccacaaauccagcccuaauaauagauggagaacaccaacacaaggagugaaacuacacccuagaagaagcaagaaaguaaucuuucaacaaacccacacaaacauaauuccaccucuaacaagaaaauuaauaggaaguaacgaccacuuuucuguaauauugcuuaauaugaaaauuaauauuacaaacauauccuaauugauugaaauucaaaaauaugagugauuaaaaauuuguuggcugucaugcauuggucuuucuaacuugauaacuggaaaaauccaauauugcacaauccauauacacuuucugcuuguuuguacaugacagugucuugcuguguaccacauaauggucuugaagucacgcucuccugucucagccucucuauuaguagaauuguuuauuugauguuuuuacaauauacugugguuuucagaacagcuuauauauuucaaaauuauuuauacagccaaaagaaguguagacaauuaauuugggugguggcuuguaagagaacagcaaaaagugagacugaaggcuuugcuugauauuuauaauuacuguaucaauuuugaagaagaggacuuuauaaauuacucuuauucugagaugaaugcuuuucaaaaucaucacagccaaugaaccagaaucuuacccucaccugaagucugugccacccuccaagcagagccauuguucauugaaacaguugaugaaugacuucauggauagaccaucucaauacacacaccauuucuuaaaugaauguaaccuguucccugcaagcugugaaggacaacagucacucaagucaaauagcuucgaccauagcaggaaaucuguauccaaaaaucauaccuacaauucauuccuuggcgcagcagaacugucaacucuuagcuuagcuacaauggagguagaauccuuucgugaugugagggacauugaaguacauuguaauaaaaugaacuccaaugucuaaaaauuguucucauuuuuguuuuguaccacauuaagagccaagauuuuaagcucuacuaaaaccaaacaaaaaaaaggccuuaucauuuuauguucauuuaauaacauguccaucauuuuuaagauugguauaaaauauauuguguugaauaugauuaaaaagauaaagagagaaaagaaaaaaauauauuuuuauuauauauuuuaauaaaaagauuauuaaaauaaaagagagaggaaaaaguuauuccuaaguggcuucaggaaguagacaguuacuauacuuguucauguccucuuugaguuaggguuuuuccuccacucauagaaacauagacauuguuaguuaaucagaauuuuucccgcauugaucuauuuucuuucugccuccaaacacuccugcauuucuuaaguggguacuaaguaggaagcaugaggucagagcaccacuguagaagagcugcuguaggcuaccugccuguugccugaggacaccugccuaccucuagcaaccccgcccauguuuguuuguuuuuguuaauaaguguuaagcuuucuuuucaguuguucaaccugugggcaaagugagcaugucccuggcacaggagcaaauucuguuuaaguuggauauaacauuuccauucucauuuagggucaguuuacagagagauaugacccagacuagcuagggguaugaggacacauguaagggaauucuggaggaggauuuuuucccucuaugcugcucaguguauagaaguccccucuuccaggcuaaguaugggauuggugacacaguguuguggcagccauccuguuacuugccagcgagcaguacuuggcaggauagaggcagcauguugugucucccagcaggaaaaugcaagggcguguucccugggcagcaggcugccaugcugagcucacaaaccccggugggugacugcacuggcuggggccuuaguuaggacaccaguuuuguguccuugguacuuuguggagcacaugguccccuuccucugccccuucuuuugucugcagguagccuugugagcacacaucuacauauucguccuaucugaagccugcuggggcaccuuucccugaucuuucauagcucuggcacaagccugugauucccagucuauggccccauuccucgccacugaggcaucugaguacuuccugucccuuggagcacucaugucucuucugucagucaggagaaagguuuuaucaaguuuauguacucucuccuacauucuucauugcucugcuaccuccucuuggcucaggcccguguuaguugaaaacuaagacugucucuacauguauggcauuuacugacuuaucauccaugcugucaacaaauuauaauguuaaaauuugaucaugaggccagggagauggcucaguggguaaaagcauauacugccaugccugauaccuaaguucaauuucugcuauccacauggugggaggagagaacugacucccaaaguuguccucugaucucuacccucauacuuacagacagcaugcccuccuguacguacacacacauacacacacacacacacacacacacaaggggaguaauaaauaaaauuuuuauaaacuugaucacauuauuaucuucccauaaaaaguccuuuaaugguuccuguugucuuaugauaaaugcgaauagucuucauuucuuauuccacauauauagaaaacuacagacuguuuccugaagucagugugaucuuucuaacucugggcauguucuacauacuuugaaaauaaucucccucuuuuguuucugagagagagagagagaauaaauaugagaaugaauacaugggcacaugagugcagugcccguggaauuuagagacaagaucuguggaacuggaguugcaggcacuugugaaccaucuggcaugguugcuagaaaccaaacucuaguccucuggaagcaguaaaugagccauugagccaucucuccaggcacacuaaagcaguguuucuuacacauagaaagaaaacaaauuaugaucguacauugaacagggguagcagcuaucuauuuuuuuaaugcguguauuuguguguguguguguguguguguguguguguauguuuaggcaggucaaagaacaacuuguggggauuugauucuuuccuuccaccauguaaguuuaaagaguucucccacccuauauuucuuaaacaaaggauucugucacugaaccugaagcacauccauucagcuagacgguuggccagauaaccucaggacccuuuauguuucuaccuccuuaacuguauaugcccagguuuuauguagauguugggguucacguucagguccucauucuugaacagcagaugccagccaucuucccagguccuuguaguuuuauaagccgucugaaagcaacaggcacuaugauucagucauauuuuuaguuaucauuuccauauauuuagagaauaagaaaauuggcaguuaguguagauggccuauaguacuucugcuucaaucaguguuguaauuguuugauuguaaaugagagaacacugacugaaacuccuuaaggcaaaaaaauaagacugauucagccaccauaacagacagguaggcccacauuaccuaaggcugccaggacuccuguguccucaccuugcucacucucaguaccaaugcuauuucccuacagcccugcugacuguuuccacucuaccuucuguagccuucuuucucucuaaucuaaaacaucuuagcagagagcaauggucaccccagguggauucauuguccaauuccugaagcagcuguguuaagaagacguauauaucaguggauguaaugcuauuccuaguuugucagaguuucaucaagagagaaaucauagccgggcaugguggcgcacgccuuuaaucccggcacucaggaggcagaggcaggugaauuucugaguuccaggccagucugaucuacaaagugaguuccaggacagucagggcuauacagagaaacccugucuuggaaaagagagagagagagagagagagagagagagagagagagagagagagagagagagagagagagagagagaaauauaucauacagugggcagcggauccuauugaagaccaucuuagucccuuggcuucucauaugccugaugaccagucaguagaggucagcccugugcucaaaacaaccuucacagcuugccaugcacagguagacauggccuucccacuguuuccaugguaucuucccagcuacacagaagugggauggaucaccaccuaaaacugaguuuaaauauccagacugaugcugccacacacagacauaccccagaggguauacauuguccaucauauagguaguugauccauuuaggaugggguuccuauccugacuuccuuugauaauguggaagcauaagcugaauaaacuccuuccuccccaaguugcuuuuaugguguuucaucacagcaauagaaaccuaaacuaagauauguacuccuaaguaacauagccucccuuuuucuuuauuuuggguguuuuuaaauugacuuucuggaauuggauuugaagcuggaacuuugcaaacauucagcuuacucuccaccuuggaccagccuggaaucccuuaaaugugcuuagaacauuuccauucuauucccagcuguccucuaaugacuggcuggccagggcugugccugccucugcucccagaguuauagagaggcugggccugcauagccaaagcccagaaugggauccagggccagaguacaaugucuagugacuucauaugaccucgcaucacuguaaagcuuaaaaaggaaaugucauucuggccagcacaaguuacaacaucugucuacacuaacacaacacaaugaaguucucugagaaaccacagcaggccuucagcaaggcugagagcgcaaacaaaggaaaccagcucagcuuuuacuggguucccagugaggcugguagaggcagaagugguggcagcaguuuggaaucuugguugucauagccacgaggaagcagagggccuuucuguccccugcucagauguacugggaagggaauguugugggauggagugucagcauggcuugagaaugcuagcagugugggcuguccugaggcacaccuugcugcucucuaggaaaccugguacugacuguccucaccucuguggucaccucuauuaauaaugggcuaacacucauuucagagcacagauguaaaauuagcauucugaagaaaugggcuguuuuuuaaaaaagacuuuugugugugucuuugccuguauauauauuuauaccacauguaugacugguacuugaagaagucagaagaaggcauuggauccccggagccacagccaacuaugagcuacuaugaacccaaguccccugcaaaagcaacaaguauucuuaaccaggccccccaaauagguuuuucuuggcuuucuuuuuaaauuaacuuugucuuuaauguuuaauuucuacuucacccucucucccugguaucuucccagcuacacagaggugggauggaucacccugcccaguuuccaaaugacacucugccaugauuuggguacucacaaccucccuuucuucccucucccaaauuauuuaugccagugucccuaaguguuuucuguuuccauagcaacaucuuucucucaggcauuuauugcaagcaguaaacgauguuugggguaaaaacugguucacugcauucuuugguucauauaauuauuaggugcagaaaaauuggcuucagaucuucaguuuaaaaucagugcaugaaagcuuuuucacccuaauugcuuucugguuccaagaaaaucaaggaggcuuccuuuuucuaagaguuguuugguugccuuguagcuucccacuucuaauucuuacuuccaugcauaguuuuauagcauguguuugugagaacuguaggauguuguggugauggaguuuuacaaagugcugguguugauuuggcccggcuuccugccugaggcugcacagcagaaugcuguauuucauucagcagguuugucuaggggcauuugggaaacuaugccugcagcuguuuccugcgguugcaggaaacagugauagaggaaguuuaaucccacaggauugcagcuuacuuucccagcuacucccgguccuaagguuuccucccaguucuuuggaaccuuccacuccuguagaaucuggacagugugauccuucagcacagagagcaaagauguccgacugcucuggcuguguucaucuauaaauaccucccacuguugucucugacuccucuguuuggagcagccaauaauggaaacaaacaggacuagcacuggcaagggacuggauauuuguuuauuuuuaaauucaacuugucuagccaggcagaucacacaugcugcuugugguagucagaacuguaagaugauugggagaauuucagguuucuaauacacacacacacacacacacacacacacacacauauauauauacacacauaccucuuuacaaccaagcauuaauccagaugugacuguaaccaaggcucuaucuaaauccuauggucuuuaaaauggagagcuaucuguguggcccagaccuagucccaaagccuucaaaggcugacuuuagaaugaggagcaaaaguguuggacauuugcaguaggagaggaacuugauuuuggaaguagaggagcugcauggaaucaugcaaacaaaguaaaugcauuuagcucugcacgagaacccaacaugcucagcauuugcagaaaccuuguggaacuuucuuagaaacucgugcaguaaugaguggagguugccuuuaacuacugagcuugugguaguaacacagccuagagcaugagaggugaugcagagagcuuugcacugagagaguagaggguaggcuggacaaggaaggcucuuccuacaaacggaagccucucgccaucuucucuauccucaucacuccaaauucccauaacccuucucucagcaaggccuuaucucuucuacucggcauggcccagaacauuuccuccuugaugccucaagacaaauaagccaaccucccaucgcuggccacucccauggacguccauacuugucugcuugagcccuguuguguagcaggccauccacagcccuguuugaaggagacuuuaaaguaccugucuaucuucacccugucuuucucuuagaugagauugcuuguauuaaaguuagacaccaacaaaagcauggggagcugacaaaagccacuuagccugcaguccuucugaacuguccagggacaaagguguuuuuaagagaaaguacauauugugcuauguaucuuucaagauacaaggaauguguuuauuucucuuuacuguucuacuuacaaagccgaggaaauaagcagaaaaucuaaauagaguaaaaaaucaaaacccaagaauuugaguacauguaugagaagccaagcaaaaugagucaguccaacaaagucaggcuguggcacagagggcagaaggcagguccuuacaugcucugcuugcugcauugcccucauuccaaaucaaacacacacgacacaacaggcauccuucugaauauaggcucagaaguaccccacaaugugccgacagacagaccucaucuguauguaagggaaucauacacugugagcaaguaguaguauucuaggacaaugaaggggauacauaagaucauacauagauguaguaaagaugcacagugugcuuccauagcaagcauucugaacaaaccaagaacagaaaggaauguuccaaccuaaugaagaugaucugugaaaccccaagguugaugucaugcugagagggaaacugucccugcaucaggagcagcugggagucuugucagcucucuucagcaucucauucuucugauuuggcaauaagguaggggaaaaaaaucaguuggcacccagauggacaaagaagcaagcaucucuacuugcaaauguuccccauuccauggacuagauacugacucuaaauauaauauuuuaaauuaaggcuacuagaaguaguaaguugaaugcaagaccaacauacaaaaauaaaccaugguuuuguucaguggcagcaaauaaucuuuuuaaaaagagagaaacagucucagccagguggugacauacaccugucacccagcacuggcguaggggagcaugagcucagaggcggucuggacuaaauaaagacccugcgucaaagcugggaugggguggggagaaagaguagcaucaaagagaacaaaaauucuuaaauauuaauuuuugauagaagcacuaaggcauaccaaaaaaaaaaaacccuaaaaauugugaccaagagaaaugaaauaaccaaguaaauaggaaaagaaaucucacagcucuuaguguguuagauggcaggaauuaagauagcagauugaauacauucuucaucagaauuucaccugucucucuguguagaaauugauaaccuuaaaauucacagccauauaaaggaccccaaacagucugauccaaaacacccuuaaauuaacguugaaggaagcacacuuuccaauaucaaaaacuuuauagaaaauuuuuuaaaauucuguuuacuuuaugggcucacauauguggaugucaggggacaacuuaagggucuugguucccccauucuaccauguggguccugagggcugagcuuagcuugucaggcuuggcccccacuaccuucaugugcugagccauuuugguagaaagcucuccauuuucaaaggcuuucuacaaagcaguggugguucagacauaucccuaaggacagacacauagauaaaugcaaaagaacucagauuguagaaagagauucauugacaguugauugucacagugaugccaagaccguuuaauaggggaagaauauucuuaguaguacauggugcuggggccacuugcuauccaugugaaaaaagagugaauaucagucccuacauuauaccaugcaaaagaaugcaguguaaagcuagaguuaucaugugacuaaauaugagcuuaauggaggagcugugagcauuauagagcuagagauaccaugcagcuaaguaugaauauaagggagcugagcuguaagccauuggaagaaaacauuuuguauguguccauuguuauuuuuaaaauguagaaauccagaugcacaauuaacaggaggcaaaauuuauaccuuggguuacguaaauuuuuuuuuuuaaguuuaugcuguaauugauaaccaucaaguaaagaacaugacccacacacugagaaaauauuggcaaagcauguuucaagggagcuauauggcugacuguggccaaacauacaaguacaauguuagugaaaggaaaguccgaugcucugaagaacuggaagggaguugccguugucagcacacugagcaagcugccccuuucauguguuuauagggccgcuguacaguaagaacaggucaggccccgcccaggguuagcguaggaugauccuaagguggaaagcccagcucugcacacccagcuucuggcugacccaccuugucugcacccugagacagugcuuaggucaaacugcaguugggcaggauugcccuccuagaccauagcguacagacccagcucucuggaagaccugagaggagaguuggaaaccauaaccuuucuacacuuguaaggaguugcucucugcgcuugaguccagacagccuucccauccgcagucugguuuucaggccaggcuguccuuugccccccuggucccucacucucuccugucugcccguucaggcagccucucuucccucaguucgcuaaagaguucucaguugaguuuauuccuuuguuuguuuuucaguguuccuuagaauugauuuuuuauuucauacaugaguaccguauucagacuguuuccacucuucucuccuucccaacucuuguuccuccuucaguucucuaguucauaacauccuauugauuauauaaauacauauauguauagaucacacgcauguacaaauacagccugcagaguugacuuaguucugcucauguauaugugguuaggacugcccauuugggauugggaguguuucagaggguccacccauggagaaacccgauucugucucuugggacccauuaacccuuugauugcuguuacucuucugggggugggcuuuccccauugauguaggcauggaaauugauaaugguguagucguuaugcugguuuuguuuaggcaaucaugcuguugagauuucaucugugucauacacaucuagaagacaauauaccacagcaggugucccagaccucugauucauaacgaccuuuccaccccuguucugcgauagucucugagccaccauuguagggguuguguuguccagaugugucuguuagaguugggcacccaguggucaguuguucaccgcaguuugacccauuguggauuuaccucucuuuagcuuuuaaauuuuaacauuguuuuggaggcauuaguugggaggagcaagucuggccuguguccuaauauaaguuacgauccuuaaaggaauuuaaagccccuaauucauuuucuuaaacuggugaaaauuaucaaauuauucuuugguuuauaaauuucccaaauaauaaauuagucagacgacugaacugaagaaaagguaggaauaaaauuguacgauguccacuugacacaacuagaaagcacagcucgggcugugcucaccugcuuaagcucagcuucauguacagacacugaaucugaauuguaaaacaaggcuucgggaagugcgcccuggggaaagcgccuuguagaagaaaguuggauccgaauuagaaaaugaguuagggcuccaggacagggacggcacauugucugcaaaggagcuagggucguucacagucugaagguuccauuugaauggaagucugcauggugaaaucucacuaguugaaaaucaucagauucugcagggcacuguaauacugaaagagggagaggaaacaagccagcaagcaugugcacaugugcucucacccaugccuccggcugcacugagugaugcaugcugugacggccuuugacuuugaagugcugauaaucuugacaggacauaggaccaacaugccuaugagaacaucugcccugaagaaagauguguacaaugccgaagaagccaggaggauacacagugacaugagcugcagaaggacccauccgccacauacuaagacugcuuuuaagggacaccaaggggucauuccguggaccugugagcccuugaggauguauuccauaguguucccuugaaaggaggcaauucguagauuccggugcagagagcagcuguggacaaguuaaugaagcuuucuuaaguuucugugcccucuauuagucgagaauaacagaaguccccaacuugcaagauuucuuuauacaaccaugccgcuaaguuugucugugcuuguagaauuugaggagagaggcagugugguauuaaugaggaaagaugaaccuacccucccaggcuggcuccagguuagagagaucagccagcugagacuuacuugcccugaagucgcaugggaucgacaagcagauacuugucgaggggcuacguauguuucacuguuuuaugguauuugcauaugaauuugcuuaauaaucuauauguuugacuuuuaaauaauuacugauuauccuaaaagcuagaagugucuuugaauuauuucugacaguuuccuuuuuauuuuugcaggccaguuggaaugccaaaaauggaaaaagucuacuuacauaacccuaguucugaagaaacgauuacuuuaguaucaauaucugcuaccacaucacauuuccaugcaucguuuuuucaaaauaggguaagcuugucuacuaaaaauuacuuuuguuugaaauugaaguucuacauuuuuauuaauaacuuuauuuugcuaugauuaaaaucugcuucuaguguuuucauacuuagaugccaguuugucccauuucauaagaauuauaauaucuauucuuaaaugcacagugucccuucaaguaauaguaacugugccaggauuccuaagcguucugaaauccagccugugcaaagcugagggcuguguggccggugggggcuggagagguugcuguucuuguuuuguuuuuuccaagacaggauuucucuguguagcccuggcuguccuguaauucuuucuguagaucaggcuggccuugaccucagagaaccgccccuccccccacccuugugcugggauugaagguggaagccaccaucccucuucuuagcuacaggggccagggccuuagcagugagugaggcugcuauggcugggcacugagugagugaaguuggauggcuucagcuagugcucgcucggggacacgguucauuaguucagcgaguugucugcucagcauaucguaaaguggcccuuccugucugaggcucugagaggacgugcaccuccagaccuauugagucuucgguggauugcauugucauugguugcagaacaaaaggcccugccuuggugaccaggcucucacucagcuugaggcacccgcgggcuccucugucucuuuaugcuggcggcaauguccucugcccuucuugugucuuuucccucucccgcugcuguaucugcccaagcugaccugagcgacaccagcaaaguccuuuuuacaaccacaggugucuucauaccuguggucacagucacgguuggguucuagguacuacaaguguccuccaaauuuugacugaugaugucaguuguuggaugugaaguugguauucagggaagagccuuucugaucaaaaccacaaaagaugggacugaaguauauuuuuuaauuaggagauacauuaaguuuuaauauguaggcuuccaaaauaacgaacaggaacuaugaggagaaagaguaaaugaacggguucugauugcaucuucacaggguuuuuucucacuguugaagggcugugacuaagaaaaugagcagcaucuuuucuaacauguaaacuacugguguacgccauauuacuuguucaggauccuacauuucuucuuucugaaauccuguaucauuguaugccauugucagcagcuucuaaggguaaaauggcuauggcuaagggguuuuuuuaucccucucuuuggaaauauuuucuaaauaaaggguuugaaaguuaacauauugcuuuugguaauuaaagcuuaauuucuuugugcuacucauggaaaauaucccuauucuuaaaguauuucuuaaauuucccuugagcuauuguuguuguuguuuuuuuaaccuaaaagaucuuuucaccauuuuuauuaauaugucaauggucuuuuuuuuuuuuaaagauuuauuuauuuauuauauguaaguacacuguagcugucuucagacacuccagaagagggcgucagaucuuguuacagaugguugugagccaccaugugguugcugggauuugaacuucagaccuuuggaagagcagucgggugcucuuacccacugagccaucucaccagcccgucaauggucuuaaauaacaaaauucuaauacugagggagacucaaguauauaaaggaggaguaggucucagaagagucagggucagaggucagcauccaugagucugcuuagugauuugccucauacguggccaucacaagugguacacacauuauaaaccaccaccaaccaccccugugugugucugugucucuaaacaaccauaagcuuucaggcacugguagugugcaaguguacuagguuagaaggcaaagacaaaugggaaaagcccagaaguaguguuugauugugcuacaguuacaguugugcuagaguuaguaaugccuugauucacucugccaguucugagaugcuuuguucuggggguugaagcucccccuguuccucuccacaucgugagcaggaguugcagcuguggcuggaugagggaaguggggugggcugcagaagugcugggggucccuguaagcaacgccagcuucccugaccugguagccauacugugggagguagaagucugugugcaguucugaguuuucaaaacaagucagaaguaugaauuucuauguaucucucagcuuuccuacauugggaacgaguugaauuuagagacaggguagagugcccaucguaaucagcucuucacugccagcuugacaccucugaauuagacuccgcccagagagagacgugucuccugaugaccuuuaugugaagaacagaucccuggacauucuuaaaaaauacauugugugugcugucagccaguucuaggaaguggagcugagugagcuccaugaccgucccagugccuguggacacgucaggucagcuuugagacaguuaagaugguggccauaguuggggcuggccuuucuucuucccugugcauccaucuuuccuucucaaagacuguggggaggggugagccguugaggggaaaugagccgugucucucaugcccaggagagcacagccuuccuauauauccccucugacuuaacucccuccacacccucagauuccccggcacuucuuauuucuuugggaaaaaggauauuacaacucaugaugguuuuuauuaucuaauaccaugucuauauuaaccaaccaguagaaaaauagagaaaagaccaagcucuauauagcuacauuucaguuacauuucagucuauagauaaaauuuaaaauuuuuaagcugcuuacuuucuuaugcuuuaaaauaaucuuguggguugaaggcucuugugaacauuggugauuauuuuuaauuagauguagaagccuaaacauuguuuaugccauucuagguuaaacucugcuauccacgcagguugucagaaaucggggcacauaugcuauagcccuagugugggguauuagacagauaaagauaaaccuguguugugucugcugcuacagaauacucuacaucgugugcuccuguguaagaaaagcagaucuuagcagagagaucuuuucaugccauuguaugaaaagcuggggcuucucugggguuugguauguuagcaagagccgggguaaguugucugcagcugcauggcgauggccuggagagggcaggacuagaggagccuagagagcaccgaccuucucacacacugcugccauaucugcugucacagcuuacagcauggagcacauaaagacuuuaaaccagcuuugccaucuauauagaaguaacaaguguguuaauuuaauaaauauugccaggauuuaucacugaacaagaggucucugcuuaugauacucaccccuaguggggguuggugacuucagcagacaaaauaaagauacuuaaugagaccaauuagacaguugaucuaugaaaaagaaaagcagcuggguagggggauagugcuggggugagucggguuuaaauagcaggcaggguuuaaccugagacuccagaaaggcaguccugaagcagcagaucuggcagaggcugugcugggaaagauacccaggaguaguggggucuccgguugugagggccacugcuuguuacaaaaaggucuuggcuuugguucuuucugaaagagaaaggcauccgaagaguuuucgcagaagaauggaauguuaaauuuuauuuucagacaguuacuguugaucaaaaaauagaagauaagggagaaaucagauguaggacugcucugguugucugcuguauaagugagcuuuguuaaauuuuccaggcuaugagugaaucuuuucauuucuucugauauuaaauguauaggcauuggguuguauauaauaccuuuuuuuuugauaggaucauuuucuuauaauaguuuuauacauauauaauuagacuauucacauuugagcaaaaaugugguauguuucucugagucugaguuucuucauuuccuggggugcuuuccagucacacccauuuuccuguaaauccauuuuccuuuacggcugaacaaggcaucaucguguaugcucuucacuuuguuguccaggcccauguggugggcaggcaggccgcuccauaccuggccuguugugaagagcacaacaguaagcauggcugugcuagcuucucagggugcugacugagaccccuuagguacauacccggcagugcuacaacuggaucauguguuaguuuagucugauuuccauaguagcuguuaccaauuucaucccuacaguguauaugucuucaucucuucuccauccgaccucaccuguguuucuuguuguuuuccugauaacaacuguugugacucagugagaugugaucucacaacaguuguauuuguaguuuccugauggcuacagguauugagcacaccucugacugacuuucuuucuuucuuucuuucuuucuuucuuucuuucuuucuuucuuucuuucuuucuuucuagaacagacuccaguucauuaaccauuuauugguugggugauuuguccuuuuggguuuguuuguaugcuuagaguacuuuauagaucuagguauuaauucucuguuagacauuuagacugaccaagguuuccacccauucuguaggacaugccuucacucuuucauugauuuuucauuuuauacagucacuuggcaauucuuggacuuacugugugugcuguuggcgccuuuuacaaaaucuuugucccugugucuugaaguguugggcgagucuuuauuagugcuucaguaguguugcuuguuacaaaccugaauuguuuauauccucuugauacauguuaguaucauacacagcuaggaauguauguuucuucaguuuucaugauaaagguuucaaaguauuccccaaugguucucugcguuucaucagaaucuguuguaauauccccccuuucaucucucauuuguuaauuuagauuuugucucucuuuugauuagauuggauggggcuuaucaaucuuguuacuuuucaggaagagccagcucuuggcugacugugguucuguuagucucugccucauuauuucugcccuggugucccaccuuucuugccuuccacugccaaugcccuugcuuuguucgucuuucucuaagacuuugagguacagcauucauuuguuugagagcuuugcuuguuuuuaaaagauuaauuuauuuguauauuuugugugugaauguuuccauucauguauaucuacaccacgugcaugccugguguccauacagacaggagaggacgucucugggacugaccagagcugccgagagacaggugagagccgucaugugggugcuggagaugcggccugcuccucugcaaggcagcaaaugcuuuucucugcuggagccacagcccagccuccuccccauuucuuuauuaauuuauguccuuagaguuuuaaucuuuccccuuaaaacugcagugacuguaucccaaagguuauggugaguuauaauuacacuuugcuuucauuugauucuaagaaauuuccagguauaaucccuccccagaaugacuucagugaccuacuggucauuuaagagaauuucuccaugucguguccaagcauuuguacaguucuaugguuucccuaguggcuggugucugcuuuuauuccacugucuccugaaauauaagacauuauuuugaagccagugcagugcgaucuccuggacccacaugaugggagagaagauccagcccucaguguccucugaguuccacaugugccauggugugcacaugccacauacuaauguacauacacaaauacauuuaaagguuuguuuguuugguugguugguugguuuugguuuuuugagaugggguuucucuguguagcccuggcuauccuggaacucacuuuguagacuaggcuggccucgaacucagaaauccaccugccucugccucccaagugcugggauuaaaggcgugcgccaccaugcccggcacauuuaaaguuuuuaaagaaauuauuuugauuauuuucuguaucacuugcuuugaaacuuaaccugucuuggggaaaguuccauaggcuguugagaagaauguguauuucuauucuacuagguauaauauucuauguguuaaguccauuugggcuauuauguaauauaacuccagguuucuuguugguucuuguuugaauguccugucuaaaaauggggacagagccgggcagugguggcauacgccuuuaaucccagcacuugggaggcagaggcagggggauuucuguguucaaggacagccaaggcuacacagagaaacccugucucaaaaacccaaacaacaguaaggaacaacaaaaaaggggaguggggguggggggacagaguaaugcuaaagagaugauacuggguaagagcacuugcugcauuucccaagaaccuggggucaguucccaguggcaugucaacucagagcuaucuguaacuccagucccaaaggcagacuaacgcccucuucugggcucuguggacacugcauacagguuagugcacagacauacaugcaggcaaaacaccuauucacaucaaauaaauacauaaguaagaaaaugggauuugaagguuacccacucuuugugucaggaucugacuaaccuuugugcccacuaguguuuguuuuaugaaaccaggagcaccaaaaugggguacauuauuacuuaaaauuguuguaucuugaugaauuauaucuuuuauuuggaacucuaucacauaucaaaauaacuacaucagcuucuguuugggugauaaauuuacuuuuugagugucuuccaguuagguauguauauuucuuagagacaacauauagucaguuuuuuuuuuuccaacucagcccaucugaguccuuuuauugacacauugaagccauuaacauuuaagguugcuauugggagcuaucauggggauuguugugugguuuuguuuccugcuaguauugagaguuuucugagugacaggcuagcuauggcagaguucuuccuugaucgccccuaucauccguuccccucauggaguuuaugcucuuuagacuacaguguguuagacuuucuucccuuucuguacagagcguucuuucugaagcacuccugugcugauggcucguuugugcuugucucgaaauguccugauuucuccagagcuuuuaaaagagcugugcugaacaugaucaucuugguuggcagcugagugcuuuacagguugaagugucuggcccaggcuuuucucagcacagagucgcugaagccagagccagagcuugcucuggugagucucacuuuguaaacgugugggcuucucccuucggcgcauucuguaucuuugcucugaauuccugacauccugacuuggugcugcuucucugcuguguacaccuagaucuuuaagucucuugcauucggugguucaguucuuucucuagauuuaggaagauuuuuuaaccauaauucuauuaaguagguucucucugccuuaagcuuuaucucuaguucuuuaccucaaggauucuuagguccugucucuuaaucaaaugugggagguccuggucccugccauugaguuugccuguuccuuuagggaugcuugaccuugugucccaccgcugacaucuuccuucugcuugggcaagucuuucagagacacuuggcacucugcuuuuuauuugagucguugagcuuuucuuuucuagugacucuguuuuguuuugagucucaguuuuuuugcugauguucaccucucauugcugguuuucucuucuuuguugcuguuuucccucucaguccaggauuggucuccuuaccucauucaucugugugguugcccuucuuggggguuuugcuuuuaugauaucuauccaucagcuguuuuagcuacuucgguuucugacucugacuguuaaggaauuguaauugcaggagaggccuugucucucuaccuuuccacguugcaguuugugcauguuuguuucgcugucuuccugacuuauuugguuaucauuuuagugugcagcuugccccuaagagcucaauuuccuuuccccuuagaaaggaaaaagccagagcuauagcuuauagcuguaacaucgaaucaugcaggacaaagaaagagacagaaaauaaaguaaaugccaccugcauaccacuguuuaauaaaacuugacaaagcuaauggagaguuggcuuugaaguuaaaaauuauuuugaguggggcuagauagacagcucagugguuuagagugcuuguugcucuugcagaggaccuagguucuguucccagcacccacauggccgcucacaaccaccugcagcuucacuuccaaaggcucuggcaccaucuucugaccucaucaggcaccggacagacaugcaggcaaaacacucacacacaaaaauaagucuuacuuuuuaaaauuacuuaggguuaggaugaaaauaacaaauggaugggguaaaagaagaagcagggaagggagaacuagaagcaaaguuaggaaacaaagagagaaagaagagaagcauguuaugaagaagaugagaaaagagcaagaaguuagacuaaauaaaggaaacaauggucugccgaugaagacccaaguucaaguccccagcacccaacuaaaagcuggacacauaguguagucuaacucuagcacuccuacagggacauggggacaggcauagaagagucccugcaagcuccuaggccagccagccugcuguaugcauugggaaaucagcagagaccccgacuuaaggugccuguguguuauccugacauccauacacaccaugggacacauacuagauguuuacacacacaagugcauauaugagcacacacuucagaaccaagcacauuuacacacacacaagugcauaaaugugcacacacaucauaaccaagccuagauaaauauaaggagaauaacaaacauuaaaauguaaaagcuuuuuaaagaaugaauuaagucgaaaauacagaugacugaaaacccaacaaaccagagcaagcacagaaaagagaaagaaaaauauaaacaaaauuagcuaaagguaggaaggggaacaaaaacgaaagccuaaaagcuauuuauagaugagagaaaauacuccuaaugguauagaaaaggaaaguggauagccaguagggcacugcuaauucgucagagugcuuuuccucugggucuuugaaaccuggaaguggcagguaugugcaggucaguugaacuugaggacucgugucuucuccugugucuuacgcugguccuuagccuguauugcucaaguguccacugucuccagggcugucucagucuaguaccuucucuucuuugcaucccaggggccuuggcuuuucagucucccauucuccugcgccccgcccccacaccggguucuuacugaaauggucucugggauggagccgggugggggagggugucuccugagugcagagacaguagggaaagcaguggcaguacuuuguucucaccucauucauugcccugcuggaggagcacagcugggaauguuggggaguguccuggagcucagaguucuuggacucuauagcgucagguggcucuagaggucuguccacccacacuuguuugucuccagaggcuggugagcuccccucuucccugcccucagaaguugccucuucagauagcugcuaggcacaggagaacuugggacugcagacccauucucuuagaaaaggcacugugucagggagacccaucaauaauagaucugagccuugugaaagcuguggccuuguucuguggguaggacuggcuacccaccaaggcuccuuguuuaccuuucagaugagacuucugccccccucccccauaggacagcuacggcuugguuaacuaugguugcaucucuucccuggcaacucuugaguuucucugcauuuugagcugucuuguccucuccaucuguauuuauaacacaaacccaacuuugccagauccaccucaccucccuacccaucuaacuuggcuuguuuguuuguucaguuuguuuucuaacucuucaaauccagguuauauugcccaacuaaucuuaggagugaggaguuccuuaaagagugguugaccugccaggggucacacugguaaagaaaacugacucuuccuuucccaguggcuauaaaucucgaagagcuucugagcucagaaucgggauuugugcucaucuccucuuccaguccgcuccuuucuccucuguucucccucuccucaacucucaucuccaguuugucugccucaggcuucauaggugcugcguuugcuguuaaaaucacugaguucauauuuguaacugcccuaggguauccagaaaacuggucuccuugaaguuaucuaucccugcuaucucuuaaagucuuucccuccccucuuugcugaagauccaugagccucgggauuuggaugaccccuuuaggacugaguguuaacugucugcagguugaccagguuagggucucuuuguuaauugaugucuacugcagggagucacuuugaggaggggugagagaugcacuggccuguuagcgugauaaugagucaucgaaacuuaaugucagugcuggguccacuuagcagaauaguaguaggugcucaccaaagcuauccaguuacagguugucggcccuauuagcagugcuagguauggguuccaucucauagagcagaccuuagauucaagcauaaaguaguuggauaaucccauaaugcaugccccugguauaccagugagcaagcauaucuugucaaaucugucauuaucguaguucacaggguucacagcuggaugacauuaaugguuacuuuucuucucugguagcauccauaguaccuuccaacauugugaaagcuagccaguagggagacagcuuucaggggaguaccagcuagauguuuccuugauccaugacucaagaauggagugcccuuagcaauaggacaguagaaggcuaaccaagagcauugguaauggcuuguaauauuuggaggcuucuggagcacuguagaccaauaacucaaaaagagggaaccuauuccugguacuaggauuuuuauucacuaucauguguaucugcuuagggugccguucccccauuauaagguaaccccauucauacucuauauguauauguguauguauuuuaagaaguuucuguggcagcagguuuccacguggccuuucaaaaggcuuuuaguguuagauguaccucccuguugugugccuucuaaccugcccuccuacucccacucuguuuaccuuuuucuguuccauuacaccccccacgguucccccugauguguccuagcccucuccugugaaaaauccucucuuuccugggguccuuuacugguuuucuaaccucuguugguauggaauacucuuccuuuuugauauuucuccuucaccgggcuacacagaggcagauacuaucugacccucuuuaucagaggaacucuauauuccuugaguccucccauacauaguguauggaugcacggugcauaguauagaacauguauaaagcuaugcaugcuuuagcuccgugugccuucucuccacauguucuauagaguuguccaucagcucuguagaucugaagcaccagcuuucauuguauuuauuuugcugguuguuuucugcuuucuaguucaucaaauuuuaccugacuuuauucuuuuuacuuacguuggauuucauucacucuuuuuuuagcuucucaaagcagaaauauaaauuguugguuuaaggccuguauguucaaaguauguaauguuauaaauuuuucuucuaacuauugcuuuaacuacucccuguauguuuuaauauguuguauuuucaguucaaaucaauuccgacuauuuauguuaccaugagaugacuuaaauggccaguggguuauuuagaauuuguguucugggaaguuuaucagacuucaguucauucuuaaauucaggaucagguguuuauaauucagggggagcugugcuccacuugaugccacacccaccucuaacaacuguggaugaguucucugugugcccugggaugauagcccuguugucuucccguucucugcugugguugccagcguuuacaugucaucucuauuuggaccuguucaccauccauacaauuugugugauggauuuaagaaaaguuaggauuucccccgucccccacccccaccccccaguuuuguugcugauaaugcaggaagaauguucuuucuagcuuucuucagccagagucucagugccauaugcuuugagcuauaguuuggguagcauuuuagaguucucacaauagaagcagaaugaaagagauugguagcuuuacacauuaaauguccuuaaggcuguauugcaggcaaagccuuaaucuugaaugucauagaauauccuccauuacuuuguuguaauaaaguuuccuuuuaccaauuacaaugacauucucagucugcaggaaauaauaggagugacuuccuuuuuuccuaauuuaaguagcugggacauuucauauuucauauggacaaauggcagaggucagaggauugaggcccaggcuuucuguuuuaguacaacacugcaucuauauagaaagcuuaggcucagccccgggccuguuugucuggucuuggagcuaacaguguauaauuagguccuuuauuccagucuagugacuuuugaaugaccagaguccaagggagcuaucugagcagagcuuuaggcuaguaaaggacaaagauagguaaugaagacaucuuuuauuauuuuccauuguacaacaguguggcuaacuugaagguuagauguuuaaaaggaaacagcugguuuauagaaaugauucuaagauguguuuguuuuguagaacucuagcugucuguuagccaguaugcucugacuguuuugugauaauuuaauuuucuuacuuuucuuuuucagaaaauucuuccaggaggaaacacaucauuugauguaguuuuucuugcaagaguaguaggaaauguagaaaauacuuuauuuauuaacacaucuaaccaugggguguucacuuaccagguaagaccagaacuuacgcuuccuuuucaguacagucauaaccagcaaaccugauaaccuuuaggagcugcggugugaacuccagggggaaaugggaaauacaggacauuagguuuagggcacuuacacuuccuggaucucagggguuugcauuucaucuauugcuuuuguuuguuuguuuguuuguuuguuuguuuguuuguaguaccaggaaaugcacugaggcccucgcauauucuagauguacacucuaccacuccuggcuaccuuguccacucagugacuagacuaauguagaaugaagggcuuggcucucccaggcacuaacacaggcggucauagucuauaguaucugacgguuacugucagguuguuaagaugagcuucaaugacugcuguacucuaguguacucuguccuuucccacagcuggugcuccuccaagucuuuguccuaaauacaccucaucugucugcuacucuuggcccugccccugcucuuucucagaugucaccucugcuaccucucacuguuccccaacuccuucuccuucugugacuuacuuuauaaucacagcacauuuuauaagagucucugccuuuaccacaucugcccaguacuagaguaagugccaugggcucauuauuuacuguguucacuacggugccugugcugugccuggcauagcauagacaauaauauuugucauuugaauaguugccuuucccuuuuggucagccuaagugaaauguuccauggggguuaaccugagccugggcuccauagcugagcauugucugggucauggcucuaucccuuacuagugggauagggaaauuucagcucccugugugcaucucuauguguaguccauggucuacugaagggcugugcuaaaagucauccagaacucauucuggaugcauguacacaggaaagcagaucuacgcaugccacuucaaggggugguuagcauugcucgcaucaaaauuagacugacuguucuccagagauaagagagcuguaacuaugaaaaugcuaguuuacaacgcaacuaaagcuuuuuuccccccuuugaaacagguauuugguguugggguuccaaauccguaucgauuaaggccauuucuuggggccagaguccccguaaacagcagcuuuucacccauaauaaacauacacaauccucacagugagccuuuacaggugaguuucuguccuuuuccagaggguaaguuuaaucuucauuuuggugggaauuagugccuagcaagaaaucucaagucugucacaguugccaagacuauguuagaaaaaguccuaggguuuucuaggugggcucaagagauguggggcaguccacacuguuugcguguuacccauuuuccucagucuuuguugugaccuaguuaucuucacuuugaauuaauuucucuacuccuuucccaguuauuccuuguuuguuugcuaaagguggggcaucaugcaggccuggcacuugcuggacagacgugcugcugcucagcugugcccagcugugccaaauggcaggucacaguacucagugagauagagcucuagccagccugcagagcguggccuucagcauacacagaggagagcaagcaagcagaaaaccuuuucugcuuaucuuggaguuuagauguccuacugcuuuguucucucuuacuccuuccugggagacuuuaugauaaaacaaguaucacaguuccccuacuuacuacuacuuugccccaaauuuacuaaaguuaaaucaauguaucuauucuuuguuagcacuaaaguucucugcuauuaaaguuucccaccaucuugcccacucucuuccuuaauguuuaccuaaaagaaaagaaggcagguguccauaacaaguguccucagucaguaccuacugcagcuucaugucacccaacacuagacaucaccaguauguuaguguaagaaacugugaugugagaccaggcaaguuggcacacacuucuaaucucaguacuuggauuguugaguccagacaaccuguagcaaggccauguugcagaugaauaaaacaaagcaaagcaaccauaaagagagaaaagaaaugaauuauuaauagaaccuggugaaucucaagguaauuacauugaaagaaaaaaacaaaacaagccagauauaguacauacuauuuacucuguguguagaaaacucuagaagaggggcugggaagguggcucuguagauaagaaugcuuguuuuuccaacaugagguccugaguucuaauccccagcacccacugaaagacuuuggcaugguagaauuuaccuguaaucccagcacuggggacauaaggucaagccgauucugacagcucacuaagcagccaaaucugaaagagcagcaagcucccagcucagugagaaacuaucucacagcaauauggcaacacaggaaaaugcccagagucaaaggaauaugcacugccugagaagagggggggcggagagaauuuuggagcacuggcuauauuuaauaucuacauugcagggauggcuucaugccuguauacaaaggucagcaauucccggguuauacuugaauacuugucauuuauuguacaccagagauauuaauuuaaaaaaacauuguaggcacaagcuucaaaaccaaauaucuuuguauuucuguuuuaacugaaacauaguuaagugcacauauuuauggaccacucugacauuucaguacaugucuacaggagaaaaugaguucugggcaguuggcuuacccaucacuuccuauuccuguguauuaaaaacacucgacaucuucugugaucuuugaaauggccacuaacuguugucaacuguaguucccuucaucccauagaccgugagacuuugcuccaguccagccuugcagaguuguugcacauuagccacucucucucuccagcccuccuguagagaccuuuuuugguaugugugcuauuggguucaaacccagagcuuugcacaugcuaggcauauacacucucaacucagaaaccaagugcuuugaucuuuauuagaauuguacauguaucucagaguguuuaaucuucucauggcacuguuauuggauccaccacuagaucuagcuauauguaaaauugauauguacguauacauuuuuugguuuuguuuuucugaaauagccucauguagccuaagauggccacagacugugcagcgcagauggccuugaauucaagauugccucagccucccaagggcugagaagacaggcauguggcacugcaaaagccuuaaacuuauauuucuaaaacuucaucauuuacauguaucuuuauuuuuauuuauuuauuuuuuaaaaaagguguucuguugcuuccuaaaaccuaguuucugaaacuacacugcuuccagguuuacuuucagaguuaacuugagucaguugcuucugcagaugagccaugggagcuagugccugcccuaguguaucugcuucuacaccugcccaacaagaagugagagugcuguguacuuucuuugucacaggucguagagauguacucgaguggaggugaccuucaccuagagcucccaacaggucagcaaggaggcaccaggaagcuguggguaaguggaagcagagcuugcucgugugugcuccugugaaguccagcauuuucuucuucuuuuaaaugguucacagaagaguuauuccugccauucauuacauacauuaugacaagguucugggacucuguggcaagagggcaucaaaucaacaugaggaucuuuugauauacaacaugaagaauagauuaugaacauaauuaaaacaauauaaacaugaaauaguuuacagaauacaaagaaacagauuaguugcagguguaugguaaugauucaacauaaagggaaaauugaucuaacuuccuuuucagauuccuuucaguauguaagaaagauggcauuuuuacuuaaaagcuaaucuugcucaucuauuuauuguuugaaauaagacacuuucagaaaaugugcccaaaauuuuguuuaaagaaaauacacauuaaaaacgauuuuaggcugugaggcaggagaaacgacuagagagauggcucaguauuuaggagcaauggcucucuagcuggaauucaguucucagcacccacguggugccucucaaccauccuuaacucuacuuccaaggaauccagugcccuauucuggccucauagacacccggcaagcauaugagaugcacaggcaugcaagcagacaaaacgcuguacacauaaaauaaaaguaaauaaaucuuuuuaaaaaucaaccuaaaaacauacacacacacaaaguauaacucucuaucauaugauccuaacacuaaacauuuugaaauggcuugcuaaccauaauuacuuaaacuugguaguguauuagaacauccuuagauucaacagggcuuacaauagaaggagaaaggguguauuguaugauugauuuuaaaagaaauaaaacucauucuguauaccauugcuaaaagaauccuuugagaaucuuuucaucuaguauuuauuuucaaaaguggaacuagaaauauguagccuagaagucuagaaaucugcucuuccagagggcccaaggucaguucucagcacccacaugaggucccgggaucugauaccucugacgucaguguguaugugcacuucugugcacacacccagacaugcucagugaggcacugagaggcgcagaucccuucagagcauggauuccaggcuccauaacuccugcugggcucuacagaagucccuuuacaccccaugcuuccuguuagcugcauuucuaucagagcacugcaggagacgguuacacaaucacuuuacauccggugcucaauguuacauacauuuauagacauucacgacaggagacgcuccuauccaacuuggaaacuuucauacaaguacaacuuuuuugcucaauuuucuauuucacaagcuauugcccuacuguguauuuacaacugggggcugugaaauuuaugucuuuggucaaacuucccuaucauagguuguuuucucuuccuuaugaaacugauaggcagugccuagaaagugucuaagugaaucgacuuggaaauagcugagagcuauaaugaaccuggcagaaagcuccuaaucccuaagcgacugcagaauaauaaccaguaaugaaugaguccuccggagaggccgccaccugcauccacauccuagcaguuggggaggguguggguuuacuucaccgggaauuuggucugagacacugggcaguuuuagcagagguuuacugagcaaaggcagauuggagagggcugucccacaguggauguagcaaccuaaucaaguuguggguuuuaagcacaucuugugacuauuuaucuuaugacuauuuugauuuagcguauuugugagauaaagugaucauuuccccucccagaucauagcacauuaagauuagauuuuccugccccauagguaauucuucucaugaugcuuuagaaaggcccugaaaagggguggaggccaaauacaguaaaaauggcuuucuaacagaagcaggaucuuugaggaugcagaccuucacuagugugugggaaagcgcccugcaccuuaauuuuuuuuauguagugagaacauuaucuucagccacaagggaguuuaaccacuaacagucuguggaaccaucaggagaugcagcagcuccaaggcacagcugcaaccccugugguuaucccauaaccgcugcucagguccuacaguugauguguagguuuuaucaugagagccagggcuucccaagagguugcuggcuauguagacaggaccagagcuuuggcugucuguaggcaucguggugcccagcuccaccauuccugucugucuucugccugaugccacccuacccacuucacuguacaucagagagucccagggacugagaccacuuccuagaguuggaaaacaaucuggguuuuccccagaaggcuuccacuugccuguuuucuaucuacuuugagacgacagaguuaucuaguagaguguguguguggguguuugcauuuagaagucugaaaguuuaugggggggggggggugcgcgcacgcaugcaaaaacauuuacuugaaugcacuacgaaaaguguuagguuuuaaaugagagaaauaagaguccaaagccaaccuggcuaucaucuggagaacacuaugcacuucuggaaaauccugcccucugauagggacauuucuauuggauaauuucaggacuaaauacacaacugacauguuacuaaaacaaaacaaccaacugauuuucuagaccaguuaggcuuuuaagagguuuuuugcagcuuaugguuguuuucagaccguuggcuugauuuacuugucuugacacagcauccaucacccauucuaaaaaagcucauuuguuuuuguguugaaacguucucugagcuuagagguuuuaugugcugcagucaucaaagcauauguuuaauuggugauguacuauuuuuuuucuugauagguguauaaaauagcagugcaccuucacucugugucaucuaauugaauaaacaagguauuuguacagcauugcaggcacuugcuacauuauagucuguuuacucacaggaaaucccuccuuaugaaaccaagggagugaugagagccagcuuuuccuccagagaagcagacaaucacacagccuucauccggauaaagacgaaugcaucagacagcaccgaguucaucauucucccgguugagguugaaguuacaacaggucagugagagcugacugagugcagguuuguucagcacgcccugcccuggcugagagagugaucauugugcacuguucuuuucucccagcuccuggaaucuauuccucaacugaaauguuagauuuuggaacacuuagaacacaagguaaaguagcaaaagccuuucugggucugacuuaguuacuuuuuuguugcugugaagagacaccauggccaaggcaacuuauaaaagaaagcauuuaauuugggggcagggggaguugcuuagaauucuaacgguuaauccaugaccaucgucaugggagcauggcagcaggcagacaggcauggugcuugaggaguagccaggagcacacguguuaccugcuaguuggaggccaggagagcccacccugacaacauggccacaccuccuaauccuucagaauagcucuaccucuggggacauucaaaugucugagccugugggggccauucucauucagaccagcaugagccguaaaguaauccacuugggauucaguucugauggcucugcuuguaauucaacuugaaagccauuucucaguggguccugugauuuuuguagaaaguguuuuuucgaaaccuccuccccggugagaaaauagggugagguaacuugaaucuucagguagaaaacggagucagaaaauaguuucuuuuuuuaaaagauuuauuauuauaaauaaguauguauuugaguacacuguagcugucuucagaugcgccagaagagggcaucagaucucauuaugggugguugugagccaccaugugguugcugggauuugaacucaggaccuuuggaagagcagucagugcucuuacccauugagccaucucaucagcccccagaaaauaguuucuuaaucuaguuccucacacauucaauguaauaaauauuuuuauuuaucuuagugaucaaagaaagaauucuaauuuuaaaauuauaaacaaccaagcuaagaugaugaugaugaugauuaaggaaaaaguacaaaauuugagauugauuuuguaauuuguaauuaagacuuacuuguccaggauuaaaggccauauuuuugaaauuuaauuugcuuuuacuauacuaauuuugcauuguauuugaugagguaaagauucuaauuugcugugaagcacaccuuuuaaagaaacacuucuuuucuuccauuucaacagaucuaccaaagguuuuaaaucuucauuuacuaaauucaggaacaaaggauguaccaauaacaguaaguuuuugagugucggcgcacacacacacacacacauacucacacugugugugcauacacgugcacaugcguuugugugauuuaacagcaggguuaaguccuugcucuguauuguggugaccuguagacucuugguuguauguaggauaugagaauccuggucuucauucaucuacucguucauuuaauaacugucagcaucagcugugcacuagacugcauccugaagguggagcuguggcucagacugcccaagucccccuuaccguugagcucacuuugaacccagacuucuuuggguccaucuaagugugguaaggaaaggaucagccgacuuacacauuguagacaaacgcugugccuacuuuggcacaagcguaaaagaugagagagaccagccagugcugucauggugcucagucggggaggucacaugggcguagaucucucucuuacauucacugaaaacugaguuuucugagaaccaagcuuugcuuugucgugcuuucuguuuauuucagcauuucuuucacauaguauaacaagauuagagccuggugugucuuuagagaagucauuuuccuccaguuaggcugugcugaauguuaauguguauuuuauucauuucucuuccaagaucuauucucucuuuaaacacugugguccuucccagugugugauagcaauucagggagcuccagaugugauccccugaccaugcacagaaggcccacauucaggcccuccugucugucauguaacugagaaaacagccuuccugauaucaugacacccaugugccucagauaucuucaaagggaggcuugcaugagcuuccuugguaguugaugagugggagccauuuguaucagcuugacauuugcucuagugaauguauacacaaaauauccaguugcuauguacuagccgguuuccccucgcuuguuggcaugcucugacugcucaauaugucuuggaaucuuuuuuuuaaaaaaagacaaaaaaccaaggucucacacguggcucugaacucacagagaucuaccucagcuuccuagguacugggauuauaggcaugcacaccacaccugacauaauuacugagugcuaguuugaccugaauaucaugagaaaagacuaaacauguauuaagaauagaugcaagcaucagaucccauuacagauguuuugauccuccaggugguugcugggaauugaacucagaaccucuggaagaucaucagucagugcucuuaaccacugagccaucucuccagcccugcuuucccauuucuuaagucaucuuugaauuagcaguaguuaguaacuaguacuaaaguggcuaguauaaauaaguucauuacaaggcaaugauuuugaauaauuuuuucaucuuaaguuaccugaaugaacuuuaaguauuuuauugugauuuuuguuuguuauuuauuuauuuguuauuuccuuagacaaaugaguuuuaccugaugauucagguuuauuuuuaagagugcacaguucagacuccuuguguaaaguggcucaccaacuuuacauuuguucacuauuagugcaguauguuuugcagugauaacucugaauguaaauucucucucucauuuggcaaugcuuaaaguauugcauuugaagugaaagaaucauuuuuuuucaacauguauuuuaagaucuuccugcuuauaacaacuguaucucagcaaaaaaacaugacuuguucuuucugguacgguuuugcaaggcugcuaccacagagagcaugcuacgguguggccccucaggaaccgcugcagcaagggagcaugucuggacauggccgugcuuccauuguugcugucucacaagguagacagugaaggaaagcccucugaggccucagcucacaaggccagcucucuagcuccgcagacagaucauacccuagagaaauucucacagguggggaagugagccugaguguggccacgagcagcuggggcuccagcugcacuccugcugccugccugccugccacgugugcuccguggcuucccuugcucgggugguaaaaucgugcaauaaaagcaaaagaaacuuccuuccauuugcagcuuagcucacaguucuagcuguucuuuguuuacucucaaaaugcuuacauaugcuugaggggauggagaggucuguguuuuagacgguugcuacuaacaguaagcuuauugauaaguaaggaauugcugugagcagaucuucugguucccagcccagucuucagcgcacagugaagcagaugagaagcucaugcugggagagcagaggugcaaggauuccagcagugcuucugcgggagggagggagcaguccuuagggugccccagccugugaggucuugcuagcccccagggcuaauggcagugcgugggagagugagcugcccuggcaggcccuggaguuacucuaaucuucuuaagucccugccauagcaagcaccaggcugcaggccaguguccuuuuucauauucuucucacuucuguuguggcuucaagggacucacauuugaugcucagacugggaagaguucuccuuuauaaggaucagccucgacuggggaggaaucuagugcccugccggccgugaagcaggcaugagcuucacagguggaggauuguccuggggggagggggggggauaagugggcuuugaugucaaguucacacagccccaaugauuugauacuuagaauuaagguuacugugcaauuuguauaccaggaugucagacaaguggcccuguaccgagucaggagccuggcuucaguccucucgguacccgacuguugaaacauugcguuauacucugaggcuuucuuucuuuuuuuuuuuuuuagauuugcuuauuuauuuauuuauuuauuuauuuauuuauuuauuuauuuauuauauguaaguacccuguagcuguccucagacacuccagaagagggagucagaucucguuauggaugguugugagccaccaugugguugcugggauuugaacuccugaccuucggaagaacagucgggugcucuuacccacugagccaucucaccagcccgaggcucucuuuauuagaacagugcggauagaauugauaucuuugaauucuuucaguuaaaaugauuuguaucauugaggauaauuuaaaaaaauaaaccuuauaaaguguucaauuuaaauauauacuaaaaauacaccauuuagugggguguuuguuuauuuguuuguuugucuuaacuuuaaguuuguguagauagaccugauuuccuaaguuguaagcauccgagccucacuuccaaguucagugccucuguagugagccucagucccuagugcucacuagagugcagccuuacccuuugacaguggaccgugcuuacccugccaagcuggggagaaacacugcagaggccacauggggucacagugcccugaggugugcucacucuuccuacuaggacacaguuucagggcaccuuuguguguggcuuucuucaagauggaugagucuugagauaucuucuuguccucuuaucuuagaaaguaggcuuucauguagagaaggagaccuuuagguuucccaugugugaguucguccugaggugucauacuuagucaucucauacuuugccaucacugcauuucauacaguguucuugugaaagucgggcuuugcucuugucuuauuucacuuacagcuacuaguauuacgccuuacguuuguguaugcuuuucuuucuaccuaaacuacuagacuaaaauaacagguuuguuuucuucgcagaguguucgaccaacaccacaaaaugacgcuaucacgguacauuuuaaaccaguuacguuaaaagcuucugaaaguaaauauaccaagguugccagcauuaguuuugaugguaaauauucauuuuuuucuccuagagugguuauuauuuugacaaacuagaaagcuccuauguugaugaguuaauauagaaauccagacuauuuuaauacuacugccucaauugauuuuccccuaugaagauucaucauuaacuuacuuuauuaauucauaauauaacuccacaaaccuaaaacaguauguacaaucaggaaaccuaagcagauguguuagggucggaaguuucuguagugugggauaacuagucacagcagucgacauuuaccuuaguuaugaagucauuggguguuuuaauuaacugauacuauauuuaacuuccagaagcacauuuugguucacaggcaaaaauauuauuuuuaacauuuuucuguguugacuuuuuaagcaaagcagacaguccugucuaagcuaaaauaagagccuuuauguauugucaaauuagcuacuauuucagacaagugauagauaucauuugauguguuauuucauaucuagaaccacgccucccuggucauacccagucucaccugaaacauuagcucagacgucagcauguuuacagucugucuucauuccauuuuucacuuguuuuaagagaaauuuauugaauuuauuacugcaaauuuuaaauuaugacauaacagcugcucaacuagauauacaauuaaauaagaacugaaacucggaagagcaugucuuuucuguggucuugauaccccggacaugcccauuucauccaauacaccugucuuaucggagcauggagugagcgauaaagcugagccuggugcuccaacacccacaucugcccagaguccccagcucacaccccggcucaucagaugagggagucggugaggguggcagcagccaaccaagcgcagcagugugggagagagucugcaugguccucacaugcucacuguacugaggguuaaggagccugccguccuaagugacaccagcgccucaaacgagccuguuugccucgcuacaggaaagauaaccugcuuuuuauauaaaaugugagcgcgguuugcaagugugcuguuggccaguguaaaagcuuuccuuuuucagaaacaaaacuuucaguuugcauaaagucacacagacuuacgagcaguaaaaaguaagaagcugccuacauggcucaggguucaggccucgcugcugcaagccugacagcauauguucugucccugaaaacgcacauggaggaaagaggauaguccugaaaauugucaaugugugugccacaugacaccucacccgcacucacucacacacacacacacauaaggaaauguaauuuuuuuacauuucaaaaauacccucacacacacacauaaauagaugauuuuuuuuuaaugcuuccuugcagcuucgagagcaaaaaagccaucucaauuuucugggaaaauaacuguuaaagcaaaggaaaagaguuauucuaaacucgaaauccccuaccaagcagaaguucuagauggguaaguuuugucuuaaaagaagcuuuguaacuuuuuguuuguaauuuuuugcugauugauaaaaguucaccuaaccugauggguuauugugaaaaggauaaccacaacuauaaaggaaaauuuucuguguccuguuuauuucugacuuucuaagguggcaaaagaaaauggaauauuaugguuuguguuagauuuaauaauuuauaagucaauuugugcuuuuuaacuacuuaaaucuuuugaaccuuuuucacugugccauucuguuugagguaugucagccuguuccucggugacuugaggcagucuucuguccuuuccuaaacuagcagugugccgacacacagccuguagaugcccacuguggccaugcaugcauucaugcuugcagugaccucagcagcguuagccuuccugcacucuccaugcuguccauggaauuucagcuugcagcagggaaccguccgcuguuucauuucaguauuucaugagcaaaauguuaagucacauggugaaugaaguuauaaaaauuaaccacuaaaugccuauaguuguaauuccaugguguggcuuaaugcuaaauguauaccaagcaaguugggcacauggaaguaaagaggauucauccugcuuuguuuucuucccguaguuauuugggguuugaucacgccgccacgcuguuucacauccaggacaguccugcugacccaguggagaggccgaucuaccugacgaacacuuucaguuuugcgauccucauucaugaugugcuguuaccagaagaagccagaauaauguuucaggugcguugagcccgcuugcuuggcaucugcugcucuagcauccaggugagaguaacccugcucuucugcuucauccccaggugcacaacuucagccagccgguucucauucuuccuaaugagucgggauacauuuuuacccuguuuuuuaugccauccaccucauccaugcacauagacaacaacauuuuacuuguuaccaaugcuucuaaguuucauuuaccugugcggguauacacaggcuuuuuagauguaaguaugucgucaagguccuaccucugugcuuuuggauauugucaggcaauugggaggauuccuuccuaguuagugcuuucaggauacagaaauacacacacacacauacucacauacacucacacacucacacacaaaggacuccuaggauccccagagaacuccaaaacuaaggguugcuauucuucaguguccagugggaagugaucuuggaaucuacuauagaugcccaaaucugugauuaucgcaggccaggcccuuauggagaaugcuguaguauucguaggcaaacagugacauccgugaauguggaaucuacagauggggaagacugacugcccauacuggucuuguucuaauuuagaaauuagaauagauagugguaaauggaacacagguuaauauauaacacagcacugcaguuaaacuauuacuuucaccuuuugccuuaaggaaaggacucuauagcuuuucuuugguauaguaacucccugcauucacugcccuugcuccuugggacauuuauaaagcaugauaaggguugauugaacacaagcacuguguugcuaccacaguuucccuuugagaccuacaggauugaugagugggucgcauguacaggauuggauucacaggaugaaggacuaauucacacugggacagcucaggcuuugcugacugcucagagaagcaaaccacugaaaacuuaggaguuacuuuugaaauuuuucacaucagucccccccucccauaugauauauuuaugauauauuuagcuccuuuaauuccagucacuucccggagcuuuuucuacauuauuuucucuugcuuuacuuuuacauuguaagacagagaaucuagaacaaagauaaauggagaacaaaugggacagggagacuauuaggaaacacaguggugaccuugauuggauaaaguuggagaacaccaggcaaagcaaagaaccagagaagaagaaggcuggaugguaaagaugcacacuugggcaaugcaguagacacaacacaaggaaggugcagaggucuucauggcacagaaaacaaaccagagggaaaauugcagacaagcuuuggugaauguggccaaugaaaggcauuggggaagagaaagaugggacaucuuucaucagcuaggugugcccagcucuagagcucaguccaggcaaggggcuaauuauuauuuguaaucugugaguacugagaacacagacuucugccugauugucagagcucccuagccuuuccuagaacuucagggaaguagcugcuaggaaauggccucuccaucccugacuccugauuguccuuguccgaaguucucagcauaucauguaguuguaaauauagacauaagauguagaaaccuuagugucuccuaguggacacuuuauucaguaacauuguuaaacaugugaucuggugucuaauacaguccuuuucuaucucucuaguacuuuguauugccccccaaaauagaagaacgcuucauagauuuuggaguacugagugcuacagaagcaaguaguauuuuauuugcaauuauaaacagcaauccaauugagguaaagacauuguuuuuauucucaguuacacugaagauuucauguuugugcugcaagaucacuuuuuguuuucucuuugaagcuggcaauaaaaaguuggcauaucauaggagauggcuuaucaauagaacuuguagcuacagagagaggcaacagaagcacggugauugcaagccuuccagaacuggagcgguccucuuugcccgaccaguccccggugagugggccucuuacugcuucaaguuagaauggguguuuccggcccaagugaaagagcagggcuaugugccccacucggcaaguacugugaccuguuucccgguggccaugagcgcuagacacugcgggggccuuguggagcccgucuaccacagugaagcaggcacagaguagaugaugagggcacagaagaauuggaaggaucuguaccacacugucaugaaaggagagugucugcaguaagguucugugcaucagcugugcagaugcugucacacaaaguccacacaugggucugugugggcauagcucaccaccagagugcucccccuucaguaagacccuugaaccugcacagcuacuaaaugaugccauuuuuacugcuucagguaacauuagcuucaggacacuuugcaguguucagagucaaacuuacugccaagaagcuagaagggguccaugauggggccauacagaucacaaccgacuacgagguaagcugaccagcgggguuuucucaaacuuauuaauggcugugcacauugaucgggcaugucaguuucuguagaagcagagaacuacauuuauuuacaguguaccccucuugugccuuuaauacagaccuuucagagccauuucagaacacuagugcuuguaccucccagggcucugcugaaccuccucagaccuccuaacuuaaccacagugacaggaaagugcccuuagcacacugagagucacgcuguuaaaaaccugucuacagaucaccacagagcaggucuggacuggacuuccugagcugcaggucugacucugcacuuguguuuugcaguccucuguguagaguguauauuauauucacuaagauccugauugcauguauuucuggcagaucugaucuuuuuccuauuuuauacuuuugauuuuuuggauaaagguucuggaacucacuguauaguaaaccagccuugaacuagcaggccuccuacuugagcuucccaagugcuagcauuacagguggaagguugcuugccugucucagaccuaaauacuuuuaauuuaacacuuacagaucuuugggcgguugaguacuucuaaauucaacaaguugcuaucuuuguccuccugagugguuucagcauacacaaauccaguggcaaaauaaacagaacuggcuauucaaauaauaaaugauuagaguauauccaguuaccuccaaaagugaggaauucauacuuaacauucauauagaaguaagugccuuucagaauugagacaguuuugguuuuuugguuuuuuuuuuuuuuuuuaauggaugaaaauaaaaauuaaacagggcaggaaacaugguucagcaguuaggagcacuggcuguucuucuugaagacccagguucaauucccagcaccuacaagguggcucauaacuauuuguaguuccaguucagaggaucuagugcccccuuccgguuucugcaggcaccaggcaugagcgugguagguauucaggcaaaauagccacacacauacaauuaaaaaaauaaaaguuuuuaaaacaaaacacaaauauacccccauacacggcauucauggcucacuugugauacuaauuaggaauaagcugaaauucuaacuacagaauguucaacuugucuuuaaaacuugaguugaaaucuauuucuaccaaaacaauauugaauuucauagcuguagaaauccuggauuuuuauagauguuguuuuaggaauacaacuuuccuuuuuaaucuguagaggacuuguauuuugaaaagcugucuuuauuccuccccugugacuuggucuuaacugguuuuagcagguaaaugaguagucacuggaaauggauuguuuucauuuuauagaaaaccuugggcagauuaaaaaguuuccagggugguuuuaauacugguuuugcguuauugucaguauacaacacaaaauaagcuuuguuuuuaauuccuaaaacagugaagucauugucaguagcaaacaucccagacuucugacgugaugguggucugccucuuuccuccauagauccugaccaucccugugaaagcugugaucgccgugggcucgcugaccugcuuccccaagcacaugguucuucccccuuccuucccaguaagccagcucacgcuucgcuugaucguuguuuucuguugcuuagugcucaaaugggaaagacauuuccuguuuucauccucuacuguaacugaagcaccgcacugcgccagguucuuaagagaauggaaagugggaugagcaauagacccucccucaggaagauuuccuaugaagacuggaagcaggagccuugauguguaaagcagauacaaguuguccugcaaagaaaaaggggcuuagagagaaagcaucuugcagccuaacucaacaaagccuuuccugcuuccagcaaagccuccacuauuugaaagggggaaaaaauggccuaaagaaaugucuuguucuguauaguuuuacacacacauacacacagagugaccuuuuuuaaaaaaacaaaaaacaaaaaaaaaauaugaagcuguuuaauuagguuguuagcaauuuagaaaaccuaaggaugcaucccauugguugucagggagagaagcagcugcacccugcagcaggagggcgagggcugcgacagggccguguuuaaagagucacugggaguccagcaccuacaugacaggauggcucccagcugucuguaaccccaguuccaggggaucaagacacacauacagugcacauaaauaccaacacucguaaaauagaaacaggaacucuugaugcagaaaaaguugauaucaaaauguuucucugaucuaucugaaaaacagcuagaaucaauuuuuucagcuugauaagaaauugucuaggcaggcauguacagacaauuuuaaaaucaucuccaaaaacuuuguagaugcuuaaaaauguaaaaaaugucuuugugggcuggagagauggcucagugacuaagagcaccgacugcucuuccaaagauccugaguucaaaucgcagcaaccacaugguggcucacaaccacccguaaugagaucugucgcccucuucuggagugucugaagacagcuacaguguacuuacauauaauaauaaauaaaucuuuuuuaaaaaaaagucuuugugcuagggaaaaaaaacccacauagguuuuauucaguaggaagaggucccuugauuucaacaaagcccagcugaauuggauuuuuuccuacauaaaaauauaaacauuuacucucauaaauaaauaaauauaauauacaaauaaauuguuggguuuuacauauaaaacuugauaugugcaacauaaguauaaaaucucuuucuagauagaaucaguaucuuuuuaguuacuuuuaagauuuaaaauuaagauguuuucaguucaucugggguugguggcucugcaggugaaggugccaccaagccugauccaccugaguuuagcaggacucacaugagggaaggagagaagcaacucgugugaguuauucccugaccucuacacggucugcauggggcgugcacgcccuggcacaugagcccaccaccacacacacacaaguaaauaauguaaucuuuuuaauuuuaaagaauuaaaagucuguauauaggauauuaaguaaggaaauacaaaaauccaaauacuucuugacuacuguagacagcagugguuucauguguaauucuagaacacuugucacaauuccuuuuugguuugaugaugguuucuuacggguuggucucucuaggaaaggaaugagguaccuuuuauccccagugacuagcaggugauauacaugagggaggugguugggagaggacacaggcaaagauauuucacagggaucaacuccuugagugucccaaugaggucaacacagggaggcaacugugagagacagguagucagagagcucagcuaugccucagagguugagccuugagagaagaaauaggaaaggagcuggcuuuuugagaaagagucaggaugcguugggcagauguaggaauguagaaaugguaucuucuugggguggaggucuagcggguaggagaugggacacccuauuuaacaaagccugacucaagauugugucccuuucaauauaaauuuuaauaagguuaacauauuucaguugggcuaucaucgagccuuugccucccuauauugcacuuuguccugacuguauguuacacccaugcuuuaucaugcgugcauaagagccuucuuccuccucagucaccaucaguaccccaaucuccucacuagcugcuagggagcaguaugucagaaaacguuucaaaaaccuuucagcucaauauuugaguagaguugcaaaaggaauuuuauuaucuuuggucuucauguggccuaagaacaggccagcaggaguuauguuagcuguagaaacuggauagcugacaaggcagcacugcagccaccgcuguacccguccucuccccagccucauggccacccucggggucuugccagggagaaggaugucauauaucuguuuucugggacuaauuauuagacaagcacguuucucauuuagaaaauuauuuuaaggggauaggaaccacauguacaaagaccauaauucuuuauucaaucagagaguuuauaaaaguaagucaagcuuguaaugugcuucuuaagaauaauuugaaucuuuuuucuuuuuuuuuuuuuuuuuuuuuuuugagacaggguuucucuguguagccaugcauggcuauccuggaacuuacucuauagaccaggcugucucaaacucagaaaucugccugccucugccuccugagugcuaagauuaaaggcgugugucaccacugccuggcuugaaucuuuuuuaauuucaagcuuuucuaauuugauaccuucuagaaaaacgaaacuguuacuugguaagaaggaacacugaugaagacuucagucuguggggcuggagagucggcucagcaguuauaggaguuaggcuuuugcagagaggauaguggaguuggcagcacccgcauggcagcuucuugcugucuguucccaguuccuaacucuggccgcugcacuugccagacaugcacacagugcacuuuacauguguacagccaaagcauucauacacauaguuaaaacaagcaaaccuuuucagaagaaucuaauuugugugcuguuuugucagagucuucaaugaguuacuugguguguuuuuacugugaauuauuauuuugcaagacaaggacguaugaggcucuguccucuggccuugaucauccacaugcugacaguacaggcauguaccccaugccagcugauagccuacauuuuuuuuuaaagauuuauuuauuuauuauauguaaguacacugcagcugucuucagacacuccagaagagggcaucagaucuuguuacagaugguugugagccaccaugugguugcugggauuugaacucuggaccuucggaagagcagucgggugcucuuacccacugagccaucucaccagcccgauagccuacauuuuuaaagagauuuaauuuucucuuggauggcaaaaauuacuguuguauuucuaaggaaaacauuuucuuuuaaagaauguguuucggccuuccuugguuagauuuuagaauucauuuauuuuggggcagccuugccuugguguuagcagacuuuacauuacaaacaaagugacccucuaaagcccccucugugccuuccuggguacuuaguaugucaacacaaguuaaauucccauuaguuuauaacaguacuucuguaacaugcacgauggcaccagugaaaaagcuggccugugaucucaggucuucagauuugcugguucucauuugaaugagggcauggauuuucgugucaauuauaauuuuaaaaggucgauugaugaaaauucugaacuuguguuuucuucuuucaggggaaaauaguucaucagagcuuaaauauuaugaauuccuucucacagaaggugaagauacagcaaauaaggucuuugucagaagacguacgauucuacuacaaacgauuacgggguaauagggaagacuuggagccagggaagaagucuaagguuuguuagaaaugagaauuuccagcugucaucacucuguggcuggccgucugucuguucucggcacucauggucguccuguguuccuuuacagauugcaaacauuuauuuugacccugggcugcaguguggggaucacugcuauaucggcuugccuuuccuauccaaauguaagucuuccaucccgccuuccuuuacucuccugccucgguaccguaggacucacuggaagggguacuggcaguggcuuaggcugagugcaugcugacuugugcuuccucuuuuagcugaacccaaaguacagccugggguggccaugcaggaggacuugugggaugccgacugggacgcacaucagagcuuguucaaggcuuggauggggauaaaggaaaacgcaggacauagguaugagcuucugcuucauucaggaguuuuagaggguagcccacggggcagcucugcuguugugucacauugucauuguuagcaugugucgcuaagaaaugcacgcacuccuguguccucuuuucuccagugcaugagaucuguccuuaaaaaucagaggaacuauuugaaaucguccuuguuuauagugacugccauguccaccuuagacacagaguuaugcaugagaagaaagauuugucugucacuggccucuccaaaaggcaacuuaggcuuaaucccaacaggagaccaaauuuauuuguuccuuaugaaaaaugcuacuuccuuuuucuucaagugcuggucuuuugcuggggaaacagggcccugcaguggccuccccacugcaucuuuggcaggucgaaauaggcuucuggaaacccagugcuguaccuggacucaagcacugaaaugugguguugguaucacaguagccuggcccuuucacgcacaguagaaaagaacuuuuccagaaacaggaauacugaagaguaauaaguacuuuucucacuuggcugacgugauauguauuggucagaguuaaaguauucuccuauaaggacaguaugaaguuuuaaagcuuugguuagcacacagagcauggguguugcuggcaccgucguguacacaugcguacucuuguucuuacaguuccucugccuccuugcugcucccuuucuuccuuagaggaauccccugauuuugcucucaugauguauuuuccauuaccuccucuuggccuuccuugagaccaggagaugguucccucuucacucuuggcuguuuuagauagugcagugauaaauacugcuuuuugcaaaugucucuacaguauguugacuuaacaaccuuagggaacguccccugaauaguagagauauaauaguucuacuguuaauuuucaaggaccuccauacugauuuccauaauggcuggacaaguuggcguucccaucugcaacaaguagagcuucacuccacccacccaucuucacuaacgcuuguugggggucaguugguuagucaggggugugcgugugcaugugcauuucaauaauagucaccccucugaaucucaaagcaguucuaauuugcaucccuugauggcuaaggauguugaagacuucuucaaaugugucuggacauugguauuucuucccuugagaacugucuguucaguucagcucauaaguccaucugucuacuaggugguucaguccauuaacuguugagaaugaggguuucuauauuguaaaaguuuuccuuauaguaaagaaaagaaaguuuucucauuaaaaaugguuucccugagcacacaaagacuuguaaugaccucgagaagagcucagugaucacagcucucuucuucugucuccagaguggagcuuguaaaguguaggcaguccccuagugcugaugaguagcucauuagugcugccugcugcugcagccagggagccuccucaccaccagugucuuccgacaugcuccucaccaaggcccuggguucccgucugcagucugcccccccuaucugguugacaauaaguauaacacucuccucguacaugcacuuggguuaccuuguuuguacgcaugugcuugucaguaccccagaaucauaauucaguagcacuggguuugagugugcuucacugguuagucccagacacuuggcauuuccaaauacauuccagguccuggaccgcugacucuugagcacucauuaguaaguauguguucauaugggguccugagggugacuaugacugaaugcagucuauacucuccauuuauuuccucuugaacugacaucuucaucaugugaagaugucaccuugguuuuauaucagagggaaacuguguaugucaagccagcaccucuuguccaugguacuacugggaauacccaaguguccugcugggguguccacauggaagccauggaaaagucuuuaaaacccaaguguucagccuucauuauugaauuaauaccuuuaauaccuuugaggacuaggcuguugauguaguucagugguagggagcuugccuagcacacaggcauuugcuucaauccucaguacuaccaagaaaaacguuuuugaagaugugcgugcaucuuuuacugaugcuacuagaacuaaagcuugucauccuuuacauaugcuggacagagcuauagcacagaugacuuuaauguugacagcucucugugcaaaauagagacacaugauaugucauugagagcuuaauaaagcugcaugcccagucauaaggaugacagcaucucugucaacuucucuaagacucaaggaacaucaacagaaacguguagagaacauucacugacauagaaauugcuuuucuagguugaaugcuauguuugaaguaaauacagaucuucagaaaaauaucguaucaaaagucagugccgagcucuccuggccgucuguccuuagcucgccccggcuccugaaguucccacucacuaacacaaacuguucuucgguaaguguucaaauggccuaaacagucagcaaugggccacgcgugguuagagagccgacgcuguaauuccucuguagggaucuccacuaaugcaucugggcuuugcuuuaaggaagaagagauuagcuuagaaaacccugcagacgucccugucuacguccaguucaucccacuggcuuuguauuccaaccccuccgucuuugcagauaaguuagucucaagguaagcacuccuuagcuggucaaaggguaaacgcagagucuggcuuuauggcugaaguugccagcaguuuccugggaguggguugguauugaauugaacaugaagaaaagcuuucaacagguguaaauggggcgcucacauuuaacagauuuguaaagggacaacagacaaaauaauuccacuaauuccuuuuuaaaagugaacaagguauuaauuauaaguuagccuuuaguauuaauaugguauaaugcuacuggucccaagaccugacaaaagauaaauuugcaaauaaaaccucaaguuuggcuauccuccauaguuccuaguugugauguuuaugaagauaaacguguuuuuuauuuuagguuuaacuugaguaagguggccaagcuagauuugagaacacuugaauuccaagucuacaggaacagcguaaguacaacaaucauuuacucugcuaggaccagggccaaugggaaggacaccugcgggcugcccuuagccuggcugaaggcagcuauugcaguccaggaauugacuuagaggcagaggagagcaggaagagucagggcugcagauacacaggguauguuagacgguuccucuuuguggguauuaaccuuagagucagcagucagcccacgauagcucagcauaaugccacccagaaagucugaggcuguacaugaaauaugcuaaugcaacauuuuauuuuuaagcguuaaaagauucaacugagcugggcgugguggcacacgccuuuaaucccagcacuugggaggcagaggcagaggcagguggauuucugaguucgaggccagccugguuuacaaagugaguuccaggacagccagggcuacacagagaaacccugucucgaaaaaccaaccacccccccuccaaaaaaaagaugcuuccugauaaaauuguaaaaccugugaaugugagaccaauaccuggcacagcucuguguguguguuuaucucgauagauaauguugacuuuaaaguguauaauaaguugauuuguucugggggugaaaguggccucuauuauucagguaagugucugcuagccacucauauuguaucaggccuugauguggagggugcaugucagcuaggaagguuucacaggggccaaagcccugcaggcugccuggggucuugugcuucauugccuuucugccuuauucagaugagaguguuuguccuuccuguuuggaccacauagugcuauguaggaagucuccccagccucguccagccagcugcuuuguaguucuucaucucugccacagcugcagucagagccuagaacucagacagcaguuuagacacucccgauucccuguaucauucucuuaggaucucgccuugcuccucccauccauaaaugccauuguagcaagcacuggaagucauugagaaugcccaguuacuagaacuugguuucuucugccuugauagggaaaauacagaagucaaugagcugaugaucucaugcagucgcauuugcaagacauaggacccugaccuagacucuaaaggacagauggaugaggaaaaccucuggaccucaggagguuuccacagaagaaauucucagugugaaacucuaauugcugagaguccuuuaaacaugcuuccuuuucuguccuauccaguucuauccaguucuauccaguucuagagagucaugaauucauguugaaauugaauaaauuuuguuugcuacuguucaaagacauuuucuuuucauuauaaaugcagacuggggagcaaacaguggcuacaagggagguuuagcaccgugucucgguucacaccuaacagcugugaucgguaguacaaacagcauccuaagaaaagcagaugugucugucuguauuacuacagagggguuucugagguuacccacggguccccugcucagucugucugacccuuaagagcuuaccacggcacaaguauggagcccguuagugcugugucggggcaccauacuaucccaacgugcuuuucagaccaucagagguuaaaugaguuaguauuuuggaauacauacagucuuucauugugcucauaaguggggccagcaugaugacaaacagacuuaaucccagcacucaggaggcagaggcagauggauuucagugaguguggugccugccaaagcuacauacauagugagagagaaagggaguggaggcgauugccaagaauagcuuaucagaaggagcuuucucagcgggcguuucagaacagucagaguauucuguuauccugguagacuguugauaaagaacagugcuaucuguaaagggagaccuuuuacuucauaagcgggacuuacguagugcacgucaucaguccacguggugugguauguuugucaguucccacuaacacagcagaacccagccaugccaagagaaguagagaauggcacacaacucacccuuccccagaauauuuagucuucuuuaaaaaaacacaagagugugucuuuguguugaaacaguguuuuuuaacauaaaaacaaaacaacucugaaccauuuuaaaacuggucauaacgucuuauuuuaaauuucagauuggguuauaucuuaaaucaagucucuacaaagcaauaaauagguacuuaguuuucaaaaugggauuaaagauuauuagucaggucauguauaacucaacagcacacauugacuuggggugggggggggggcggcggggggaguucuccacuuccagcagggcucccuacccaggcugcaguaucaguaggacuuagggugcugauugucagucaugaguauuggcuuuauaguaauguuuugaucuauuugucuugggucuguguccuuuccuauaugugaauuguauuucaaauuuaaaaacaaauacacauguacauguuaaaauuaucuguauacaaacauagaauguguaguucaaacucgaaggcuuuguaacugggaaaugaagucuguuuguaacuucgcacagaccaugggugcuccuucccgccccccgcccccacuucagugccaguguuugacgcacgaaggggcagcuccucuguaugagcaguuugagaggccuagagggggucagggacagaugguucccagaagccauauuaaugacuccuguuuguuuauacaauaauucaaggcucauccacugcaaaguccaacaggauuuacagagggucucucucggcauuucauuuuaaaccucauuuuaaaaccuggagaaaagaaaucugucaaaguaaaguucacuccacuccacaacagaacugugucuucccugaucauagucagguagguucuagacguacgugugggugggugccagugcuucccucacucacaguccccugucacgccaagcacgcacagcguccuuuaccauaugagacuuacagugaaaaacugugcuuuguauggguuuggauuuucacccuuaaagucaacauaugaauaacuuuuugugauuguuugcauaguguuagaacguauguaucaaaaguuacaaaauuaauuggagaaaauguguaauugcuauuuuucauagaaacaaccugacugugauggacgcugugaugguucaaggucaagggacaacggagaacuugaggguggcaggcaagcuuccagguccaggaagcuccuuacgcuucaaaaucacagaagcauuguuaaaggauugcauagaccgugaguaucgggcuugggaaggcccggcuuugagcacaugcuuucagccaucaggauuccagaagcaaaaauaguguuuccaaaugugcauaccugccuucugguccugagcgugugauggaugcuaagagucccaggccuuacaucagagcuguuccacuuggcucuuuugcagguuuauucugaaugugaaaaguaaaacauacccuuugaccauggcaggucagagccugacagggaaggcccucugugagccuaggcugugggaggccaaagcaagggagcauuaguucuaggccauccuaaacuacagaacgaguucgguuccagucaggaguacugacagagaccuuacugcccaaaaauacauauaugaaacuaguuaauuaucaauacaauggcagaccccaguggauuguucccggaugaaaccuuaugaauggcuggucuuuuuggcaugugggguggauucauaauguccagcauacagaagcucacaacauguuuacacuggaagcacauaauagcaagauuuaucuauauuugugauuuuuuccccucuuuagguuugaaacuaagagaaccaaauuucacauugaaaagaacauucaaaguagagaauacgggacaacuugaaauccguguagaaaccauugagaucaguggauaugcgugugagggauaugguuuuaaagugguuaacugucaagaguuugcccugagugccaacgccuccagagacauagucauauuguaaguacguccuugucuggcucaccacagaguggagcuuuccacugcugcuagagucaguucacuacugcauggagaugcauuuccagaccugaagggucuuuacaggggcuacagagaugagcacuggcugcucuuccagaggagcuggguuugauucucaguacccacaugguggccaacagccuucuguaauuccaguuccugaaggaaucugucuucuucuggccacuucagggacugaaugugguguacagauauacaugcaggcaauauuuuuuaaaagucuaucacaaauguauuuauuuuauuuuuuccuaccuaacaucaacuaaaauauuccauguuuuuguuuccagcauuguaaaacuuccucugcccuuaaauuggaucagauaaucuuagcaacuacuuuuuuuagaauccaauuucaguauuacuucuacgguuguaaagccuaagauguuagugugacuuggucagccacagagccaccugugccucacauuuuuccaagauggaggcuuugccuuaacagagacagccucugugccuucagugucaggcgcaacuauggagcgacugaugaugcaguaccaagugaccucugcccugugauuaaacaacaauucugugagcgucuguggcuguuaaucagcacuguuguguauauugcuccaugcucagcaaaacgucugccacccaaguguccagggaggaaggaggcaccgauguguacagcuaauaacacaaggaaucacaagugacuacaaguagacaggaggugacagaacaacaguaggcaugcgacuuguuguguuguguucuguuguguuuuaacaacaucaguacaaauaaauccuagauucaacaaagaacaacaauagaaccgagaagcagcaaguuugaaaacgaaccucacugccauucuugugucucagguuuacuccagauuucacagccuccagagucauucgggagcugaaguuugugacaagcaguggcuccgaguuuguguuuguguugaaugccucucuuccguaccacaugcuagccgccugugcagaagcccucccuagacccaacugggagcucgcgcucuacaucaucaucuccggggucaugagguacagugugcuccucugcagccaaccagggcugccucucacucacccucuggggccacucgcucucucacaguugccgggucucagcaggcacagcagacaccccuagcucugucaggcuugagugcuagugggaacaguuaaacaaacugaacccuucuuggguggcauggauggcaaagucuuacuaccuuugaaaguugcuuaacaaaugaggucuaugcuaguucauaagaaagcaagcacaaaauaucagguauaguugccuuauuugggcauauguaauuaacaucauuauaagccuaagcaacguaggacagaguagaaauguuucugaagguuuggcauucuuaucuuuauaucaguuuauuuccuuacguacuuuagagacucaaauauacuuacaauaaguuauuuauagcugcuuauacauccguaagggaaagagaggugaaccuccauccaguuucucucacugcagcugucuccucugacgcacauuauugucuucacacucagcuucuguguaggauugugaaccuuuuuuuuuaagauuuauuuguuuguuuguuuguuuaugugaguacacuguagcuguacagauguuugugagccuucaugugguuguuggggguugaauuuuuaggacuucuacuggcuucaguuggcccugcucacuccagucaacccggcucauucagucccugcuugcucuggcccaaagauucauuuauuguuauauauaaguacacuguagcugacuucugacacaccugaagagggcgucagaucucauuacggugguugugagccaccacgugguugaugggauuugaacucaggaccuuuggaagagcagucagugcucuuagccacugagucaucucgccagccacaguugugaacuuuuaaaguuggugugcagaggcuggagagacagcucagugguuaaggaaggcaccggugcuccuccagaagauguggguucaauucucagcucccgcuuggcaguuacaaccaccuuaacuccagcuccaggagagcccauccccuuuuauggcccccguggguauugcaugcauguagcgcaccggcauccgugcagccuaaauacuguacgcagagaucgguccuauaaacucugaacuacgaugcuucauuuuugucuuuccuuaaaaguguguuacagacaacuuggaguuuuuacaucauucuguaguuaucaaggagccugugguaaccaaauauuauucuuguuuuggcaaagaaugcugacccgccccucugcuccacagugcacucuuucuccuggucauuggaacagccuacuuggaagcucaagggauuugggagcccuuccgaaggcgacucuccuuugaagccucaaacccgcccuuugauguaggaaggccauuugaucucaggagaaucguugguauuucaucugaaggaaaguauguucauauacuaaaaguccacuuuuuaauacacauagacuuagcugauauaauuacaagaagugaaauuuaucuuuacucggaauuuuuuaaaaaacgauucuggugcucagauacugagaacucaugagaguucuuaacagggacaaaauaugcuuaguuauuaguuauuaguccuaaccuuauuuauaacugucagaggugacaaacuguagaagguuguggcucugaucccuuccacuucugucccuaguuucucuuuaugauggguuuacuaaugaaauuuuuuucuuaguauuagguuggaaguuacugcuuacugauuuuucaauugauccauuuuucagcuugaacacacuuggcugcgaacacagucaugguagggguuucuauaguaacgcaucaucccggccugguacaggcagucacaggcaguguggcacaucaguccacccacacagcagccauggcagcaaaaacucagcugauguggacaacgucagaaccagaaacaguucaaguaugucaagcaggacuucuccacaagcagcugccucacagucuacaagcaaaaccagcccccuagucucagagacagcugcagcaacccagggucacacagcaagcaggaaguccagaggggcaaagcagggccagcacagcagccagcaccacagccacagccacagcccacuggagcagcacucacagccuccaccaccagugccucagcaccaggagccaccacccgaaaggcugucuccugccccccucacacacccuucccaccccgagcgagccagcaccacacggcacagcucagaggacuccgacaucaccagucucauagaagccauggacaaagacuuugaccaccacgacuccuccccccuagacguguuuacagagcagccuccgucaccgaugucaaaaagcaaagguaacccuguccaacccccuuccaaagaacaaggcgugugagggagaaggagcagucaggaucauaggcaguggauacagcaccuuguuagguagcucagacccaucuccugcgggaagcaauggccucucuguaucacagugcaaacggaagcaacugcuugucaugaaacuuguucuucccuuguuucuccagacagaaucugauggacggcugccggugauaacuguuacagucauuuuuaaaaauuauuuugaggccagguauugcuggcacauaccuuuaauccuagcacucgggagacagaggcaggaggaucucugaguucaagaccugccuguucuacagagcgaguuccaagacagccugggauacacagaaaaaccuugucucaaaaaacaaacaaacaaaaauauuuugaaaacagggcuaaaaccaaaaccaucuaccucuuaacucaaaauagaauuucuagcugugcacacaucuguaguuguacuggugagguagagacaggaaguuugucacaggcuugaggucagugaggcuacacacugacaccucucucuaaauaggaaaaggggcaaaagaagcaagugaaaaaauaguuggugaaaccuccaaagaggcuggccaacaggacagggacaacaggaagugguggccgugcacacaucacagucuuguaggcagaggagugagggauguaccagaucugcagaauugguagguuagggaaggaacuuugccagaaggaaccacacaaacaggagaagugugaacaauucaagggauggaaaauccaaggccagagugacagcgaggucuaacagggagcaugagcgaaggcuucagaguagugggagugggaacaggcgcuugugugcagccucauggguaagguacagaggaauacaccuuauuggcaguggcagggccucaagacuagagcaauccagaaccgcaagauuggggacucagaacuuggaaagaaauguggcgcauagaccaugugguuccuaagacugcaagcagccuuuccaucaguucaucuaagggggugcgaccacaagccaucaaucaugguauaguucauuucaaacaagcuaggggacaacagcguugaggggcuuuuggguuucggaguugcagauuaggcacaggagaccaagggaggaaagucccuguggguguggugugugccccuuguagagaccaggagaaugcgugggucgcagcaagaccaggccaggugucuugguugcuuuucuauugcugugacaaaacaccaugaccaaagcaaugcuuauaaagugaagcauuugcucugagggcucacggucccauggccaucaaggcagggaacauggcagcaggcagggcacacaggguuccacagcagggaugagugcucacaucuugaagcagaaagacauuacugacugagauugaugugaaaccuccaagcccacucccuggacacaaacaguuccaccaacuagggaccaagccuuagggggcauucuuauccaaaccaccacauccacucccuggcccccuuaggucuguggccauaucacaagucaaaaugcauguaguucaucuuccaaggucccuacagucuuucacuuucaacagaguugaguaguccaagucucuuguaagacucaaggcagucucaagccuguaaccccuauaaaaucaaaaugcaagucacauaugucuaacacacaauggcacauaauauacauugccauuccaaaaggaaagaaagggggcagagugagaaaugccaggccaaagcaagaccgaaaccuaacaaggcagaguguaacugucuucccgaaaacagcauggccagaccuaucacagcucugagccuccccaugaguccagaagacugaaguacaaggcaguggguagacugugacagcgguggagaggaagagggcucuugcaguguccuggagccagagugcucugacugugcugugcagugaggagagugcugcaagccauuacaccaccauaggugcugagcacagcacaguagaggccagugaggcuggggugcagcccaguggggaaguccuugccaagcaaggacaagacuuuugguuuucuuuuuuuuuuuuucuuuuuuuuaagauuuauuuucuuuauguauaugaguacacuguagcucucuucagacacaccagaagagggcaucagaucgcauuacagaugguugugcgccaccaugugguugcugggauuugaacucaggaccuuuggaagagcagucagagcucuuaaccacucuccagcccuugguuuucuaacuuuguaaaaauauuguuacucuaccuucaaaccaugcaaaacaagcauaggucaaguaaaguaggcucuacuuugccagccccugccaagauuuccaugcccaggugaggaguuagcaaggcauuguuugagauaaauucagaagucuggaucgaagucaagucugaagucccucuuuucacucguguguugaaaagggagccacacacacacacacacacacuuuucaagugugaccucugcaggucugggugcugcugcugaaggcucaguuggaggugguagaaucggagcuuuccaggccuguguacagugucagcuccaugccgcaaggauugacuuguucaguauuguauuccuggcucuuggaacauggcuaaggcuaugcugugguuggcucugggagcaucuggaucucuuaagucacuaagcuuucuguuuuaugcuguccuuagugacacuguguggccacuacuguccuaagggcuuuuuguaauuccuuacuuuagcccugcagaugaucugccaggauugggcccagcugggguguuagcaaccccaggugaugcaccgccaacacuccaucucccaacacaugaggcuuugccuuucucuguugcgacucuuuaaagcuccaucaccuuuuggcaaacauuuucaggccaguuugccagaucugcggacaaacuugccaaacuguauuguaagaguauaguccauugcacaccaguugugucucaacaaaguugacuuuuuaaacaaccuccucacaaagacaagccugacaggcagcuguaagucaagaaggaaaaauuggagacagagucuagccgcuccuaauagaacuaagaacagcucuauguuugaagcuguuugaucaagcucuguuuuuacuccaauuuucauccccagggaaaggaaagucucuccaacaacguaaggccaagccuccgaagaagcaggaggagaaggagaagagggggaaggggaagccgcaggaggaugagcugaaggacgcucuggccgacgacgacagcuccuccaccaccacagagaccuccaaccccgacacagagccacuccucagggagguaugugggcguucacaguggggccucagacugccuagcucaguacacauuaaugucuccugugucaugucucuccucugagcauguguccuguguguucaacaugccugcacucuccccugcagaaaccagcccagcucugaggcugggugacuuuguuccccccacccccaccccugagaagagcauuuagaaauauuagaaacugaaccgcugcuaaaguuagcgagcagcaggguaauuagcaucacacuaccucaugaagucuguucguggcuguaaaugucaaagaggagaaggaacuggaccuauucacugucuaguaaugcugggaacagggcucaguaacagcccacccccaaggcaggggcaacaguggcucucccagagggagucauguaacucgucuuugcuacuuuuuggguucuucuuuuuuccacccuuuguccaacccucaccccucauccccauuuuacccccuaacacuagauaagagaaaaacaaggauagaggagaaagagaucucugagccuaauuucuuuccuuuuguuucuucuuugaacauggccacuaacaaaccacaaccaaaccucacuaaacgaccaguaaccacccaacccaccucucggggccuucgaauuuauguucccucugaaaaguuccuggaauuccaaacaccauacaaucacagaaauuauuugcaucuggaaaaccauacuucuucuagggcacaaggcaaaucacggucagcugcuauggacaguccgagcagcccuucaaccuuacaccuagaguuaaaacagaaacauucuuauuuuaaaacauucuuuuuuaaagaaacuggaauauaagaauucucaaaacugucacuacagaguagguucaagaugccguuaguggucacuggaaccagagcccagccuaggauacaugagcacaugaggucagcauccagcagugacauaccauucagaauagugcagcagagcccagcaugccaccaccacaccccacccccccaccaccacacccccacccccccccccccccccgugcacguguccagcaguguggcuuguaagugcugaguggaaaggcaggcuccaacucguucuuguuuuaggugaguguguucagaucuacacugcggaucagaaucuggcuucuggucuccaucuaacggccuaaaaaaucaguucacaagcagucccggcucuguucccugggugauuucauguuucacauaggaugcgcaugucccacugucccuuugcagugccuugcaguuggccuggugcccugucuaaucccauuucauuuguaacuugugcuggagcauuggacuuaguucccauuuuagcaaaugacuagagaaguauagcaucuucuggcaagccgguacugagacauauacccacagcacggggagaguacugagacauauacccacagcacggggagaguacugagacauacauacccacagcacggggagaguacugagacauacauacccacagcacggggagaguacugagacauacauacccacagcacggggagaguacugagacauauacccacagcacggggagaguacugagacauauacccacagcacggggagaguacugagacauauacccacagcacggggagaguacugagacauacauacccacagcacggggagaguacugagacauacauacccacagcacggggagaguacugagacauacauacccacagcacggggagaguacugagacauacauacccacagcacggggagaguacugagacauacauacccacagcacggggagaguacugagacauacauacccacagcacggggagaguacugagacauacauacccacagcacggggaagaguacugagacauacauacccacagcacggggaagaguacugagacauacauacacacagcacggggaagaguacugagacauacauacacacagcacugggaagaguacugagacauacauacacacagcacuguggggagaguacugagacauacauacauacagccguauaaccucuacuggaucagucuuauaaguagagaccagguuuuacucacgguacuuuaguaagaagcuacuaauugaugcugccacugcccacugcacauaaauguaaucugaaugacuuuacacuuaagacucaucaaaagacgauuacacuaaguuaaaaacagcuaaaacauugauagagguucaacagauuucaagaagggaguuuaugcggacagcaucguacuguauacaccuguaaacccagcauucaggcagcccagacgugugaacauggauuucaaggccaagccugauuuacacagaaagcuacaggccagcaaggagcucugcaguggggcucugucauuccucaggcugccguguauggcugugucuuggguuaugguuucauuuccaucaucuugcuaauccuucugagcaccugcaucugugucuuuacaggauacagagaagcacaaggggagaccagccgugccugaaaaacaggaaagugaacugucucaagggaagcccaagagcaaaaagcucuuaaacgcuaagaaagaaaucccaacagaugugaaaggcagguaaguaucgugggguuguuggugggagccaggcauugcuccagucacuucucuaagggagggugugagcagcagaagccaugcacugcuguuccacuaggccucucgugucuaaugucuacuagucagguggaugcuuagggguuugcaccugcuucugaugccaggcaugugaggguaggguuagcagucuguugugaaggcuugguuuaauacagacccacaguaccuacccuguggacagaaguaaccuugacgggucacccacugguaaaggagcuaacuuuucucaagagcuuggcgucugcagugucacaaaccagggaugcaguugggaucuagaauucugugcuguaaaccuuggaagaguuauucuugccugaaucauguucugggaugguguccccaaugagacaagccuaccauggaagaagucuaguacccacagggcagaauucaggcaggccccauaaggaggcuuucuguggacugcuucccaagaaaaaggauguguugagcuaauggguuguugacuaagaguucuucguauuuucauaagcugggcuagcaucuuccuacugagcugaugucaggguuagcauuguggaggugaugguucauggcagauggggaggugaggcgagaaggauggggguucucuuaucauuguuaccucccuggaccccagaaagagccuccagggugcaagacaugagccaagaccaagcuggcaucugaaccucucucacccuugaugauggaaucauuucaagucagugggcuguuguccauuuuauuuaaaagcucuaaauuuuuuuuuuuuuuuuuuuuuugggaaaccaucuggcuuaauuuaggaauauugaauuagcaaaaaauaaaauagucuggcaccuuuuuuacuuuaaagccaauuaauuuuacaguggcaaaguuaaacuuuguaaaauagacacccccacaguuacagauaacuuaccuaaaaauagcucacacagccucuaccagaagguugagugucuguguuuuaggagucuucugccauuuuuagaauauggaauuuuaaacuaacccugccagccagaaguagaagaacagaaaauuguguaacacugcccauaaauggcauucuuggaguuuuuguuuguuuuaggggcggguggggcuuuuuguuguuguuccaguuuguuuauuacacugcuuuggacccacccccuuauaaagucuaagcuggacccacccccuuauaaagucuaagcuggacccacccccuaaaaaaucuaaacaagcgucuuugcagugugugcucuugcaugaagucacacuuggccuuccuuauuuucuuggucuaacaaggaguggaagagccauggugauuugggggcuacugggucuaaaaaucuggagcuauuuugauguuugaacucuacugugaacgaguacagugguuuauuuuugaccuugaaccuagcagaaauuagcagccuagaaaugagaacuaggggcucgagggguacagaaagagcuugaacagccgagcaagguggguugugcugaugugacacgcggggucugagggaugugcugacgucacacacauaagcucgggugcaggaagcauacuuaaggacauuugagaggcacagcucaaaaaaugccuguucaaggcuggcuauggugggcuguuuuuuuuuuuuuuuuuuuuuuuuaauucaaaggcugaagaggaucaaaaacucaagggcuagcaugagcugcaccagugcaacucaguaggccugucucaaaauaaagagcaugcucagugggaaagaaccugacuggcguauacaaagccccagauuuaccacccagcacuggaaaggaagaaaauagauuuguacagacuuucugaccugucccagcaagcagacugucagccguccugccgucggcagccuucucaaggccugacuucaccuugaugggcaucacagaaccugcgcugugaagagcaccucuguccugcccugcggcauugcuugagcugaugcucucucuacggggcuagaacuugacucccacccaugucagaauuucuguuggaaaauacauucaggagcacggugugguacuggaaaggcucggucguagcacaauugcccuugcugguuccgugcagcaaguucaugcccauauuuccugaagcagacacugcacuccaaucagggaagcagagguuagacccucacguguacacguguauacauacacacucccagaaugucuagugcacagaguccaaguuuagaacuagguaauggcuuaggaaacuauaaauaaggcacacaacugaacuaugggcuacuuccauucuuggugacuuacagccuugccuaaacaccaggaccaauagugucuacauccuuguuugucuuucaguuccuuugaacuaccguacacucccucacuggaaaauaaacagcguagaaaucucccaaccaagauuccucuuccaacuacacuagcaaguggauccaaaucacgaaaucccccgaaaacaaaagguaucaucauguugaucacagauguuuuugguucacuguuuucaugacugccagcgccuggugguagccaugcaguagcugccagcuguguugggaagccugugaaggcuguguugaggguucacugaagcaggcucaugagagaaaacccuucccacauuaacuuuccuuucugaauucugugcagguacaaauaaguuaguggaaaacaggccaguugcccucucaaaguuccuccccagcagucaagaacuagguaauaccagcagcucagagggugaaaaggauucuccuccaccagaaugggaugcugugccaguucacaagcccagcagcuguaaguauggguuuagcagcuacugugguccauggccgcccccgauccaguagcugcuggguggggagguuauuuccagaagugacugcuguggguggccugcuauagccagcuucagccaaagugcaucuguccggccagggacuggucuacuuacaccauagaagguaagagaggccagagauccuagaccagcuggaggaaagcccgaugcccaggcccaugucuauacagcccuuccaugcuuuccugcucagagaacaccucagccuggccccaagcucuuuacucugcucucaccaucagccccacuggacucggccccgcugucugcagcaugggcaaaggaagccagggagugcccaggucacacugucgcugucccuuuuggacaccucuacugccuuagugcccaguuuuccugcuucuuccuugaucuuccaucuuccuuagaccccaacuucgggugcauauuuucaggacacugcaggcuucagagcuuugguuuguccacuaaggcugagucaggacaaagcauuagucagaggacucuaucccguguguacagucaggauccauucagcagcccuuggcuggagguuuaccuugcuuggguuucuguuguucucaugaagcaccauuaccacugaggagaagguuuagucagcuuaugcguccacgccaccgucugucuucuccggugcagaggccaugcgguacugccuacugccuuguucccucagccugauuccauagcaccuaggaccgccaggguggcauugcccacagugaacuggccacuuccauguccauccggaagaugcaccacagacuuaccuauaggccgcucuaggugggcgguucccuuuucucaggugacccuagcuugugucgaguugacauaagaguagccaguaaaaacuuuguaccaguaaaggaagccaagaguguucuucauggcuuaaaaggcaaggaaagugccacggaaggcuaccccaggggagaaguaccugaagccagagguucucuaacuucacaaagcaguaugaaggcucucuuccccagcuucaggccuuauuccagccuuguucugaccuccucaguucuguuccaucuuccuuugucaagcacaucugcacacagacagagcuucccugacagguuucaggaaacacaagccaacacacacacacacacacacacacacacacacacacacacacacgcccacggccagcuggcucuguugcguuuaggucuguagcaaagcagaaagcaugacggaaggauguggcaaagcugcucagcucgguagcuuggaagcagagaagagggcacagggaggggugugaccgugaagggcaacuuccucguagucugucuguccaguugcuaauccacuagcggcccucacaagccaucaccugcaggcgagcacugcuguuggaauaagcguugagcucacuagccuuuggguauggcucccauccaggcugcaccagagcggggccugcccccaguauuucaucuuucaccaggggcaggucagaaaaggucccauccaaaaaaugaacagggaaggaaggagcugggcauuuguacaaaaaaaucaaccuucaacaucagugugcugaauaagcguacugugcucuggaacuucuaagaagcuuaugaacaacucaggcaagaaaugucucacacacacacacacacacacacacacacacacacacacggcauuugugaugagcacugggcaugagcaacagcagagcagcuauagagaggucaccuuuauggucacgagugggcagguggcaggcuaaagcaaugauaaagguuaucggugccacuggggguguaggagaaaaaaggugaccugaccauggagaauggagccgugggcuucaggagauaggagcuaugcuccgcacugaugucacgggguccugacaugccccgaggacuuagcagcagcaggugcuagacagcuugagcagacaugagaucagcagagcagugcagaagcagggcagacuggggcugcagugucaugaacagcugggccgaguccuguccugggccccuguuagggacacacagcagcugugugaguaacauaucuucuguuguuacuccuccuuccaguuugagugccgaugugacacugaaauauuguaaaguuuuaaagcagcucuguagauguuuacagucccaggaauccugagagccacagccgcaccuucagcacccgggccugagacaaggaaccuugcuggacugagggcagucagccugcgcacuucaucugcugcagguuuacccuggaaggaggcauagcucccucugguccucaguggccucagcugcucaugggguggcagugaagagacugacugcccugcccugcauuuggggagcaagugcuuguauucccugaagcccacaggcaccaagagaugcacauuucccccuucuccuuagaaccuuuaaguggaaugcauaagucuucaugugucugcuuuauagaagcauuugaauuucacaucaaaaauaacuaacuuugaaaaguccagaugaaacugucacauuaaugggaccuuuuguuaauuuccagcuacugacagucuuuauaaacugucucugcaaacccucaaugcagacauuuucuuaaaacaacgccagaccucgccaacaccugccucuccuucucugcccaccgcucccugcccguucacaucucguggcagcuacagcagcguugucaacagcuccggcagguaggcugcucaccucuggucaucacagugacacauagaccccacgcucuugugccugcuggugugaacccauuuucauuauuaaaccccuuaccugggacaagcucuuccuguguuccagguaccugaccccagcacugaccuuauccugucugugaacaagucuguuacuguguucuugagcuguguggcaagcaucccacgacggagcgcuucaccuaaaguguugaguggagugcaugagcaggcugugacaucugugucacugccauguuacauguuguagagugacacacuccucccucggugccagcaggcuuaguaucacacaggcaccauguccuccagacaggcuccuguagagaagucaggaagcuaugaccgacugggugaaggggguuuacugacuggggacccccacuguaaccaugucuaggggacggagcccugaugaauggacuugucccaccagccccaccauuggcugauauucucacagguuucuuugccaagggggcaccuucagguucuucaaaauguggucuccaccuuuccccagucccuaaauugggguaccucccucagucuccuuccucaauuucccagaaaccccucauuuuucauaugguuaagcucucuuggaccccagaacacuuucacagggcuccucugugcucugagccauccuggacucuuccacugucggcaccaccagugaggggcaguucuuuccuucuugcuguagugacacaaaagccaagcagacgagcagcagcaagagcaagcugacaaaggcggccucgcuccccggcaagaauggcaacccuaccuucgccgccgucgcugcaggcuaugacaagagcccgggugaguggucugcacccagggccugccacaccuggacaguguggcauaugggcucuguccagcugggccucaaacugauucacaguccuuguuucaggugggaauggauuugcuaaaauuucuucaaacaaaucagauuuuuccagcagccuuggcauuucacacauuccuguugacagcgauggcucugacagguguguggcuuacccuugggcagcaaugaggcugagacucccggggcgggaggcaucuuuccuauagcagccacgugguaggcucccccaucucugugcuuucauauccgagccccgauugacacagcucuccaugugaagccguagauggccggguucacuaaccaccauuuuguguauuuucccuugcaacguucagcucggguuuguggaguccugucagcaaccccaacagcccugacuucaccccccucaauucguucucagccuuuggaaauucuuuuaaucuaacaggugguaaguauucagcccugggucuauaagucggaagccuguaacaagaaaaggggugugacauguuagggacacuuaguacaggagacauggcugccaucugagcagaggguaucuuuuucaaugcaacagcuggugauagguuauauggaagucuaggggagggacaggugugcuucuccugucauggagggcuuccgagaacccugcacacaaccaggcagccauguggaaguccucccuaacacccuugccugguacagcaggacucagugcagaagggcaugccggcuggcugugcuccacagcacaugcuaaagugcuucucagagggacucuggucugaaguugacucccugcaucugccgggcagugugcuugaguuagcuaaaagaucaggaucggacgcggugccuucuagugauggcuguguuagauguucacauuguggccuuguaugugccuguguucuugggaacaccccagaguguugugggagcuuacgaggucugugucagcucacgcacauggcacugagggguguguugcuaagagacucaucucaucccagaguccaaagaggcuugacccagugucucauauuucagcaguuuucagcaaacugucgcgauccugcagucagucgucccagagaaguuggaaugaguucaacagcggccccuccuaccuuugggauucuccagccacagaccccagcccuuccuggccggccaguuccagcuccccaacccacacagccacugugagugcccaagccccauccuugucauuaccaguucuguccuucauguggacugugcugacagucacaccgcagagacaccauaauggagggcuguguugucagggucacacuguucugugagcugccugaggcgcccuucaaagccauuagagucaggacaggcugaggaaacugaggggcugugguugaggcccuggccgccugaucucagggacggccccacuucuuccacggcaagcugcccaguugcacaugcauuguuccuggcaagcacacagcuccuagcucguggccgcauuugcuucuacucucaaguuucugcaaagauuaugcauccuggaggugcucuggccaagaacaguaagggauucauccuucacaaaccaauagcagaaaccccagaccagccgcgcauggccaguggauagugcugugaagauggggccauaggaaagcccaucucccuuaguaauaguccuaacucccguuuauagcacguggccacucuuaaaagcagaccagcaaauucucuauacacuccagguagucagucggacugugggcuuugcaucuugauacaaguuaguguggccaggacccacgcaggcgccugccucagugagacccacacacagaaagcacagaaagcaggcugguugcacuggguccaccagccaggcugugucagccugcaauaaaauaucagagcuauggcuaacugucuggaguauucuuuaaaaucaauaaaaaugggagaagucuguggaccacucuguccccugccggcccugcucaccccacacucaauauuauguuccuucuguuuuuuucguaguccauccuuggcaacagcagcggcuugugguccaccacuccauucagcagcuccaucugguccagcaacaucaacagcaaccuuccuuucuccacuccaacaaacgcgcugucgagcaucagccucaugggcacggaaaacucugccgccgcccacaccccuuccgccucuggcccagcugacgacuugggacagaccuacaaccccuggcggaucuggagccccacagucggaagaagaagcucugacccuuggucuaauucgcacuucccucaugaaaauuaaaauuaagcaaaaaacgaagugggggccccucaucuagaucaugauaugccaguuuccaagacaucuucugaaggcccucacugccucaagcccucuccccuccucgcagggcaggcuuggugcacuggcuucucucacaucuuucuugcaauuaugauacucugagauuugcuguugugcuuaaagacaaaagucuggacucagccacaaacuacuacagccuguccaccugaaaucuugacuuacccaguccccaccugucucuuccugccuucuuuaucuguaagaacacaaauuuggcauuacaguuaagggagugauuugaauugauugacaaguccuggcaugugacaauuuuacuaaauuaccaaguuugguuuuuaauaauuucacaauauuaugcgccaagaucuaauuuuaaaaauguacgaggacuuugugcugaaaauacagaguauuuuuuuaaaguaaggcugucuuggcuuaaaagcagauuacagaaauguaagccagcguaagagcaguggcuggauguaaagcgcccagcaggaaccacaggcacucugugcuguuuguacuugagguauguaccauuuguauaccugaauuuauuuuaaagauaaacugaaaugcacauagccaagucuugacauuacaagauuguguauuucuuaaaauacaacuuuguguuguacuuugaaauaaaugaugcuuuuuuucaaaagccuugaau

SEQ ID NO: 130 - RNA, 8990 nt, Mus musculus
gugcguguccguaacguaaauacagagcgccgcaagugcgggcuacguagcgggaagggaaguggccccagcggcggcugggcucggcugcccugggaagguggcgguagucccgggcccaggacgaggccucgagggccuucaggugcggccugcucugugugcgcaggguggcguucgugccgucggccguuuccacgguuagcucgcgaccuggcgucucagcggcugggcgagggaccggccggcgcccggcagcucgaguccuaggcccgccguggagcugcuggguaaaaccaaagacagccgcuuacgugggaaucgcaggauuagagccguuuuucuauucuaagcaggucugaaauuuugcaaggagacacacacccugaaaccuugucguugcuuguucuuaagucaaaugucacugggccguuuguauuuuuaguugacagaggcuugggguaauggagaccugcuggcggggcggggcgccgcgccgcgccgcggagggcagguaggcugggcggugaccagcagucauuuagcuucggacuaguuggacuggccccuucgcgcuguuauuccuccuacccagccauccuaggaguaaaaccaucaaggaguguaauuuuuauugucacauucugaauaaccagggacuugcuggccaucgccgauggacuuguacaaauaaacugugugucuuacuuuuucaguaaccuugcuuuuagauuaaacuuuuuguuuguuuuaaaucuuggucauuacaaacacggaauuuugaaccaguguucggucauugucccguguuaaugaggacgucauugcacacccccuugugcugcuuuuuccuuggccuccauuaucaguagugagcuacugcagcugucaaaggcuugauugaggugaagguugggaaaccaucgacugaaguuaagugcuuguuucaggugauacaggaguuugugguacugccuugauggcauuacccuuggccagccccuagacaagccccagaaccaacucuauagcuucuggccccuaauccuuucugaagguggcaagagaaaacgucauagcgcugacgaggaguucuaguagccaaauaauuacauuuaagauuacaucuaagagaaauguucucauuccaucuaggaagaugcuaccaaguacuuccuugaguucuucgaugcacgggaauggaguauuaaauuccagggaugcagcaaggcacacggcuggagcaaaacgcuacaaguaccucagaaggcucuuucgauuucggcagauggacuuugaguuugcugcauggcagaugcucuaccuguuuaccucuccucagaggguuuauagaaacuuucacuaccggaagcaaacaaaggaccagugggccagagaugacccugccuucuuaguccucuuaaguaucuggcucugugguaagugugucucaguuuacaagcaguauaguagaaaaacaaauugggguuuucagaggaaacuuuaucuuuugggauaauguauggcgggucagacucuuggggugugugaagcugugggauuuguuugucuuuucuaaaacaugagaaaacuggcaagaaagaaaguggaguucuuccuagugcuggcuguaacacgccagaguaaacuacuguacccaguguaugaaaguagggcaugggguucgucccagaguugguuuauuccuucucuuuugaaacagcuucuagauguguaggccaggcuggccuggcacucaggaagcucuuaacucagucucuuagugcuggcuugacagucguguucugccacacuggcugacuuuaaaacaaacagaacaaaacuaauaagaaccaaacccaagugugugccaagaaauauuaggauaggaauuacauuucuuaauuaggcaaaucugcaaggccggcagauugcuaucuuuuuauuuuuguuuuuugucaagcggaggggcagggguugguaggaccaggaauagaaaccagugacuuaaaucuaccaggcaagugagcugcacccccagccuuccaggguaagaguucugaaaguacugaucaaacuggaaaagaaccuuuagauucuccaguaccccaacuggagaacaucaacaguccccgucaacuagaggguacuggaguauguaggugcuuuucacauuuaacuggacuuaagaguaaguugagugccgucccguccacacugguguucugagugcccuguguccugucauuuacugcauucagaggugacaucucuuuccacaucaguugcauguaccuugucaugaggguuuucuucaucaucugugugccaccucuacuacacuguggguguaugggagucagggacuguuuuguaccugagccuggcagugacuuguaacucuuuauuucaguguccaccauaggauucggcuuugugcuggacaugggauuuuuugagacaauaaagcugcugcuguggguuguguuuauagauuguguggguguuggccuucugaucucaacguuaaugugguaaguacgguaaaguggcuccuucuaugcugucccgccucuguuuccuucagaggggcaguaacuagugaagacagaguagcugaaguggcugggcagacugcuaggaugguucuaacuuggcuccugugucuguacuaggucagaaaauacucuaaugggugcuuucugucauuguagcaaaucccagaaugguuuacccugcuaaauucugauuuuuuauaauauauguaugguucugauuagcuuuguuuucuacauuugucaguggguaccauuuccaggugcaugagugcuucaguauuguuucgguccauuuagaucuagguuauccucuggaguuuuacaucagucagggguguuugaaagggguuuuguuuucagugugucuccucugugcugagaagaaauuacauccagaggccuucaaaggccgucagccugcuucugucugggguugaaugaacaaccauaguuggcuguagacuagagaucugguguucaguguguuacuucccucagagaauguuccugugugcuuggccuccugggcaaagggugaugauguaacaaguggcuucagaagguggagacugaggagggagcagagaaaaugcaaucguuucagacauguccacacggcaacaggcauguguguggucuuauuuagaaacuggaguuauuccauagaugguuuuaggguagcagaaugguagaccuuugguaccuagauaugguagcuauuacuguuuuaaacaaaaaggcuaaggcuuuaaccugaugagaccaguguuuuauuuucuuuuguaacuuuugacuaauaaaguacagguucuguggguacugaauaguuaauaaaaaacuacuauguaccauuggucuaaauuccuaaaaucuagccuaagauuaauauugcuaauauaaaucaaauacucauugccuagcuacucauggggggaaauauguaaacuuccaagaacaguuguugacagugucugccgugagugcagugaccugcauggccacagagcaaggccgggggcugauuuggcuuuugucccccauaguuugaucaaguaggaacuggcuuacugugcucuuugugagaacacaggugucaugaacugugaggagcuggaaguagaaacugcgacauaccccuacccccaacaucugcagcgugcccuaggaaccagcaccacgccauguuuuggggagcuauggacacuugaucccuguuucaggauggucagcugcagaggcgugcuuaugugcagcagcauggacuuuuaugugcauaucugcaagcuggguuggaggggagaagagaaauggagaacuaggaggcuaagaacaacacacacaaagucaaguucacugugggaaaguccucagugcggcagugaagguguagagaacuggggaagccugguccaggcagggcucaaauagggcucaagugagagaagggaugcccagaaugguguggugguaauagggugaggagagaagguucagagcuuccugugguaacaggaugugauggccaggaaguuugggcuuaggagacgguuggaagugcugcugaagcauuccucauuggccauaccgagucagguuggugggaugcuugcugcagaggugagcagagggagggagaggacuggaagcagcagucuggccugaggaguguccaacguggaggugggaaagcagccagucaguucuuugggaaccagugucuguccuguugguucaaggaaugugcagagguauagcaggagaguagugguuacacggacagacuugugagcaggagagcagugguuacacggacagacuugugagcaggagagcagugguuacacggacagacuugugagcaggagagcagugguuacacggacagacuugugagcaggagagcagugguuacacggacagacuugugagcaggagagcagugguuacacggacagacuugugagcaggagagcagugguuacacggacagacuugugagcaggagagcagugguuacacggacagacuugugagcaggagagcagugguuacacggacagacuugugagcaggagggcagugguuacacagacuugugagcaggagggcagugguuacacagacuugugagcaggagagcagugguuacacagacuugugagcaggagggcagugguuacacagacuugugagcaggagggcagugguuacacagacuugugagcaggagggcagugguuacacagacuugugagcaggagggcagugguuacacagacuugugagcaggagggcagugguuacacagacuugugagcaggagggcagugguuacacagacuugugagcaggagggcagugguuacacagacuugugagcaggagggcagugguuacacagacuugugagcaggagggcagugguuauacagacuugugagcaggagggcagugguuacacagacuugugagcaggagggcagugguuacacagacuugugagcaggagggcagugguuacacagacuugugagcaggagggcagugguuacacagacuugugagcaggagggcagugguuauacagacuugugagcaggagggcagugguuacacagacuugugagcaggagggcagugguuacacagacuugugagcaggagggcagugguuacacagcagacuuguagggagugaacugcaggcucccuacaguuccuuuaucacuugcuuuuaaauguuauaauuuaugaaguucccuguggucauuuauguguacaaugaguaaugaucaaaucaagguaauucgaguuucuauaucaaacauuuauagcuuguugguguugggaaccuuggcaguucuagcuagcuagcacugacugcugugaucauuagaaugccuugcuucuguugguagccacaguccaaccuccauuggugaccaugauuccauuuccuguugcucugaugucaggguuugguuuuuccuucuguauaugccacauguggguccgucuuuguguuccuggcuuguuuuguugauuuuguuaauugaguggcacacauucuuggcagaaauagugaguuccaguuuguucaaugaagcacuauuuaggcuuuuugauaacuaaguauagagugucuauuauacucugccaugcuuucuugauuuagucuguuugucuuguuucugugccauuuaaaauagaaucuaaacuauaguccaggcuagcuuagaacuuaccauguagccccaaaaauguccaccacccacaugcuggaaucagagacauggacccugguuucuguauucaguguauuagugacacaggcucagcagguaaagcacuugcccacuuuaacccccaggauucacauguagaauugacuccacaaaguugucuucagacuucauacuugggcacauucccccauaaauaaauauaauaaaaaucaucuaaaauccagugauauaaaugacauuaguuuccacacguuuauagaauuguucuuuuuauugaagaucuggacacuauaguuuucugguaggucggguuguagugcagcaauggaagcaugcacacaggugcgcgcgcgcacacacacacacacuuuugucugggucuaccacuagcagccccuuucccguucuucuauuucuuucacuuuuuagugguaauggcaguugacacagugggguuuuuguugaguggcugguuuagaugucauguuuuggugaugucauuuaggcuuuaaugccugcacauuaccuuggacccuugaacugugggcuuuguguacaacauaauccaugagaaagcgcaucuguccuagcuaaccccagucgucuucuccuucauucucagagccacucuuggugccaccagccuguccucugcugauagcaacucuuaucuuccuauguguucagggcaagacugcugucucugacuuucuggccuccuggcagaugucuuaauccucaccuucaacuaggguugcaccucaucaccuccacugcugcucaccucuggugacaggcgacacaggcuccugucaucuccuccucuguggaaucugccaccaaggagaccccaucagaacauuucagugaggcauuucuugcaucugacaguggcuuuuucaucaugaaguaacaaaguagccccaggcagccuuagaccucacucccugccucuuaacugcugcuuacgagcacacacaggucuccagcugugccaggcgccaucagugcuuugggccuuuauguagacauuaugauuuaaaauugcaccucgggucuccaucuccguucucacuguccuaucauaugcuguguccagcuucucccacuggaggcuguuccauugcuccaucuccagggcuuggguaauguguugcagcagacaguuggggacugagagaacgagugcacugcgcaagacguuuucacuuugcucuucagguucgucuccaacaaguaccuggugaaacgccagagcagggacuaugacguggaguggggcuaugccuuugaugugcaucugaacgccuucuauccgcuccucgucauucugcauuuuauccagcucuucuucaucaaccguaagugcuuguuucucauauggucagauucuuacagugugcugacacucacgguaugcuuucuuuuccuggcagauguuauucucacagauacauuuauuggauauuuaguuggaaauaccuuaugguugauugcuguuggcuauuauaucuaugugaccuuccugggauacagugguaaguuuuggugguuugagaacagagaaagaaggagacauugacagccauugccugagguguuaugguucacucauaugcucuuuuaauuacacaaguguucuuaccuuuuagcuugcccccuguccaauaguagaguggaacagguggugugugacauuuggagccaugcuaacucauuauugccaaguuacagguagaagcugccuuguuguguuagauggauucaggccccauauuauuaaccauaggguagagaggaaaaggcauggaccgauguuuaugggcacugaaguaguuacaaacauuucuuagggaaugaucccagaucaggcccagggucugcugaucccaggccaaauuuacgacuaaaucgucuagguuauauuuccuaauaugaaugaagauagucuuaggcuguucauuuaagagaugaucucaaaccaggacucuaucuuaauagaaaaccugccuguuauguucaagguccuguguucagcgcccccaaaccccuauugcuaaaaugucuagagaucuuccgaucucccagagccauccagagaacucucagcuccuguucacccuuuggaugacugggacuuuacugugaacaguucugacuuccuuccccccaugaucaguuucccagggaucgcuuagccuuccacuugccugguuuggaguauuagaauucuuguagugaauuuucaccuagcuuaaaaguauuauaacccauggcaccaaagugcugguucuuaguggacuuuuggauguucuuccucagaacuguugagaaaaugcuuugggcacuaaggaaacaggaagcuuacguguuuacaguauacugccuuaguucuucccaaaggcugggcuauuaacuugaucauaccucaaacugagcuauguugcuuuuugcagugaaaaaugcuuuuucucacaugcuaucagucuguguguaggaaaacauagugaucgcauaaugaggcauccauuaucaugcugauauaggaagacgaguccuggaaccuuugucuagauaggaguguucaccccucagcucagguugccuagugagauguagcuauagaucugcaagcaucaucauggaccuacacacgugugcugcuccugugguccaguguguugaaaagggccuucuuccaguguguacaucugucagccauggccauguuucuuuuccagcacugccauuuuugaaaaauacagugauccugcucuauccauucgcaccucucauggugcuguacgggcugucgcuggcacugggauggaacuuuacccacacauuguguuccuucuacaaguacagagugaagugagcauccuagagaaacugucugguguugggaagggaugaguucuuguaaaucuguaaauagcuucaauaagauguaaaguuuuacaaauucaaggugauauuaacacuuguguagaacauuccuuaaaacuaauuaaauguacauuucuaauaaauauuuuuaaacuaaagcugugacuguuuauuuucacuugaagcuguauauaaaauaucaaggguacaguaaguguuggaucacacagaccaucuuguuggcaaaaugaacagucugucccauuuuuaaagcccauuuacgcagaccccuccgaaa

SEQ ID NO: 131 - RNA, 8061 nt, Mus musculus
uacggucugugacggcaacggcgugguuugaauguugcacuggguccaccugccucuguuccucuccuuccggcugcggggacguucggaguggacacagcggucgccggugagugcggucgugggagcuagaggcucucucugcaguuacgaaaugacuuucuuucuguuucgaguuggaggucccgcagaccuauuucuugaucuucugaaagcagccagguugucacuuuauucgagucgugcugcgacgcgcgugucucugagagucucacucguguagaucuagguccgagccauccaagcgucagugaaauuuauuauuuuuuuuuaagaaggcaaaacuugcuuaauuuuaagauguugcgauuuuagagugcugaguuuuuggaguugcuguuuauuaaagacagugauuuugcaggccccugugauugucacuuguuaaagcagcugcuuuugguggcugagaggccguuaugacggcugccuacuaccuuuacguccugggaauucgaagaagagagacauuuguugauuucagagaacgcgguugauugcacgggaaauucaguguucuguauuuucaggaauguucacuccucguuauagauauauaccuugacccuuuagaaagagaaauuaauuaaagaaccacuuacgagcugguguuguaguuuagggguaaagagcuguuuacgugcauaaccauuguaaaaaagcaaaacaacaacaaaacuccagcaaaccuuucggggugagggagaggaaaaaugguuuuggcagccuuuuguuuuucuguguauacucauauauuaacauauuagaaaauagaaauagguuauauaucccaugugauaaaugguauuuuucaguuuauuuuuauguguauggguguuuugccugucauaucuacaccaugugcguguagugcccauggaggccagaagauagucagauccccuggaacuagauagaguuaaaaaaacauuuguaagcuuccagguggucaccgggaauuaaaugugggaccucuggaagagcagccagugcucauaacugcugagccaugucuccagccccauuuuucugguauuugcaacaguacagaggaaaguuguuguacaguagauggcaguauaauugcuucaagguccaaaagcuacgcacauaagaauaaugccuacuguauugaaaugaguugcagcucagagcacuuauauucuguaugcaaggcuauggguucaauccccaguaccuucccucaccaaaaggaaaaacaacaacaacaaaaagcaguuuugauggugcugccugcuuauaucugaaauuaaacuucagcagagaaucuugagugccgaagcugcuuugagagacacaucuaugacuugagcagauccaaaccaaaauauaaaguccuugucuucuggcacugucccguguacagaguggagacagccacuaaaugguaaaccagcaaaguacaauagaacacgaguacucaaguaaggcaaggugcagaagugcuggcagggcuguggcugcgaauguuaagcuguuugguggagguaguccucauucaggacugaaacagcgugauccagguagaccuguugacaagagaagguuugagccaaaauagggagaagaccuccagcuucaacuagguguugaacccagaaacucaugcaugccagguaagcguuguaccucugaaacauauuccuaguuccagcuuuaauuuuuuuuaauuuauuuuuuaauaaaugagcuuuuagcuuuaggcaauuuuagauuucaagagaaguggugagugaagcuuaguacagggaccuguaccuucccugcucaguuucugccuuuaucaucaaauauuaguguagggugcucagugcagcugcugaaccaaauugguacguuauuaacgucauuugcuuuauuaagacagauuucuuuagcuuuguuggguguccauguccuauuauauuccaggauccaacucagacaccaauguaguguguauuguauauaaugaugauuguguagcucuuggguucuuggccaguuucucggguuucuaguugugaugaccuuggcaguuucgagaagugagauauuugaaaauguguuaaugaaguguuuuccacaguuaggguuacuauugcuacgaugaagcaccaugaccaaaaaaaggaagcaaguuggggaggaaaggguguauuuuccuuugagagacacaucucucuucuacaucauaguccaucacugaggaagucaggacaggaacucaagcagggcuuauggcaaggugacauaaaauuagcuagcacacacaauaacccucaguccacggugguuuuucucuuaaguggaguuaaauguaucggcuuugugguggaagucauuucauuacauguccugggaucaaguauaggugcuagcaacguuuuguucuguuuuaugauagguucccacuauguagcccuggcuggaaugcuguccgcucugaucaccauugguguuccccaucccugaucuccugguggagguaguguuacaugucaguuuguucuccuuaauggcaaccccugcuguucuguacagcacuccugggagcagugcuccagucccuuuacuuguauguaaguguggacugauccaugacaguguaggucccaguuauaaacugaaacuuuguuguguguuuguuuaacuauagucacuccaguauggccacugggagcuguuucaguugugucuguaucccuuuaauacgcucccuuggguuugcauuucugaguaccgacuuccugguuccucagguugcagcagacugucagcugucucuugaaggagcccuuugaagcgagugcuauuaaagucacuaucugagcacaaaguguguucauagcugcugguguaguuguccucucaacaaacaaagugagcccauguguacauacaugccaacccuagugguuggcaggguuccugaggggagaugaggagucugaaagggaggacuuuucuuucugucccaggcuucccaaguguagggucagaggcaugugccaccaaugccuaucuguacauacucuccuaauggcuggauaccuuggggaagugauugcuuucugcaagucaucuuccucauauguaaaauaagagggcacuugguucugauucuaagagguagaauuucuucaguaccaucuaguuuugcauuuucugugauuucucugacaaagaaaaaugaucaaauauuauuuauacuuguugugacaaguuuugggugauagaaaacuccauuucccaguuuugugggaugaacgcagacacuaagcucacuagaugaaaauaggacuguuuaacguauaaugacuacugagguuuuaccgacacggaaggggagaugugcccaucugcuauguguuugaccagcaguguguuuccuacuccucagccucugaagagagaauucccacccccauggcugggguucugcgcuccgcguucccgaggccuccaugcagacugcagguaagcuuuaacuuuccauggcuuucucuuacagcuagggcugaccuccaccucacugugcggcugaggauaaccuugagcucugccugccuccacuucccaagugcccagguuugugcagugcuggggacuggacucagcuugaugcaugcaggcaagcacugugccaagugggcuacauccucaguuuaagaacuugcuuuuuuauguuuuccucucuuguuaauuacaaaacacaaaagcaaguuaaucuuuuuaaaagguccuucugauguaaauuaguugguuuaggucugcugcauuuguggugugagagcucagagccuuaugagcacugggcauacacucuagcggagcuacacccagcccuuguucauuccugcucuaugugcuauuuucccuagagauuuccaaucccaaaaugccuuuuccuguagacuaagccaaugaaaaggcuacugcugauugcccuuggucuguuuuaauguuacaguuuuaggggaaacccuucaauuaugaaaagaauacauuuucaaucacagucagauaaacagaaaaaguagaagauaugcaaucuccugaagaaaagaaauguguuagcaucuccuccuagugcuuagagaguacauugggauaacuaaugaauacauauugaccagacuggguacagacccagagauaugcuaggacuccauacagaacaccuccuggcuguggggguggaaaugucagcuacuuccauuuggcuaaugaauucaguauggucucccuuuugguacuuuggaaacugacccucugggaagaugugugacucacaucuuaguguuguaagcaaaggaagcaggaccagguuucccuucucucacccugucuagacuuaacccucuaguuguuggaucagcucuguaguucagagaagucugaaagagaaagacugcagugaaucccuguguccaacugcacaaguaaaggaggacugggcaauaaagucaagaggugagagcugggccugguggugcuguuaggacuagggacacucacugugcuuugugugguguugguuuacagacagugucuuacucuuuaggccugcuccaaacuugaaggaaguagccaaccccagacuggaagucuaagugcauaugguuuugcuuuguuguucauuagugcuuuaaugagaugcguccacucagugagguagccacguuagacuguuguagacuauguuagaucagacacuugucacauaaaggcugguggauacaggcucuuacccuacauggaguucuaaaugacagauguuuucugcuucagacugugaagaaaggugcagaaucucucauugguacagaauggauucgucacaaauuuaccaaaucaagaauuccagauaaaguaaggccugauucuuuuuuaaaauauuuuuauauaccaauuuuauaaaauuauaaguuauuuucaaauuuauuccauuguguguugcauugugucuguguuucuguugcacagaugugugugcacuuguccugguuuguguguggaagccuagaaggcaauuguguagucauuucucuccacugccaugguacugcuggggaguggagcucaggucaucagacgucaggcacagcagcaaacacugcucauggcaggucacagccugcuaguggagauuugcuuagguugcacaugcauauauauuagauaugguguagacuugaagugcauauagacagauauaguguagacuuggaagcacauauagacagauauaguguagacuugaaguacauauagacagauauagugcagacuugaagugcauauagacagauauagugcagacuuggaagcacuguaggaagcugaccucugcucccagcccaccggguuucauaggaauggacuccuauaauuuucuggccuguguauucugcucaugguucucccuuuauauacuguggucuuugucacuaucguccugagaagacugugaguagaggcuguccccuugugacucuguccuuacuuccugcaucaaccacacaggcaaagcucuccuuuaguuuguuguuguccuuuuaauuuuguuuggguuucacuugcuucuuaguuaauugaacuuuauguaguaaaacaguugaaugauacagaagaacaugaucagaaggcauggaggcuuccucucuucuucacagguucccauuuugcauugauauaaagcaacuauuagcauagaugaaacaacuuggacauuacugcaggccgucauguauggggucagucugcaugcuguguaucacccuguggguuuugaugaaugcauaagauuauauauucacuacugcagugucacacagaacugugcacugcccuacaugucacugugucccgccucucaggcucuagucccuagcagccuuuucaaucacuuucugguuuuaacuuucccagaaucccacauaguuagaaucguacagucuguauauuagcuucuuacaaaucuuuucuuguugacaguucaugaugcagguuuauguaguuuguuuaugugcuuaccugcuugcuuccagcuugaggcaguaaugaagcuguacaaguaaguacuuguguacuuguguauggcuguuaguuuuugguguguuagggagauauuugguaguacaauuaaacagcaaagaccauuuagccuugggcugaugagaugacucaguggguaagagcacugacugcucuucugaagguccugaguucaaauuccagcaaccauaugguggcucacaaccaccuguaauuagaucugacgcccucuucuggugugucugaagucagcuacaguguacuucucuauauaauaauaaauaaaucuuugggccagagcaagcagggaccaagugagcggggaugaccagagugagcagagguccuaaaaauuaauucccagcaaccgcaucaaggcucacaaccacauuauggcuuacaaccaucuguacagcuacaguauacucacauacauaaaauaaauaaauaaaucuaaaaaaaaaaaaaaagaaaggccauuuaaccuugucaagcugcuggagaggucauuuuguuggacagaaaugucuuuguacagguuuccuccccuacuauauuuuuauuuacuuuauuuucaaauauuuaaauuuuuauuuuauguguauaagugcuuuggcugccuguauguauguguaucaugugugucugguacccaaggaagucagaagacagcagcaggucccgggaacuagagugugaauggcugugaacaccauauggggcugggaacugagcccagguccuccacaaaagcagcaauuguccuagcugcugagccaucucuccaguaucaccugaagaaguuauagaauacagagggcaaaauuuaccacauaacgucaauuucagaauuucagcucugggcagauuguuuacaauagccaugcugguugacuguccugucguaaaagccugaagcuaaaguguguaauucucagacucuaaacugcuuaggccgagguuaaggauaacagaaagaugaugggcaggaucaucaugaacuuuugugcaguguuguccauuuuuuaaggcauaggcaauauauaaaacuguaaguugggagaguuaccagucaugauucuccuuuucuagguguuucagccuaaaccugaagaucaugaaaaguaugguggggacccccagaacccucacaaacugcacauugucacaagaauaagaaguacaaagaggcguccauacugggaaaaagauaccaucaagaugcuuggacuacagaagguaugcagcgauccuaaucaccaccucagagucuuguuggcugcaggcucauacuuuaaaacccacacugugugcauuugcuaucucuuauguuuaaaugugucacuuagugugcccuguuuauuauaaguuaguauacaaaacaugguccuucaaugugauguuuuccugaaaugguaccacugccuuuugaauugaucugugauauugcuccucuuguuccuaggcacacagcccucaaauucacaagaacaucccaucggugaaugcaaagcugaaagugguuaaacacuugauacgcauccagccucugaagcugccacagggacuucccacagaagagaccauguccagcacaugccucaagagcacuggggaguuggucgugcaguggcaucugaagccuguggagcaggaagcgaaguccugacgccacacagcuucagcucacagaugcacuuacuaaggaaaccguucucauuaaaguguauguucauccagucaucuccgcugauggaguccugaugcuaucacuucguucaguucucucccuuugucccuugagaauuuuacuccacagugggcaauaacugaauuauucagauaucuaccauuaggcuccuaacacaucauugucuccuuguagaaacuguuaucuucuucaacugcuuucuuauugaauucuauagaugugagagacua

SEQ ID NO: 132 - RNA, 1818 nt, Mus musculus
uaaaacagggucucuguaacagagccugagagguuaacacaacagaugccauguuggaggcacuauuuuggccuuagaacucagcauguaggccccaacaccugccaaaaccagaauaaagauguaaaccaucaaagaucucauuuaugguuccagaauccagggaaaucccuaaauacacuagcuugcuuuucggcauacuuccucaaaaauauccugacauaaacguuacaaguccaggugacagcccaucgcuucuacgacuaaaggcaggcucuugaagcagagagaaguaauuacacacacgucuacuuguguccaacaucugcuggagaacaacauuaaucugggaguagauuaauuaaugcaaccaagacaaucccuacucucugagccaugcccacuggccaaccuaaucuacccaauuucucaaugagucuuucuuccuaggugaccguagauuauucuaucaaguugacagcuaaaacuaaucagcucacacacaaaauaagccugggcaugguggcucaugauuacaaccucagcucucaagggcagaagcauaagggucacaccucauauuuggagcgauaggccugggcuacauaaggucauuuaaaaacuccaacugucagcuucucauaaauacuauacaacugaaaagaagcuguacucccaggaucccuaacucggggaagagagagaaggauccgagaccagccacucagaaucugcaucacaguauucguuuaucaccgagaauuucacaggagaccuuuacguuuaaaugcggagcuucacgcgacuaaaagugcugcccugaauuaggcggagguggucacugccuuuauauuggggguaaggacauaacuuucuauuuauugaaccaaaucgaguauuauucuuaccgacgaacugggggcccugacaccuauguacuccccuacaaacuccuaaccgaaacccuaaccccauguaccugucagcagacucuucgccacucccugagcucaagagacugguggaguaguuccggggggacccgauuucgcacuaacuggggcgcaugcgccguagccuccgcagccgcccagacgaggcccucccagccgcucccucgaucccagccgaggauguguccuucaucaacacugggacgcuguggcacuaucggccacaucacccucagccguaccuggacuauugaugaggccuacggagagaggaagccgcagaucaagaauacccaccggguucacacagguuucaaccucgcagcaauuguuaagggcagagaaggggcuguuaacuccgccacuucauuggcuacaguccucucgcgauacaaugugagacacucgcggaaagggcgguggcgagugacgaaagccucggagaagcccuauccuccgccacccggaacuacuggcuuccgagccuacgcuucacgugggcuaauggccggagggaugggcgcuaggcacguugggaauuguaguucuuugugcacugacugcgggucccggcucuaccgggaaacgagccgggucuugagccugagugacagaggggcuucauuucucguuguguuuaauaguuucgaaaguguagcuuacaguacauuauaauuuauacacagcucacacuaguaacaucgccccgaaacauggagaaaauuuucaccaugccaggaucuucccuccugacuuucuuaggcacaugaauuuuuagaacuugcucauacgaagauucauauuaggggacccguugcuguguccuuaugucuuuuuccccuuaauaaauguacacaguugacaa

SEQ ID NO: 133 - RNA, 57796 nt, Mus musculus
ggaugauaauauuuugggggggggggggauucucccaucugaaaagguauuuucuguugucccuuuccaugggugaguucuuacugcaagguguugugugagucauauguggacucccuuguauguuacugacuccuacucugcacucaccuucagacucgggcuucggugcccaucaagauaggguagggacuagcuuuuugaaggccgagggucugaacuuuuacuguuccugaaacuuuuauuucugagcaucaaguucacauuugguauuuuacagauugaccagucuguuuuagaagcgcucccacuugaucuccgggaacaaauagaacaaguuugugccgcucagcagggagagccacguggaaagaagaaagaaccaguaaauggcugcaguucagggguguugccacauccuguuggaacaguuuuauuacagaucccagagccucaagaaccuuguaauagugacagcaagauuaguguaauugcccuuccagcauucucacaaguacguugaugucagggaccuucagucaugcuuuucucaccuguccucuccucuaucuaauuccugaggagcuugcacuucugcagacagugguuggcaccucagcaccagagggaagagaugugggaggcagguguuggucccuaaagauucuggaagacacucuuuguugacuuuacugguucacacagaucaugagaccuccugaauaggggaagaugcccagaaguguccauguguuuuuggcuucccauuuuguaaccgagugucuuguucugauuaguuagcacagaaauuggauugcucauauccagugucuuggaagguuuuguccuagcuuugcuguuuaaggaccuguuaaagugauuugaaaacagucuagcuguccuccagaauuaauuuaggugugacuuuccuuguacuagguggacccugaugucuuugcugcccuuccugcugagcuucaaaaggagcugaaagcagcauaugaucaaagacaaaggcagggagaggacacuacucaucagcagccaaccaguacaucugguaagaggagagaacugucaugucccaaaaagggacuagggugaugacaucauuguguuauaacuguucauccuagagagugucugaagugaucaaggcagacgaguagcgagugcuguaagucacugcugguugguacuugugcuggucuuaguauuuuuggauacaagucaagcuacuuguccuuugagacugcuguuugaaagaauguggguucaaaacaugaaaucucaaaacaugagucccugaacacacauuuuauuaaaccuacguaacugcuaaaugagaauacgaaguuguacagcugagcucggaggacuuuaugccuuaagccacggcgugccuggccuucuuuccugcucuugguuguaaggggggguuggaaggacaaagagucaaugguauuauuaccugauugcauuuugagacucucauaccuccucuuuuagugccaaagaauccuuuacuucagcuaaagccaccagcaaugaaagacaagaggaacaagaggaagaaccucauugguucucccagaaagaguccuuugaaaaauaagcugcuuagcaguccugcaaaaacucugccaggggcauauggaagcccccagaaguuaauggaugguuuucuacaacaugaaggaauggcuucagagagaccccugguaacuggaacaaaauacugacuguuacuagauuuuaauguacuugacacugucugaauacagcauucucguucacuuccucaacaggaagaagucucggcuucuaccccuggugcacaggaccuaucuaguuuacugccaggccagagcagcuguuuuagaccagcagcacccaaccuagcuggagcuguggaauucagugaugugaagaccuugcucaaagaguggaucacuacuaucucagguuugugugguagcucugugauucgagaacaggaccugagcacaauggcucgagccccuugucuaacauuacaagcuguaaggcgugcuggguccucaccugggguuuuccuccucccuagauccgauggaagaagacauccugcagguugugagauacugcacugaccucauagaggagaaagacuuggaaaaauuggaucugguuauaaaauacaugaaaagguaauuuauuuaauuuuuuacuuaaagaggaaaaaaaaaaagcaugucccaacagucaauugagggcauauggauagaacagguuuuuaagguuccugguuuuaaaugccauauaauaauguugacaggaauacuaaguuaaaaauaaucacucccaugguuauauguccaauacacaagugaccaugaaauguuucugagugcccuaauaggccuuuuaaaccaaguuuauuuucuuaacacuugguuuuacugucugggcuggccuuuaaacucaguggcugagauuaaaggcgugagccacuguauccaguucaaaaaaaaaaagaaaaaaaaaaccaagaaugaagcuaagucugaaggacaaccaugcgugcuggagcuuucucuucaguggugccucuuccucaccuucagguugaugcagcagucgguggagucuguauggaacauggcguuugacuuuauucuugacaauguucaggugguuuuacagcagacuuauggaagcacacugaaagugaccugacugcugugcagagggccuggggcucucugcgcugugccagcagugcuugugagguauuugcaaagugcaugauagugaugcucugaguuuucauaauucuacauuucuuuuuaagcaaguguuuuguacauuucuuuucaaaaaagugccaaauuugucaguauugcauguaaauaauuguguuaauucuuuuacuuguagcauagauucuauuuacaaaacguuuguuuauaaaguuuuauggauuuuuacagugaaguguuuacaguuguuuaauaaagaacuguauguauauuuuguacagguuuuuuuuuucuugugaaucccuaaaggaacuagcaacaguuuauucuacuuaaaggcuggaccuccaagccagccugcuacagauguccaaaagcugugaaauugcucaacaguccaaugccagcauuuuacuaguuuugugaacaaggaaaaccaauaaaauccuagccugggauuuauuaccuaacucaaguucgagaugauguugagaaaauaauaucucuucucuagugugugcugugucauaacacauuucuuauaauacauucauuuguaguggauacuuugaacgaaugaacacucugaacuucaaguucuccuacaacagguuucuucaaaggaugcuauuggguccucaggaguaacuaugcagucuagucaugagguguguggaugaaucacugaggucuaaucaugcagaagcaaacaauggaauguaugcagagcgccccucugagggcaagcguuagcaggugcugaugagcuagaauggaggccuagcagaaccuacucgacugcagugucuccucuuuauuggcaguuuguuccaaugagcucuccugacuaguacaagcaguaauuguagccagccauggcugcacacagagcagaaggaaaaagcgaagucccuaccuacauuuucuaguuagaaaagucgcuaagggugggagaaggguaagucacuguggaaagaauacccauaaacuuauuucuuacaucgaaaaagucccaagaaucacaaaaucuguagaagcuugguuaaucaaauacugcaggacugauuuaaucaguauaaaauugaaagauuuagauuuguaauaaaaauccaaauuugaaggaagggcaaacuuuaaaacagcagccaagucuuaaaggaagggugggugagugcaggcacgcuggacuguggggcggggaacugaccacugucaaaccaguguaaguugcuugguuucucauggaaaacauuuuauacaccuaaguccaucagcguccaaacgucuguuccguugguaauaucacaacauaauauuacaucacuccaaauucugucccaggugggaaaauuagaugauuucaaauacuuucuucagcuccacaauaagcugccagucacucuucugcauuucgucucugaaccagucuuugagugcaucgauggacugccggcugaucugcaauagcccaggcacaaacagggugagccaaagguacaacaacuguguccaugaaagaaagccaaaucucacuuaagcaacagaaaggcggugcuuugcagccugcuuucagagggagaagcccacaucuguggcucuggagucccugagauugucaggaggcacuaccgcugucuaucagaaucaacaccugauguucccaaagccauauuuuaguucucugaacuacugcaauaggcaaccagacagauaaaagggacuaagauuucugaaguuuucagucugaaaauaugcuacuuuugcuaguaaaauacuuaccuugcugacaaguauaucuguagcuucaaaaugucucccaaacauuuugggagauuccccagggauagguucuauuuugacacagaccucuuguccuuuuuuugcaacauccaccugcuugugguuuauuucaaugcuuguuacuaucccaaugucaacaaacuguaaaauaaagaucaaugucagagacucacauagguuaucaugacagcugcgcuuggucuaacccugcaguguccacauuaauuucuccacaccaccccaucuaccccacacccaagacggcagccaaaaccaaacaauucucugaagacuggcaugucuguugcccuaguguaauuuugugguccugcuguaaacucucaggcauaggacauacagcuagucacaaauaagccagaaagauggaggcacaggaggcaucugaguuacagagccaacagcucaaagugacaccagaaaguaccaguacuaacugaaaguucuucgugccaccuaggucagaaaaguacuagaaaaguacuagaugaaccuagaucaccaugucuugacaguagguagcacaugacgaguagccacuggccugcgagaaguggaaggaaaacacaaguuuguugcccuuuccaaaguaaauccaauggggucagugucgcugagaaauaauguuuuggugaccugcauaguguuggaacccccuugaagguucccuuucaguaagucugucuauaaaggagagaauggacaaauacaaaugaauaaugucccuaacauauuugagcuggacucuucacaucuccacugagauuacaacauaaaucuguccaggaguaagcaaacaugugacuuaggaaugcagacggacauuacugaagugauaccaccuaggggaagacggagcaucaagguugaacaacaccacuugcuugagauaagaacacugauguuggccuggaacuuacauuuuugcuuggaacgcacauagguguuccuuguuucacuugaccagccuccacagugaccccuauuacuauuggaucucgagaauugaaaauguauugagggaggauuuucaucuugcagggaaauacugcuaugugccugaaaguaaaaagaaagcaaaaagcccucaagcucaccaauucaaugaacagaaagcaaguguagauggguggcaaguuuauuggaugaaugccacaaaguucuaacccaauucaaagcuacaucagggaacauguucaugccccagccagauggcgaugccuugcccccaaagguaacauauuuugcuaaccauguccuggaguuuagaacauggguagaacuugcugacaugucugucaugcaugcagucauccaucuauauauuccucuucuucauauuccuagucuuuucaaaaaaaagcuaccacaaaguuccuguccuuugucauucacgugcuggaagcacauuaggacaauuuaaguccugagcuucuguuuccuaggcaacucugguaaccucaagacuuccuaaccacacagccguccauguaguaaccaccaauguaaucaugacgugauuuggcagggacgggggaaguaaacacauagcucaacuuuuccugcagccuaggauguuacuccuguacucaacuuuauaauggccauguuuucugaaguacacucugccaguguggcugccauaaguacuguucugugugugcacaccacauacugacuacuuggucugcuucugaucucucucucucucgcucucucccucccucccucccuccuucuccaccucucccccccccccucucccucuuaccacaugcauacacauacauaaacacacacaggaauguuugucccagaaagcagcuccugggucauuaauaccacuucagaacacagcuaauacuauugucugcauucuuaucaaaguaaauaaaaacaacuuacuuaaauucuucuuguuuuuguuuuuuguaguccugucuguauuuuguaaaggcaucaaauaagugauaaauaauuucugcacuaaagauucuaacucccaaacuaucagccaucucuugugcgucccguucaauucuuacaucaaaggccaaaauuacugcauaccuggaacaucaaagaucauucagugagaaggagugagucacacuaaagagccugaagacaaacacaagcagagaguacuuacuggggaucauguuccaacaucacugaagccuucauaacguccuuuuuauggacugggccaauguuaauuccugcauacuguaaaagaguuuccagguuuagcaugcaucagguaauuguaacaacccaucaugaccaccauaugcuuacaaagcuggguagcuacuuacuggcaccucugauguuuucagaaauucaagaagagcuuccaaagagcccaguguagaugccuggacauaaacuccuuuuucuucuaguuugauagcauuuagugucugcuuuaacucauggaucaauucauccuugaaaagacaucaaacaugacaaagugcaccuuuaucuccacccuuauguuaacuuucacccaccugaaagcauagauuaggacauagucuguuguagaaaagagacuggcauaagccacccuacccuauucuaacccauuucaucucugccuuacgcuaauagaaaauagacuaaaucucugcagcacuuaguaaagagaguaugacugggaagaaugucauccuucaugaggaccacacaaauauguggcaaccccaagccucaaauguggaauuaccuaacucuucaccuaacugcagacaaauacacuccacucuccggccugagguaauauauucucuaaugacaugacccgauuuugccuaaauacugaagguggcuuacaggccuguaugccugacagcaagcaacaguucuauuuucucuuuggcaagcaaauaagcuaugacuagagccugcuuuucauuggauaugggccaacugaucuucccaucagacaaauacaugcaggccaggcugaguuacacagaagacuuacaaugcaaaacugaaacauagcaaaaacaguguuucugucugugggugcaugcagguagaggccagaggcacuggaucccccuagagcuaccagaugugacuacucgauccaaugugcucuuaaaugcuaagccaucucuccagaccauuuacuuuuaaagggcuuuuggccuuuucucuccacguuugaaaugugguuuuaugaagccuggguuuuuuaaauuaggaaaaugaacauuuaaaaucaugcacauaaacuuauacaacuucaugauaguacaaauaacuugaaagaacccacuuuucugaaaaaggacaguaaaugaccuuuacaagauguccauuucagcgagcaucccuaccacucaacaaaacacugguaaggagaacagcaggauacaggugauaagauaugggaguagacuugaauuagggauggggagggaagucaaagcagaaggauaggagggcaagaggauguuugauaaagccucaaggaauagguuauacugacauaaaauuauguacuuagucuauauacacaaacuuagauuuaugaguaugaaagccuggccugcauguauuuauaugcaucauauguaugccuggugcccauggagguaagaaacgagggugagcucccuggaacuagaguuggagauagcugggcgucaccacaugggcgauggauccucuauaagagcaucccuucuacaggccugcaggccauuuuuaguggcacaaucaggccauguccaugauaccucaacaguaugacuaaacaggacccaaacaauaacauuacuuacauaugagugcacacaaaagucccauccagcagagaugucuaugaacuacaaugauaagaugucccuaaaaguuuauaguagugacugacauccauauaguggugguaaacaagagcugucuagguggacuaggcccacucaacaguagggagcucuugccugguacuagaacccuagccaccuaccgagaggaucaggaccauagcagagcagcgucauuccuuacugcauucuaaagcacaucugauguucacaguaaguggacucucaccucacaucaaacaaguuucgggcccguagagaaaucauggcacgucuuaauucacagaucaauggaucaugggaucuuagccucaaaaggauacauguacaguguaaccacugccugcacccaagcucugggaacaucacggaacaggguguaaagauuuuaagaggcaggauaaggaagucugcucuaagacuguaccuccuauaaaugacagaaaguuacacccacgauaccucaacaguauggcuaaacaggaccugaacaaucccaauacaauagacuugauuuaugaggaagaggcaucucuagguaaaaaaagauguauguauggcuaaugcacaaagaugaugaauugaagguuagucugggccccugggagggaaacugguucaucuaaacagcacuggaaaaaaagcuaaugaacuuacuuugagaacugggauuucaucauccuuguaggccacuaggagagguaagccagccaggguuuuuucaaggucuuucccaagaaucuuuacucccugggccgcuuccacuucuuuaugcuuuucauauugguucuagagaaaaaaauauuuuccauugaauuucucucaacagcacugauguauuuugugaccauauggagaaagaguucuuaaacucugcacaagaaacaauaccuacagcauagucuguuucucaaaauaacgcaggaaagguuagaagauacugcaacacauaaaaaguaaagacagacaacuauucagaacuacagaaucuauggaaaaaaugggagagugaaagggaggggagaaacagggaauaaacacaaagcucugcuggcagaggggagugagccaacuguagccagcuaugccuaccaggacagaaggaaggagaaagggaugguggcucagagcaggcacagaugucagacugaaagccacaguacagauggaggauucuaacuccuguugggguaacacugagauguguccugcacacacugggaaaacaggcccaaguuagcagaaggugcacaaagaagugcacuuuccaugcccguagaaugacagcacaacaaagccauagaguggauuauaaauaugaagugcuuuuuaguugagaaggggcagcacuaagaauggcuccacuuccacaggaagacugucagucacgacucuccaugcagcacccaaggcugucgauccuuaggcaguccuaguaacuugacuacccauguccacuucugcaguaacacaaggacagggacaaaugugugcuguguguuaugccaagcagcccucagaaagacagaauggcaucuguagauauaagcauugugucguccucauguccacacccgccaccuuugcuuaccuucacacguaauuccuucauaggaggagguaaaaggaggccucgaaucugagugacaaugggcccuucuacuccagggacaaugauuguauccccuuccuucaaacguccauugaucaauaugacaucuauuguggugcccauuccugggagagcuuuaaccuguucucaaacaaacaagacacacauauauagauauagauauauagauaucucucucucugaaggcaugucaccaacucuaaaagcagugcauguccauuacugaagggcuguagcguggcaaggaagccugaugauuaccuccaugacuugugcucucagcucuucacagugugcaagccucuugcucaacaugguuugaguuaacuccacaagaagguagaugagacuucccaugccaucaccaguaugugcagagguagguaccaaggacacgaaagugcggggaucuuuauucucauaaaacaaagcagcauucaaacccuagaagcaagagcagcacagagcaccauuaacagaaggcccaggucuagcuauuuuuaaauuccacaaauacacccagaguacugcuggucaguagguaagugcuuaucuaaacacucaagccccgcauuaaacaaacaaaaaccccgaaaugaacacaauccagaaauaauuguauagacauuuagagaaaaaggaaaacacaauuucuaaaucaauguaguuuaugagaaugcucgggcugcagagagaaagcugucugguguuaaaaauggaucgagcaaagaacugugcacccaguacccagucagacagaggcugaggaaggaagaucaggagcccuggaguuuaacaccagccuggaaacaguaaaaccccaucucagaaaaacuaacaauaaaacagcaaaagccaggagaguaaaaaaaaaaaguacccagcugagaggggacauucugcuagguccuucagaaagaaauucuccuuaccugcugugcaaauucuacaauaauggccuuugcacgcuccucaaauucauccuuuguauucuucuucugcuuuuuuaaaguaacagccacaucagaaucaggacucuucuuccaaucauauaaccugucaaucuggaaaacauuuaucagaaacauuucaaaaauccaacauuaaagguuauaagcuccuaauuugugucucucugcgcacgcauucacacacacacacacacacacacacacacacaguauaaagaauucaggcauuuucuuguacaaaaggcccccguuagagacugugcaaaugaagcucucagaugagaaacugcugagguggcaugcuguccauuuuagccuccagugaguugguguaaaccugcucucugcagaacagaagguccuagaaugauccuaugaacacuaacaugugaguuauuaaaucagcagauaggcaaggacugaugacagcaagugccagucaggaugacguaguaacugcuuccuugcucaaucuagaaauaaucagucugacuaguuaauaacaagagacuauuuccucacuugucaaucugugagauauuucaggugaaggaaaugcuaucugcaaacagaaaucaauauacugaaccuguaaaucuauccaauuaugcaucaaucuaaaagauacuaauuuuguuuauccauaucuccccugugaguaugagaauaagagaaggaauuaaucacuaaauaaugacagagacugugucaccugacagcgagcccacacugacaagguaaggaagcagcuuugucugucacuaagagaaaacccaguuaaggagggacagaccuaagaugacugucaggaucaaauuacugcuugaggucuuuaaaauaauuucugaaaauauacuuaacauuuguucuaaccuugacaaaaaggcaaaaagaaaaagggcuaauguuuguagagcugaaggaaaaccugagaugaucuaaaaacccaguuuuacuggaaaaagaaaagauaagugaucuugaagacagagcacugagaagcagcaacaccgcacagagagaaucugauugggggaaaaauacuccgcccuagcuuguuuaucaugugacauuaaguaauaaauuuaguagagaauaucugaacaaucaccaauaaagauaaagacuagaugaacacuaauauaauucaauacaacucaaauaugauugaccuauuacacaaucacacagauaaaauucuaaaaaggagaaagucuuaaaaguaagcaauauaaaaaacacgcagaguaacaggaaaagauggaagcagcaaaagcaggaaaacauuuaagggaaaaaaguagaauuccauaacaagugaaaauaucuucaagaaugaugcuuuugaagaaacacauuuuugucauuaaaaagaaagguaacagagcuuuguuaccauuaguuauacuuuuuuaaaagacaguuuuaaggaugaccugaaccaaaaugauacuggcaggaaacugaguucuggagaagacacgagaaugauccagugguaaaugggguaugacaguccaagauggguucugcuguuguacagucuuaauauuuauucuuaugcugggcguggaggcgcacgccuuuagucccagcacuugggaggcagaggcagggggauuucugaguucgaggccagacuggucuacaaagugaguuccaggacagccagggcuacacagagaaacccugucucgaaaaaccaagaaaaccaaaagaaaagaaaaaaauucucacagaacugaacaucuauacauacauaugaugcaacaauucuucuauuaacuauucacuuaaagcaaacaaaaauaaaugacuauacacaaauauccauagcuacacuacuaauaagcaacugggaacuacaauccaucuaugcuacaguagggacucacccaagacugguguuacuagagaauggaacauuauccuguuacccuaaguuaaaaguguuacagcuuaucuaacaauacgcaaagaagggagauggcugugacaacaggacacacugacacuagaaagagcacacaccacagucccuaccagaaugaguacagagacaaagggacaauauuguaaagucagcaugugccuggguuagagggacugcauucuggagagugacaauucagaauuguuuacacagcuuucauguuacacuagauuucuaucuuguuuuuaaacuuagcauauauuaauuauauaauaaugagcaccuuauuuucauacacauauauaauuaaacaaauucaccauuccuauuuucuucuugucucuccucucucuugauucucuucuuccuaaauaguuccuccuucuauuuuugcuuuuuagaaguuaaaucaagaaucaauauaugagaggacaaguagcauuucuaugaaugugacuuccuacauggugcucagcccuauccauuucuugaaaguggcaucuuuucacucuucagaugacuggugaccgguuguccuccacacugacuaaacugagccucguguaugucacacaagcauucuaccaagucacaucucuaguccacucuuccuuacgaaugaaugcuccauuuugcacauaaggcauauuuuuuaauucacucaucuaaugggcuucuaggcuuaauacacacacgcacacgcacacacacacacacacacacacacgcgcacacacacacacacacacacacacacacacgcacacauguauauaacgaacuguucuuuuaagucuuccuagucuaacacaggguaaagagauggugcucaaaagcucauacugccuggcaagaggagccaaguucuguccccagcagccagguggcagcucacaagcacugugagucuucaggacuccuuggagaccaggauucccauguguacaaauccacacaaggacacacgcuuuaauaaaaaaugaaacaaaucuuagaaagaaaaguauuuucagaugagugcuuaccuuauuaagugcaacaaugaaggggcacuuuuuagauuugagaauguugauugauucaauugucuggggcucuaaaccaugcauaaugucaacaacuaaaauggcaaugucacaaagagagcuuccucuguuucucagguuacugucaaagggaaaaaaaaacuguguaaguggaggucuuuucaguauuuucccuaagcuuaaauguauaauuucuuuguaaagccuaaagagacagaagaaaacacguacagucucucugguucuucagggauugacuggucaugagcaacacacagauagccaaaucccagugauaaauaugguuugcaauacggacuacacaauccucucacaugugcacaacaucaccucuaggauagauacacaggcagaacugccaucucugacccaaaacuccaaacccuucugagacacacacugaauuucagacuuuuaggauaucugacuggaaagugcacggagauguaaaacauguccacugccaggcacagcagggaagggggcucaacugaaccccagugagugugagugcugggugaauagguguuacacaugcagucgagggugacaacaaggggagucuggcuuagcuggcaugaacgugaccuuccucagcugucccugaaccucaggccauaccccggacgugcagggcaugcagcuguguauuaaggacucccauuaucccuuaaguggccggacacucaccuaacagacaugaaaauugaggcugcugggauaagcuaaugccacaaguuccucuaagagugugugugugugugugugugugugaauauagugaagugaaaacaacauucccuuuguaauagucugcagaaauuagaacaggaauucaugaagaaguuuucuuacacagaagugaugcucuuuccaauuauaaaacaugucuucuuauagaaaccaagaaagcacaggaaacauuauaaaaccaaugaugaucagaagauuaauuaugauacugcagauaccaaggaacuauucagaguuaaugacuaccccccaguguuuuggcucacugaguuaagucaugucugauggcaaacgcugucuuaccugaaagacucguguccaggaguaucaauaaucagcaucccugggauucggacauucucucugucaaacuagcaauggaagagaaagaugcagagucuaagagcagucgaaacaaugaaagcuucuuuacaaaacuauuuaccaaagcuugaccacaccacugcuuccuuuucccaaagaauaaucuuaaaauggagucagacagcacaauguuuaauauucucuuuaauaucaaaguuuuguagagacugaagaugguucaguacuuaagggcaugcgcugaucuuacagaggauccaaguuugauuccaggagucacaucaagcaacucaaaaccaccuguggcuccggauccagcuacccacuguuaggcucucacaggcagccacacacaugcagauacacacacauaaaaauaaguuuuauggaaaaaaaggaaauaauuuuuguugaaguuguauguaagucugaaaguaguuuaaauaaaucugauucaaauggcagugaagaacagucaucuaucugcauuaucuacaaaagcugacuugguguguguguguguguguguguaucuguccgcaugccuuuaacccagcacucagugggcagaggcaggcagaucuacagagugaguuccaggacagcaaggguuacacagauuaaccaugucuuaaaauacaaaaauaacaaaaagauuuugacaauaucuauagaauuuaucugaggacuggaugguucagugguuagaggcauuuccaauacaagccugucaacuacugauuuggucaccagaucuuaugaucucaugguggaaggagagugacuccugaaaguuguccccgccauggcaugugcacaccuacauacagauacaccauaaauaaaacauggcccaauuuuaaauaaaucuaaaauaccaaaacuaucucaaaauuauaguuuaauaaugcugaccaaauggaucaaaaguguuaauaaaugcacauccuguuuuaaauacaagcauuuaauuaccuggacaauguuauugaguacaaucguuuacuaauuccuucauucacucagucacucauucuacaguguagguggugaauuuaggcucuggacagccacaggaaacauucuagaagugauguacacccacagcccuuggaguuuguuugagucuuaauauaaauuucaggcuggccuccaacaugcaauccccuugccucaaacucucaagugcuauauuaaaagcauguaccaguacacccagcacacaucacaagccuucugacccuaauacaaugauccagaaucacaaccuuuucuaugaucugcguuuucccgcucucaucuaugucacagugauggaaaugcaugaggcuucaaaucuguuuuugucuuaaaugaacauguauugggaauuguauuguuuccacuucagugccuugacugugaagaguaaaucacagauaucauacuagcuguacagagagcuacaguguaggcuucauuuuaaguuuggucuuuauguaccaaaaccacaaggguucacuguuaggagccauccaaugaggaacaacacaaguauuacuuaaggcugcuggaaagaugacucauggucaagaacaauggcugcccuucuagagcauccagguuugggccccagcacccaaauugggugacucaucaugaccaccuguaacuccaagugauucaacuacuucuuaaaaaacauaaaacuaaaaaaaaaaaaaaaaaauguuucuuuaccuucuaagaggaaguaugaauuuaaaaugcagugagccaggacuggggcugucuaguacucgcgagccugaggacaugauuccaauguccuaagccugggugcuggcagggagauguaaauaagcagcucacacacaauuacggguaagugaggcuugcuuugugucugcgcagcaguuggaaggcaggcucagggcugccuggacuauaggagaauccauaaaauccauaaaacagagauucaaaacaauguacugcaaaaacaacacaauauuaaguaacuggaaaacuggccaaagaagccaacacuaagauaguaaauggccagaugucucaugaacaaacuuauaauuaugcaagaagaaaggcaacgaagucauacucaaguaaaaacaaaaacaaaaaugaucaaaaaacagugaacuaauaaggcuuagguaacuggcuuuaaggcuuaggugacuagcaaggcucuaucuacuuccuaacaaggucacacaggguuuguacuaugagucccaguaagcuuuauacuuccuucauuauguuaacauugaaaacgugggcacauccaaguaaauagagaaaauauucaguuaguauauuuauauaauuugguucaacuuuuaaacuccuauacagcucaugcuggucuggacuaggagccucaaacuggaccuaaauaugcaguaaucuuccugccucaggcaucaaaaccagacccuugugcauggcaggaaagcacugcccacugagcaaccuugcuuucccagacagagucccuuauguaaccauggcucuucuaauagucucuuacguaaaagaucugccucaggagccccuuaagccccugaggccuugcacauauguguagagaucagccuuuaaacaugaagggguaaggauaguaaaacacagaaaaaaacaaugcaacuucagaacaauggggccuugaaaagcggggcaaccagcggucuagagcccaacagcaccaaguuauuucagagugcuaaaaagagggucuccaacaucauuaugacuauuaagcaaauccuuugggaauguacccaaagcuaugacagucuucagaaagccuggggcuuauaggaagaguuucucauaccugguauuucuaccaacauauuugaaaagcauaugacuuuguucuccuacuauaaaaacuucauaaaauugcuaucaugauggaaccugaaauucaggguaaccuggaucuguguuccggggccaugcucacuaauaauugccuuuugaagugagagguguuucuuaugccaacaaaacaaauaacauaugagguaacuuacauuuuuaaucaucuuaguuuguucauuaauagcuucaagaggaacauuuguggcaccaaucugcuguguaauaccaccugcuucgccaucuugcacaugugugugacggagcuaugaaaagacagcaaaaugagauugguauuuuggcaugaagaacuccuuuguagacagaguggcuguauuagugaccccagacgaaagcucucugaacagauaccugggcccccucccccaguccccuugacucaguuacaguauugcugaugcccugacaggcugcucgacugcacagcugucagaggaacgucuucuuuguucacaggcuauuaaugcacauguucucuuaccuuaucuagaauuuuugucuuuccugugucuacauguccaagcacacagaugauaggggcucucagcuuuucuguauuuacauuuuuaccauguucaagucgucguuucuagaaggagggaucacaaauuaaacacugugcgugcuuuccacucucuuagcuuacaccccacaccuugguuagcugacuacacacaacugcuuuuacuguagcugccuuuuuuugagacacaggaucucacugagcacagacugaagacaaacucaccauguagugaugggaaccuugaauuucugauccuccugccuccacuucacuagugcuuggcuaccugaccaaucacuugagcacugagcuacagguacgugccucuguguccagauguuacccgaaggacgggaaugaauucaguccuacauuugaagcaagcacuguaucuauagucauaccuccaguccuuaaacuacgcuuuaucuuacacuuaacugacagaacuugauuuaaauaggagaagugcaacagcgaagcaggcacaggcacuugcuacaauccuagcacugagggacagaugcagaagagucaaggccggucuaggcuacccgacccugucuucaaaggaaugaaaacauaaaaaccagacaaaaagaaaaaauaagccaagaagcuucaucagcacucagauuucaaacacugagacaggugcuuacaucagccaucucuacacacaaggcaagcaucugccccuugagagccacgcucaacacaccagacaucucuaagccaccacccaacaggauauugauaucuggaacaaaugaucagacucugaugaagcaggccccauccugucuaaaggaaaagggacgcucccgguuuagaacagugucaagaacacagcuugguccaacauuacaaaaacuggagagauauuagucauguuaauauuuguuaaagcacugacucuaagccuuuagcuauacaagcgaaugagcacaaagggcugaggaaggaagcaaagacagagugcggacagauaccucaauccuccguuucgcuuugucguacgcccgcucuucuuuaguccgaucgucgucggagucguacucggagucugagcuagcgucuuugcugggcuucgugucuccagccuucccugaguccuucucauccgacagcuugcaguccuccucguccccaucgcugccuucacuguccccuuccucuucuucaucuucacucucuucuuccuccuccucuucuucuuccucuucuucuuccucaggguuuucuucuacuucuaugugaaucauauuuccuucuuugaggaaaaacaaauugauuuuaaaauaaaaguuaacaucauagauuuauaccaaaagaacagagacuacaaaguacggaaaaauaacagugaaauuacacuaauuacagcagucgcccuacacuuuguuccugauaaauaccaaguauucaucuguagucagugaagacuaccacccagcagugagaacugaggccacuacauuccaggacccugggcaggcugacagcaggacagcucagcucagcacaacacggaggcuccugucccucacagugcugugagaguucuggaaacagggagacauuccgaguccagaccugccaaggcugagucagggagggagacaaagggagagaugaauggguggacacuagucucuagcacuguuaguggggauaaaauccuagaaugguauacccuagaucaaacaggaaauaacaaaugaaugcacugaccacuggcucaccgucuaaaaugaaacaaacccaugcaucuguuauuuagaugcuaguguacuagugacugaauagccuuaauuuaaaaaucccugaaccugaaauucuccaaaaacaauauuacuugacuuuucucuuuugacacaaggcuucaauuuucugauucaaaacaaaccaaagauacucaagaucuucugcuaaaauaaaaaaauaaaaaauaaagcuugaaaaaauaguaagaaaaaugaagcaaaaaauguuaaaaauuucuucuauccagagaauacguuacuauuuauauaaaaaagaggaaggauaaacaauggaaguuaaaaaacagaaugaaaagaaaaaaaaggagugguauguaagcuguaaagcuguugggaaagaaggcggcacuggacucuuggcaucuuaaagucaggucagucaggcacauacuccuagcaccccagcguucagaggccgaggcaggagcacacaguugaggacauggcuaggcagauguccugucuuuaaaaauaaaacgaguuuguauggaugggugugcucauaugugaacaaacucucaaaauaauaaaaucuugaacaaaauaaucagcaauuaguggucucaauacaaaauccaagacaauaaaaugcuacagauuaaacagcuucuaucacauuugagaacaaaauaucugagccauuguauuucuauggugagaaccagagagccucugagaaagaaaugacucagugccaguaaaacuccugccuaguuaaugcaaagcucuggguucgcucuccagcaccacagauauucauaaacacaaauggaggugggguggaagagagggagagagggacuauauaaaucauggcauucccuggucaucaguuuuuaacccagguagguuaaaaacucacuagguaaaauauauaggaaaaaaaaaaagcaaaccauacaauagugaguaaaacccacuagguaaagucuauaaaacaagaaacuagaccauauuaacauuaaaacuuacagaauucagugaaacccaugguuaacuaaaaaauaaaaaaagggaaaaggaagagucucaaaaaucaaaaaaguaaaaaguacacgagagaaaacaguaagaaauuacacucaaagaaaguuguuuuagucauaaaagaccagaguuuacaucuuauucaccaugaacagggagugcgccaauguuugccuugugcuaggcuuuguguagguaaguuuuagagacaagcuaggcaugccauacugucuggauaaaugcauucuggguagcugucaccuugaaggagaccuucuaaaacaacauucagaaaucaggaacacacauguguauggucaguggguguggcuguaauucaggaacacacauaugugggcaauaggugcccuagaauacucagaguuaccuuuuucucucuccucaucacuggccauagccucccagucaucuaagccagcaucuucggugucuuccucuuccucuguaaguacaaggugcuacguaaggcucugaagaguaaccucacgcuugcuuccagaagugugacauuacgcuuggacauacaaaaagacaugauccggguaugaaaaacuguguggcuguuuuccuugagacugucuuuccaugcaccuugcaagcuguacguuacgauaauugacauuucacuguucuaauccaguuuuaauaugccauauucguuuaaaaccagaucuuauguuugaauaaacuaaauuaaaaaccucaacaacaaaauauuuggauuuuuuuaaaggaugaacagacucaguucucuaaaacuuucaacucacacaugacacacaggguuuuuauuuuacucucaccagacuuaucuuuuaguacaacauuuagauaaaaaaaaaaaaggcaaaaauguugccagcccuuguaggcuguguacacacuuguacgggugccuacauaaucaaaugcguaagcugaacacauuuagauuaguaaguaggggggaccucuaaaguuucaaaauguauguuucugguucuuagaaacaaucuaacuaaagauauuuccaauuaauuugcuuuucaaccauaaaguuaaaaacuccaggcucagagacuuuugacccauaaauaagaacaaggaaauucaggaacucuucagugucucucacagacauuuuacugacacuacuaaaaaagaaaaaugcagauucaagcaucacauucauuucauaauggaaaugaaaagagacgggcuaaaaagaauggaagaaacccauucaagcuugaaauccaucuggcuccaaacuacuucugaguagugaacacuaacuaucuaauaagaacgcaugaaaaccugaugguacuggccuggcucaacagaagguggcgucucuuccuuuucugguccuccuugguccacagcuuccacaggagcacuuauuuccaaaguuucagauacuaaauaggagcaacaaaguguauuagccacauuuugcagucugcaauuucucuucaaauauccuguucagcauaauaggaauccuugauaccguugauaccacuuauauagaaaaucacuuuugauaaagagaauacaaaaaucacagggcuagaagaaaaaauaauuuauaucuuguucuuuaaauguaacaguaccuuuucauggaauaaaaugcagauaucucaaucugacauauuuuuugaagaugcaucuuauugugugaauauacaugcacaccuguguguagguagaaaggcacugggucccugggaaauauaucacaggcauuugugggacgcccagcuuguuaccugggugcuaggauccuaauucugguccucaugacugagcaacaagcacucuuuuagcaacugagcccuguucucuaacaccugaaguacuuauucuguugccucucauuugaaucacaugagaaugacuaaaaaguuaaggaacaguggauaggaaaaugcaguucugggggcuggagaggaaaccaaguacaggagcgccuuuggcuacauagggccgugagcuguccccaacauccugcauacauacaugcucgcacaaagaugcuuuguguugaaagcugugaggagaggcccauguaaccccuccuaaggcgaaagcuacuucguacacaaaccuucuuuacucucuagcugcugugguguuuucuucuucuucuuaucuucauaaacuggccuuuucuuuggcaacgagucuuuugauggcacuucaacaccuaagcaguggggagaaaaaagagaaaaaguuaaggcuuauacugucauaugguuuauuugguacuggagagagagaauuuaaacugaggcauaguagcucauacuucuaaccccagcacuuugggagggugaggcaaggagaccaccuuauugagguucuagaucaaugugggcuacaugggcuucaucucaacacuuccaaaacaguaaaggaguuuaaaagacacacaccccaaaauacgaaaggacauucagagagaaaccuauggcuucuucccggggugccuguacauccacacacacugagggcuaaggaguguguggaccuagcaagcagcauggcaacgaagcagcagagcagcucuggcaccacacacugacucaaucagccagagucuaaguucuccaaucacgcuggucagguguucuaaaaaugccaaacaagcaccgucaccagucuggcuuuugccaucagaauggacaugggagccaucaguacuccauuugugcuuguuuuauuuuagacaggaucauguuauguagccuaggauagucuugaacucaaagaucaaccaucucugcucaaaaguccuggggcuaagaagggaauggcaccaagccugucccagcauuucaucuguaacugcugacucacuguauuauacaaguucaucgacccaguuaacgguugaagagcuucugaccaaucuacaguaauacgagaaacgcagaugugaguauuuucacacgggcuucuucaugaguuaucucuugaaugacacagaaguuaaauauguguuuaguauuguucaaaacugucagcuguucuuaaaaguggacuuuuagacuuagcuuucaaguuuacaguuuacuguuaaaguggccauucaaaucuuuuauaugcuuuuauaaggagguguuagguuuccaauuguugaauaaaaggcuuuaauagaccucggauagucuucauaaaauaugaacuaggaagguguaaauucuccuuccuuuaugguuuccauguuauuacacauuuauguguccuuggcauccacaaugucacaggacacaugugaaggucaaaggguaacuuggcaaaguuaguucucucccgccauguggguaucaggggcugaacucagguuaucagguuuggaggcaaguuccuuaauucacugagccaucuugccagacccuuaauuauacuuuuagagacauaucugaaaacuccccaccuaacacauuuucuccuauuuuucucuuaaaguuuugacaucuaauauuuagaacuaagaucuauuuugaauuaauaaaaauggggauaaggacaaguuucugcauagggacauucaaucguuuaacauuuguucaaaauaaucuacauauacugcauccauugaauuucccucuauaaaggagaauaaagucacucucaugugcaggugcugcucugcucaucuccuuuccacccaugugccaaucacugauccaauauaacacuacaaugauccuuggggcucuagacuguguuuuaaauuuuuauuuagaguaaaucuuguuaucagguaacuugaggcuuccaaauuacuguuuucaaaaacauucuugggaaggcuggacggaggcucagugguuaugagcacccgcuguucuugcacaggaguggggucuaguccucaggaccacauggcagcuuauaaccauccauaacucuacuuccaaaggaccugaugccuuuuccugaccucugugggcaccaggcaccacacaugcacauguacauauauacaguuaacaacacucauacaccguguguguguguguguguguguguguguguguguguguguccaaggcaggggacuauguagcucuggcugucuuggaacagagcagacuggcuuugacucauuugcuucccaagugcuagaauuaaacauguccacaacacgcccagcuuaaauaaaccuuaaaagguuuuaaagcaaucacuuuggcuagucuaagucaaccuuuucacgucuguguuuuagaaacaggaagcagagcacuguaaagugucauucuguaauuucaacugagaucccacugaauccauggguaaauuaacccaauuuagggaaagcuucacagucucgagucuuggggguaacaguauguuuuauacagucauuguuuugauuuauucuuugcuguuuuacaauuuucagauuuacaaguaauagauuuauaaugcuuccacuuucuuuuguggauuggcuuaauaaauguuacugcucgaguguuuguuuuuuuuuucugcagcagcaaauagcuggcacaaaaacacaacggauguuuacauccugaucaucuaucuguuacuuacagcccugguaaccucauccuuagcgcuacaucugucuuggugaagaagaugccacagcauuuuucuauguugaugaccauaaccugcagaggcagcuuccuagccucuuugcagucugccugccauacacuaggacaucacagcaugacacucaaugaguauggugagcaaaggcugcccugccuuuuccauaauauaaggauuucuuuuuauucaauuuuaaaauuacuuuaguuguauguaugugcacacagucauauauuugaaaaugagucagaggacaauuuaaagucuguucuuuuccuuccacuaugugggucucagagaucaaccccaggguaacaggucuggcagcaagugucuuuauccacucagccaucuuuucugcuuacuguuuuucaacuuuucaccacuaauuuaacagcugugccuuuugggggguugggaguguguaguagaaggagacugauaucuuaaaaugucagaccaggaaguucaaugauacgguuuguaaaugacaacucgauaaaucuuuagacugcuaaaaugaaaagacagugauugauuuucaaauagucagucagucuuacauucccaggauuauacccaauuuaugagauuauccuuauguauaacauaugcaaauacuuauguaaaucuauagauaucaauacauauucauaaauaucuaucuaucuaucuaucuaucuaucuaucuaucuaucuaucuaucuaucuaucuaucucuuugacccuguuaaugaauguuucaagugcuugaauguaccaagcuugcuugauuaauugcuugcuuuaguuaauuuggccaugaugauuuggaaucuuuggcauucacaaucuugucauuagcuuauaucgugucacagcucagcuguucuaaggagagaaguuucauaguaguugagcagcaguauagagaguagaguauagguuugaggccagcccucugagcaacuuaaggcugugaagacaauaccagggauuaaagaaugcaaaaggcccggggauguuuguguacagcuuugcagaagccuggccuuuugccuuuagaaguagcccuuccccuuuagcuggaccugaaucccaaacugacugaccacugggacaaggagucagcuaauuacaacuccacagagcucgguggucucuugagguuuccagcucugugacccuagugucacucagccaaagcauggagaaaaaaaacuguuagcaaaaaaaaaagugaguucccuuaaacuuuucugauaucagagaucccuuacucaacaacccuggccaucauuaagcaaacaaauaggaauacuacucuaauuucacauaauguuauacaauaauguacucaauucaaaaaugaagaaaauuauuuaaaauuuuacaaaugaagggaaauucugggacucuuuucaucccacaaaggaccacaaacaucuuccuucugacacaguccauaaauggaggcuguaaaguacgaagcacaguucagaaucagccacaagugacaagggugagcuuuaccugccucuaaacucucacagggaugccucacagagaaaugcagggccuauuucaggaucuacuuucuuaaacacauccuuaguaauacaaaguuuacgccaucugucucagauaaaucugcugcuuuccccaacccccaacuggaggacucaagcgaaggagacuaugauagacaauggugcccaccugcuccccauccuggaguagcacacacuucaucuccucaccaagagagacaagaugaaacauaauacacacaaaacacugaagcuuuaaagaauucacaaagagccgggcgugguggcgcacgccuuuagucccagcacucgggagacagaggcagguggauuucugaguucgaggccagccuggucuacaaagugaguuccaggacagucauggcuacacagagaaacccugucucgaaaaaccaaaaaaaaaaaaaaaaaaagaauucacaaagaaaacaaaaacacauuauaacuguagaagguagaccaagaaucuuccuaaacaugcucauguccuaaaucccacacagagugggaauguggaagaagagcagacagacaaugaagauggccuacaugacaugauuuaacguuaagcacuuaaacguguguggaguagggaaauuaccuggcucgagccaacuucgucauggcauucuucacgaguaaaggagagccuuuuccagagagucugggaucagagggagauguggcugaacacacagguagaagguggaaggcuucgagauggacacucgugagccauggaauguggguggccucuaaaggcuuuuagaagagaccacagaauguucuugcucagaagcucuacaaacacacaggccugccaacacuccaguccagcccugccuuucaguuacacaacuguaagcuauacaauguguguugcuuucagguaguuuguggucauuuacaacacagucaugauaauguaucugugccuuccgccagcucaggaacugcugagacgcaaaugcaaaggaaacgguuuuguaccucagcauuccauaguaaauauucccuuggcuuucgacaagguggauaaagcuuucuaaugguccuuuauguguacuguaaguuauucugcaagauucacagagaccaacacuaccaggaacacugggugaguguccaggccccacagguccaacaguccccacugucaucugcguauggacucccuuuuuaccaugucucaaaauuacgucuguuuccuggugaacuuccucuucacugaaauaauuuacauucugggcuuuucuuaucaaucuauaguuaagaguaauaauuugcuacacuauauuuuuaaaaaugcaacaccaagugagauucaauacacugacuuauccaaaguaaaaacuucuaauuucaagucauuaaucuauuuccauuugaauucauaguuaucauuuuuauuauuuuaauguuuucucccaaauaaaggagguaaaggaguacuguugagacacuagaguaaauccaagucuaauuuguaacauuacaaaguaugagggcacauccucuucucaguuuacaguuacugguagagaccuacaaaugaaugguagcauauuacagcccucuccucuacuccuguaacacaguaagauaccuucucagaaacucagacuccuuucagcuaacacaggcauucagucuggucacgaguuuuacaauacagacagcagcaggauuauauaguauuuugaauaaaaucaaaaauaagacucaaugucucuaacuuuaaaguauagggguguguguauguagguggguaaugauaaaagcuagaauugcaaagaucagaguuaaaacuaugaaaacagaaauguuuuaagcaaaccaaagaaagagguuacaauagacaguacagcuucccugccuagcagcccgcaucuaccaggucaacagcuuaauccagaggagaaaacugcacgcuaauaacuaggccagauuuacucaacuggguucuuaaaaaucaacacaagcacuucugugcaaucaagacaucacacucaaauucuccaaggugacugaaaaccuccagcaauuuccacagauaccagaaaaucccugcagauauccagaagaacauucugaaauuacuaaguuuuacauuguucuaggcaauggauguggcaacuuaucucuccauagugagcuaccuuucaaagacagagugagacaacacuagaggaucuuugcuaagaguagucacaucauuauagacuguggacagccuuucagagcugaaaaauuaaaacuuucuauuacuagaccauguggauccagaagcugucaggcacaggacagcauuaaagacugagaaaaagagacccagggccagagcugccucuucagaaacaaucucuuccacacagguuguaaagacugauaaagccugauaguaaauaauuuauaaucuuaauuuccaucuaauuacaucucuagcuacuccauaaaacagcauuucugaggcuguaaaauuauucucuuccuguuccauucaaauuuguucuaagagccuuucaucaccaguggcuucugaggucugcuugggcaccaacuauaugcaacuguauucucuaacaccacuaguuuuuaagguauauccucaauuaauaaauuuucugaaaucuauguacaaacauaauaaagaguucaucccaaaaaaaaaauuagguuucugucugcuucagcucugugcaucaccauuuccuaugaugauaggucucaacagcaaugucaaacaaaggucaccacagcaucaguuacaaaguacacaccaucugagucacugauaucauucuaaccaaguuccuuacaugacuacauaaaaguuuaaggaauaagugacagcagaugcuggcgaggauguggagaaagaggaacacuccuccauugcuaagugggauugcaagcugguacaaccacucuggaaaucugucugguaguuucucagaaaacuggacauaguacuaccugaggaccuagcuauaccacuccugggcauauacccagaagaugcuucaacauguaauaaggacacaugcuccacuauguucauagcagccauauuuauaacagccagaaacuggaaacaacccagaugucccucaaccaaggaacggauacagaaaaugugguacauuuacacaacgaaauacuacucagcuauuaaaaacaaugacuucaagaaauucgcaggcaaaugaauggaacuugaaaauauccugagugaggugacucagucacaaaagaacacacaugguaugcacucacuaauaaguggguauuagcccauaaguucagaauauccaaauucaauucacagaccauaugaaucccaagaagaaagaaaaccaaaauguggaugguucagugcuucuuagaagggugaaccaaauacucacagaaggaaauguggagacaaaguguggagcagagacugaaggagaggacauccagagacugccccacauggggauccaucccauacacagccaccaaucccggaugcuauuguggaugccgggaaguacgugcugacgggagucugauaugauugucuccugagaggcucugccagagccugacaaauacagaggcggaugcucgaaaccaaucagccauuaaauugagcaugggguccccgaugaaggaguuggagaagggacugaaggagcagcagcaccauggagacagcaauagugucagccggccagaucccccuggagcucccagagacuggaccaacaaccaccaaucauggagggacccagggcuccagccacauauguggcagaggauggccuuguuggacaucagugggaggagaggcccuugggccacaggguguuugaugccccaaugucggggaacgccagggagggaagacaggagugggguggguugggugggagagcacccucauagaggcagggggaggggggauaggagagguugccaaaggcgagaccuggaaaggggaaaacauuugaaauguacauaaagaaaauauccaauuaaaaaaaaaguuugaggaauauaaggaggaaauuaagggaagacccagaaagaaaguuuucucaauggagcaaagauauuauuuuaggucuuaucaguuaaaaccacaacuauaugacugauuugucaucuuuaaacaccaucaacuaggacagaaaccaaggcugugugauaaauagcugauuccagaucuacaacaaaaacaugggugaaccaacaugggugaagcuagaaggaagaaaucaguuaacaccauacugugguccuguggaagucagucagucccauggacuaucccuggggaagaugaugcaaugaguaucaaaugcaucauagcgucgagagguaaaaucaguaaucuccacucauugauacagucacaaaaccaaaaaucagaauuaaauucucgagacacuuuuuaagguugucagacaccaacugauuauucugaagccuuauaaggggaaaagaaguaaacacuuaucuugacaucucuggaagaaaacuguguuugggguaaaguauuucgauaccuugguuaauucaauguaggauaaaaggaaaaauuaauuauuaccaauguuguaauuccuaaagaauacugaauaaaugguaacaacugacuggauguuagaacuauuacugaagggguuuguuuuguuuuguuuuacaauagggcugcucuucaaaccugacacugcagcacaucagaaagcccaacucugucccagcugaugugagcaagcauacaguaccacuaagaagcugccaagcuguggaaucuaagaaauuacagaauaaaagcacacuguuuaccaacaucaggagaguguaauucuacaaggucagaauuugagauauucuagugaacucuccagaaucgucaauaacuacauggcaugucaaaauggaggugggugguaguacugagagacaaaccuaucaaccaaaugcaaucugucgcucacaucuggauccagauuuacaccaacccauuuauaagaucucugaaagacugaggaaaaaaaugaaaacacaaaucaaaaauaaaaagguaauuugugggcugaguagguggcuuaguugguaaacaccugcagggugaucaugaggaugugcuaagacaucuagcacucacacuaaaaagcaagcaagcaaaccugcucagagcugcugugcacaccuguaacccagcacuuggagacugaaggcuggcagacccacucuagacaagugcugugcuccagcuuuagccaaagauccugucucaaaaacauaagguggagaagcaauuaagacacucagugucaggggcuggagagauggcucagcgaguaagagcacugacugacggcucuuccagagguccugaguucaauuccuagcaaccacaugguggcucacaaucaucugaaaugggagcggaugcccucuucuggugucugaagagagcaauagugcacucauauacauauaaauaaauaaauaaaucuuuuaaaaaaagacacucaaugucgaccuuugaccccaccaugugcacauagaugcaugcaccuacaaaaaaaauuuuugaaaaaccuaaauauuguuagugauaauauauauucuaccuacacuaagcaaaguccaucuauaaauaaucgagagaaaaaguaaaaaaauaagugucuauaacucacuucaaagaaccgcagggggaaaacuggucagaggaaaaaggaaugucaaacaaaacuggaaaagguuaguaaucagugaggcugcuuagaaggccucacuuucacuuuuucacuucauuggagggcgggcaaauuucauaggaauuuauuauuugcacauaaacuuccaucacagcauagaaggcauucucccuaacaauggcacuuuccaccuguuccguccuuugcuuacacaguuuuccacagauucaaucccacaccacugaaguccugagaagcugcgcacacagaguucaaccaccaaggccacuacuuacccugagcuuggaggugucuaagggucacuucggcucuggcucuggcuucucucugggacuuaguuaacagcuuuccuucuuuuuuuaaccguucuuuucuuucuuuuucuuuuugcuuuuuccuuucucuuuuuucuuguucuaaucguuccuaaacaagaguacauggcauauaaaaaaauuauacuagcuaaaugaaccaugaaguuuaaaauaaacaacacaaauuucaaacaucuuaaaaaugcaugcaaaauauguugggagauuacaacugaagauaucaaaauguuauacauuauucuuaaaauaacaccagguuauaguauuggcaguagcacacaugcagcuucgucucuccacggggaggugaggaagacuuuccuguaccucuccaucuuacguaugucagagcacuuagcauaacugcaaugcccauacacacauguacauuucacagaaaacagaccucagguaaaacucacuaccaguauaagacauaccucuucuuuucguuuggcuucaagcuccucaagccgcuuaauccuuucuuccuccucucucuucugucucuccuccuccucuuugagcuuagccaaagcuuccuggauagcuuuaacaguagauuuacuagggccuuucuucuucucuuuuucuuucucaucuuucucuguuuucuuuuucuucuuaucuuuuuucuuuuugucuccuucauugucgucuacccaaaaaaauaaaggcaaagugcucaagcuuauuucuaugacagugaauacacacuagccagaaugcaaggagcacuguggcuucugccaccaguucucaaagaguggcauggaucacagcgaccugagacccuugugucuagaacagcucaucagagaucacaguugacccacagggcgucugccaaugcuguugcuggccugagucacccugaugaacagacgcugucagcaguaaaaaggcaacagacgugucagggaucugccagauaaucacagcacaggucugaaauucuaaagaagcagacuagcucaagcccauuuaggugcuaaagucauuuuacuucugugagauggggaugaugaaaacaaugcuaagaauaugggggcaugggaacaaaauacaaaaauauaacuguacuucaaaacccugaagaaauaaaaucugugaugguguuucuccucaaaauucagagaauaaaaaucucaaugguuaaaaacugguuuuuggguuuuuuuguuuuuuguuugacuaaaaaucuuucuagucuaagaaaaaacuauuauuuuuagaaaucuaaaucaccugauauuuagauauauuuauucuaagagaaagcaaucagcacacaccuuuaaucccagagcucagaaggcaaaggcaguugaaaaucugugaguuggaggccagccuggucuacagagugaguucuagcacagccagggcuacacacagagacccugccucgaaaaaaaaauuaaaaaaacaaacaaaaaaagaaagcaaucagguagaauauuuauauuucaauuacugaucaauuuacuucaauuaccaaaaaagacaaacgaggucaguaacaagacuuagcagauaaaggggaaaagcuaccaaguggguagcccauguuugauuccugaagcugagugguccugagagcugauuccuaaaggcuguccucugaccucucccuccccauaugaugggcacaauauguccacacagacaaaccaguaaaugaaacaaaaacaugcucccugucaucuaaguguaacuaauuuaagucucuuaauuuacuuuuccuuuuauauuucaaagguuaagcuguuuuuuuguuuuuuuuuuuuuauagaaagggaaaauuuuaguuaacaucugacaugaauuuugagaaggaaaucucuuuggccacugagucuuuauuaacagcaaaagaaguauucauaauaaaacuuuauuaaauuucuauuguauaaguaaauaguucagagaaaugguuuaacgaguagaguguuugccaugcaaacacgaggaauucagaucauacccccagugaucacauaaaaagccagacaugggcuggagagauggcucagcaguuaggagcacugacugcucuaaggcccugaguucaaaucccagcaaccacaugguggcucacaaccaucugcaauggaucugaugcccucuucuggugugucugaagaaagcaaaggugaauacauaaaauaaauaaaucuuaaaaaauaaaaagaaaagccagacgugacagcacuguuuccugaccagccaguauacuaacucuauguucagugaaacccugucucaaaaaaaucagauggaagacgauuucuuaugcucuaucucagcauuccuugguugccugugguucucuacagagagcugaggcacuggcuuuacuguaucuaucuguuggugucucuauucaacugcuguucagaaagccauuugggugaggcuuuauacauacaguuucugacacuccgggggacucaaccucacagcaguucaugggaaaaaaacaaggccauaaauuuaaaagagagguauacagaaagaccguagagaaaugguguaauauuaaaaacagaucauggaaagugacagcggaaucgaccuccagccuccucugcacacaaagagauggaccccccccccacacacacacacauguguaugaggacuagucacaagauaguaugaccacaacuuagaccaaacaugaaccagagccuucuguggccaugaccaaccuuccagagcugcagcagugucuccuuucucuuccgaggcagcuccugugucaggagucccucugagugucaacaccuccuccucaggucucuucugaggcucccucuguuuacucugcuccuucuugcccuucucuagcucuucuuucuccuucaucuuccgcaacuucgcuuucucuucaucucucuuuuucuucucgcgcucuuucuuuucugccuucuucugggccaccgucuuaauuuugaaggaagagucaucguccucauucccacugucuacgguaggaacggacuuguucuucugauuuuuuuucuguccuuuucuggacugcaaaaauucaucggacucaccaccacuuucaccagaggaguuuacucucgaacguucuuuacuucuuuugcuauugucuucauccucuucugacccgucccguuuuuucguggauuucugggcuuuuuuaccuuuuuuagaaaguuuauuagaaucaucagcauccucacucccagaaaggggugccucugaguuaggucuggcagucuuuuuugacuuugaaucuuuaucuuccaauucuucacuaucauucucaucaaaacuuguuuucuugccuuuuugucccuucuucuuuuuaucuuguuuugaggcagauucuucuucauuguuuucuguaggcuaaaaaguaucccuuauuagaaacaucaacagacugucaucccuuaaaggucauggggcuccucaguguggagcacuucacucagugcucaccucaauaccuuuuauggaagcaugacugucuuguuucacaagaauauuaaaguaugagucuggagguagcuuagcagugaggagcaacuguugcucuugcaaagaacucagguuuagcuccugcacucacaugcagcucacaaccaucuguaacuccagcuguagaggaucuaaugcccucucgucugaccucugugagcaccaggcacacacaugguacauguagcuauaugcaggcaaaacacucauacacaaagcaaaaaucuaaaagaaaacaaaagaggaaaaaaaauaggaacaaauccaaccacacaaaagaauaugccucacacucaccacacacuucacaauccaggugcccuaaacaauaaugaaaaguacacagacaacugaagguggagacgccauuacugaccccaaguggaucaaguuuaucaacaggcaauacauugaguaucccuagauuccuauaaaguguauuucuaucaauuggagguuuaaaacaauacugcuuuuuuuucccccugaaaauuuaguuccucccuuugacuaguauuauagaaacuauuuauauaucuacaaccacacauuuccaaaccaggcaacucccagaacauggccaagaagacagcggagacaggaaggaugcuguucucucucaccuugacugcagcggcgucucugucagcucugaugccuugggcuuccagagacaacuccuccagcucucucagaaugucguucucacuagaaaagaaguacaugggauuugaagcacuggaagcauuagauggcugcaaugcucaagcuacgaaaaucuaaaugcuuuuaaaaacauacucaaagucuuguuucuuuuucuccuuuuucuucuuucccuuugacuucugaggcuccugcuccuuggcagcaccagcuccuucuauuucugcagccaaggcgcccaaaucaguaucauccuugguacuuaaaugaaaacaaagaacaaaauguuacucaacaacaagcaaucuacuuguucacuuauacagaucuuuccuugcuauuuuacacccuuucacauauuagcaacacagagaaacaauaucaaguucucucauaauagcacaguaccuaccuaccaaacugucugucuucuuccauaaagaucacuaugccaaaaccagaagguaugaaucaagagcccuaccccuaaaacagacaagcaaacagccuaggcagggaagggaaaaaaguaacuucugcaaguaaugaacaucugugcauaugcacaugagcauuuuucugaauggaauuauuuucauaaaacauugaauaacuaaaguauaaaacaagcuaucagaaaaccuaaguaaguagaccuuuauacauuuuucacuuaaaacagcagaaauuagaguguugaaaaacuuuagaaaccaacuagucuauugucuaauuuuauuaguugagaaaaugggacuacacaaagaucuaaauaccuuguugaaagcauaacuauacaauuuacaugaguuaaguaugguuuacuaaauaacacacacagacacgcgcacuccaaaauuuagaaccaaaccuauuugcaaucuuuuacaugucugauuccagucuacaaugucucaccuauauuaguuggagaaaccaaaguuccagucaaguuaaaaucuacagaaagccaaggucagucauucugaaauguacaugcacaaaaaguauguuaaaugacacauuaagacaucaaaagaugcggcugauguaaaaaauaaucaaguuucccuccaucaacuuaacucccagaauaauggcucugagacuauuucuuuuuuuuuuuuuuuuuuuuuuuuuuaagauuuaguuauuuauuauauguaaguguagcugucuucagacacuccagaagauggagucagaucucauuacggaugguugugagccaccgugugguugcugggauuugaacuccggaccuucagaaagccaccaucagaagagcagucgggugcucuuaccuacugagccaucucaccagcccccagagacugacuauuucuuaauaaacgccuagaccauaaacuucagcuugcucuuugacucgcucucaacuuauucccccuucagucuaaccugccucauccuaucaggauucuggggucaaucucccacacuucuauuucccagaauucuuucuaucccuaccgggugucccaucuccaauuuuuuugcgucagcuuguuggccauaaguuuuuuuuuuuuuuuuuaaccaggaggcguucauaagaaguccucucuacaggcuggagggacggcucagcaguaaagcgcucacugcucuugcagaugaccuggugguucacaagcaucugucacuccaauuccaaaggaaccaaugcccuuuucuggccuccuccaacacuaggcacacauggguuguacagacauagauccaggcacaacaacuauauacauacaauaaaauucuauuuuaaaagagacaucaaaagcuuuuauggaacagaggaacacuuuagauauuguuuaaucugguaagaacuucuaaagaaaaauacauuaacugcuuccuuacaauaaaaagacuguuuaaauaaauacugacaaauaccaaauuuaauuucaagaaacuuacuagaggauaggaacuguaaaucuagaaauaaaggaacuuaguacuuucaugaaaaguugaagagaauuaaaauacuugauacuuucauguggcucugaacaguuuaaacgcaccacaucuauccuggggaagugaggaguggaaaacuuccuaguaaagcagcuuggaaacaagcaacccagaagggaaagacauuaacucggcaaggaggauggaugguacagauaauaaugguaguguacaaaugaagaaaacaaaacuucaaaauacaaaguuugugacauugaagcuuggugaugagguuuuagacaaaacccaaacaaaaggcacaagccaugaaagagcaauaaggcuguauuaaaaugaaacacuucugaagaagacacuguuaaaaaaaugaaaacacaaaacaaagugggaacgauauuuacaaaauaauaugcuauuaaacacuugugucuaaaauacacacagaacuccuaagugcacucaacuaaauauggguagaagauaugaacaguuauauugccaaaaggcaaacaaguugcaaacaauauaaaugaaaacaaagcucaguaaaagaaaaauggaauuaagacaaggaaggagaugguguucucuauuccaaaggcuaaaauccaaguaacugaaagugucagaugcugaugaaagcacaaaggugauguaagagacagacaagccugaagcaucuuguaaugccagaaaguaagaauuggauuaaauaagacaagaaagucagcacgugcacacacaaugcuagguaugugacacgugggaacaugaacaacucaaggagcuccaaccacuacugaaaacagcaaaguaguuaacuagagcaacuaauuaaacacaguauuaaauuauaagucaagggaugguggaauagcucaguggcugcuagcaugaucuaucugccuacacacguaagacaucagacuugauccgcaggacuacaaaacaguaaagaaaucugacuuauaagacaaaguaauaaaauaacagccacuaacuaguucaugcugagaugaacaaauggaugaaugaggaagaaacaaaagcuaaauaaaacuccauaucuggggguagaacaucaauucccacuccuaauacugugggugugcauagauaaaaugaggcuaaagaaaaauuuaccacaaaacaugugguacauauuuaacagucaguaaaaacaaaagaaaucuaaacaaacucagcauuacagcuaauucauaccaguuucuuaauuguagcaagugcaucaugcugcuauguuaacaagguguggugguuugaaggacacuggcccccauagacucacaccuuugaauacuggucugcaguuagaacuguuuggggaagauuaggcuuaacuggaggugugucaguggugcaggccugaggcuuccauuugcaccauucugaguucagagagugacugacugauccugaugucaugauuuugcuucacucuuuaacccucugacauuguaagucccauucaauguuuucuuuuauaagcuaccauggucauguuauuuaucaacagcauagaaaaggaacuacugcacagggaaaaucaggacuggauagacaaagauuuugcacauguauauuucuguaucucugugugcagguauguacauauguaugcagaugcauacagagaccaaaaaaggggcuggaucccuugggguuaauagguauuuaugagauauucaaacugugugcugggaacugagcuuagggccucuggaagagcaguacacacccacuccugagccauguagacagcucccugaaaguuauuuuuuaaaaauucaccugaagaaaggaaaucaugucauuuaaaucuacuccaaggcaaauauuaaaauuuaauaaaacaugcacauaaauuguauguuaaaaaacaaaaaaugcuggcgagaugauggcucagugguuaagagugccgacuucucuuccgaaggucccgaguucaaaucccagcaaccacauguuggcucacaaccaucccuaacgaaaucugauguccucuucuggagugucuuaagacagcuacaguguacuuacauacgauaaguaaauaaaucuaaaaaaaaaaaaaacaaaaaauggcagggcagugguggcacaugccuuuaaucccagcacuugggaggcagaggcagguggauuucucaguuucaaggccagccugguuuauauauggaguuccaggacagccagggcuacaacacagagaaacccugucucaaaaacaaacaaacaaacaaaacacaaaaaccauaaaauguugaugaaagaaauacaaagagacagaggaaucacaucuguugauagaagacuaccaaaaaccacuuaacaaaauucucuccaauauuauacaaaggcuuaaugaaaacccaggaaagauuuuuaagacauggauaguacagaaaauuauaaaauuuauaugagagggcaaaacacuuagaauaguuaagagaauguuuuuccuuuuuugugagaaaauaagguggggagcaaaaauuccaaggcuuauaauguagcugacaaaaauacacaaaacuauacuggaauucugauaaaauacaaaugccuggaacagaaggaaaaccaaaaccagccuccaugaagguagccucacacaagugugcucauccuccuuguauauaggacaaaggccauugacaaggaagcuaaccuucccacaaaugagauggugcaaaugaacauccucaacaaaagauuauagucucuguaugaggcacucugugauuuaaaaaacagaaccucugggaaaauagaggaaauaaacugaaacucaucaaaaugaagaacucuuggaguuggaaagaccauagacgugaccugaggaaaacaagcuccagagucggggcaggagaucgagaagugcuuaucugaaaaacagcuaauuccagaauguguucaaaaacauucaaaacccaacugcaaaauacccaauaguccaauuugaaaaucagccaaaugaaagggauacaauuaaagacacuccauguuagucauugggaaaugggagcuucccacuggacagcaaucagaaugccacaguguacaccaucacaacgccacauucccaacauggucacaaugcuagucagaguguagggaacugcacgggucaccaaaggaugugaacaggcacaugugggguaugcagggggagcuggugcuggaacacacagaauauaaccagccccagcccugaugcucugaaucuuaacuguggaaaugucuacacaaaucuacagacaugaaugaugauaauacauaccacaguaaacauacacaagaguguaaaugaaaccaagcauuugacuaugaccaguggcuuuuaucaguuccaacaugugagucaugccaucaugacacagcuuuaggauuaucacaacaaacuaggaaauagacacugaguucuaucauuucuuacaaguacauaugacucuguaacaauccccaaacaaaagaucaauucuuuagacaggauaaauuaauacuauuaacaaaauuaaagucuaaagaaauauuugcaauauaagcacaugaaggauuguccuauaauacuucagcuuccuacaagccuuuaaguugcaaaaaugcccaauaaacacaugacaagauggucaguauuacagaauaaaguguaagcuacaucgaggcgucaucaccacugcccaucugcuagaguaaggaccaggaaacaagcacugagaggacagggacagcugacacucacccgcccccauaggcaaagcagaaguggcacagucaaauugggaagacaguuucaaguccucuuaaagcuacaugcaagcaagcacccucucccucucccacauaccaucccccucucccucccccucccccauccuucaccccucccccucccccccacucccuuaccucuaaccauaugacccugcaagcuuacuccuaagcauucaccagaguaguauguguccacacaaagacuuguaugcaaauguuuagagcaauuuuauucauaaucaugaaagcuacaaacuucgaacaccuguaagauaguuucaaaauagccaagacccacccagcagaguauuccacaauuaaagggggcaagaaugcugaugcaugcaccagcacagaggacucucagucacuacacuaaagaaaagccaaucaggaaaugcugacuacaaagcaucacuccuccaaguagcacaccccaucucuagcaagggaaagcaugacagaacuaggcacggggugcagcucagcgauaagcucgcuugccagugugugugagccuccggguuugauuccuagaacuuaaccacagcgacuccuagacaaagccuucuguagggagaucacuuaccaaagguccuaagcaaauggucuacuuacucacagggacaugaccuagcccauugauuguacacuugaaaugugcacauuuuauauuacuuacaccucaaaaaauguguuugcucaauuuccagauuauaaaaaccauaaaggaucaauagagaacauauuuaacaauuuaaaacaguuaaaacuaaaauuacauacacgccuaaaaauuauuuauccauuuuuuaacuuaugacaauaccuaaucuuuuacauuaacaauguaauguguaguuaaaauuauguuacuauggacauuuuuuuuuuuuuuuuuuuugguuuuucaaaacaggguuucucuguauagcccuggcuguccuggaacucacuuuguagaccaggcuggccucgaacucagaaaucugccugccucugccucccaagugcugggauuaaaggcaugcaccauuuuaagacaucuuuuauuuuaaauauauaauuuauuuuauguccauugccucaauguaugucugugggaggaugucagaagcccuggaacugcaguuacagauaagugugagcugucaaguggaugaugggaaauugaaucugggucuucuggaagaguagccaguguucuucaccacugagccaucucuccagccccaagacauauuucuuaauaauguguguuuaaguaugcacucagcauugguauuugguauuucuccuugcaccacauguuccuuuccauuguagaucuccauaggaguuauuacuaauaaucaaaaauacuagcagcaacaauauaaaaauauugcaauuaagauauauacgcauuuagagaccaguauaaaaucuucccuuuuaaggaaacaaggucucccuggcuggccuggaaucaugaguucaaaaccgaaguaagcaacaagacucugccuccaaaacaaacaaacacacaccaaaaaacaacccacccccccaaaccaaaacccaaaaacccaaguaacaacaaugcucaaaauuucucugaugcucucuggugguuugaaugagaaggaccccuauaagcucaaguguuugaaugcauaggccccaauuagaccaacuauuugguaaagauuaggagauguggccuuguugaaagaggugugugugucacugugaacugacuuucagguuucaaaagcccaugcucggccuaguguguaucugugugucuguggucccucucucuccuuccccugcugccugugggucaggauaugaaucucccagcuacugcuccagcacuguauuugucugccucccaccaugaugauaauggauugaaccucuggaacuauaagcaaacccacaaguaugcuuucuuucuaaaaggcgccuuggucauacugucucucugcagcaauagaagaauaacugagccaugcucugaaguaaaaguuuagugacugcuuaucaauagaacaugacagaaguaauguuaagaguuuccaggccaaggccuuaaagccacaguuucuccuuucugucucuuugcucucugccagguagugugaugcucaagucacaccaagaggucaaguucagguuccaauggcaaguccagaggagguuccaaagaagagccauuaucaaccaccagaggagguuaaauuuuucauaaagcaagcuuaagaauggcuccauuacagccaccaugacuguauaaucacagaaaaagccagccagaaaacauaguuaaugcccaggacuacaaaaaaaugauaauugucauuaagcccuuuaaguuugagaugauuuguuaggacagaugugguauaccaauuuccucugagaauaaaacaucccaucauuuaaggaagcgcaaaguaaacaacucaaauagcuucaagaagucccugaaacugaccaaacucacaagccagacucccgacacucaccuccaccaucaguaagcaauaaagaagggccuagagucacucacagacuagccaaacugcaaagcagacugugagaccagaccagauggcaggaagaagcagacaacagccaagcugccugaaguuuagaccaacugagucaccuagaaaggacacucuccaaccuacugagcucucugccggcuguggaguaugcuccagguuccccacuuuuaugagcugucacucaugcugaggugggcuccuauaaguaacccaauacaauucauuguuccaccaaguuggacuuggucucuguauuuuggucuuucaugaucucuguauuugaggugaauagacaugugccuccccgugaaagucuuguuuuacaguaacacaguaauaacugggacauuccuguauuucuuucuacuccuagccugaagaaaagccaaguauguuuauagaaggaaucaaaauccaaacacucuuucaucuacccaccacugucuaaaaucccaaagugccaaggaaagggaaggccagacuaaagccuguugcugccucucuuuauccuaccuugcucuguuucucucuccucgaacacuuucagcaacauucaaaaaaggaaaggcaggaagagaaagccuacucuuuacucagcagcuccaguaucaaaacuggaacaccuguuccuccccguuggcaucucccuucuccggcuucuccuuacuccugaucuccagcccuaccucagaccugaacaaaaauccagaacucacugcuccccuaccaaucccaacagcucuuauucccagcuaugcuguuaaaagaucuaucuccaguacuauagccccucaguuaacuaagagcuacgugugugcacaacaaacacacacaaaaucagccccaccccuucaucccaacuuaacaacauccuuauggugcaguaacaccuuuauagaaaccagaaaccccaucaccauuacaaugcacaguacaacaaacacaaaguauccuuauucccucuacaaacacaaacuaauauuuacuguuuuaauucuuaaaaauuuuacuuguguguauguuuaucugugaguguaugccacaugugcgugggcacccguacaguccauauuagcaccugaucagcauuaggagccuggauaugaugagacacaccaguagccccagauacucagaagguugaggcaggaaaacacuugaucccuagaugauguucuggccuaggcaacauaguaagacuucgucaguaaaagaaaauaauaauaauaaauaaauaagagaugccucuuaugccaugaaauaacuauccaccuguuuucuaagugcucacuuaaaaguaaacucagugucucuguagucugcuucaaugaaucuggugcuuacuguuaaagaauuaccaccaccuaacuuacucuguuuacugccacauaacugguaguggcacacaccuuuaaucccaguacuugagagguagaggcaggaagauuucugugagucugaggccagccuagucuaggaguucuaggacagccagaauuguuacacagagaaucccagucucaauaaaacauaaauaaauaaacgaacaaauaaaaaccugaauaggacaaaacaaacaaaaaaguaaaaaguuuaaugcugaugauuauuuucugagagguuauuucugaaaaacuaacuuaucaaacacaaccauaauuaugcaggccugacuaguuguguacagaauuauugguaguuuuauagcaacugaaaacccuaaacauuacuauuaucccuuagcacucaagagagguagaacacagcaugcuccuguuuuuccaaucuaguacacucucaugaugguaaaauuuaauuacuagcugcauuucaaaaugcaaguuugaaagcaggguugagugucucaugcuuagcagaagcucccagugucuaugcauauacacuuaucugccauaauaaaauauguuccccuucuuccacccauuuucucaguuuuagggcaaaguauggagaagaagcaacagguaccaagucuggccuuuacaugggagaaggggggaaaggaaggggaaaggaagaaaggaggaaggagggagagggaaggagaaggaggggagugagguacagggggagggagggagaggaggagggagggagaauugguggcacuuaucuuuaauuccaguauuuggaagacaggggcaggagaaucucuguuaaguucugccuggucuaacagugagugccaggacagccagggcuacacacagaaacccugucucaaaaaaacagaaggaaaaaaagaaagaaagaaaaauucugggagccgaauaaagaaaggugaaggcuucaagaaaaggguuccucagcacgaugccuggugcagcaaagugaccuggaaagccuaaguuguuccuauggucaagauucaaguggccuacaucuaucccucuucagcgggcuauauccccugccauacaucuguugccaucgacagauaaagaaauauuguuacagagacuaacuuuuauaaagaaaaaaagggagagggacagauggggaugagaaaagggguuagaaggggagggaaggggaauaaaacaggaacaaaggcuucugucuguccacccugggaccaucccagccuucuacagcaacaagcaccaagggauucugugcauuccuaagaggcaccacagucaagaagaaccugcucaggaauggcgaucacaacuuuaaaagacuaggcaaguugcucaccagugucaacacagagcaguuuaguaaaaauccgucuaaggcugggaauggugccaugugacuuuaauucuagcacuuggaaggcagaggcaugugaccgaucucugaguucaaggccagccugaucuacucaugacagccagggcauuagaaacaaacccugucuugaaaaacaaagcaaacaaacaagccugacugcuacuauaauuacuuuaccucugcauauggcaaaacuuccaaacugcauucuaaagcacuaaguugaaaggcuaguuaaaaaaauacagugagacuuuauguaccacuaccaagacucuagcauauguacauucuccacaucaguggaaaugcuucauauuaaaauuuacaguuaaaugcuauaaaugauguagcuugguggcugaacacuugccugacaugcacagggcuucagguucaaccccaaacacauuaaaaaaugaaauuuacaguuaagauauaaauguuucuuacaauugacuguguaaauccuugaaauauuauaauauuaugaaaaaguuaaggcugucaaauaaugaaaggaaaaaaguagcagaacugagacaacacaaagucauguaugaaugagcauuagauucaaggcagauuuggucucaagucuuccacuuuuauacgugugugacacuuuucauuugaggagagucaugagcuacagaguugacucacugguuaaaagcauggguuguucuugcaaaggaccuggguuugauucccagcacccacaugaagauucaucacuucaccuccuuaggcaccaggcaugcauguggugaacagacauacacacaggcaaagcacucauacacaaaauaaaaucuuaaaaaagaaagagaagucauacuacuauaguaagagacaccaaaggaauaaagugagaagccuagaaauaaaaauccagauacagagcaucuacugauccugaugugacacuggcaacaacggcauucaacugggcacaauccccucuacaggcagcaccaguacagagaaacacccacacacacaagaauaugacaaacaccuacaaaacaccagccacaaaaauuaauuaaaaauggaacuaagggcaaaacuagagcaauaaaacucaaaugaacaacauggguguaacucucaaugaccuuggucuccaaaauacauucuuaguuauaaccucaaacuuacaacaacaacaaaaaaaacaaacagaacuugaucaaacuucaaucugugaaaaagagccuuguuaaagugagccuacagaaugggagaaaauaucuacaaaucacacaucuaacuauguuaucccaauuauauuaauguuuacaacuugacaauaaaaagacagccuagugaaaacugggcaaaacauuccgagagacuuguguccaaauaucuaaaaugguguacaguacaugaaauaacuaccaaaugacaaucgaguccauaguggcuccugagcaugcaaucccagcauuugggaagcugaggcaagaguaccggcaggcccaaggcauccuaagcuauauacacccugucucaaauaaaaacacaauuacccagccaaacuccacugccaccacuacagucacuaagcuggcuauuuaagagaaagagaaggaaggagggugguggacaaggauauuaaaaaacuguagcucugucucguacgaggcuaugccagugccuggcaaauacagaaguggaugcucagucaucuauaagauagaacacagggucccuaauggagaagcuagagaaagcacccaaggagcugcaacccuauagguggaacaacaauaugaacuaaccaguacccgcagagcuuguaucucuagcugcauauguagcagaagauggccuagucagccaucacugggaagagaggccucuugguauugcaaacuuuauaugucccaguacaggggaaugccagagccaagaagugggagaggaugaguaggggaaaaggguggagggaggguauagggaacuuucgggauagcauuugaaauguauauaaagaaaauaucuaauaaaaaauaaauauaaaaaaacugaagcucuuauauauuacugaugaugggaaggugcuuagaaaacaauugaagacuuuaagaauuaucauuauaaccuauuaaguucauuccuagauacauauucaaccuaaacacaaguguucagacaagcaucuauaaacaagugcucauagcaacaguauguacaauaaccaaaacaucuuuccaugcaauauuauauacugugaucucuacuucuguaugacugacagcacuauaucucauagcagugagagauccacugguaccacacuaagaguccuugagauaaaagagcuuuucugauccacugcaaucuuaaagaccacaguugcauauacaguaaguacacuguggucaaaauguacaggaacuaaugacuucauaucauccaccacagccaacacuaagugacucuaaacucuaaaguuacauguuaucagcuagaugugacgauacagaucuauaaucccaacaccugagaggcagaggcaggaggacuccuguaaauuacucaagcuugagcuacacagcuaauauauggcuagcucuggauaccaagauccuaucucaaacaaucaguaacaacaaaagagacucaauguccaaauuauuuuuuaauucaacucuauuuaucaaauggcagauuuaaaacaacuagaugaagguuaaaaguaaaagauguguguucaucagugugguggucugggugagaauggccuccauaggcucguguauuucaaugcuugguuccuacuggguggacccucucccucuuuuccucccucccucugugguucuuaacaugcaagcucucaccuaauacuccaacaugccugccugccaccaugcuccacaccaugauggucaggaacucauccucuuaaacuguaagcaagcccccaaggcuuuuuuuauaagcugccuuggucaacuucacagcaauagagaaaaguaacuaagaaucaguaauacgguaccaaccaaacuauacagaccacgaccaaguaggaucaguugaucuuauaacugccagacugauucagcaugugcaugugugugugugugugugugugugugugcucgcucucucucucauauccauaaaugacaaaaaaagacaugaaauguuuguguuacaagggguauuaucaagaaaaugagcuaaggguauagguuauuuacccagcaugguccuagguccaagccccagcaucacaaaaguaugguaagagaugauacagcuguuauagccagacccacaaacuaguuauagcauagguucugcauugaguguguuaguuauuaaaauuaugcaaaauacugugguaacuaaggcaaaaauaguacaggugauaauuucaauagacucugcucaauaaaauccaguuuguuuguuuuuuuuacuaugaucuuuuuaaaaauuauuuucauuuacuauucuccuuguuuagacagggucuccuuuuugauucucacuggccuggaaucuacuauaucgaccaggaguuccucuaacucagagaucaaucugccacugucucuggaaugcuagauuaaaggcauaaaucaccaugccagauauuuauaaucucuuaacagaaucuaucuguuacaaggcacaaguuaggugauuugcauaucacuaaauucuugagaagcuggcagguggcucaggguuuaagagagcuugauccucuugcagaggaccagaguucacccuuuggcaccaaugccaggcagcucacaagcaccuggaacugaacuugaguagauccgaugcacucuucugccucaaacgugcaccuucucacucaugccuccauaaaugaaauauccaaaaguaaauccaagagaauuauuagaucaugcauguuuuccuuauuaccaucuaacuaauauaaaugauuaguaaccaguucaacuauaugcaagugagaaaggauugcugaaucagauuaugggaacuacagguugucuccuuuaaaguuagaagccugaaagauaaucagauuaacaauaucugaauaugcauaaagggggaugaaacacaaaucuaaacacuaaaucuacuacaaauaaauaaguaaauuuaguuuuuuuugagacaagguuucucgguauaguccugacuguccuagaaauagcucuauagaccaagcugaccuugaacucagaucuugugggccugccucuggcccacaaguguuaggauuaaagguaugugccagcacugcccaguuguuucaauaugucuuaaacaaacaguaugaaggcaacuuuauauauuguuuugggcacacuuucauuucaaugauaaaacaugagaucaagggcagaaucuucuguuucuuuuaggggaggcuuuguacuaauaaugccccacaaucacagaucauggaacaaaagucuuaaacaagucccauuucguaguugauuuuuuuuuuuuuuuuuuuuuuuugguuuuuugagacaggguuucucuguauagcccuggcuguccuggagcucacuuuguagaccaggcuggccucgaacucagaaauccgccugccucugccucccgggugcugggauuaaaggcgugcgccaccacgcccggcucguaguugauuuuuaaucuuaaguaguagguauguuugugugugcacgcgugguauauacacaugagugaagugcagugcccugggaggucagaaggggaccugauccacuggagcuggagguaaaggcagugguaagccacaugacauggugcugggaaccagacucaggcugucugccaaaacaccaugcucuucuuaaacacugagccaucuccucagccccacaaaccacacuuccuaucagacaucuguuaacuugauuguaccugacuggaugaaugccuagcacuaaagcaucaucuaagguuaguacgauaggcagaacacccacaaggaggagucuguccguaauuacagagcaacaucaguaguuaaaagcaaugaauggcuuuuuaacacccugacucccaaacacuuauuugaugaauaacacccugaguuccaugauaggcaauuuccagauaaaugggagaaaaaaaauguuuuugcuuucccucuguguuuggaaggggguuauaucuagcaggcuugggaagagguuguuugaguccauuaagguacagaaaagauucaucuaaacugaaaaaucuacaauacuuagguauuauuaucuuuauauagauuuagggagaaaauaaaaagaacuaauaguaaaaaaagacaaagaaagcugggcggugguggcacccgggaagcagaggcaggcagauuucugaguucaaggccagccuggucuacagagugaguuccaggacagccagggcuacacagaauccuuguccccugcauauuaccagugagugacauccacuguaacaaccacagcaacaacaggcuaucacuacagcauucacugucccauagacuaucgacaugcacuagacgaggaagguuacaggguaaacagcaaugccgcaucaccauucugucucucauuccucagucaauaaaaaaacaaaacaaaaccaaaaaaccuuguuaccacaccuuaugggaaagcuuccucucagaauuauacaagcccaaacagaauuccagaauucuaaaauacagauaaaacaaucuaucucagcuacugauauaauaaaacauauucuaaucauguaaaaaucggacaaguaaaauuaauugaaacccaauacugaauggcuaaaaagcuaaaauaaggauuaagcauaagaccguagacaagaauaaucaaguaauuugaguucuuugcaagaguuaaagugucucugccuccuccuuaucuaccaagcagcugcccauuucucacccccguccaccugagcggaaggaagcaugcuggcuugauagagccuggaagccugaggggugaugacagaaaacgucucaaguagggucugucgaagggaauguccccaaaugagaccuuuuuuugagacuuucuuccuagccuucauuucuguccauuuaaaaaauauuuucuaaaauaucguuuaagauaagaguaucacugggcggugguggcgcacaccuuuaaucccagcacuugggaggcagaggcaggcagauuucugaguucgaggccagccuggucuacagagugaguuccaggacagccagggcuauacagagaaacccugucucaaaaaacaaaacaaagagccgggcgugguggcacacgccuuuaaucccagcauucgggaggcagaggcaggcggauuucugaguucgaggccagccuuuucuacaaagugaguuccaggacagccagggcuauacagagaaacccugccucgaaaaaccaaaaaaaaaaaaaaaaaaaaaaaaaaaaaagaguaucauuuaaacacacacacacaaaacaaacaaacccagaaagcuguguguuuguuuccccaacccuaacaccccauaugagguaccgaaguuuuuuaaaagccaggcaauuuuagugaucagggcagagccccagacugcuugauccacacuggggaaaggcgccugagcaaggaucugguaagcacuagaccaugcaacauaaaccucacagggugcacugccaucaaagugagccaaagggaugcaccaagagccuguucucaaaugguuaguguguuaguauaccaagaguggagcuggaucucuucuguucuaaagauuucccacaggggaaaaucuuuuauaaacaaaucuuuacuaaaacugcagacaaaaauuaguaucuuuccuuccaauagcuuuucuccaucguuaaaaaguccgaaagguaaguaaaaacuagaaacugaguaacaaaaauauggauuuuuuaaauuuaaacuugguauaaacaugaaucaaacagauaaacuggaaaaaaaaaaacuuuaaaaacucaaggaagccuccuaguaaucuacuccuguaauuccuuacaaggugaaggagagucaggagguucaaggaagccccucuggccacacagagaagcagccaggcuaagcugugugagacccaguuuuaacaacucuaaaaaacgcuaucagggaaaacagaaacuagcuuuagagguaagaaaacaguuccuauuccuuaguccaauccaacugugguugucuuguuacauuucuacagggccccagcacaaccuuuaucuuccagauacaccugacguuuguacacaugaaaggccucagauuugguuuagacuguccaacaaguggguauuuuagaacuggccaagugaugauguuugcagaccggcaaaggcaggguagggugaugauuuaacacagaaacagacaaugcagaguacauacauagauagaugacugauagaacucaaaauucuucucagaaaaauauaaauaaauaaaauguuacucacguaugccaauguccuaccaaagguucaggaauaucugcuuaccucuuuuuauucuccugauuugacuaacaguaacuuucaggccacucuuugagaagcccuacccccauucuagaggaaguucucagcuucccugcucuacagaacccuccucuguugucccucuuaaugcucacaucuaaaucuguaauaaacccuguuccucauaaacacuaacucugccacaagaaacccagaaucuauuccgcagaccaguuuacauucuccaacagaccuaaaaccaaaauacaagccuagucuuuaaauucuucuugccagauagccaacugcgagguccacacacuuaaguguuccgacauacacuucaacagcuuuaacuucaaaaccaugucugugugagccacagcgaugaagugccacaaggcuugguuuuguuuucgguuaccuguaguguuuuaaauuaaguugaauggccauuacuuaaagaugaaauggaacagaugguugcagacgcccaggaagucaacucaacugaaaaggguaaaagaacuuaaucgaacguggcacaggcaugcuccccaaaucuccgccuaaguagcucauaaacacacacuccuuccccugaaaaggcuuuuucuuuuaagguuagaaagcagcgacccuugacugguuucuuccccuccuccuuucuuaagggaagcgguaggaagccaagacauacgcaaaaaaaaaaaaaaaaagaggccggaaaauggaaagccagaaagcaggacugggcaaccgggacuuuaaauaaccccagaaguguuuccaacuuggcacacgggaggagggagccgcugggcuaccucuccgcaaccccgagcaccuccgaaguuccugagccgcucugggaggcguucccagggccaggggaggcgagggagccguucccggcccgccccacccgggcucuccgggcccggcucgcacucaccugggccguaggccuggcuuagcagcgcccgagcccggccccacaccgcccggacccccaaacgaccuccgagccccucagccccacgccucggaccccagcccgagccccggccgcgggacgcgccccgucgaggcucgcccauccagggccccgcgcgacucccggaggacccccggcccgagccccgccgccuaccugucuucgcucuuguuuuucuguuucuuccccaucgcuugucaacggcgcucgcggccccggccccucgguucggugucucacagacccacugucucccggcugacuccaaugcccgcucggcucggucccccucgcgccgccgccucucgcacccggcucuccacagacccgcgcacugggacagggcacauauggugugagcccucaguacgcaagcgcaucgccccgccgccucggcguggggacgcagggcgcggcucaucgagagcggcgcuucggcuagagcgucuccaguagagccgccggccaggug

SEQ ID NO: 134 - RNA, 4022 nt, Mus musculus
cuauggcagaacccuagcugcagcggccaaugcauuuuacauucucugugagaucugggaggcauggcuucacugugguggccugugccagcagcagaggcccucugaggugagcaggugggcugaggcugggaacccacuugcugggaggagaauuccagacuucugcuuaguucugcccacacuguaggcucccgcagggcaggcacuaaggccuggggcccggcuuuccuuguauccucacaggcccuccagaggccuuucucuugucaguaggugggagaugaagacugaaagagcuuuuuagggaacuaucagcccuuuguuuagaaauggcauuucuuccuuaaggacugcucuucucuucagaggucuccagugccaggccacagaccuaaagcagugccugucagcggcuuuagagccgggcaaccagccagacuccuggugcugcugccgccaacugugaagccucagggagccugcucagugcuuggugauacagugguaauguaccucaucagacugcccuguggacugaaugcaacaauguauccaguugagcgccuggcacagaacagguauuuaaucuggggaaauaucucaggugccagguguacagauaggauaccagugauaaggggcaaggguggauucaguuuguaaccacuucagcugugcauuucagagguucccaucuuagacuguguggaagagagaacacauucagcucacagugauagacaguaagagaaagugcacaaaaugcccagugaauguguuccaaucauugcuggguucuucuaccaauuuauuuacucguacaaggacuuuggcacuguguaaauacaauguucugaaugcaggggaggcuccuacaaacaagcacggagaggaagcuguggggaaggcagggcugugccaggagaaaacaaaaccaauccauuaaugucagacgauauuuacuguugguaacagucaguaaaugugguaacaagaaacagauuccuucuacagccaaaggucuccuccaaaaaaagggggaaagaaguuagcaucugcuaaggucacugagaacacagagcaacugaaguuugccaggacaggcucugugcacuggaagggcucaugccuucuucuagaacuuguggguugcaacuccauucuuggucaaacgacccuuucaugggggacccuuaagaucaccggaaaacacaaauauuuacauuaugauccccaacaguagcaaaauuacaguuaugcaguagcaauggaaauaauuuugugguugggggaucaccauagcaugaagaacuguauuaaagggucacagcaguaggaagguugagaaccacagcucuagagaccacccacuguaagcacaagcucaucacuagcuguguaucuggucuuuuuaggggucacuagaaacuuccuccuaccguaaaacagggcccgagcagcuccaucacaagcccgugagacuauccuacaaucuucuggguuucaauucuuuaacugaaaacuauguggguccgaugaagauacuuuugaguccccugggguuggguuuuagggcuguguucaggcccauccuguuccagcucugugcagagcaagggcucgggagauggcccaauggauaaaguacuugugcaagugugagaggcuaagcuguaauacccagaacucaggccaagcgggaugcaggagcagacaucuguaaucucagcgcaccuagugcgagauaggaggcagguucaggagaaucccuggaagucuucuaaggaaaccaagucuuuacaagcuggccagccuugcauaggcagaggcaaacaacaacagggaagagaaguacgaggcucuagagaaucaaacagaggacaugggaauggacgccuccauuuugcuagaggcuucucuaccagcccuugggucaagccuccaaccagguguaggaucacagaagacauagucuuguucuagaagggcaaaccuuauuggcauuccuacaugaacaggagaguugaaccaaggugaucuaacacccgaccucccucuugggcaaaauggacaacaacccuggcaucuuuucuccuccaccagccauguugacuaagccgugcacgcaggcugcucauggcagucucugagagaugcccccucauuccuucacagaccugcaucuaccuugggcuucuguaugaugucugagggggucugggaguacuuauuuuucauccuugguauuugagagugggggaagcaggaccuggccagccuuuuccagcaagggcuguuucguuagcuuucucagcuuucuagcuaacaggaucuuggcgaaucacuuacacagauacagagaagaggucuccagggacagacaccuaauaagcuaaaagaucggacauaauucaucauuuuacacacguauugccacagccaaaauaaauacuaccaugguuucaaguuucucagugaaaaacaaaaucuuuuuucuuuucuuuucuuuucuuuuuuuuuucccugaggggaaaccauuuuccaauagacuuugaucaacuuccagaugcuauuagcugaccaguuuguguaacccgauuauuauaugcauauguaucaaugacacguuucuugauacauugaacaaucauuuccuccguaccuaacauuuuuaagguaauucugcuaugagcauggaaaauugccauccuugaacaagcuaccccuucuggcucaacagcaugcugcacacaggcacgcaggcucagucagacugacucuucccuagucagcgaugcccacagcaggccagauguuuguaagggaagucguggaagcauuggucuuuggcuucuacaggccaugcaugcucucugaagugaggcaaagccuuugcauacaguccugccccguggaggcucggggaaggguuuguucugggcaucacccauggacuacacugauaacagaucuuucuuuucuuaguccuggccucacuggaaaaccuuuuuaaaaaacguuguacuaguuugucuuuaauuccuuucauuguuucuaaguucucuacuuguuuuaaaggacaaauuaagcuucuaauaaagcucugaauggccacagagacugggcuguuuuggggcuuuuauucaccauaaauauucgucuaauggcaauaacggugaguuauuggguaccagcuugguaaugggcauuuuccauacauuaccuuuggaagaaggaacauuucauggguugcugcaauuuaguccagcuuauaauaacuuccaacuccuuuuacuguacaauguaggcaacuggacgggccauucuccuucugucucauuuugguuauuauuauuuuuucuucuuaggaguuuaacccuuuuguuuaaucccaucauguugacugaugaaggccauuuauaaucuucauucucucaaggcacacuuacucuggccaacugaggggcauccacaaauguaaaggggcacucucuugggguuuugucuucaagcccgugccgugaccuuugacuugagaguacauuccucauggcuagcaggccuccaaaaaggccagcucagcaaucagccuaacugugggcuuugcagggucuuggacaucuccaucuggccauuauuccuuggagggcuaucuaguaguaaucuggucucgucuucagguauuacaguaaggcuuguucuucccaggauggcugccaucucugaaggagcaccaguggcccugagacagcagcaauggauacuggcuaugaacuucgcuccuaugacugaggucuaggcuucagguccugucuucaccacuuaauguauuaacagcagaggaagaugguuaccaucgcuacauaaugucacugccacuugcccgguguugucagccauuuuuauucgacucauaaaaaugaggacguggcuguguuccacuguggcucuguguuucccuuggacgaguauaauaagugacacaaacccuuucaucugcuuaguguccauuugcauau

SEQ ID NO: 135 - RNA, 8162 nt, Mus musculus
guuuuugcuguuguuauuuuauuuuauuuuauuuuauuuugaagaucagcaauugaaaacagaaguaaguauuguguguauuaucuggaagcuuugagcagcuggcuguaagaaucuggaugagugauaaccacaggaguuaucuuaugaaagccugacaacccuugagcagggaacaggacacgcguugggggaagcacaugacccgagcagggagguggggugguccagagaggacuuaacucggagggagucagucucugauuggagcagaacuuccauugucucugagguugaaacaagggcaaacccaggggugcuuagaggcacacgucacugguucccccagaauccacacuggacagugcagcgcaggacaaaguucagcguucaacguacaagagcaguucugaacacuggucgcgaccccucuggggaucagaagacacagacauuugcaccaugauuccuaacaguagcaaacuuacaguuaugagguagccgcacaauuuuaugauggggaggggggugggucacuacucuaugaggaacuguacugaagggucgcagcguuaggaagggugggaagcacugggcuagagcgugguguagaaacccgggaacuuggcacuuuauuccuucggaaauuccaaaagaaaacuaaggagaggaggcaaggcuucgugguaaguucuaaguaguuacacuuuaagugaagacaagagaaaagcguuuucucaauguaagaaaagcaaguuauuccuuugcuuaaaauucaucgucugaaaugggaggagcuucuaagugugaacacuuccucuuauggucgcuuggccacaccccugugggguggagaaaacaccuuuggagcccagcugcucaucuccugauugcuaggaagcagagacauagauagaaccggccagggcaaaaucuagccuccagggggagaccccagugagcuacccucuccaaggaggccccgccucuaacuucacaucaccucccagcgcaccucccagcgcaccucccagccacuauuuuguuacacagccuucaguggacccacucauugauuaggucaaagcuucacgguccaaucaucuuucaauaacugguuccaacagcuggagaccaaaaccuucaacacgugaaucuuugggaccacuugaugccuaaccuauagccuucccauugcauugggaauaaaauuugaacucuucaccaaaaccccaccgaaagccgacucucagcccuccucuuuaaccuuuagguguuuuguuuuguuuuguuuuguuuuguuuuguuuuguuuuguuuuguuuuguuuuguuuuguuucaggacauguacacuccaagaaggccuggauucauccuccuuaaauguugccugggcagagacccucucagccagcaccuugguuacuauuacagaauacuugguguauuuugcuuuguagcgcuuaccugcaacgcuguagcuguccuuaaccccguauuguguauacuguuggccuagauaaggcuggagacaauauccaggagagagaaguaccagagggccccuaggaagaagagagaauaguaaauagguuugucugagagggucugaauaguuaagcugacagguuugugugaaaacuggguaggguaguggccaguggaggcuuucccaggcccgcaaggaugguugugcugcucggugauccugguuuuccauggggagggaccagaauagaagggcuuuucacuuccugggagccucugggguuugccacaagccugucugucagcaugcagaagccgacuacaucagcucagggagggcuuggcggcaggugucagcugcaggcccugugggcacgaaugaagucagaggaggagagauaggccuucaggcagcaagggaggagcucccugagggaagagcugaccagguugagugugaugugagcucaaaacagauccagggaagugguccaaagggcaagguugugauggaagaugugggagugggugcuuggcuccuaagauggacuccuuagaaguucccacuggagguggccagugugguagagguguaauggaggcagaggcagguagguaucugugaguuagaggccugccuggucuacaaaggguguuccaggauagccagggcuacacagagaaacccugccuugaaaacaaggaggaggaggaagagaagaaggaagaagaggaggaggaggaggagaagaagaaguuguucucacaagcucucuaguaccugaucgcagauggguguuggguggauuacagaaauucuugacuuuccaagugaccucuucuaugaacuuuacaacuaugaacucaauugugcccccaagaaaacccuuaauuacuaaccccacaccuccccuuccccauuuuucaaagagagagcccaaaacacgggggugggauaaauaacuuucccacacauaagagccaucagaaguauggggauuugaacccaggcagugugggcccagaguccacagcucuuaacaccaugcugccuuaacauuccaaaccuuucucuggcuuuuuaaaaaaauaccuuuuagauuuauuaauguauuggaggauggggaaugugugucaugacauguguggagguccgaggacaacuggaggguaaaguccaggucaucaggguugguggccaaugcucaaauccacugaaucaucuugucagccccuggcucuucuuggauggcaaaccauuugaagcuuccacacuucagggaucaggaugguggcucuggaugcaaacgacacggagugagucaaacuccucuccucucccguuugguuaaggcaauaguguggucuugcuuccuuuuggccucugccauuuucccucaagaauugcuuuaccacaggccagggaaacuuccaagcuucaggugucucccuuucaguuucuggagucaggaugccagcauagaccauccagaguugccccugcucccagcagggacagggauucugaugccagaggccacuggagucauuugggcaaaggugguccacacagccaguugccauccacacagauguguacaggacaauccucugugcgcgcgcucacacacacacacacacacucacacacacacacacacacacacacacaagcuucuuaacuggagucuaaucagggccugacuuguucggagcccagcaaagcaacacccuuggugacagacagaccacacccaucucuuuaugacugugaguuucggaaagaaccgacuuuuacuguuaucaaaccacgaugcuuugccacagagucgauaaucaacacguaugucuccauuggcauucaucuucaaacccaagcgagcuuuguugaaggucugcaguaaagaaaaacaaucacgauaggcagcccacugugucuuucacaaaagcgagcuagauuucuguggcuaauaaauucucagagugggcaacuauggaguguacuuuagucacuucacaugcaaauaacaccauuggucuuugagauaagucauguuuuuacuauuuugaccuauaaauauguugaaaacaucagcuugucauugggcuggcuuuucugaaagccuaccggaacuuucuccacuucagaaaugauacacuuuagggugguacuuccuauuucagaaaccacaaaaaucccccucccggccccuccaaacaccuuggcaaccugaguguugcugaguuuuuuuuuuuuguuuguuuuuuuuuuuuguuuuguuuuuuguuuuuuugagacaggguuucucuguauagcccuggcuguccuggaacucacuuuguagaccaggcugaccucgaacucagaaaucugucugucucugccucccaagugcugggauuaaaggcgugcaccaccacugcccggccugaguguugcuguuaacacucaacaccagacuuugggaugcacuaaggaagugccagggacucugugacacugagggagacagaugccccagggcuguuugucuuuacuggaaaguucuguauucagauccuccugguagggucuguugcaauaaacgucuaucuggaaagcauauuguugccucaugauaagacccgagagaaaucugucugcugucucauuaauguaacauuaacucaaggcuggagugauggcccagcaggugaggaugugugugcaaaugugaguacugggcuuuggauucuauauaaaaagccugauugauguggccacccaugagccuguaccgcagcacuguugugggcagagacaggaggaucaugggacuugccgaccucuagaguagcuccagguucagugagagucugcaccucgagggaauaagguagagagacagcaaaacaucugcccuccucugggcucugugcaggugcacaagugugcgugcuugcacaccugugcaaacacgcaugcaugcaugcauggauacacacaugcccagagagagagagagagauacacagacacaaaugagcacacacaagagagacagacagacagacacauacaugagagacaaacagacagacacacacaagagagagagacagagagagagagagagagagaggcacacagacacuacccacucuggucuuuggcugguggacuaauuucaccagcuaaccaauucuugccugauaauuccacucauucuuagcaacaagugguaagccagaccuccuccaugaagaaacacuugcucccucaugagagcccaggcuucaggcguuucuuuuguccuguguccaagcugauuagucuuagcuggaagucugacuuaauaaugcuuuagaagggauaccuaggcagaaccaucugggugcaaauccucucuucauggcagucuaagcagggccuucggcuucucugcaucuccuucuucauccacugcagacaaucaccgaguuguguucacgguaucuccuaaauaucacucaacacaucugccucagccuccaccacccuuagcuucaucgcagucuccuagaugcccccauaauaauagaagucuuuauuuaaaaaaaaaaaaucacaaauuauagcugggugugguaaaacaggcccauagcuuccucacuccagagguugaggcaggaagauggccucaaguucaagaccaauuuaaacucuauauccagauucucucucaaaagggaacaaacaaauggaaauuauguaacagccuugucuggcuuagacaccaucagcuccguucaucaccaccucuugguuagccugaagccccacuccccuucaugccugacacuccccaccuuuccagguuuguguccugaacuccagcaugcaucagcuaccuccaaacccuaucccaguguaaaagcagcucuuccccucccaggccugggucucugcauuccuuccaagaauucucucuucacucuucacuuaauucuugaauuucaccuccaguggcucccuccagcuuucagucaucaccccacguaauauggggacuguggauggaaacgaucuaugagguucaaauaauuuuguggggcuuauuauuguucaugauucaauugauaaucuauuacuguacccacuuuauuaauuaaacuuuggggcuggagagauagcucagcggcuaagaguacagcucuguaagagaguccgaaucaguccccagcaccgacaagaaacaaacucacaaucuccuauaacucuagcuucaggggaucugauacccucuucugcucaaucaaucucucucucucucucucucucucucucucucucucucucucucucaaaaagauaaaccuucauaauuuaaaaucauguuagguacauguaagagauaaauauaguguauuuugaguucuguguuuucugcuuuagguuucugcagagcacuuaaaaaaaaaaaaaaugccccugccucagauaagaugcacugauguguucccagcacagaguucagggccucgggaaaccugcugugcacccacacuguaccuccagcccacugaugccuggggcuucccacucaccugucuucagagcccuuggaacgagucacaugugagguccuggauggaauuucccucuggcuuuagcucaucuuucaggcggaagccucaccugggcugaguccucagcugccuguggaauuugucacaaaagaguuaguaaguaaauguuuauuggucacaagguucaggucaccagguuugauguuuuguuugugagacaagguuucacuuuuguagcccuggcgggacuugaacucacuauuauauaggccagguuguccuugacuucaaagauacuuggcugcaucugccuccugaguucugagcauaaaggugugugccagcacaaccagcucucucaagguggcucuugaugccuugagaaacaucacuuagguuuuuacaaacauuuuauucaaauuucaucuuuaagauauauuaaauuguuuucauaccguagcauaauggcucucaacguauccucacugcagaccaauagguauguuacaaaacaaguucguuguaaagacguugggagauaucaggucccugccauucucugaugacuuacagaaauauuucaagguugcaaggcugacuauuuuuuuuaauuguuaugguuuauauaauccuuuaucugugugaaggaggaauuucucauuacagugugaccaaaauaaacucuaaaaauaaucugaaccccaaggcuggcuucagacggugccagguucccauaacccuucuacauuuuuccaucuguaaagcugcucucgguucacauuacugggcucuauggugugugaauauaagcugaggcuauagugggaauauauauguguaacacaaaccguuagccauuugauauuuuagggauuucuggaauguuauuugaaagauggacugaacuaucucuuugaaaguuucaaaaccacuaagcgggggaggcaauguccuagaguccagccugccaguaauucugcaaccaaugccuaagaaaacaaagggucugccuggggacugaacccagagaggcccaaccaggaaaaaccacuggagcauuuugcuggagagcgaggugaacaagaauaugcucugggucuccucuggaugcccagaucccugaccucaaagguuuguguguuugccucggugcugacuucaacauggucuggccccuguucagcagcuagggaagcccuugaguaauacaugcuggugcucaaacauugggagccaggcauagaccuagaaccuccuaaacucaguaacaguagagaucagagcaagccaggggaggcuaaaggaaaggagcaguccagggcugggagacucuguucagaauggggaugccacacagcaccucuuccuucuccuacccccaccccacccccagcccuauccucagaccugccuucguccugugacuuuuucaacaaagguagauuagacaccagggucuuuucuggucccuccuccucuuuccccccauuccuucuucuccucccccucccuuucuccucuuucuccucccccuuccucccuuccuccuagucuuuggcuuccccuggacuuuccccgacucuuuaaaaacguucucucucugacagucgacagggaaaggaaagauauuuucuucauugguguaaggcacccaugcucccacaaacaacaacccggcgcuccuguaaauaacaauaaugaaacuuacugggucaugaaauaaaggaaggggggaugagguuagaagguggacuaguugagaaggggaacgggauuaauggagggugggagggacaagauguugaggggauaaaagugaucaaaaugcacaaugaaaacaauuauuaugugcaauuaagauauaauaguaaaaccacuuuuuaaaagcucucucucaguucugccccuguaacuacuguccuaucugucccuagccuucacaugaaacgucuugccaucaagacgugacuguggcauugcgucccucccuaagccagugugccuggacuuccccugcuggaacaguggcgucaucucaaaggucacagcgacuuccugauuuuaaguccaggaagcuuucugggagcugaugcucucaccggccucuguguaaugaugucuacaga

SEQ ID NO: 136 - RNA, 125406 nt, Mus musculus
caucuuugucucgcggccucgcgcucgcucgcucgccgcgcucuccggccccagcuccgggccgcucgugcaggcgcgcgcgcgcggggcgccggggccugaggcggcgggcgacgcccggggggcgggugggggccgagggaggaccgccaagccauggugugagcuccgcggccagcgcucuccgcgccgcgcuccgcuccgaccggacgacaagccgcccgggcggcggcggccugcccgugcggcccgagccccggcgccgccgagccccugcccgucucucgcucucucgcccgcucccggagcggcgacccggggaagauggcgaacgacucucccgcgaagagccugguggacauugaccugucgucccugcgggugagugcggccgcgcccugcgcgccgcgguggacacggacacccgcgggcgcggcggccccuuugucugccgggcgagcgggcgggcgggugccacggcgcucccggggacccggcggggcgagccuuugucaccgcccugcaucccucccuccgcccucucgcccuccucgguuggggucccucuuuugaguugauaaccucccccuccucucucuccaggacccugcugggauuuuugagcugguggaagugguuggaaauggcaccuauggacaagucuauaaggucgguguggggcgccuuuguuccccguggcguggagaaacuucuuaggggacgagggaaagggugacgaaacgcugcugacugcaggccgugccgccuggccaaaguugggaaaggggguuucgccuggcuuuucuuuuuuuuucuuuuucuuuuuuguuuuuuugccuguguucagacuggccuuaaaagaccucauuuccuggcuuugagauaaaggaaauaagcuacacuguuaggcaugcacuuggcuuuagcaaaauagaaaaggaauuuuguguucgagggugaccacagggucuccccccaaacccccuuuccuccaaaucuggccuucaugcguuugcguuuguccgugaauuaaaauucgguguagacaggccuugccuaugacuccacucagccacugccuugguauucuugagacaugucaucgugcuucugccuucggagugcuugccguaggcuccaacuuggggaggcuagcguuaccugguacugauuuuaaagcuuggccagcauacccuguucuaguggacaguaucuuggggaagcgggcgggggagugugcuuuugggccacgggaacaggaggaauuacaguguggggauuauaaaaugugaauuccaggaauaaccuuugugacagcuguguaauugagauggcugggaggagagagagcaaggaguagagaggaugccagacuucacacccgccaccccuggucguucucucucuuuaaauuuauccuccucccugggcugcagaugaagcugaggaaucuguuggccugugucgccgcggagcuggcaccuaaggcugugaacuguuguucauucuguuucgcucgcucggucuagaaggcggcucaggcuccgaaguguaaaaaaaaaaaaaacacaaacaaaacaaagcaaaaaccuuuacguucguucgguuuccugauuuccuucuuguugguaaacgguuuucuggaauuaucuuugcuuggggaguuuucuaguuacugggacugggucaagguugagcuacacacacagagaaaaauuaucuuaugaaggagggcuuuguggcucaccaugaagaauugucauuguuucccuaaaaauggggguggugguugaagcugacuguagacauuuucugaggccaaauuaaguguggauucuuuugucccuuuucagccuugugaauaggguuuaugugcucaagauugcuucuccggggcuccagcuucccccucuccccagcacggggccuggaaggugguauugacaggccugccuguggucagagccugagucaguacucuuaggugaucucaagugaauuagcauguuuuguugguuaacuguuggggccugggccagauuuuugaauuugaaagggagcccuguuaacagccugcugggcccaacugaauuuggaaggcuuuggaaaauuuuggaaaagacuguguugcaacucacuggaguggcuggcugguaacuggcuuaaagacacucuucccagcuccagaguuuguuuaagcacggauugguuuuuuucuaaccuaguuuuucuggccagaucuaaguugugaguagacucuuccaagugaguuagccagagcuuguuuuugaccugauuacacaguaguuggauuguuuguguuucccugggucagcguggaaacugcggguagagaacuaagccagaaagcaguagugccuuuuaaaaggccagcguggguuuaguugguuuuaaaagguggacacuuugugguguuaaucugggcaaguucuuuguccucuaccucuccucuuuuaaccgccccccaccccgcccccaggcuuuugaaguagauuugcuaaacacugcuuuuggggaguaacggggauguguuaacuauacccagugcaguugaaaaauauugaguucaaaucucuuaagacauugauguaaaaggugcguguaacccauacauaguaguguagugcuugguuuuacuuacagguagguagucagucucucucucucucucucucucucucagucucucucucucucagucucucucucucucucucucccucucacacacacacacacacacacacacacacacccuaucuuuagggacauuuuuaagcaugcacacagaguuuuuauagcgcaguuaauagcccaccauugguuuuuugguguacauauucuuacuuucuuaugucuugaacuuagauaacaguuuauugauaagcacuccagguuuguuuuucuucuuuuuaaacauugucccgaugucauuccacacuuaaaacacaucagauucccuuuaguauguccugccuguuucaguacaugcuacuaagcuugugaacugguacagggagagcuagaaauggcaucuguuucccuucccuuuuaaacacacaguuucuggaucccauacuguugugcggguugguuuagguuccauuuuuauugguuggcauggcgugguuuugaguuaggauauuaauaggugaauuuauuaacagcuauaaagacaaauuuuaagaaaagcauuuucggggacaacauuaacugaacaaccuagaguccucaauuauuucagcauacacacacacacauacauacacacacacacacacacauauacacacacacacauacauauacacacaaacgcacacauacauacacacacaugcauauacacacaaacgcacacauacauacacacacauacauauacacacaaacgcacacauacacacacaugcauguauacauacauacauacauacauacacacacaugcauauacacacaaacgcacacauacauacacacacaugcauauauacauacauacacacacauacauauacacacaaacgcacacauacauacacacaugcauauauacauacauacauacauauacacaugcaugugguauguguacccccauauauggguccauacgugggcgugugcacaugaauauggagcccuaaguuugaugucaggugucuuccaugacugcuuucucccugugaauuguggaaagaucucucacugaaaaccaggaccucccaguucagcuagucuggcucuaggcccccuguaucugccuccuguaugcugggauugcugagggucaccauguccaccuggguagugggacucugaauuccgcaagugcucugccuccugagaugcccucccagccccuaugcuugguugaauagagaggcagguugcuuauuuagagggguguguuuaaauaacaugcagagaccggaagugaaagugagguuucuacaaagaugacuuuuugaggcuauguucugguuuuugaaauauuuuuaacacaagcgggcuggugagguugaauccuaucugccauuuuuuuucuuucaaagaggaguuaaguugcuagggagauggcccagcagcugagaaugccugcugugcagucaugaggacaugaguucaaauccccagcacucacuuacaaagcuggaaaugucugugccaguaauguagcacugugaggagguuggagucaggaggaccccugggacuugcccuccagucuagcuccagauucagggagcgaaucauuugagggaauaaggagugugugagugugugaguguguguguguguguguguguguguguguauguguauguguaugugagauagaggagcauauauucugguggcuggguggugaacacaggcauguguauccaugcacacgcacuuccacguguacauacgcuuacaugcauguaauaccccccaaaggugacauauaaaaaaaagaaauggaaagacaauguauuuucuucagagaaauguuauuucuauccuuagguauuugaaggauuauguggaaagauacccauaaaauuagagcuuagaaaaaauaauuugggggguacuugauucagugagcaagugcuugccuacugugagcugggcccucaguucugccucuggaaaccugcuguguaugaaguucuguuuacaagguuguauucagaacaccauacaugagaaaugucuguagugguggccugccugcuuacuaguuguccagguuggauaaauggcgaauuuuaauuauuaucaucacugaggacaauuauaguguagaagauuaaggccggcacaagcuuguugccauguuacuuuggguuuaacuuaccauuugaauauuugaggauugaugguuuuuuccuuggguaacuacuacuauuuuauauuuugcaaacucacugccaucccaagaaggagaauucuguuuugaagagauuguacugugucagagaagaauuuagugguagucacugcugggguggaggugggggugggggugucugugucugaaaucuggguggacucagggagguacuguaguuaaggaggauggaccagaugugcucugucucgcuguccucggaagaggggcuucaugugaacugagagguuaagcaggaggcaaguuuaggcccaaaggccuuguuguaagggcagcuaacaccaccuuaggaaaggcggagagggaugagggugugugcaggaggaagcuugaagaguagccaccgggaauggccagacuagggaagugauugucuggaaggcagucugugggggguggggugggggaagcugaggagcgacgucauucugcaagcacugagggucuguuaguagguauuauugggccugggggguccccaggaugagagaauuucaucagccgguguucugggaagaacaguuaagaugauuggcccgggacagaggaaccuagggguugcagaaugauccuuucauaggggucucucagcaaagaccaugggaaaaccacggauauuuacauacgauucguaacaguagcaaaaauuauaguuaugaaguagcagcaaaaguaauuuuaugcgggcggugguggcacacaccuuuaauccuagcacucgggaggcagaggcaagcagauuucugaguucgaggccagccuggucuacaaagugaguuccaggacagccaggguuacacagagaaacccugucucgaaaaaccaaaaaaccaaaaccaaaaaccaaaaguaauuuuaugguugagggucacccauaaagggacucagcauuaggaagguugaggaccacugaccuaggacauaagucuagaggggagaugucugggcggggccgggaggagauagagaggaagaaaaguugaggcagcagauacuuggcgguuuccccauauaucuaacuugggggaugcauguacaaauuauaggcguugcuucucacuuuuaaauggaguucuuuccgcuagauaggguggaacuucaguagaugggguaggagugcuacacgguugguucugguugcugcucagggguaaagcgccucaacgguugucuggcaagcagagcaucucuuguuccuggggguggugaagccauccagagggcccugagaauucugagcaagauguucccuccugaggcgcgucagcugaccugcagcucaggggcauguuccgacguguucugagacuuggcuuuccuuaaugcuggaaggauccuggaugugggcaagaugggaggaagccagccuguugagcaagaaguacugcuguguagcucuucagacuauccaccccaaacuuuuacccggugcuuccgggagagcagggacaucaaagcaguccgugcuucucugcugccugccugccgcuggggucuugacuucugaaacauugugacaagcugcagacuggcauuuugcuuuuuuucuuggccagcauuggagauguguguauuucuauguauuaaucacaauccaaagacauuaucugugccuuuccgauagcacuuguaugugucacagguugagccuggauaaacagacacaucaaaaaggaauugaacuccuuuuggaguaauaauauggcacagggaagaugugcugggccagagaaccaucauccaaggagccucauuccuagugagugaagguucugugauugaguuccuuagagucgcuuugacaucuaagucuguguguggcguuugguuuguuuccuuuguugguaagcacuugcccacuggugugagccuaggacuggucgucagacaguucucauuuuauucuguuguauuaaguucacaaugcccugagugaucguugcuuucauuuccccaguuauucauuucagucauuuaaaaaaaaaaaagcaagcagcagguuauguaaacaauugcagaaauuaaaugaacacuuuuugaacguagaaggucaaguugcugagacacagcucuggugagaggugacauguggccaccugucaggcccacucuguggcuucaaugaugggauuuuauggacaguaagugcucgaaaguauacuagagucaaggacuggguccgcagagacuucccaucccgcguuuauuagaugguuuuaaggauuugacugaguggcuacaguguuucucucuggguagacagauaccuaguagacuguguuaugcgaaguaucuucaggcaguugcuuugacauuuuaaguaaaguuuucacuguuugguuucucaucuggagucaguguuaaaauacuagacuuacggucagcauucagcgugaggcuucccaggcacuuacuuaacuguaggagucgauuaguuuguuuugcuauaggauagcacaaagguugaaucagggacaucucugggaaagaugucuaggaagagacugaagaagggcgaggaaccacuacaucuacuaugaguggucagaaauauguuuuuggguuuuagaauuuuccaccaguuugccaguaguagaauaugaucuuuucagcuacgagacugugugagugcuacagacugaccgcuggucuuguuuggguuaaagcaacaagcaacaucguuuuuaggacggacugacuuucuuucuuucuuucuuucuuucuuucuuucuuucuuucuuucuuucauguaaguacacuguaguacacuguagcugucuucagcuacuccagaagaugggaucagauuucguuaccgaugguugugagccaccaugugguugcugggauuugaacucaggaccuuuggaagagcagucggcgcucuuaaccacugagccaucucaccagccccaggacuuuucuuguaagacugagacauuagccuauuuuacacaugggaccguuaagagguauuuagaauuuauuuggcgagucaaaggaaauagguacagccuuggguguuuucaguuacccacuguacuauuuccagcauagggauucuuauguguuaguguacuggguguguguguguggggggggggguacugcugcuuccuucagugaaugcaggauagagggacacacacacacacacacacacacacugacagauaucaggguauaugcaugcuuuuguacaucauuccuagguccucagccaaugccccugugcccaggcacaugcuugcuuuuaugagacaguuccucacuaaguagcccuugucuaguuuggaacucacuguguagaccaggaugcccuugaacuuuuagaucugccugccucuguuuucagugcugggauuaaaggccugccccaccacugccagccaacuguugcuuuuaaaugaggcaggcagggucuccuuaguuuaucucuguagcucaaacaacucagucuggucuugaauucaagguucuuguacuuacgucucagaauggcugggacuguaauaaugucauccaccuggcugcagcgcucuuuuuuaaaaaauuugguggcucaguagcacuucuguuuaguaaaacauggucaaagcaggugacuggcaauugaaauggaagguagauuuuccauagaguguguaguuuugcuguggcaguuugcuguaggugugugugcuguuucugagacagucuugccugcaccugggcagugagcugugucuugaagcauaggccugacuaggaaaacugauuuggaguaggcucucagcuccccuuacuuggcucacgagcaggcuguugucagugucuagcaguugacuucccaccauugagaagcugagccaagggaccugugguguauugucaagugucucugauccagcauugugucucagauauggcuaugugugaacauguuauccuauuacauucaaauaauuaagagaaagaaccguaccuuugguuuauaacuuagaaacacccucucuguuguuugauaauagaggguuuagaauguaguaaggucaccaccugugcauagugcuggggucagaaauccuuagaugcuuguuucagaacguggagguauccugcccuucagaggcaucaauuuuuugugcugucugcucuaacuuaacauuguuuuaaagucuguuuucaaugaugguucuuaaaugcuuucaccucccuuuuagcccaucacccaccaaagguagugggaauaaaaggauggaggggguggggaaguggacuuguuuagagagguucuuuggagcaacucccauuuguguugucuggaaaucggcaguucaguucacaggucagcggcagcucgguagacuuguaaacacuucaaggagagauauacuacagugcuguucagaagaguaggauaccaugaaucagcauugguggcaccacuuagcagacacagucaggccucagccuuuguauaagucauaaggaggggccaggaccacgggaacaccaggaaaaguucuccgcugugccucucucauggaagcaaagagcucagcgaagauuugagaccaaugaguauugcacagcuaacucuauaagcaagucuaguucaggcucgucacugucuguuacguuuauuuuauauguccuccaacaucaccugcccuccacuugucuugccucugcaugugucuugccucagcaugugugucucucucagcugacaucacucugccaaucugcuugaaucuucgaaguggcaagaaacugcagcacaccaccagaaguuuuuuugguuugcuucuuuuugaggaguccugaccaacacagcucaacuacacaauguaagguggaccaauacauucacaguuagcagagaauccuucaucacguguccuuucaccagcuugcuuagcaggacgccuucucuccuguaucugcuucagcaaaacguuccuucauguguuugccuuaacaaaacaccauccaacacagcugauuuucuaaagagcccuuagguuuguacuucagccuguuggugcaucagauauuuacugcucugccacgucucccuagugcaugcugagguccccuuuucucaguuuaccaacccugaugacauccugugacaguagcugccgcugcugcugggcugcuguaguucaagagcaguugacuacuugucuccucuucuuguuccucccauagaugaggucgucaucuggggcuaacaugauaguuauagccaacuggacuaugauaccuccuuguuaaaaccgcaccuuuccucuuaaacugcuuuugcucucuuaugugugguaccaaugucacaugauuacuaguccccuuagguacccucagagacaagacaagcaccuggcaguguucagccccucucaccaguuuucccuaacauugaauacauacgauugauuguuucggauaaccuguugauuucaacuuaaccacuuggggguuuccucagagcugggcagagcagacugccccgagaccugguguccagcucuguccugcagcaccucaguuucucauggucaccuucuuuggcuuacuguuucauuugcugaaauccauccgucccccaguggcucucggggggggggggggggggggaagugugcagggugugcaguaagucacugcauggccuugaguuuaucuuaucuagucugucagugucuggagcagccuuccucuaaggacuagggccagaguucugguuugccuuggcuugggugaugugagauagucaccuggugacuguaugaggcaaagaaagggcuacaaacuuaagacacauucucuugauucuaggucuguacuuccuugguaucaguugcuucgagcagugaugcuuucuggccucuagagggcaggcugcuuggcuugcuuuagugccuggcaucaguaacugcucuaucccuuuucaguuuccaaaacuuggcguuuaagacgaugaagaguuuggaaacugcuuuuagaagcuuuuuaaaguuuucucuuauuuacugugaaauguacccuguugaagcuuauauuucaguuuuuguuuuuuuuuuuuuaaaugcauuuauaggccagggcagccuuuacucacugcagguuuaggcaguguggcgaucuggaugagacaugaauacucaguuacagagacucaccgucccagcucacagcaccaggcaaguacuaaugguucuguuuguguggauuugccuuuuuauucuuuaaauuaacucagugcacagcaccugcugaccuucaccugcgguuucugaguucaucucuguggugccugauuucugacuuacacuaagcuuuggauuggggaaagcacuugaaaggugcacuucccgaaucuuuaccuuccccgggcuugcuguaagguuaagucauaucuuuugagccacaaagauaaacuguuuacuaucaccgaacuucgcuaacaccagaaaccaggcuuuuccucagcagauuucauuguauagagguagccagugccaugguguggagcacuaggguuucccuuugccccagauaggagcuguugcccugagcgggaccugguugagaggauggaggggcaggccugagagggaagagcugaguuccaaccugagaucacacaagguggcaggcgagaacugacuccugucgcuugccgggagcgucuguguacacacuuaaacaucucugauacguggacagaagaaacaagugcauuucaaguuaaauaagugauuuucucuguuacaugugaagggauaauuuuacccaucugaguuuccuucaaaaguuucuuagaauauuuuuaugguggugguaauauugugugaaacuugacuuaacuaacaaacccauauguaugugugcauguguguaugugugcaugugugugugugcauaugugugugugugugugagaaugaucauauauaugauuauuuuuaucagagacuugaggcauucagcucagcucuuacucaguguaauaacugugaacauuuugaagcucuugaugugggaguggucuuacugcuguccccagacuucuugacccuccucaguuuucugauguucucuguaugauugcugcaugcguagcuuuuguuauugcaauauugagaucucaggcuaaagauuguuauuugaguaaagacaucaaggacagaccuuucugucgggauucugcgugagacacuggagucuggggcguggugaggacaagccuuccagugcuacuuggugguuguugggccuggguauccccuccauccucugagucuguggugcucucucuuuccauuccagcuucuuucucuuuugauuuccggggggggggggcaaaauugugggugcucagcucuuuccagugauuuaagggcauaauauuuauuuuuugguucacuguccucaaguauuuugagccuagucagcugggugagaccucuuauuuauuacugcaauacuuaacacguguauaaugugugccaggcaccaugugaacaaugaacaagaaagucagucugugccucuguguaguuuaugagcccaacguugggcaggaagagagcaggguaagagaguggugucacagauggagcccugcaagggcugugcgagucagaguggaggaaaaguggauuguuaggaggaaacagugguguccacaguagagauucuuugcgugagucauagcuaugugaggagaaauagauaguagguagauuuaaaagaagccauuaagccugugauguauugucuugguuaauaccaggugggagauuugaauaaagagacaggaggguucugcauuuacuguggugacugucucguucaguuugccuuggaggccaugcugccuaugucugcuguuacuugguauucauuguuuugaauuucauguaccagucuauccgugcagcaaccuggcagacuucuguucagagguggagucguacuaggccuuggaauguguuuagaguaguauuugggaugauacccagagaauggagaugugaaguugacccugugugugcuguaugcacagagaggaggcuacuguuucaggcgcugguccccaugaccuuagagcuggaaaggggcuacacugcugacacugcuuacagguuuugguauaaacccauguacagguuuaaaaguuccucuaguucugguuauagaaguuaaaaggugaaccucguucuucuugucuaagcugccgcacacaguuuuagaucacuugaucaugggagugcauuauuauugcccuuguaguguuuuauuucccagcuguguagcaucagugugugucagugaauauaacgcucacuacucaggacgucgucacacauguagucuguuacuuagcacauaaccgcuucuuaauaacgugaauaaaaggguuuuguuuuucugagcuaaguaaaaugguuuuguuggguuuugaaagaaauaugaauugaguauuccuauuuuaguuuuuaaaauuacauuuaucuuuauauguggcauguguauguacauauggguguuagcaugcaauggucuggggguauagggcagaggacggcuugcuacaguugacucuuuccuucacugggcucagagaucacacucagguuguugugugagggcaaguacccauaccugccgagccaucuugcaggcccacacagugaauauagaccauuccuaaccuuuuccugaucuuacuagaaaaggauuccauagauauuaauuccaguuuucaaaguaugaaguucccuuuguuuuauuuuguuuuaauugggcauugucagcaucaaaccccaagauugaauuggacaauucauuuuucgcuaguuuguugcucaaucugcugaaaauauuuucuguugcuugcuuacuguuacacaaaaucaguauuuaaugguuaaauuuuauguaggauuucuguuucuggcucuguauacaaggacuuguuuuuuuccuugucuuugggagucuuuuuguuuuuuguuuguuuuguuuuguuuauuuuauaaguccauuuucuuugccagguuacuauaauuuuguuaucuuauagguuguauuagaauuacuacuauacuacuuauuuauuuauugggaucagguuucucuuucuagaccaggcuggccuccaacucaaagagauucuccugccucagccuccugugugcuggaaguaaaaccugacuuguaguguauauuuguuccuuuccugugcaccuccuuucuuugcuuugggacugguccguacguauuccuugccacugugugcuggcuacuuguuaugaagcaaagcugaaggaggaaggguuuaucuuagcuuguaguuuaagggcgcagugcauucuggggggaaggcauggcagaaggagagugggugucuggugcagcaggaaggagagagcaguuugucuuugcacagcuggcuuucucugguuuucagguuaggauuccugucuguggagugguggacucgacauguuggauggaucuuuccaucucacuucacccagugugggaaaucccacacugaaaugacuagagguuuguuuccuagauguuucuggauccugucggcuugacaguauugaucaccacgugacuguguuggucaguguucuaaugcugugaagacucacaguuaguugaaguuggcuuacaguccauuaucaucauggcagggaccauggugauacccaggcagauaugguagcggagaguuccauaucuggauaugcaggcaggaggaagagagacacugggccuggcuugggcuuuugaaaucuaaaaggccacgcucagugacauacuuucucaagcaaggccacaccuaccaacaaggccacaccuaccaacaaggccacaccuaccaacaaggccacaccuaccaacaaggccacaccuaccaacaaggccacaccuaccaacaaggccacaccuaccaacaaggccacaccuaccaacaaggccacaccuccuaauccuucuaaguagugccacucacucucuggugacuaaaccuucaaauauaugagccugugggggccauucuuaaccgccacaucccacucucagguccccauaggcuuauuauagccauaucguaaugcaaaaaugcauucaguccaacuucaaaacuccucauaggcuguuacagucaaaacauuguuuaaaaguccaaauuucaaaaccucuucugagacucaaggcaaucucuuaauuguaauccccuguaaaaguccaaauaaaaaaagaucacauacuuccaacauacagaggcacagaaucuacauuacaauccccguagggaggaaggagcaucagugcgugcguaaguacgacuggagaccagcugggcaggcuccaaucucugcaucuccaugucugaugucaaaagucuucagaucuccaacuccuuuuagcuuuguugacugcaacacaugccuuucucuuggguuguuucuguuccugguuugcaguucuucuuggcagucaucccacaacucugccaucaccaacaucuuggggucucugaugaaaucaggguucacuucagcuucacauaguagccucugggcugccauacagggucaucccuuauauaugcaugcuucuuguaccuguggauuugucuguggauuuacuggguucagacaacugguuuuguccuguuuccccucccugguuccuaggcuugggacuccugauguggauaugagccccagaucugccugcagcagcuugcuugcccacccacccacccuccaaguuguuuccucaggcucuuucagggcuucauuuaggauggucacuguugcucaggcuucauggccacccccaccccacccccuuaggacuuguuuuacaaaacccuguguauguuuguauuuguggauaugugcaugugaguuuggugccuucagaggccaccgaagacagcuuguuaagcuaucuaaucugagugcugggaaccaaacuugggucuucugcaagggccauaucugugcacuucugagccacugaggcaucucuggcaccugccuuguguucuuacguccauggguguguuugcuaguagucucaucuaguuuuuucuuaaucucggacauuaguguguguauacgugugugucuguguguauaaaauauauauauauauauauauauauauauauguauguauguauauguauauguauaucaaagauuuuggaucuuuuugauaauuuuuuaggcuuuauauuuucucuaauuuuugcacauaagaaauagcuauauuguuugcuuuaccaauguuauucuaaccugucagucuugcauaguuuuuaguagucuuacuguucucugugugcuacgacuuccagaauguuagucuuucaguagaugccacuugccaugaauuuuacuguguuuuagugcugugguggugguuguuguuauuacuauuauuacuguuacucuuauuauuauuauuauuccuguaaguauucuugaaguuugucugagagacaguucaguuauguaggagaaagccaguuuaucauugaggacccauuucucuguuuuuuuuaguaggacuuagcauuggugagugucucuggcacuagcuuagugucuggugagcucugcagucaguaugugaguaugcgaguacuggcuuuguuccuucaucucuuuucuguacauguuuugucucugccuuagauaguuuccuuauauacauguguugauuuguacuugcugaacucaggcaggcccccuuuuagaccuuggguuccucaugucugggcagccucuguauuccaauuuuaccucugguuucucaaucuacccagccucucagcucuuccucacugagggagcaggcuggucuuugcuuugguuucuuucuucuugagucauggcuugaagguuugaagggagccaguagaccuagcaaccagaggucaggggucagucugccuuucacuugugugaugccuagucuccccuucugccccuuuuccuuucuccgaguugaaaacaacuuggugugugugugugugugugugguucauaugcagaugcagauguguagggcugugguucucagcaugucagaucuccugcacaucaaaugguuauguuacgauucacugcagaaugaggaugugugguaaaggguugcagugugaggaaggcugagagccgcugguuugaggcgagcauagcaucagugccuaccucuguaagucuccuccuggucuuuugaggcguagucuccccugaaucaagccgcagugccgaggcggcacagugcugaugugggcggugaugccuggcuuguuccaugggcgcugugaucugaaaucuggucucuuaaccaagccauuucuucagaccuucuccugaagucagaucuuguguaguuuggcuuugagcuccuccucucucagccuccugggugugggaugugaggugugucuugccacaucuggucucacugcuggcuggucggaacguugaugcaaacucagagcucugccugccgguaaugggguuaaagguguucaccaacaugcccagcaacuccucuguuuuugaugguaguagugacauguagaagagacaucuuaacuuuagaaagagcuuugucuuagguuuuguuugccuguuuguaacagugcuucucuguguagcccuggcugucuuggaacucacucuguagaccuggcuggguuuuaguguguucagaguuccaccgccaaucaaucuggugacauccuucacacagacccauguccugguccuucuagugucugacagcugcaccuuagcccucugccuuuuguugcuggaggugcucuaggcauuuccuguaaguggaagcacacagugacugucuuuguucagccugaugucuucaggguucaagcauguuguagugggugucaguaccuuaugucccccuuuguguagucauguuccauugaguagcuauucaccauacacuggcucaucagcuaauguuucccuuugagcuccuaggguugacgcugcugugggcaugugugugcaguuccuguguagacuuuuggggcuguaggaaucugugcuaacugacuuuuugaggaacugcagagcggguaguuucgugacacucccacagcaguuuaggaauguacgcuuuuuacauccuugccaaugcgugugauagcugucauucuucauaaugggcaugguuguuaucuguccugugguguugauuugaaugucucugacgacuaaugacagugagcaugucuucacuugcuuuuggccuuuugaguauuuuuaugggaguguuuuucaagucuuucaccuguugcuuaaguugagugauauuaugaguuacgaauuuucugccuaaguauucucuguuuguccaagcugcugggucuauaaugugcagcaucuuuguguauucuuggauuguauuugcacuuucuuuaugguauauauuuuccaaguccgcuuuucauuuuggugauaucaaauguuugaugaaauaagaaguaugcuuuuuuacuuaugaugcuggcaucacaucuaagaaccuuuuccuaauccaagguuacaaagguuuauucuugugcuuucuucuuaguucgguuguuuuagcucuuagguucauugcugguuagcucaugcaugcuuuaaguugggcacauauucacccauuuacaccugaguaucuccuugagcaucauuucuugagaagacuuuuaaacuacccuccucucccccacaacccuaccaguuauuuuaacacacuuguagaccucacugagagcugcuggacuccugagcuucgcugcagugauuguugugucugucucuggccgauaucacaacaucuugauuccuguaccuuaauuugaaauuaggaagugggagcuuucuuccggaauaguucauccaagagccugcugauucugccuaucuuuuuacuggcagcggaccuugacacacgacacaauuuuuuuuuuuuaggaacauugcauagcaguugcuacgaacuuuucuguuugguacuuauuccucucaacaugaguauuucuccccuuuugcagauacucuguuauauagcagacuacuauacuuuuguaagggggccucuagaaacauugcuaaguacugcuugcucuauguauacuccaaagaauaauuugauaaugccagccauuucaagaucuuaacaaucuuauaaauuaugggccauacaauacaaaaacaggaugagaucuuucaauuaaugggaauuaugccaauaucuagauguaaaauaucuuuaaaaauuaugcuguaagacguuuucagaacauauauaaguucuguauguagguuacauaccucucaauaucacaaaagucuccugugauuuaggguaggcuggagucuguccauggaccacuaaguaauaguuugcuuucauuuucaagagccauuugguccaagaguucuguuaaauccaaucauuuuugcuuaaaauauucccuguauuaggaagagugugcuuugcugcuucagaguuccaguuugacuaugacaaauggaaaaggucuuaguccuccgucacugggcuccaccaagaauaacauuccagggucuacccaccucagcggccaccccaaaugccucguggaagaguaacuucaguacucaaugcuucucucauucaguacagauagaccucagcucugauccagagcaccaaagaacagugguggagacagggucacaccgaguagcccuguccuggaacacuauauagaccaggcuagcuccaaacucuacagagauugaaggugugggcugucauaccugacuuuuaaagcauaguuuucauugaauuuguucaacuacuggcuuauaaaucuuacugaaagaggaacuaccuagaacccagauuucaucaagcaaccuguugacucaacugcagagcaggaagcuuuugcuaaaauacauuuccuucacuugugaggaaacguuuguugagacauuaacuucaaugcugagaaaauggugguauuucugauaaccuauaaggaacauucuuuucugacauuucagugagggucuuugaagaaaacauugucucuccacuagguacaagaaacucguacauuuauccuaugugacucuccacaagcaagcucugaggaaacugcacauagugaaggucagcucugauacugaccaagcaggauaaaaaguuaaaguccuuucuaaguuguugugaagaccauucugauuuccauguaugcucacuaaagacuuagggacugucugacaggacauuuuguuugaacuguagucaaagaauggaucuuccagagacuauagaccuuuuccggauacaaaacccacuguucugggcccgacauuuacuuccugcuaguuaaaugaaaaccaauuaaaaauggguauccccucaauucccaugaauugcaaguuuauuuacuaauaauccuucccagcacuacuccuuugagacagucuuguuacauugucuuugcuggcccuugcuagccuugaauuuuagcagucucccaagugcugggauucucugcaugugacaucaugcuuagccugguucacgauuuucaccauucagagaaugugauaacagcgugaggccucaagaaguaggggaacagauguguguaagcaaauccugugcucguucgcuugggccaccauaacgugggccacuguaucgugaggccacugccugggaggcuggacagcagcgcuggcuuccuggguccuagaaaugggacuagagguugugggagggacauuacugggcuccugaggccuucgugucuuccugcccuguggaggcucacugucucuguuuccugugacuuuuccucucaugccuuccuaguguuucucuuuacgguugaguuugcuacuccugaaaggaaaucugucagauuggauugggacucugaauuuuaaccaauauguuccaagcuauuguaggguaagacuucaccuaggaauuuugagagagacucagcugccccauaacaauacacacacacacacacacacacacacaccccaaaacugcuugaguacuaaugcauuauuaacugaaaaugaacagcaaauauagugggcauuguaaucagguagguggcauauucacucacaacauuaaugccagaugcuuauuuuagaugauacagauacagaauugguaagggacaaacacagcuccaugcuuuuaugugguuuaaggcaacagggaguaaaugugccuuuccugggugaaaaccgcucuccaagcuuacuggcuugccacgucauuuugcuuucucaugaucaucaucaggccguggauuggguccaugcuggcacaguggcucuccuccucucugcuccaaccccucagcaacugcugugucaccugguaguuaacuagaaguguugugguauaugauaggguugacaaacauuuaaaacaccauagucuuuuuuggucacauuaguuuucuccucccuuuuuuucucuuuuaaaguaauguuaaagaagauauugaauguugggggauugaggugggggauauaguacugaccuuuaaaaaauaucuucauucuagguucuaugacccaguauaggggaaugccagggccaggaaugggaguggguggguuggggagcagggggaggggauaggggauuuuuggaggggaaacuaggaaaggggauaacauuugcaauguaaauaaagaaaauaucuaauaaaaauaucuucauucuagcaaaagucuagucaccauuaauuacaguauuugcagaugagcaugaggagguaggacaauagcagagugacccaaauggcuuggaaccuuugcuuucgcuaaggcgccucaauucaugccuggcaaugcuagcuagacuugcuuuucuuagcucaacaggaaaugagagcccggcucuguagaggaagucaaauacacccagcuuucagugugcaggcuccucguuggcugucuaggagaacaaucagauugggcucacucuaaauaaugcucauuuugaaaaggaacucagcuacagcuacaguagacucugauucaguaggucuggguggggccugggacucgugggucuacucuuccuccauggugucaaaguacuuccacaccgugaauacugaggaugcagauuguugaagucugcccagcguguugcaggcuaggcgacugccuagggguuucauuggagcagaccuaauccagugccagauuuggauugagauuguaucucaugugugcaggaugaagugucuugugaagccacgcaaacugaugaugugaauagauuguagcuuuuagugaggguucuagguuuucuaggacuuaguggagacaggauaguugagauggccacaucugaccuuuggguacacagguagggggcuuuauggcugcucaggucucaguuucaccaaggucgggggucuccccccccccccccccucggggaguacagagucaugccgcugccuccuugccaccacugguagcaguugcugaaacucgggaucccauuuugguugcuagagcacaucuagcagagaaggaacaguguuugagagagaaugagcaggaggccugccuuccgagugagggcgacagaguuggcccaggguagaggguuccuaguagagacacaagaggccauugugguguggaagagcugcagagccauccggugacagcuuucagacuacagcugugcucugagucagcaagggugggcagguagaagcgagacuuucaugcacacccguccccguuuugaucgcgugcucuuucuugcaucuaggaaagcagucagggaaaggugccauugacagagaagcuucagaccagguugugggaauacaggugccagaagaagugggugggaggcaggaagagccugaggaguagaaggagacugaggaagaagcagauucgcucuuaguuccugcaaaggucugcauggcagagaucugcaugucuguggggaauggugcauaagaaucugcuucccucaccucuuagaaauuccuaagaccuugugaggcagagggacucucgccccagugugaaugccgccccucccccucugauugaacuaucuuugucuucccacugauagcuuuaucugaaguaaauuacuuuccggaguuuccaaacuagugguuugaaguaaagagaaaaacugcuaagcuauuugaagauacauuccuuucuaaaaauucucaaaguuguugacuaacuaaaaauucuugcagucacuucagugauuuuugccaagauuguuucauguuuguuuaauguuguuguggguaagauagucuugacugcaagaaauagaagauacagcugaguuucagcuagucacggggcuguccugugacaaaguggcuucgggucuagaguuugcugaguuuccccuuggucaucuuaaggauguggcucuguccugcauguccuuccuagcugcaaccucucuuaaaaauuuuuauucuuauuauuuuaacuguaggcacgcuaauaaguguuaauuuuuaaaaucaguuuuaauuuuuaggcuuuaauuucuuugguguuuuuuuuuuuguuuguuugguuuuuuuuuguuucaauuuauuuauuuauuuauuuauuuugaguuuuucaagacagaguuucucuauguagcugucugucccugaacucucuguagaccaggcuggccuugaacucagaaaucuaccugccucugccucccaaguggugggauuaaaagcaugugccaccacugccuggcuucuuugguuuuuuuaagaauuuauuuuaugugagugucugucugcauguauguauguauaucauguguaugccuggugccugcguucuguuccuaccacccccagguaugacuccaaaccaucuguaacuccacuuggaggagacuccaaggcugucuuccugugagcaaaccacguggagcaagccaguaagcagcagcccuccauggccucugcauccaucagcuccugccuccagguuccugcccugugugauuuccuguccugacuuucuuuuaugaugaaccaugaggaggaaguguaagccaaagaaacccuuuccuccccggcuugcuucugguaauggaguuuuauugcagcaauagaaaccccaaguaagagacagccucuuccuccaaaagcaugcaggacauguuuucuacucuaugcagagugaggaaguaagugguagucauccauaccuuuccagccugaggacaggauaggcucucacagcacuaaggaagcagauuccuaccguggacuaaaucaagcuuuccacacaguugaguuguuauaaaugacauuagucaucacugcuauaguugguguuaauggucaggucagcaccuaggaggcaagccccuuggcagggucagccucugagacaccuuaacaggucaacuugaugugggaaggccccucuucacugugguagggaccgucucuggaggcuaugcuggucuguauaaagcagugggcaagcugagcacuggcccaucagaucacugcucuccccgugugaguggagaugcacuguaagcagcgcucucaggcucuugccaccgugacuuccuccacaggaaggaccaugaccuggaauugugagccaaauaagcccuuugucccucagguugcuuuugauaggcuauuuuauuuuaccaugacaggcagagaaacugacagccaucaacaaugacaccccuguuccaaaggaaacaaguauggaagaaaagcuuguaaaggauuuccaacucacuguucggucaggucucacaccagcacuggcugcuugggugcacuacaguguccgugcucaaggaacccccgaggaugcucaccucgugccuguacaaacuguggcugcagcacaggcauugguuuuauuuauuuuauucugagcuuccuagugacugcacugugccagcgagccugacuugcugcucuuggguacugggaaaguguuugauuagcuauuaccucucgguuaaccacaaacacugugccacuguacaaagcuaccggucugcucugggagaaagcuuuuacagcuugccaaggugauucugagcaacgugagcaacucugucugaauauuuccuuucaaaucucuucuuccugcuuucucccuauaauccaugguaaacagucuccaaacucaaaaggccaccgauagagaagaugcccugggcaggugcagcuacauccagcuaaccccagcagcuguuacacucgcugaaagcaggucuguuauguggcugguuuguugcuggguuuggguuguuuuuuaacgagguaggacugugcucuaaguacugcugggaaagugaagcuuugggacaagucucccgcucaaugugaaucacacuuccucucacagagcugucagaagccgaggccgcacccugcugagccuggccuggcuccucuagugucuucuccccuugccagcccucuggccacccuccucaaggccugcagucuccugggaagggggcggggggucuuacccagaccagaccagaggucaaugucccuucccaaaggcgguugucgguggguuuuggauucucaggcugcuuccgaggguuaccucuguguaucgacauguuguauugauaguugccaguagccgucaaauuuacugucuuuuaacucugaaccuacuaacuugauaauggaaauuacuaccaaagucacauuuguaaaacugaaacguuaaaucuauacguacagauaacuagacaguuuaaauuagaaaaagugucaugaauaaugcuaagugcaguuuggcgugacuaccuacagugcuuugaaaggucaaaaucucaaaucugguuuucauuccuaugaaucguaggaaauagucuuaaaacuguuagucucugaagacugcccgucugaugcaaaggcuguaucaccucugcccagauucagcaagaacacuucaacuuguuuuucuaaauuauauacugguuauaguagauagacauagugauuuuucucuuaucaagaaaacguuuacaaaagauuucuuuuccugaucagggacaucgagacagggucucacaagcccagacuacuugauauugaauccuucugucccagaauuacaaccucgucuaacuugcucaacucaaaugauuucuucauuaaguugcauuaguaaauuuccugaaaucacaaccuaggggacugaaaggcaugcucaguagcuaagcguugcggugaguuuagcugcaucgcuuugugcucccggcggugcagggcgcacauuuacacccacccaccugggacucuuuggaucagugaaugaaacacacacacauuaacuuauuuuugaaaugccuuggcuacucaaaggcugggcaguucuaauccuccacccagcuaucauagauuucccuccaguacuccugacucaacacccucuaaaucuaugaucuaucuuugcugcccuguuccuucuggguggaccuagucuuugcugcccaagacacuucugggcagcccuguugggggccacauuucuuuucuccuacauuucagaugauuuuccuucugcagcucuaaauuugaucugucuccuucugaaacauagcgauucucucucucccucucuuccaguuccuagcccacacaaucuaagggucccuccccugucauuuacccagucauuggccauuggcaucuuuauugaucgaucaaaaaccaguuggggacaaggaccuugaguguuuggacacacagauucccgauuaaaucaagcauuagaaccaauccucaacagccgagagcgcuuugcuggucuugcagaggauuuggguucugggcccucccccaucaaucucuaauuuagaaaauacucuaccuuguggaggcauuuucucaaucaaguuucccuccucucggaugacuuuauguugggucaguugaccuaacguuagccagcuggggcuaucaacaguacggauugagaggguuucagaaucuguuucuuacuguuucauuuuccuuuuuccuguuuugagggcugaacaagcuccucuguguguuguauauagucacaucauugaaaugauguuguauacaccaaauguuggcauuauaguaggagcauauagccaugcauauuugaggagguucucucucucucugucccucccucccucccucccucccucccucccucccucccucccucccucccucccuccucccucucccucucucugucuuuuuuuuuuuuuuugcauguaauuugaacucauuuaaauugauguucuauucaugguuucuuaaacauuuuguaguaguaauacagcgcagaguggccguguauucugguuguauaucaggguacaggcaagcaaaagauuccagaucaacagacagcagauuuaugaguaggcuguaauuuacuuucuaaacaaucggugcagaacuguugagagucacuguuagcauuaaguugguuucuuuucuuucuuuuucuuaagguucauuuauuuuauguauaugaguacacugccgccauguaccagaggggagcaucggguuuaagaaagcuuggccccuguguugcuuacaugcauagaggggcagcggcccuuggcagagcacagcucaguucuuggauugggaaagcuuuuaccuuaagacauugagacuugaucuucugaaaguucuucuuccaaagcaccaacuacuuacuuuuuguugcaagcaucuguuuuuauccuggagauuaaaagaaacccuaaaacugcccugacugacuugacccugggaauuagagaaugguuaguuaguccaguuaccugcucaggugacagaagucuccucagcaccccuaguuagccuuuuauccuccggcccuugcaagcuucuuggcucacggucaccaagccgugucucugaaguucuucuggaacuucugcccuaacggugcuaacuagauuucugagcuucuccacgucugucuguauguguucggaauaccuuuggaugugcuccaguuugaugauaagccauuuaaaacucauggugguuguugguggauaguagccaaguuuucaggauguguccauacagucgcagacgagguuucugagacuggagcagccugggaagguagaaguggccugagucauaauacuagaaaguggcagaaagggaucaggagggacccugucacuggcauacugacggauuaauuaucuugaguggauucuagauccugucaugucuuugggccucuguuuccuccucuacugaaggaggugugggccuacucaucucucaaguguggaguguuuucaaaagaugguuguuguugucaucuaguauggaguuucacuaggagguaaucaggguuuguaaggcauuuggcucacuucaaacaaacaaaaaugggugcugagacaucuuuccagcccuacacucuuaaaguauuggcuuacuuuaguuuuagguguaugaguguuuugcuugcagguaaguucaccaccugcguucagugcgcauggagguccagauccuuugaagcuggaguguaggugguugugagcugccacgggggugggggggugggggcgggggggcuucgaagagacaaacucugguccucuuaacugcugagccggcucucagccccacaguuugugucuucuucugucaguuaucgucaucgucuucauugucauuguuacuguuguguguaugugcauugugcaugcuugcauguggaggucagaggaugucaggaucuguuauggagucuagagcuuacugaguaggguagacuggcugacaggcccugugucugcucuccagugcagggauugcaaaguaugccccacugcaccccacugcaccucacuuccuuuuccaugggugcuggguucuaaacccaguccuucaugcuugaucuagggaauucggaagaaugacggugaugacucuuuuggaucagaguggguuuaagaucugauggugcugguucguucagaccuauagucccaagaggcugaggcaggggaauuaggaguacaggaucagccugggccacauaguggguuccaguguagacuagaaauauuaugugauuguuccagccugugcaugguuugcugcaguuuggcagguacuuaugggugcugugccaugaagaauugccggcagccagauaacuuacgggcuuuucucuguuguuauucuuauauuucauucuucauuuuguuuuauguguauuggcauuuguguuugcacgugugucuaugcugugucugaggagugcucacagagguacuggauccucugugguuguguuacagacuguugagagagaagagggaaagggagaggagggagcggggagcgagugagcagggaauccaaccuggacccucugggagagcagacagugcuugcagucauugggcuuucucuucagcccugggucuuagucuucauuaaaaguccauuggugauaaugacauaucagcuggggccaacaagucacaucauggagaucacugcaggcccuucuggaaugcaggaggauguccucucaggccuuucuggggugcacaaagaguucauugaagaccuuucuggggugcaggagggucaucucuuuucuucugcauuucuguagcugcucagguguggcuuucuagaccaucaguaaggugucaggguuaacuaaaaacuugggaugauuagauagugugucucuuucaguauuuaugaaggaaaagaugguucugugagugaauuggcugggucguuuuaugugugauagaaacauuucauuugacccuuuuaacuuucuacuuuguuuauaaagcaaacauuugccagaaacuguccucaugcaauacugauguaucuuuaaggauccaggauaacagcaacucuccccaggggcugcugugucagaauccaaggaagauguagggucuugcacgggcuucuuccaacaggagacauuagaaacaaaauuguuuuugucagauauugcucaaaagauauagcacaugagacuguugaagauucuaaacuguuuuucuuuacaaguccucuggcugcugcagggauaggaggcacaagaggaaaugaacacggaggugcauggaagcaaguguaagugcuagagacaggaggagcauggagggccaggguggcaggccagguguggcugauacggccaacuguuaauuucuaguggcuuugaaugccugcugccaggcgcuuucaggacaguucauuguugauguuaaagcagccuguggccuccaguguuggaaagccaguguggcagacuugcugccaggacugcugcugcacucaggguccuuccauuggcucucgaagcccacacuggagcccucuccugcccagccucugccucuguucauuauagggcuuuagucuaucagugcaguuuccaugcugugacagaccgggagacccguuuugguugcccgugguguggagaaagccacccaacaugcauucccucauugucacucucucuaagcuuucuguugggcccuggcucuuaccucauuuccaccucacacuuaaaaccucugcuggccucugccccaucccucccugugcccugcuuauaacugcagguuugucuguugccacagcacaccacagucuuuacuuaguguuaagggucaccuccacaccuccuggcuuaucguguagcugaauucagccuagccugguguaacccauucuauucuuaauuccagccacccuaagaaguucuguuagccuaucuuuucccgauucuccuaccgacgugacuaacccccuagcaccgugcucacuccuuaaugccuguucugcuuucacagugcucugcacgucuuacugucagugacaguccuuugagaugcagaguuagugcccaugacacaguagguugggcaccugccggacacuacauccacauuugugggaaaggugugauuaagauuaagagcccggcagcauuaggcuucgcagcuccuuucuucgugcucacccugcucacccuucuucaucuuccuuucuccguugcgggcucguuuucauucucuccacuguguuauccugagcuguccacacacaggaaaggaaggagguugggcaauuuggggugcuggucauggaaguuagucauucugacgaguccgugaggcacaggugauaaagcugcucauaaacgcuaaucugagauuauuucucacccagaagagcugccaucugguagcuguagaggcagaggcucuugugcuguugcuuguuauauaguaauccaugggccuuaccuggcugaggagcuugcuguuuucuucuugacuuugagauuaaaucccaugggucacgugguuccaaggaauguagcaguguacauccuugcuucaagugacuagugaggucuugccaaggcgagguguuuuucuuucuguccccuccgccuucgcuguuacuaauuguugucucauuugaugaucacaguaagauugggaaacacuaaguaguuaguuacguuuggauaagagacagcucugaaguaaucuguggcgggccugcccagugccucguugagcauggugaugaaugcacacaggagaaauccugugcgcucuuucccagcaugccccuccuuugaaccacucaagacagggucuguguuuggaacaggugacucagaugaaagaaaguuugcaaaguaaaacgguugucauuucugccugcuuguuagcauucagggccuacaggaaugccuuuccccucugcccccucucuuccugagcccucaugugaauucuugccuccuuuauuucucuuuacacagacuuggcuuuccagggaugcguaggacuaccaaagacugccugaauuaauaucggcugacccugcuguguggcaggcgacuagcuaauaugcagucuuccuguguggcuccucaggcguggggccgagucagcggagacugucagcgacaguugagucuguguccccuccaaggagaagaggaagccacuucuuucugaagccucuaaaguaccuuucacugagaaggugggacacuugagacugaggguucacauaaacgccuggccccuaauucacuggaaacuuucaaaugcugucacaguuuccgcugggaaacugacuuuggcuugagcguuggccugucacgggguaaaacugccuuuauguuuugacaaaggaaugcuucuagucuacaccauaagaaacaacccagauuuuaaaaagcacacgccucuuuuuagucuggggcaguuaaucaguuugaacggaacaaaacaauggaagauaacuuagugcuuugagaguugcauagagagaaaaaaauguucuacagaaggacuuuuggcuuauuggugaaaaaugauauaauacuaguaacccugguguccguuggacucugugcucggcagggcucuggcucuggcucuggcucuggcucuggcucuuuggcucugugcacauaggaugauugccuuuucuugccccucuugugcuugcucacacgugcgcucucuuuaggucccuaucaccaaauuggucaugaccuugagagagacugaaucggagugacacaugaggaccucauaggaugguggugugcacuaccugagauggcgcucgugcuacgacacacgugauggaguagccaaugggauuugccaucucaucgcuccuugguccauuuugguagccaugcuguuaaccaugguuccugugagguagcacgugugacuuuaaggcaguccaaggcauggcauccagguggagcugcccauucuccacaucugagccagugagggcccucgcucuggauuccucagucagcagacaacaguggcauuuguaaaaccacacuaagugacgauggagcuucccaaacaugauauuuaguugaugucaggcuacaguguggguggccccaaaggaacgguggucauaagggcauaugccacguggaggguguguguauucuugaugcaggaguccugagacuuuccuugaccugacauuucugcaguuuuguauaacguauggaguaaauacaaaggagaaggaagguccuuuuccugacaucaccuuccaaaugcccugcuuguggggucuugccauguagcccagguuguccuggagcuuugcuugagccccgaggguaggcugugggcacuggguagguagcagcagacauuaucucucuaauaguucacauguugugcgcugggcaggugguuugguucaucuccccccccuccccccauuuauucauuuccuguguguuuguacaccacacagggaguggagcgcagugagcaacucugaggaauucuuuacuugcaccacaugaggucuaaggagcaagaccaggcgguuggugugggagcaagggucguuaccugucugucuguacaccuugccagagcagggcucuuagugcaguggauguuccuuggaggcugccagcuauuuuccuaguggacucggugcuguauagagcagggcugauuacuuaaauaagauggaaacuuacgucuucuacaguggauacauagagucugugauaaaacuuucagcccuagaaauuaacucaguuuacuuaaguuagagacaguuccaucuuuguccucuuaacuuugagauucagcuguagauguuggaacuccggccaucacagugggucccaccugucaccauguagguaagcucuucucccuccucauggcugggauggacucuggcuuucacaucaaaaguacaugugagggaagggucauccugaacauguuacaggccuagaacagaagguguugcaucuccugggagagcaggacguucugucaaggcguccgggggacaugugcugcuugggguuuuacagugauuuauuaucaucuugauguuuucucccacaguguauugugccucucacuuacucuauaaaucuagacuacuccauaaggaauuuacuuucucuaguacagucacaauuugaaaccacucguugacccggugucugcaguagucugugaaguggaguacuccacuguagcugcucauagcaggaaagauugcagucaaccuaggcaagucuguggccugucuugaaccauacacuucaccccuaaaaggauccccacgacuguugcuccuguugcugcagguggcgaggcggagcuuuggggguggggagcguuacuucacucaaggcaggagaguggggaaacuuugugggaccucagaacccuggggacacuaaugauucuggacuguaagcgauuguuuucucccuuaaggcuaucccagacucuguggaguccugguucgugcucaguuggaucaagggcauuuuaccuugucuccuuccccucuggaauuacucagcuuuaaauucuaguguaaauugugauucuauucaccuuaacaaaaguuugauuuuuuuucuaaguaaaaaacccaaaacuggaaacaggauuguuggcuuauguuuugggacaggccacccugcuuugucuccuuuuaucaauuauuagcgauggguccccaugaaauguauuuaucugauucucaguacccuuauuugaaaaaaacagagccauucauagugacuaacaggguuguaaacuuaagcaccaagugucucucucaaggcugaaugucgcaguuguuacugcugcugugcuggacacuggagaaaggaggaguauuggucuagcaguccugaagagcucacugucauuccgaggcagcucugccugucagcaauugauucaauaugcggugguagaugauaggaugccauucacauugaaggacagaguagcuguccaaggcaauggggcucuguacugaaagccuggaguaagcucggguacugucugacuucagcgauucacuuuggaugagguuguuucccccaagcuuuuuagguugaguugcuucuugucuccuugguuuccugagccgcacucccagcacuccccgcacuccccgcucuccccgcacuccccgcucuccccgcacuccccgcucuccccgcacuccccgcucuccccgcucuccccgcacuccccgcucuccccgcacuccccgcucuccccgcacuccccgcacuccccgcucuccccgcacuccccgcucuccccgcucuccccgcucuccccgcucuccccgcacuccccgcacuccccgcacuccccgcucuccccgcacuccccgcucuccccgcucuccccgcacuccccgcacuccccgcucuccccgcacuccccgcucuccccgcucuccccucccgcucucucgcucccauccuccugcucgcuccuugcuugcucucccugucccuuugugcuuucguuuuauguuggcuuacagugaauguguguguaucaaagaguaaagcaucuuuacuggagugcuaaccugggcaugaacaaaaacgacgagcaaggacuucccacuuccucugcugcugccucuaaaccggaaacacaaaccugguggcagagcuuaguggacaaaaguuuugcugaguauuugaugcuuuacauaugacaggcagucuuccucacauugcuagaagugacaggaaaagaguccugugucaggucagucacggcccucacuggugcagcucgcgggaaggaggagcauugauuggccauugggaucaaguguguauccaggcuccagucacagccacuguaauccgcuuccacagauguguagugcgcccccaugcggcagggccacgugagugcuucguggcgauuuuguuggaaagaugcugucacccuuuguuucuguucugucagccccaccucagaugcgguuaccguuguuuuguuuuguuuuguuuuuguuuuuucccaagaagaaaacuacuacaaugcccucuacugcugugccaggggcacagacgagcuggcuguuuggugcugaauuugauuuauaauuuaaugaaauuuuguucauuaaaaauguaauuuuuuacucagugaauuuuagauguuagauuuguagauuugcccuuugaguaguacagagcacugugcuguccuuuguguuggggaagagagaguuugccugagucuuggaugugugugucggcaugugugguggcaugugcaggguggguggugccugggagagcuuccaggccuuguccagguggcguuacuguccacacaaaaggccugcccacuuccuaguguggaggcacaaauucuucauagaaacuugaggcuuuuagccuaaaguguuuuuaugaaauagaagguuuuacuugaaaggaccauucacaacuacauagguuaacaaaacauuuuuggguuccugcccuuuuccccagacagaguuugaaguuggcaucccagggaagaguugacucugaggguguagguugaaacaaauccgacagauugguuucggguaguuuuugcgcacuuaggucccaaaaagucuauaucucguuggguccgaggaugugaugugaugugaugauucuggucucccuggaaggaacaggcauugcagggcuaggauaauuaaagacuuccuuaaaggagcgagcagguauucucagcuuguaauuagaaaggucuguacugcaugugacugcaaauuaaaacagcucgguuggagaggagucugcuuggugagcccggcagccuuguuuauuucuucuuuucccaaaggacugcuuuucucccuuaaguuauauagggauuagagaagcagccuggcacacagaguuaucaacaaacagccacaacuagcuguugcguuaucucaguacuaauugugccuguguugggacaagaagucagcuugauuacccuuuacagccgugaaagauaauccacuaggcuugggguaaacugcucucacuuguuccaccacuuuuuaaaaaugauuuuagugaggaaacccuuuggagacuucuugagaaacuuggagccauugauaauaacuuugccauuaggcccagagaagcagacacacuuugaaugucuucagcacauugauaugcugggcauaauuguaauguauuuuccauguguucaaaggagcagccacacccugagacuguggguguaaaacaguaucauaguaauuuaggaaguaucccggagaggcucagugggcuuugcacauaacucuauacccugcuuuuuuggcauuugaaaagucuaaaguugagaggguaaagcugcugagagcaugcuaaauacccuggaagaguggcuaggugggagugucuggaguggacucagaaggacaucuucugaugaucaagcaaagcaaagcaaacuacucucccacucugaagccgggcaguuugcugugaggugagggacuuacugaagcuucaaguguccauauaauuuauauucaucacucuugauucugaacuuggggauagcaggagacuagaaauaaagaaugaggaaacauacccaggcuggcaggaugguacaacaggagaagguuguccgaacucacacccaucuagugguggaugcugcuucagccaccuacuguuccuucucauuccacuucuuuguaaagacuuggcuugaugugugugugcaugugcacacauuuacuaucuauguguauguauguguauguaugugugcauucauuauguauacuuguguagguguguaugugcauguguagguguguaugugcauguauauguguguauuccuuauauaugucugugcauguguauguguguauuccuuauauauguuuguguggguguguauguggaggccugaaguaggcaucuucuguuguuuguuucccaucuuaguuuuugagacagguuuuuggucgauccuggagcuugccacaccaggaguguuuagguggguagugggcauccgagcucagcuucuccccuuuccugagccaucucuuuagccuaucauuucacuugcuuuucacuuagguaguuuggcugucuccagggaugacagcuuagcuuuagugcugauaagagcagcaagacaggaggcagugccauguccuugcauggcuuaguccccaaacccuggccggggugaugugggagugaagaaagcagacacggggacacagagaaggugggaucaggugcucuagggcucuggaaaagcugcagcauucuggaagcucauuguguuuauuaauaaauacacuuaaccagggaggcaggguugucgcauacagcugcaaaaggaggugaggcugcuaacauagauacacgaggagccaugguuauacacaaggaggcagcuguagcuaaucucugcaggagcagugucugcaggggagcggccuucaggcuguaaacaucauccacaggagaaagcugcagaggaaguuuucugcacacaccacaucaucugcauuuguacgcagagccagggaaggcuuggcccuugccauuccucggagccacaccugggcaggcuucggcagcuccuuccguggggcugagacucugggccuuggcacggccaagcucaugucagcgcacacacucagggcuccccuacucaccacauggcauucuuucuugugccacucgcagcucccggguguccugggaaguaggacagagcuuucacaacggugcuugaguuaugaguuagcauucugugaagaacacuuguacacaguacgccugcacacaugcaugcaugcacacacauucuuaucaggaaaagucaacuaagaaauagccgaagucgcugguaaguccugaguggguuguauguaggcacagccuucccagugcuguuccuccuuuccugccaugcuugugggguagagcgguagaauuccaagagucugcuccuuuccugcuucccagacacaguauggaacuaugagaagcagcacagccuuagaccucaugaagcgccucuugugacacuucuuguccuuuuucuuuagcacgugcuuauuggguaccuagugaguguuaguguauugcucuuuccauuuauagaaauaaauggccucuguucgccuuuacaaagcagacaguacggugagguaaacagguacagagcagauaauuccauaguagguguugaagcagaugauaguuucauucaggcacaggaggguuguuaaggacuuaaaugccaucuacgaggaacagaauuuagaagcuauaaugagaauuuuaauuucuuuuaaaaacacagaaauaaaguguuuuuguuuuaaucccugauguugccugugaggcugcuucagauuguccacagcagcugacucugauuugccacaugcucuagcaggggugugauuuuuccagccagcuuauaguuucugcgacugugugacauuuggaauucuggggacuuuuuagaggguuuguaaauacuagggccccaagagguggugugggugguuguuguuggccauaguuuguuaaguaguugugcacaaagaagaaacaagaagaaauuagcuauccugacugcaaagaucaaucaauacccaagggacuugaugccccuaguuggcaggaaguagucuaacgaugaugucaucucuuucuacucuuauuuguuucuucuucuucuuuuucuuccuccuccuccuccuccuccucucucaucuaguguuagugagucaaaaggguggaaaggauggagaaagguggaagaaaaaaccccacaaaguagccaaagucuggcuccaagaagcuauaacugugcggagcuuuacuugggcucucuggguuuucgugcaucuccaguuccuguguaggugugcaguugugaagaacugaguguugagguggacacgcuagaugaugagugaggaagagauuuguaacugacugggagagugucuuuaaaugucauuucauacacccgggucuuugcacugugaaugccuucaguggagacacuuagcagacauuguaucccaguccugggugucaugcauacucacauucuuaaguagcucugcuuuccauuguauuuugacucgguguagagcuguaggggccagcacaguacucagcaucccggguaaggugugcugugguuccucggcuuucugggcaguuuuuguauuugaacugugaguagucucgcccucugugguggugaccuugcugcugagcaugugagcauuacuagcugguagccaguagugcucucugguguuugggguguuucuguucaguucuuugauucuccuauuaugcuuucccuuggagccaucccuucuuccuuccagaguuuuaaaguggauugaaauauaaugaaguugaagucugauggcaugcaauagggacaagaaggcaguguuggaagucuggccugugagucagggaggggagccccgaucaggcugggccacaggugcgagguucucagcuguguuccaggugcccagcacuucauucagugacucaugugccuaucugacaggagccauuaccucauugguucaguuuugcauugguucguucuuggcugaagagaggaugccacuccccuauuaaccugcauuuucucauguucugauucauuuaauacuccacccauuuucucaagaucucaguugacaagcuuaugccugugacagaagcuccuugguguuagugccacgguaaagaaguagggagagaaacaggaugauccggaagguucauggaggugugcacucucgugugucagcgcucucgugugccaguaaucuguuugagauguuguauuuccauugagcugaagagaacaugggagacuuuauaaacuugcauuuccugucugugacuguacacccugaaaggugcuggcuuagaauucaagggcauuccacugaacucuacugaaaaguucaacuacagucacauucuguguugucacugcuggguccugucuugugucugucuauaaaaccaugccagccaaagugccccuguccugcuuuuccuggugccagguucugccuacagggagccuuggcagccuugugcagauagagucauggcaccaagggcggcacagagcauuggacaauacuggcucugucugcaucauaaaugacuguggcaacaauagcguuuacuguguguucugugcaugcuacaaguuguagagcuugcuucugcuuacacugucucaguuuauucuucagauuauuuucuuguucuuagguaaugagacuuaggcuuagggcuguuuaugaagcuuguuugacuuuuuacugagcuagucgguggcagaguugugaucugaggucuuugaaauagaaguguuugaguguguuuugguauuuugcacacaaacauuuucguuaugcugccuggaggaggcugucgaaaugugaaaugcauucccuggagaauuuagcgguguguguguguguguguguguguguguguguauguauguguguguaucuauuuuuauugagaagaaaugaaguuauugaguggccucaucaggcucugaccuaggaaacacaguuguagggauuucagcaagugugugagccauuuuuauuagcuuaguuaucuuuuuagccauuuuguccacaaaugcccacugagucguguuuaaccugguaaaaauauccccaagucuaacagauaaucuauuuaaacaguauucacuguagacauugccggcacucacagguguucuccugcggcuuuggaauuaaucaguuguggguuuuauaaaguccccucauucuuguggcuuaaagaaugaaaucaucugcaugguuugcucuucagcaaacaucuugucuccugcuggaguuuucccguggacuuucaggggucacagaugcagaggggugguccuagcaagagaggagccaggcucuagcaugagugccuagcccugaacaacauugcugguuuucguuguuggcuauuuaucugcauggucuuuguuuucucucugugacugagagucugugcagggauuuguuaacaguaagucuucuuguugcugcucagauccagggacugggugcugguguauuugugagaaaucacuuucagguucuggguuaugcgccuguuuuucugugggagcuagaauuguugauuuacguuugcacuaagcagagugaauuagagcccgaggagggugcugugggagaaugaggcuggcauuuggcuggcgcuaaaaacagcaccguguuugcgcauucagcagcauucagcagcggcucaguggugggaagagagggagagccucuuacuuuauucauuuucaagaggguuggaaagaaacccagaagaggccacauaauacagugacauugacagagaauaacuaccgaguuguguguugucauaagagcgagcagcaggguaaaauguacuuuuuuuuuuaucuguuuagaguaaccuauugagguaguugaggguauggacagcuagucccccccccacccccccaucuuguauuagcuuagaaaaguuaaugaggaauuugccugugcuagauuugugaaucuugauuaacaaagugacaagauuuugucaaaugcuuucuaaaaauggaauuuguuuugauauauauguauuuuuuaaguagagugaaaaauucuuguauucuggccuaaaauuuccuaaaagauuucuuguagguuuccuaguaaaggcuuucugucugucauaaagauugaauucacauggccaggacuagggacuaaaaguaagugcuucagccuggcaagaagacuguccugucuucuucacuguuugucucccacccucccauuuuccauuuuuaggacucugcaggagggaaagucugcacagcuaguguugggugggccuaggacacuauuggaggagcugaagggcaucaugucucccagaccuggcuucuggucccuaguguauucuucauccuuacagucaguagcugaguuuggcuucuucugggaucgggguccguguugcacaggacaaaauguguauacgggcauuuguguuugcauuaagaacugccuguugcaggaaugcuggccauguagcugugcagcaggaaggcuuagccauaucugaguucugaguuugguaaaagggauaauggaagucggcugcauuucauccuuuccuuguuucccaccuucguggccaguaaacacgguuucuuccacaucgcccacuucccuuaaaguacuuuuaaggauguuuuuauuaauaagcuguuaguuacuacugugagggauacucucugaggaaggagaacuaucugagagaacuugacagaaccuugugcauucauacauccaccuuugcuuucucauuggccauuggccuuuucauuaugagcugucacugaagauuugacugugccugcucuuaguucuguacaguaagaaaggaauauuaaaauauaacccaccauuuuuguugggagugaaaauauuggcauugugagcauuuuggggcuuugagucauauguacacacaucuuaacugacaguuagcauuuuuuccuaguugacugccuaggggcaggaaguaaacccagccagugcuacaguuccucuucacuuggcugugcugugaaguggcuguccuagugagccuuauucauagagcuggggaacaguggcucugcacugcuguugcauuucugggcacguggaguauagcaauacccucaguguugcuggucuuggggaggugguguuugucgccuuguuuuguucugugaggugguguguguguguguguguguguguguguguguguguguguguaagggauagagagucgaguuuccuuuuguugcugaggaugcucaaugaggugagcaucugcucaguagaaaggcgugccagcuuucugccuguacaucaugagaacagcggaugccccucucuuuguguuugacccaucuuugccucaggaggucaugaagacucugaucuuaaaauaaaucauagacccuaagugcugcuucucagacccuccugcgagguuucauuauaggccuaaauauaagcuguagcugacaucacaucuggaaacugaggagacgcaauauagaccagccuguucuuguuuguagcuggggaaaucaguacuuauccuucagugguuaaaggucggugggaguggcauuuguagugcuagugucaggagggaccccacgccccuguccuuugugcuuugugauccucuuugucacagggcugccuuguuuaucccuuaggccugcagcuugguguuagcacugacuuuauccagguguuguugaagcuguaggcauaccuccauagguagugaguuuuguauuuuauuucauggagaacacagaugcagggcuugcuuagcuucugaggucucaguuguugagagcacugcacaaggauuuguguguagcuuugagauagaagguacaugagcggaaagcuuaggccuaaggaaccuucagcaguaguucaugaaguuaagugacgucagaaacucguugcuguggguauuauuuugugagugcuuuuggaauaaugaccuauuaaccuauuuuuagaucauccucacuuggcaguucuagaauacuuguuacaaguuucagaaacauugcaaauaaacuauguuucugugucugugagaacaccauccuagcaaguaauaaaaacuguagggaguaggucauaucuacagcauaaugaucuguuguuugcaaauaauaaaaaucaaaguguaaaauucauuccagaauuuuaauucaguaaaucaaauguacaguucuaguaaccgaucauugaguauuuauuuuuuauuuuuauuuuuuauuuuuuuguuacucagaaauccgccugccucugccucccaagugaugggauuaaaggugugcaccaccacugcccggcagaucauugaguauuuuaaaugggaaaauaaaacuuuauaaaaacagucugccauguaacaguggauuugaugguagaacucauugucuuggaacaugguaaaucagauguuuuguguguugugguuguggcgauaaugcugucuuacauccuuuuugaaaaagggaugguacagagagacuugaggauaccaugaugcuuuuugucuucuccucagugucuauauaaagcucccccaggucucaaguugacuccccacuguuuccuuggcauccuuuguccugagguuccuauagcuuggccuuagaugcuuuuccuuguaugaggagguagcuggucugaagaaaggaaggaaaaggcuugagaaacucagccagugucagauauagggacaucagaaguaaccugucaccuugccagcuuguucucucaaguuaagcaaucucgaguuaaaucagucucuuuugggguccuccugcuauuaaaaaagggguacuauuuuauuuaggcuucuuacuggagugucuuacagagaaucauugaaaaugauuguuaaaccauauuaaaugucugugcgaucugaauucgugcccuuuggucuccuugguuuucuccuagaaagagcucuuagauccccacccccucauuuuugaagauucuugcauaacaccaccuuuuuaguauuuccuucaaguuuguagauuuccuaggagaggcggggagggagcuguuggugacagaggcaguguaacaguucucacaaauccgcccccuuuccuuuuaaugauugucucuguuucacugaaguuuuaaaaaugucuccauccaauaugaucaaaguauuaacuggguaaagcaauguaguuaaguggagguuaaguaugguuagaaaaguagaguuuaaaacaaaaucuagcuuaaagcugaguuguuuaacuggauuaaucaaaggaaucuuuuguuuuagaccugugcuggccucaaacucacaauauggccaagucuugcucuuucuuccucuaucccucaugcuggcuggggucagaugcaucucccacuuaggagggacucaaaggaccaguuguuuuuauaaaucuucugggagcaaacuguucagacaauaagguuucuaugcagcuuuugugcuuuacaaauuacuauaaacaguacauauucuacugcagcaguaaguacaguguaaagaauaaauauucuaccggagcagaaaugcuuuucuuugguuuugauguaaacaaagcacuucauuuuccugauuauguuaaugaagaguugaggcuuuguuuuuuuuuuuuucuuuuauggcugcagacaggauggcuugguuuuuacagagagacuugugagauauugcauaaguaguugagucugugugucuggcaucguaggugccacaucugucaccugcgcugagugcacacagcauggaucuggaagcaggacagggcagucacaguuggaagcagccagagcucaccuuggugaacucccugaaccaugcuggcccagcaggucuguaggacuggccaacuucgacgcuuuuaguuagguucuuggcuggaaaaauagaaccaggagucccugcuaagcaaagucauuuucaggacuagaaagcuugugaugggaagugaacuuuuaacugaaugugguaaccggugaugcugugacccaggcgaugauaccagggauuguauguuucucaguuagaggugccucaucuuaagggucuagacgaaauccugauccagaauauacaauaugguaggcaucgcguggcgaugugaugcguaaucuacgcuggcuucgacuuggcaagccauccauggcuggcccagguggcacaguugauguucccccugcccucccucucuuccccuucuggccagugaagauuuccccuugcauugacuugaagacuuaggauuuggagcagcagagacgcuuucaaaggaggcacuugugaauagagccucugucuggcccaggcccugccucucccauucagcucaguacagaaguacuuuugaugccaucugcugaguugucagcucuugucgagguaaaacagcugaaguggcacagggggagauuauuaagggcacaaccaucuaaaugggagcccuuuaacaaaagucuggcaauaaacauaauuuccucauucuaaauugcuguggagaacaccccccccccccccccgaaagcaugugguacacaaagcuguacuguugucucacuaggacuagcagagggcugagagggucucugacuuaauacgaauuuccuccuccugggcccucaguacuuagcccuccuucugguguaauuggaaggaguagcggagaggauuaugggaagcaguggucucuuugaugcugguucucagcaguugcuuuggguggguaggggccgggauauaauauguaugguaaugaauuugaguagcuaucauguauggaaagaugacagaugaccaucauuugauaugugaggaaagaggccagagcagccaggaugucuucuuacacaccugccuuugauugagacuggaugcuggguccuaaauccaccuagccucagcacagcuccagagaaggcucaguaagguggagaaguguugcuucuuugcacacacccucagcucccacuucagugaguggaugaggccccuguucucagagcugcuugcuguaguuagcaugugaguugguucgugguuuaaagaguacaagcucacccaugguguggaucucucacacccuuuggucccguauguuggucagaguuuuuuuuuaggguguuggccacuauauuguuggggcuaguaaaacaaaaauuuccauccaguuaauuuguuguaaauagagaagagccagaguuacuuccggaauauguacaaguacuuuggguuuucaaccaaggggauugagugaagcaaacuuuucuagaguuuaaagcuaguagguuacauucagagauacgcaaagggagagaaauauacuggaaaaugacaauguuucuauuagucugauggccugccuuauguggcacacaguucaguggccuccauuauguggcagcacuaugggcaugccuugauucagagagggcuccugacaaugcuaaucugaaucaagccagguaaacuucugacuaagaggaacaaauuuaucaacacagguaauacaagggaccagucagauacauucaaaacaugagacuguaucaagaagccaucuacucuccuugagacuuuguaucaagaagcuggucugcugucuuagguacagagauguuuaucuuggcugcagaguaagaagggcuaauaaugaugggggucgggagcccgcugcccuggcuguuaguacuguuuacuauuagcaagcagaaaguggaaagaaagggaggccugcccacaaaacucaccucuaaggacauaacuuccuggcaagacuccuaaggucuuaaagccgucccaguuaacgccaccuaugggcaugugugugaggagguguggcuuucacauuuacagcaacacagucaagagaagauagugaggcagauggcugaagcaagcuagaguguggugugugagugcagacugauugguggguaauaugggaaucaugcuuuccucggcucugauaauugugucugaaaacugcuaggcagcacucuuccuuuuagaaaggguugucuugaugucucauuugaacugguucagggaggucaugugucuuacuaggagaaauagaucaauguuuauguuagcaggugcuuaaucuagacaguaaacaauuagucauuacauauagggccaugugacuuuuuacuuuucuauauuugaacaauuuaaaauagacaaaacgguauuuucuguccagcaacagugacuuuugaggcuguguuuaaaguguagacccagaaugcuuuuaagggacguccuucccauguugaccuuucccccacuuaguuuaaaaagccaaaacaaaacaaaaaaaucaaaaauagcaaaguaaagcaaacaacaacccaacccaacccaaacuugcuguaaugacaaggguuaucugugguucagggcaugcacggggugcuccugcuguuucugcagguccuggacgggucucacagaggacuucuguucuguggacccaugcucucguuuugacuguuucugggccgaauuucucuuuuguucaguaaauugaacuaaaguggcugccugcucucuaugcuacaagaauuuaacauggaaaaauagaucugacagauuguuaccucuacauucugagugugugguggugcccucuggugcuguuaagugcuggcaguguggggcggggcugacauggagaggggcggggcugauggugaugggugggguugacacggugaggggcaguacugagacaguguggggcggggcugacacggggcagggaggggcuagcaggggaagaugguggcuguggucucauaaccugggagggaugauguugccucagcaguugccacucaccugagugauaagcauggacauaaaugucuuaacuggaugguggaaagauucuggggccugagcagcaucugucucugccucauugaggucuggccuuggucuucuugucuguaaauguaccagcaaguagaauugacuggguauuuggaaagaagcaaaccuuaagcuucuaaugucgaguuguugucugcuuuggcaccucccccuuuucaggguuuucuuuaaaagguuaauauugcuugugcuuuuucucauuuguuuccagcuuuggcaucuuugucuucauuucccuuuauguuuccuguacuggaauaguguuucuaaacucugcuugcauaggucagccagcuccuuuccacugagagagguguugacaaggucuggucuaaugagaaagaacugcagugguuuguuugagacuccuuucagaaguggaagucuguuaucucacugcacggugagcggaaaggggcuguaauuaaccuggcuuuuauuagauccucccgacuaauucaggauuaaagaguuuaucauuucucuuagugccauuuuuuuuuucuagccucuauuuugcaguuaauuuucagaaugagcccauggcuuauuuuuugaccaauuuacuuuggugcccuuggccuugguugugccauaaucuguaaucuccaaaauagccaugcuguuuaaucucaggcguugggaaguacagcuguggugcuuuuuggugcgagccugagaguuaccuuugguggugcacccggcccuuuucuccaggcgacagcuuuugguguugagaguguucuagcugcuggcuccaguagccuccuccugucuuaggcacccccuucuaaccggugcaggaauggccagcugucuuauccuuuacuuagcuaugagauuugcuucaaugguuguugcugucuaguaacuggccagugagcuguaaugugcacugcugguacccagagcacuacuccuucccuuccugccccuacugcuaucacugcccuuugagggugggguuaauaugaaauacaaaguauccaguuacuuaauauaaaguuauuucugaacuucuuuugaauaacuaauugaaacauagaaauucuuaauuuuuuauaauguuuacuuauuuguauaguuuuucccuugacauguacuguauuacuauaguuacuuaagcuguuuaccuauguggcugucauaauuauaaucauaguaaugucauagacauaggaauaguuuaguaucaugaaucuuacacacgcacauaauuugaggcggcauuuccauacauuagagaggcauggcuugcccuugaucccucuguuuagccuagucucccagugcugggauuauagacauguuccaccauuuugcauuuugaaauuuuugaauuuggcucauuuugaauuuuuacagaauaaaaauauuacuguguaaaacuguggcaaugcagacacugugauuagcaacagccuaucuuccuccuggcccuguuuguuaagaagcuaggacucaguguuuuccuuuaauuuucuccauugcauuggacugagaagacuaaccagggguuccugggccauucaugucucuguggccgucagucauuagagccaaaauuguuagaauaggcagccaugcugggcagacaggugucacuaggugguaugaaaccauaccaagaugcauggaauguagagccacacauauuucaccaugcuguuuccuguauucaucccucagucacacguuguguugaagacuggcauugugggaggcaggggucgugagggagggcucuggccuccuggacaccuguucuucccuacauggcaguuugcuuguggcaggugacugguccugaggugauccaggugaggucagcagugcuccuccugggcuucugggcccucuaagccuagcauagccacugccagaccuucagcagacgcugcugucuuugcugagguucuuugguugggaucaccagucauggccgaggguacauggaaaggacauugagcuaguguugaggcguggccccccccaugaagagggucggaggcucacagacuuauaguuggagucuaggccacaggacagccauucagaaucaucgucucucaaacuuucaguccuuuucaacuugguuuaugaggauuugugcaccugaaagaggauuugcaguacuauuuggugacauuuaaugaauuuuuaaaaaauucuuuugaaguaucaaauuaagagcacacuuacgaauuaaaugaagcagaacuauugaaauaauuuauuuucgcccacauuuuguucaucuuuaacugaggacaguggagguuuaacuguccaggaacuugagugaaacuguuuuaugucuccacucgaggaggaggaaaagaaaaguugccccaggcgucaguuuucguccuuccugagaugugagaugccuagugagggggauucuggugugggccugcccgcucgccaccgccacugccugugauccucagguuugccuugucugguuuucagaggacuguugcccacuuugauguugguguggggugguguucagagacgucccucggcugcccgucucaugcuccgugcacuaacugggcccuccgugcacuucauugaagauuguagcaucuggguaggaacacugccuguccugguuuugaucuuuuccaucugaacguccugggucaccguggacuguaaauguggaauuucuugagugaggaugugaaagaguaggaaaagggaaggggagggggaggggagaaggcaaugccaggaaacacagcagugagcagauaugucugucugucugucugucugucugucugucugucugucugagugcuccucacugaggaaacaggaaaagugaaucaagggcucagguaccuccugggcuuuuagucuuuguugcuucgguccagcuacuuuaaagaaaaugucaaguaaaaguggcucuaguuuucuuuguaugcagaaguccagauagauuuuuaaaaacauguauggauuguugaaucuauaguuagaacagauccauuacccuaaagccuucaguguguucuuucuuugauuucccaguguuaagagagagccgugcuuuuccuaggaaauagaccucugagugcucuuggaggacccuaggguucauagauuacagccaguucuacaggccuucuccagagccaggcccugggcagccccuccagcugcccagcuaucaggguuuugcauugucagauuucuggguuaaucaucuuaauggugacuaggguuuucaguccccccccccuuguauuuauaugguucuuauuuuguaaguguuggauuaagguuguagcuacccaucugcagguuuuauguucaccuaucaguguaaaucccugaaguguccuguguguuguuguucaguagcucugcaaggcuaugguguacagugugugaggcugaguacacgaggcaacuggagugucuggcccuggagaagccgucuccuuuccuccucuuccuccccuucccuccccauccucuccuuuccuuccuucuccacaccuccauucaauuguguuuucugugaagaaguuguaucucaaugaacuuaccucuggauggucuguuggaggugcugcuggaaaccuagaagggaagguugucacagcagcuugaaggaccuggcuccuguugagguuguauguacaaagguuuguuccucgucuucauuauuuguugaaaaccuucagcugauugccuacugugugcaggccuggacugguauugauggugagagcuuaggguccagaaguuagugacuugcuucuuuuuccagcacuuuaaauaacaaccaccaccaaaaaccagcuuauagcugguuaagggaugggagacgcucucuaccuauaguuugccugugucuggcauacgucuugucucucagggucgugcuugcaugguagguuagugugggcaaaggagugagaggacaggaucagggcucucaggagugcccugucagcaccuuguggugguugcugcuucuuguacugccuccuuguuaauccaguaccugccccuuccgugcauccaggagacagcuauauaucuuauucacuguguuucaguguucaacuuacugcaacaugugauucaggguaguguuuacaacuuuuuucuuauugcgaacugggguuuugcuguuaauacugaaguguguugauauuauucuccaugggauauggcgccauagauucagagaggaucaagcaagugcauuugacuaaagacaacaaaggccacacagugacaacagcaaugucucccaaagacucagcucaggcccaggggucaccuguaccuugcaagagcucuccuuacacaucaguacugcagugauguugugggugucauuucacaaagugaacccugcuuugaagucacgggugggggggaagugaacggaaacuucuuggguaaggagauaacacuacaauucuguguguguguguguguguguguguguguguguguguguguguguuucuggauaaaugguugccauuaaaguaagcaggauuuuuauuaaaauugaugggugaguaguggcugcugugugugugcucaccgaggucagaggucaauguuaggugccuccucuacucaucucucuuguuuauggaauguuuagaguagggucucacugacugaagcucacugauuggcuggacugacuggcagccagccccuuggauccucuugucucugcucucaguaccaguauuccuucugggugcgugcugucacgcccagcuuuugacaugggugcugaggaccugaaugcauugcccauugugcugucuccuaucucccuguacuuagacacugugguaccagacacggugauagccuagauucucaggccgacacaugcuguguaugaguacacuguagcuauacagaugguugugaaccaucaugugguugcuggcugagaauugaacucaggaccuucugcucgcuccagcccugcucacucgggccucucgggccucacuugcuacgaccuaaagauuuauuauuauauguaaguacacuguagcuaauuucagauacaccagaagagggcaucgucucauuacgaaugguugugagccaccgugugguugcugggacuugaacucaggaccuuuggaagagcagucagugcucuuaaccgcugagccaucucuccagcccucaaggcaauucuuauaaaggacaacauuuaauugggguuggcuuacagguucagagguucaguccauuaucaagaugggaacaugguagcauaguguaggcagagcugagaguucuccaucuucauuugaaggcugcuagccaggcagcaaggaugacgguuuuaaagcccaagcaucagaccuaaucuaacucuccuccagaucgugccacuccccgggcuaggcauacucaaacugucacaccccaaacucaauuauguucccuuuuugggaucuggacccacuguguaagaagcuguguuuuggacaauuucuaaaugacagaacagagauggagagcccagaugacauagccuuuguauugccagguauaauaauucccugaaguguucuaauugcaggacugguuaguacuugguguucauaauaauuucccugggccauuagcaaaagcauuuuuauggcacucaaagauucaagguuuagaaaguuucucauucaugugaguucuuuaaaggaaacaugguacauaguguacuuuacuuuuuuuuuuuuuuuuuuugccaucucagcuauguaagacgaagacucuuugauuguggauggguguggcguaaacagacaucauauugucugcucuagcuuuccacucuuaccaucaguauuccuuaguguuacuuucagagaaguagcuuuuaccagaagagagcaugauucaaugcugagguuucuaaucuaaaacucuuaagagaauagguguucugucuucuuuauuaaaacacaaguucuuacuggucccauaauauacauuuauguuuccuuuguuugccugccugcucgucugaagcacuggcccuggaagauggagaagcgacaguaaauguugguuguaguaagaaguaggagcaauaggugagcuuugcacagcugugagccgaugcucuuagccuuguggggguggggggugggguggaagggucagaggugagacuguagcuccugcugcaguguucugcucuccugcagggcaggcagauguuuagaacacccagcuguuuucucagugacauucuuccuuggcuuagaugguucauggagcgcuguauggcugcucugucuccuuucuguccugcuaauuuuuuuaagagaccuuuccuggaaaaguguaaucauagugaagauugugguuuugagguucacagugcagaaccaguuaaacuggucucugccuuuggauuggauggauggguggcggucaucaagaaggccuagcgcugaacucacgcuguuuaccgcagggcuguggaggcuccaugugugauuuggaaauaacugagagcaaggagggcuuuggaaguuuggagcugaccucucauggucuagauggaacaccacugggguguguuggucuggauggugugacuccauggcuuuccuuccacauaugaacugugcguaagagagaggugaaucucggucuggucuucuaagucauuuuuuuaaacauuaaaaaauauuuuugaguuuauauuaaaauucaguauuucucccugcccuucuuccucccaagcucuccuguuauccccccuucccucuuuuaaguucauggcccccguucucauuaauugugguuacaucccuagauguauguguguagacauacauauuucuauauauauucugcucagucugucacugaacacaugacacauuuucaaggcugaccauucgguaguggauagccaguuggugagcucuccccggagaagacucuuccucccacgcucagcaguccucagaaggagugguccugaaacccuagggugcacgagaagccagcggacacugguuuaggaagccguggggcucauuuuguucucucccguccucagguuguucugugggaacaggagcggucuuuuuauguuuggucgggagcuuggcuucuuuacuagaaaagccuaacaucucuaccguagggauuguuuuuucuuuuuaaaaaaagugcgugugcgugugcgugugcgugugugugugugugugugugugugcgcgcgcgcacgcacacacgcacauauguauguauguaugcauaccaccugcaugcaggugccugcaguggccagaagaguguguuagauccccuggagcuggaacuacaggugguugugagcuaccugggcuagcagucaaacucagguucucuggaagagcaguguauacucaugaccacugagcugucucuuuaaaccccuccauaaacuuuauuuuaaauaaaauugucucuuuguguugaguguucaccacccuugugugugaauggcggugcauuuguguggaggucagagacugauagauaaccuugguguugcugggugcaagcgccuuuuaccuugagguacaggaucucuguugacugcagauagucagacacaggcuaacuggcccgugaacuuggcuucugucacugccuuccucuugccguaggaacacuagacuugcagacacgcuccauccagcuuuaugugagcacugggcauucaagcuaaguguuucuugcuuguuauacaaguugauucaugagcugaaccccaccaaccgccacucagaugucucggaacagguuucugaaacaaaguuuaucauugagugcaaaugagaagcagccaggccaugaugaaaucuuucuaaccuugugggaaucucucuugguugggugcagugaugacaagccauuccugccugcuugucugccgagagguugcaugguuuugugacagggcuugucauccuuuguaaacacuguguucuuuuauuuguggcucgcuaccaccugcgugccuguugugggaaguggagaagauugugugcugcuccaguucugagggaauccacguucuccccuuugauugauucucuucaggugauuacugcuuccuagaaauuacccuucugcccuucccggcaaagaagagcuguuaguuucuuaaugucaugugauucgacuauggaguacaaauucugcuucucucaugagauacauguuguauuucuucauacucugugugcacgcacgcacaggugaacacaagcaaacauuuccagacuacuaucuucuugaguaguuaccauguuguuaagcauuuauagacuaaauuuuguagacauuugaagcaucuugauuuccaauauuuuuuuuuaaagggccagugagguaacuauggcagcagacaaaagccaauacaagguucagagacccagcucauggguucugagucuguccucauacuccuuucuuuguucuaagaggcccaggccagggauuagcaacuuguuuguuguuggcuauuguguauuagaaaucgcuaccaauauguguagaauaauaugcuugagguucuguuuuauuugguuagauaggaugcaucuguuuagcaugcacaccuguaagggaguggguccucucucuaaggcuuacuuucucugguuuauaagaugagggaagugguacuuggguuauguacugugaggagcacaggcauuugcccaagacacaccuguccaccaagugccccccagagccagccugggcugcugucuacucugcucuuccagacuacaaggauguaccggccuuaaggucaccauuguggagcuaagguuccaugaccuggcacuugucuguacugucggguagaaaacauguauuuuucccaaguuaagcagcugcuuaguuucauaaaguaaaugaaaaccuuguguacucuugcaucuaccuugaaguuggauggugccgaacaacacagacuuuaaggcgggguggggggagcgagagcgagcgcacaugcaccaugagcagaaacagggcgacauuauggugacccccuaccaggugugcaguagcagcaaggauugugagggugaauugagaugagucuaacacugugauggagcugggcauguguaagccuagaauuugagaggcugaggcagaagggccaggacuuugaggcuagccugggucucaagaggucuugucucaaaaaacccaaaaccaauuagccaaagaaaccuguuguggaggacauggcauaaggcaguguugggaccgucucugugggcuaagagaccgacagaggcucacgcucuuccuucuuggauguguuaauguaucguccaaauucccacugccguaaaagaggccaucagaccuucccugucaguggacauagagaaguguuagauauuuuaaggagggcuaggugaggucuagguagagaugaugcaacaugcaucccuuaauuaggccuugaugcuaggagaggcugcccuuacuuacaucaccugcucugcccuucugugggccaggccaggcuuccucaaagguggagacaggcuaucaugguguuccgacuucuaacacucuauagugcgauuuuccuuggaacguguguuacguauugcauauuugcaagggcaagguggcaauuuugacuugguuagaaacacugaaggagagcuggaaaacaggccguucuccuuagcuucuaucaccgucaagccuaggacugguuuuguuuuucuuaaaaaggaaacauuaauuuuccuaaaauuaaaaaaagaaaagaaaaaggcagaaaugaaucgaaagccgcgagguuucuccucugagggaaacucugguuccuguggggcaggcacacugucugaaaugacagacagaggaugcguuagccgaauuaacuauuugcaauaaagaaagaugccacaauauaagucuuugcagagcgucuugaucgacucguggguuuuguagaucuguaaucuaaagugguacuguaucaggcuccuaaagagucccuacccagcagcacauagcuguguccucaaaaagaaaaaacucccgugcuguuccccuccccccaccacccgacuucuagccaugucaagguugcugccuugauuuggaaguagacacuguagaaaagcuggagggcugaggggcugugugggaacuauuggaccugucugacacauggccaggucagagagugcacucacuacacugugucuuaaaugcacucucccuucuuggguucaagaaaagcacaauuuuacuuugugauugagcugccagagucaugugacugcugucagagucaugugaucguguuggaccuagucaugggagcuacauguuauuacugacagggggauagacuuucauauccugggcuuauguuugcuuaagugauccacauugaugcaucuugccugcuguacuccuugaugccuugaaguguauauaccaguguauagacuguguguguauagacugaaguguauagacugugcccucuuugacaugggcacagcaguauaaagcuugucccaguguuguuauuuagaguguacuaguugucacauaaugccauuuuccaggacugcuuuguccuuguuauaaucugagucccugaacaauuucugugaguaaaugccgaguuguucuuggguuugauguuauaaauguacucuuccugucacaagacaagagacuggcuuuggaauaugugaagauguucuuucuguucugcauuguugcagaagggccacucuuaaaguggaguccuuaaaaguaguuacguuuacgauagcagggugguuccuaguugcuucagagaguagggguuaaccacacgcacccuccgcaucggugagaaaggagaaugauaacacagggguuuuauuuuuuuuuuuuguuuuuuguuuuuguuuuacauacagagugguaugaauaagcuacacaguuuagguccuagaucaaagauuacaguuaugaugucauuuugcuugucccugaaccuugaauacuuccucuucucaggauaacagucuccauacaccauacauugacuuuuggggacauucaauauaauuugugaaaucaaguaguaacuauugggguccacuaggaagauucaguuaccauuuauggcauaaaggaaauaucuagagggcuuucuaguuuuguuuuguuuuuggccauugaagaaaagguugaggcugauauauagaaaaacagauuacuuaaguugauuggugucagggaagauggcuuccuggcuugauugccagccccuccauauauccaaggggaucugagguccucaccuggcuuucaugggcuccugaacacauguaguguaaauaagcucacacguacacacauggacacauaaguuuaacaaaagucuuuugagaaacuuggagauaguuugauaguacaucaaacguaucagaaaaagaauugauauuuuauccgaauucauucgaucuucugucuuuguuuuuaucagcuccguuguucuauuaugagcaugcacuuaaaagcauguuaccuuuuauuaguaacagaaaaggcgcgggggaggcuggguuagagacuuuagccacuuccucugaggaaccgucgugagugucgguacugaccagucuuuguuuucugugucuccagggucgacauguuaaaacgggucagcuggccgccaucaagguuauggacgucaccgagguaagguuggaccacacuuguugaugaagacaucgugacuuucaaguucuuccggcccugguacuucugcccuccuuggcacauuuagagauagugaucaccuaagcacauggcuuugcucugguguuggcucaagguccagcagcaggccaggcgacuugaguuguugagauaguccuaaguaacuaagaaucucauuugcuuaaugcauuuuugauuuaaaccaccaacccgcagcaacccuccuccaucggagugaugucaucuuuggccacaaaaugggcuguaauuggaaacaucuucacuaauagaaaggaaaauguugggggagggaucauggaggucacaugcgcagugauuaaagggaaagcucccuugggguauuagaccacaucugugccauuucuuuuauuuuuuauauugagaaaagaaaacauggagccaaguucccagaggcuggaagacagcaacaucuguuagaaugucgaguagauuguugccauaauuuaaugacaaaagauaguucuuucaauagucaaugaggauuuacugugcagcuucagaugggaaccgagaaccgagucaaacaaaaagugagcccacacaugcacacccacacacucacacacaugcacacaugcacacccacacacacacaccugaacacacgcacacugcgcacucgggacgugccucugugagugcauccuucaucggguaugaggagcuagagcugccucauuuuaagcuauuuuaauguuuccucucuugcacuugcugccuuugacucaguguugaaucagauccagccccaaguuguagaaagagcucagcagcagccugaggagcuugcagggucuuuacgucacaccaucauuucccuaaacccagggauuacugaggaaagugagggcuauauaaagaccgugucuaaaaaguaaguuagccuuaagcuuggcuauuuaugaauccagaguuuaguuccuuucugggcuucgugcuuucagccugggcuguguucccugaguagccgcuguagccuccuggugccuuacuucacgccacagauggauuucaagucugacccuccuucucuaaggcggagccugguuauaaauguguaauaugcagaaagugaagcauacaggagagugcaaugaaaaaucaaguccuucccuuuucugacaggagcccuucaguguauuucucuucaguccugucucuaugagacauguauaaaguacaugcucacguggacaugugcuacgugcucuguguuauucuugcuguucucugugcuggggauuaaugaggcccuuguguacccaagcuagaguagugcuguacuacugugcuacaaaccauaguuucuugcuugaaaaagaaggcagcauuggacaggugauugacuauuuguagagcuccuuuaaaagcaauuaaugggagcucguuuauuccaguaaagucaaaagugaugcuuaaagaccaacggacaaucaaccaucgagucuguuagcuccucagugauguuucucacauuuucuucucucagaaugaccucugcuguggccuggggcucggagaggauccagaggaaguguugauugugaauaaaagaccuuggacugcuucagccugccccaacaucaaggcuucugggcuuaugaugcuggggccuggguggcagauaggagaggucugcagcugagcugcagaugucagcucugggaggggagggcucaaggagagggcugucuugaugagagucagauuaucugcuuucccuuucgucucagggacacaggugcaggagcuaauuccugggaaagucacagacaggcgugugccuuauuagcaaggacuggguguugguuagcaggcucagcgggcaggaacagugugggugggaaggccaugguauggugaucuuguuggaagccugagugaaucuagcuccaucacuagcugcagugagugaggaugugggccuacaucacuagugagcuugguuauuugaagaaccuggacaugacgcuaugggagggacuaagggguguucgagggaggcaucucuucauagauguguacacgauccugucugggagcuuguaguguugagaagaguauugcuauuuaaucagggcuuguugccauugggcuguuauccccugccuuguaauguaaguucuuaaguuucguuuguauauaugcaagggcuuauagacaugagguacccauuuguauuuauguaagagcuauauagaugcgaguuacccauuuguauucaggcaaggguauauaugugagguauucauuuguguguauaagagcuguauagaugugaguuauccauuuguauuuacauaagggcuguauagauaugagauuuccauguguguuuauggaagggcuguauaaaugugagagauccauuuguauuuacacaaggguguguagaugagagagauccauuuguauuuacauaaggguguguagaugugaguuaucuauuugcucucagcuguugcucuacaagcuucuucuguuaguuuaaaggagaauuagcuagaccagcaguugugauguauuuucguccaagguguagcacuuucucuguaggaagaucagcuguuccgugugcacggaggcagccucagcuccuuacagguuugcuuugucuugucgguagauuacuuagugcaggcuuggauguggcugugacggugcugccugacgcuuuguguggguuguuuguuuuuucccuucuucauucuggaugcagugugaacauggacauugacaaugcugucacugggcaggagaggggaaguggcauaagcugaucauucuucccagccugguuggaggaggaugagccaggcagacuucagugugaucaugcccuuucugcuuaggaauuuaaguagguaaucuuuuaaagucgucaggggauauucauuaaaaguuugucucuauaaacuaauauauacuauugaggaggacaugucauuugagagugucugucugucuguccaugucuccucaccucuguguguguguguguaugagagagagagagagagagagaaaaguguacaagugccccaaaggccagaagagcgaaucucaagugcauaauggugguggacuuaauuuuccuuuaugcagaaccccagcucugcucucccacuacuuagaaugugaguguaggcaugggaugguaggugguccuuuuucugacaaauguguucugugucuugucuccugggagaguuccacuuuuaaaacaauuguucugacuuggcuacccucaggaggcuucagacaaacucuuaccauauguuuugcagagugccaagagaugaggcucucuggagagggaugacuguuguuaagcgggaguggcauugcuugucugcuggcagaugagagcagcugcaguguucugagggccuccucccagaccucgcucccaggaaguuccucugccucccuguuaucugucugcuuacugucagugcacccaugacuauaggagggggacgagggagggagagggagaaggagagaagacuugagaacccagugucaaguuagugagccauggcuagacugaagugaaaugagcauguggugggcugcccugguauaacucauagugagcaggguuuuuguuacuuaguuucuaauuaucuaaagcagaacucuuuuugagugccaaauagggucaugaguggcuaaagcaguaggcuuaaaguagcaaaaccucaauugugaaaacgucagaacuuuuauuuuguuugccuuuuuaaauuggaucaugcuaauccuguaaaaguauauuuuccuuccuuccuuccuuccuuccuuccuuccuuccuuccuuccuuccuuccuuccuucuucccucccucccucccucccucccucccucccucccucccucccuuccuuccuuccuuccuuccgguuuuuuugagacaugguuucucuguauagcucuggcuguccuggaacucacucuguagaccagacuggcuucgaacucagaaauccgccugccucugcuuccugaaugcugggauuaaaggcaugugccaccauugcccgguuuaaaaguuuauuuuucuauugagcaaaaucucacaucuucagcucucuuacauagcuuuaaaaaucacauuugaaagaacaacuguuuugauagcuauacacagugcucaguaucauagggaugugcaguguguucagagaugcccuacaugcauucagggcauggcagaaggacuagcagcaaggucaaaucuaagugaaucaaggaucuucacauaaaaccagagacacugaaacuuauagaggagaaaguggggaaaagccucgaagauaugggcauaggggaaaaauaccugaauagaacagcaauggcuuaugcuguaagaucgagaaucgacaaaugggaccucaugaaacugcaaagcuucugcaaggcaaaagauacugucaauaagacaaaaagaccaccaacagauugggaaaagauccuuaccuauucuaaaucagauaggggacuaauauccaauauauauaaagaacugaagaggguggacuccagaaaaucaaauaaccccauuaaaaaaugaggcucagaauugaacaaagaauucucaccugaggaauaccgaauggcagagaagcaccugaaaaaauguucaacauccuuaauuaucagggaaaugcaaaucaaaauaacccugagauuccaccucacaccagucagaauggcuaagaucaaaaaucuaggugacagcagaugcuggcgaggauguggagaaagaggaauacuccuccauuguuggugggauugcaagcuuguacaaccacucuggaaaucagucuggcgguuccuuagaaaauuggacauaguacuaccagaggauccagcaauaccucuccugggcauauauccagaagaugucccaacugguaugaaggacacauguuccacuauguucauagcagccuuauuuauaauagccagaagcuggaaagaacccagaugccccucaacagaggaauggauacagaaaauguaguacauuuacacaauggaguacuacucagcuauuaaaaagaaugaauuuaugaaauuccuaggcaaauggauggaccuggagggcaucauccugagcgagguaacccaaucacaaaagaacucacaugauauguacucacugauaaguggauauuagcccaaaacuuaggauacacaagauauaagauacaauuugccaaaugcaugaaacucuagaagaaugaagaccaaaguguggaaacugugccccuucuuagaauugggaacaaaacacccauggaaggaguuacagagacaaaguuuggagcugcgauaaaaggauggaccaucuagagacugccaauauccagagauccaucccauaaucagccuccaaacgaugacaccauugcauacacuagcaaacguuugcuaaaaggacccugauauagcugucucuugugagacuaggcgggggccuagcaaacacauaaguggaugcucacagucagcuauuggauggaucacagggcucccaauggaggagcuagagaaaguaaccaaggagcuaaagagaucugcaacccuguaggugcaacaacauuaugaacuaaccaguaccccggagcucuugucucagcgcucgcugcccauucauugccgguccucacuuggucuguuugaguagcuaacgcuguugaguggagaguguucuucucuccuguacugcgcagugugggagcuuauggaguuuaccucagccugcuccuuccugaaaggagccucagggcaucaaggaaagagaagugagggcagcugccagccucucccuuccuuccuuccucucgggagugacuuaccuguggaacuugccgaucuuagcucaugguccuacauugguacucacugcagacaagaaggaacaggucugagguuucuguaguguuucuggccuagccuagcaaggcugugugguugguucuucagguuugacagugacccuauagcaucagggaugggagacaggauguccacacacagggaggcagaccauaggaucggacagaaaucucuguuuaauucuuauguaugaccauguggaaaauuagaagagaaaagaagauauuaaccuagagguagucucugccagaauacccuccucuuccuuguuuccuaucuucugugcauuuaaccccucaugguagauaccugauaugugcacacuuacacaugaauggcuauguuaugguagauacauauauaacaugugcacacuuaaaauguguauggccauauucugacagauagcuaacacgugcacacucacacacacggccacauuuugauagguuccuaacacgcacacacuuagacaugugugacccacauucuguugccaaggucauccugcuuugcuaacuuguggauuuuagagucuagguucuugugcuuuagaaaacauucagguggaaucacuuuuuguagagaacuugauuuuuggaaauuaauacggaguauuugagggugaaaacacacauauuauauuuugccuuaaaaauuggaaccuaucaggauuucuagguguugacaugaaacuuuggaacaaccuaguaauuuggggaccuagaaaaaagugucuuccugggguucaggaagaucagcauuugcugcuugcuuguuuguuuguuuuguuuuuuguuuguuuuuuuguauugugcuucuuggagggcuuuauuuaucccagaguugugcucugacuucugugacggccauggucuccuucaugggagcauaguccuccagagucaccccugagugagugguauguaggaggggacgaggcucugcccguucugcuuuuccuguagagacgugccgucucacgucugucccacgcuuccagaugagcacuaaggucugacugaaugacucagcaaggaaccaacuugguuagagaaggaggaagaaggcccucugaggacugcucugacuagaccugccauuaggcagagaagagcucugagacuguggccauucccagaagaaaggcauggauucaguuacauuaagaaagagcaugaguuuaauauuaacauuggaguguuugagagagcguuuuucugucuccaucacuuggauguuguuaguuuugaucaagguugcaguuuuuccuaaagcacugagugauuugggugaggaugguacuuugaaggcugccauuucuuauggcccagucccauaauaaauuccauuuauucugaaauguauccucuucuagaaucuguaaaauuaucuucauuuacauuuuguuguauggugaacugaaguuguguaacuuuuuauguuugaaccaaaaccagauucaauuuaauugauucugugcuacauuuaccauggcuuaugcugaguaagacacucuuggaucugcccggacucugcaaggugaaaucuuuuguuuucuuucaguuugcagccguuagggcagagcucaguagcaguugauuuaaacuguugugaagaagcagguauugucuuucaggaacaugcucaguuguauaucucaggacacaaaccugccagagacauuggcucacaucaucagcuccuuucuccagcuucacaaagaccaucaguugcgccccuccccccauuuguucagcugucacugccugauaauuaauuuuguaaagaagccugguggaaagaugguagacucagaacauuucacaguuuucuuggguccuaguuauuaccucugaggucugucugucucacagacaguacuaucaucaguucucugauagccagggagccaacugaaagcuuguccacugucagaacccagccccagaugaagaacuugucuaugagaguugcuccuguuggucagaggccagccugcuaauuggcaccagcugcauuaacucauagaguuggggucagcagugccucacuguggaggaaaccagaagacagcccuuuugcuccaagagcuccugccccaucccucagauuccccuauuugugaucacccuggcuccccucaagaggagugugaaggacacagugguuuggacuugcaggaagacacaugggaugguacaucagcuuccucuguguuacuuugucaguucaauuguugguugaaaugucagccuuaagucugcguacugcuguaucuuugccuuaaaugagguguuuacuuugguagcuguauguguguaucuacuaaauguugaaaugagacuaccaaaguuauuuuuuaguaaaagauuuguguauuuauuuuuaugugcauggaugggauggguauuuugccugcaugaugugugcacugcaugcauacuugguccucagaagccagaagagggcauuggauccucuggacuggaguuccaaaugguugugauccucccugcaggugcugguauagaaguaggguucucuggcccgaucuuuuaacugcugagccaugucuccaaaccccaaacuuuaaacuaauuauuaaagggaauuuggaaaucguuauaacuauauccuaaagacuguaaaauacuguauacugaaucuuagucaugauauccuaguuguaauuggcucaaaggucuuuggcaaauucuguacuucugaugcuuuuucuccuaggcuaggccugcauaauuagacaguaaaugacaguaaguggugcucagugucuuuuuauuuuauuuuauguguagugguccucuguuuuagaauuauaaaagcaucagaaguaauguucagaguaucuacuacauuacaucauccuacagcaguacuuggaacagagacugugauuuccucuaaguacuuuuugcagcucaguuucuccugccuuaggauuugacugcugaagaccuagggcauauuuugggaaauaagugcaugcaaucacuguaucucaaugguguuucaucaugugggaaggcuacuguugaauuugauuguacuuaaagucuuguauuucaugcacucugagauguaacccagauguguccccauuauauagugcacaaacgugcacaggcuuccugccucagccugucgauccugccaguacaggccuccuccacaucuacuuuguaguccaguuucaaagguguuauguugugucuugugauggugcagaguggugacagaacauaaauagagaugugucgcaucaccagaaacagugccaugaaaaucugccaaucauaauucucaguauacauacucaggguuuucagacuagcagacagcacugauuuuaagcguucaacaauuugagaauacacucuugguuuuuagccaguggguuauggaaccuuugggagcucugacguuuuguuuuguuuuguuuuguuuuguuuuguuuugagacaggguuucucuguguaccuuggcuguccuggaacucacuuuguagaccaggcuggccucgaacucagaaauccuccugccucuuccucccaagugcugggauuaaaggcgugcgccaccacgccuagcucagaguucugagcuucuuaaagugaugaacagcuggaucuuagaagaaugucuucgucccuagaggaagagagagaacucugcagugcccagggagcagcucaccggaggcucucauggccuuuacugucugcuaagaaguagaaccucugucuaggggguggaacaguggucuuggguuaauggaacacgauggagagugggggaaagugaggagugagggacaugaggguaaaaaugacuccaagucugggcagcucacacagcacugaacucaaggauuuggcugauugaacuuuaagacaagaguuaauauuugacccuuuuccuaccuuguuaaaauuauucuuuuuguuuuauucaugcauucuuuuuuuucaagaauuacuuuuauuuuauaugugugaguacacugucgcucucuucagacaucagaagagggcaucagacccuauuauauauagauaguugugaacuaccauaugguugcugggacuugaacucgggacuucuaggacaguagccaguacucuuaaccucugagccaucuguccagccccauguauucuuuuuaaagauaaucuuacugcauaucccuggccagccuggauagcugguagaccaagcuggccccaaacucagagccccccuugccucugcuuccuuagugcuuggguuaaagucaggcacugccgcaccgggcuguguacucuuucuucccaauacuccaaucugcaugucuggcuacugugaguguaaggcaaggggacguuuggcucuuuggagcguguguuuagcugugggcccuguuccaggagcagcuuuagauggcuuuguaagcaggccucuuuguuccuugcuaacaaacucaccaccuucucuugucucaccuguauuaaucgccauuauccuguacaaaugagagugcguguacagaugaaggacacaauuaaagccuuucuauaaguugaauauucuuaguuugguuacgaacaugcuucuuucugcuucuguuaaucacuacucuuuucugucuaguauaaagugccuuuggagaaaagauuucaaaucggggcaguuuuuucuauuggcgaaguucaaugcugguuuugugcaagcgugugcacauaccuguguauuacugagaaaccccagaucucucaggagagggagaaaugucaauauagagugaguguguucacgcagacguccaaggccuugcaggagugaagggagggagggauucucgagauuugcucaguuuuccuaccccaaggcugauugauuucuuguguguguguguguauguguguguguguguguguguacacacgugcccacuugcacaugcguucucucucucucucucacauacacacacacacauuuuccccccucacuuuaauucugauuuuccuucauucagaugguacuuggagaucuuccuuaaucugcccucuuacaggaaguuugucagugugugcagcaggcaacagaauaaauucccuauggugaugggugcaguuucuuccccauguguauaggagacagagacugcaccuucucauccuuugucauguacaagaugaaguuucaugcuuguaugucccucuuuccuuccucuuccucuucccaucuuaucacaagggcucuccccucccccacccccucaccugcuggccccacccgaguggaaccuugcacacugucucuaaaaucauguguugucaucuguccauuaccuugcaaaacucuucuugucuuaaauauauuuauaaauguucccuaagaaagaaauggcuuuuagaaaaugauuaauugaaauaguaucugucaaauuaccuuuuuauguauggugguguuugagguaagcaaauugcuacucagagagguaaguagccggccugaggucuuagguagugaggggcagcugggacucugccuaucagugccgcugauggucagacuuguuacgucccuucucccguggucauauucagaaggcugagcuguggaugaagagagugcacacucuguugcuuucacugguguguaugggaggaaaccuaguuggucaagagccacauguuuuguuauuuuuuuccuaaggaugaagaggaagaaaucaaacuggagauaaauaugcugaagaaguauucucaucaucgaaauauugccacguacuauggugcuuucauuaagaagagcccuccaggacaugaugaccaacucuggguagguagauaugugcaagccuuugcugugcauccugucugugguugucacaguaacggaauugaguacuucacaaggagagggaggaaggaagaaacaaagacaaagggacagcagcuucccuacccugucugcacuguagcaaagagaucaggaauaggcugccagcuuacaggaagcucguuuuguuucacauuaagguagugucagucacucauagauaauauuaacaauaauaguuuauuaugaaugguaaauuccauggaaauuucuugaacugacacauccagccuuuaaaaacaaaucaaaaacuacagaaaauggugacugagagccugucaucugugugaggugugugaguuaagcugaagguauuaaaauuuauaaggcaagauaacuuuuuuuauugacuuaaaaaagguuaauauaggaagcacuagcagcuugggacugacaugaaagagguacagaaggccugcgauagauucacccagaaacagaccugcuacccagucacagcuacugaucagugacaaagaugucugccaggaaacuuacaggagagaacagcaucuaugccagaggacucucuggaggcucagggauggagcuagguugccauuuuucguaauguacaaagauaauugaaaauagaucagaggucuuaauguaagaucugaucuguuagaggacaacauagggcagucaccucgcuacagucauaggauuuucuggaaaggcagcaauaucaacaguuggaagaugggauuggauaagauuaaaaaguucugcacaacagagaaaacaugaagaagaucguguauagaacgggggaaacuuuuucugucuauacaucugacaggauuaauaucuacaguauaguuuuaaaaaguaaaauaucgggggcuggugagauggcucaguggauaagagcacccgacuguucuuccgaagguccagaguucaaaucccagcaaccacaugguggcucacaaccaucuguaacaaagucugacgcccucuucuggugugucugaaacagcuacagugugcuuacauguaauaaauaaaaaauaaaaaaaaaaaaaaaaaaaaaaaaaaaaaaguaaaauaucagacagcccaaucaaagaugcagcacugaacaggcaguucucagaugaaguacacaucacccacaaaugacugggaacaugugcagcguccuuagcucuggaggagaagcagccacagaugccugugaggacagagcucacacacacuaccuguaaaauguaaacugcagucaccauggaaguuccuuaaaaaaaacaaaccuaagaguagaaauaccauaagaucuagcuaugccacguuaaguaccagaaggacuccauugugauauauccgaggagauaccuguacacacaugaccacauuauguggccagacugcauaccugugggcagauaaauagaaaaugcaguauuuauauauacacgcuggaacgcuguucagccgcaaagaaguauaaaacucugcauuugcugggaaagagaugugacugagaucauccuauucagugaggugaggcagaugcaggaagacaaauaucguuaggguuuguuuuguuucuuguuucguuuuacauuuuuggguccuagaauuccuuaaugauauauaaaauuacacacagagacuguccaaaaaaagaaagaaagaaaagaaaagaaaagaaagaaaaggaaaggaaggaaggaaggaaggaaggaaggaggaaaguuccugaagaaugauacccgaggccaugcuuuuuucuccacaugcauguauguguauacaugugcacugucaaauaaauaaaaauacagaugaaaguguccuugguuucagucuuagcacacaaagacuauaguaguuuagcuccucguacuguguuaaaacacugacagaaacaacugagaggggguuuacuguggcuuccauggcagagccccucagaugggagucagggcugccaggagcuggcuccucacacagccucaucagcccucugccgagacaaaacacacagacacacaagcuagagagaggaaaagaaaaagaggaggaagggaggagggagacacagggacugcaaagguagaaaugagacaauuauuccuauuuuuauugcuuaauuccugucaugauugaaguuuuggaacaguucaguucauuuucuaagaagucuacaaguguaguuaucauauuuaaacagauacacaccuucaaaacgauguugugguuuaaaagaaccacuucccuuuugauuuagacucggcuaauaggaaauauucugaagucauuucaagauaauaguauauaagaacaacacaucuucaggaagaacuucuggaauacagaucucuaauaaucugguagugaugaccaccaaagugauuucccuuagagggagggaagauacaccucagaguuagcacccaggcaugggccacagaacgggacggcagggaauauacuuuuauaaagcaaacuguuguuacuuggaugcuuccgaugugaccuugcaugugcccagguggcuuguaagguaacaggauugugugaccucgcuuggauaugugcucaggccugggauauggcuguuacaacaugucuugucugccuuguagcuuguuauggaguuuuguggggcuggguccaucacagaccuugugaagaacaccaaagggaacacucucaaagaagacuggauugcuuacaucuccagggaaauccucaggguaaggaaagcaggagcaaccugugcugugcucugaucuuacgcuuccauguggaacggacuccuccgcuugucauugcauuccuuucucucuauauauagagauaauugucucuuuugguagccaagcauucucuauacauuguuuacucuacauacguucaaccccgaagacccaagagguuggccugugugguuuagaaacuauuugaaacaaacucuguauauagaguacagccucccccuugugguugcuucauaaggugugcguuauagcagccauccuguccuagauguaugaaugugagugaccugagggagggcuguguggcuccugugcuacagcaugaggaacuugagcaugcucaugucaugcuucauguggaggagguugggaugccccuguagccaggcuccagucccacaggguagcugaggcucuccgagucugugauuguucuauggugcccagcagugccuccugugaggaaugagccuacacagcuggcugugucugggcuagcucugcagaggcagcacagcaaugcucacagugcugagugcugguuuccagaccuuccguggcuuuggcuuuagcuguuagaaucucuuagaauauuuaugaaguagaguccuaagugcuuagugggucucccccccaccccccagccgauugcaaagcuggcuaaugagcucagagcaaguuucuaaacuaccgaguuuuagccacugaaugcauucuuugacagcacaggagguuuuucagagccucauauuugggaguugugugugaguugcuaagggacuucuuucucccacugccacagcuguucugucccuuuucccuaagcugcauacuuaaacugauugccgggugacuuguccuuccauggguuagaaauaaagacucuggacucaaacugaaaguuuauuuauuugccuacuaaucaaagucuaguaacaaguuagucuuuuuuuuuuaaguguaacuagauuuacuuuuuauacuuaagauucauggaaggcugcaaguuuaaaaacugucgaguagaauucccagagaaauguuucaaugucucucugcuuauauauuuucuggagcuuucaagaaaggugggagugugauguuaggagaauccauaaugccuuacacuuguccucacugaguaucaggugccugccuuuuauggcucucaggagaguugagccuaaaagggagaggcugcuguccuagggcucaguaaugaacccucaggccggguucagcagcaaggacaggcugcauccuagagcuggcuaggcaugggugugaggagcuuggcugauagcuguucucuguucaaaaguacacacaccuuuuuguaggcaguagcuuuagauuugugggcaucugcuuuggcuucuugugugcugcaaaauuucaaggauagagcaccacucuagguagauacaagaaauccguguuuuuagcaucauuuucuagacauaggauguaucucagauaucaaagaugauugccuguuucuaacccgggggagagcagguuaccugucaguguaaugucacccuugacuucaggaacauuggcgagaagucuaaguugcucguagcucuagucagcgugguggcacauggcacucuuugaaaugcuacagauugcuuccuccuuagugagcaucuuuaauaagaaccuucucaacccaugagcugucuacaguaacaacuuucuaugauagaguuuuaguccaaaaccaagaaacacccaguuaugugcugguguuuguuuuaggaguuggugugauagagaaaacaagugagcccagugaguccucagacauugcuggaggugccugguuuccauauggaaaaguucccucuccucccuccaggcaaggguccugaguauacagccuaccacugccucaaguuuugggcuagccugcugaacagugaggggcacaggacucacuggcagagccguucuggccgucuugccuauuuccucaaacacgugcuaagccaguuuucuccuugugauagaaagcacuguuucguacugaagaugagaacgugggacuucacaucaccgggguugagcagaguuugacagcucuuugucacguguagucaaggaagcuaagcguagaagacaacuguuuccaguugauuuagcacaggcuguuuccugaguuggcguggacgcgggucuguacccaggagggguaaucauggccuuaguucaggguugggucccaaagaacuugcugcacauaagggaaauguauuuguuuuugcucucuugccuggucuucaagguagcuguguuaugaacuguucccugaguagaagcagcaguccuuacagaauauggacugagaaauggggaggacuucacacacuuacugcuggaaggugcagauuguauuuaagccaaaacugucugagaagacagggcugcuuguguuguuggaagaugccagaggguaaagaggaaguucaugcgaguuagaagacagaagugaacugaagagguagaaguagagauucuguaagaccaagcggcugcaguuggcucuuucagcguuugaugcuacgcaugccgaggagaggcgcuuccuagucugagcaccacggugcgccaugugcaugggcucggcacccaugaugaagaauagauagguaccacauaaccuaacuucuguuucacuggcagauucguaagugaauuuagaacccacugugcuggaagaaaaagugaucuagggcuguugccguuaaucguagauguugggccugagaacaugggccugugcgcccggagcucuggcacccgagacaggaggcuuucaaguuuaaagcugggcugggcuacacgguaaagacucuagcugccuccaccacugcagcccccagcccuuauuuauuuuuaauaggaaaaucaaaccccugacaaguaacccacccuuucuuucagugccgagggaggcacuucagaaucaauggcuugcuaugucuuaagaagccgcgcuguggagugcagcgucucgugaaugaguuguguggcugcugccucgcugcguuuacaucacagguggaugcguguguuuuccuacaaccuccuuccugagagaugcgacuggacucauucuggauacagggcuuccaaagugugugugccaagagugcuuguuugccuagggaagaaagacuuuauuccuacaugaggcuguucuggugacagaauuauuuuacacuugaacaggagugagauauaucagcacgugacaguuuguuccucuguagugggaagacaagccugcauuuuaagagcuggauuuuaaggcccccucuaauucuuugcuguuccccugggacgagucuagcucaaauaaauucagucacccacuguaagauagacuuuuggugugggaaaggagccguccugaacacaaauagcacaaauuauagcagaaaaaccucagauggcaaucuaaagcugugucauaggcacagcuuaaagugguugugaucaucccagagggaaagaaaguccagcucacugcucucuguauguguggcaaggcuggcggugucuucugggaaugugccaaggguaaauuuuauguucuaaaugcggauuuacaaaaacuuggcccacgugugcaccuuauuauaaaagggugcuccuggcugucuauuuacagggacagagaacugagacucaaaucugcuuuucuuuucagggauuggcacaucuccauauucaccacguuauucaccgagauaucaagggccaaaaugugcugcugaccgagaaugcugaggugaaacuugguagguggccggccggugugugccugaugcaccguccuggugccagcggguggcuugcugugccccuuugguaacuuugcuguuucuucuccccugaaggaugagaggacuggcuuacuguuuagccagccccagccuccgcuucaugcuucgguagucuacucugccuagauauagcagccaaacagaguuugaaaaguuuuuguuugaacuuggggugggaggguggggugugguugaugaggcccaaacucaggaacucaugacugaggugccuuuucugcccuacacuaaguuaaaagucagacuucguuauguaagcacaguggugccuggcauagugcaguacaggauggaaggaugaaggaaaaacauugugaguuugaagccagccugggguaugacguuagaagggggaugagugagagaggggagaacaagagagauagggaggaguguguaggggggugcagagagauggguacacagagagacagauagaaagauagagagacaggcacacagacacagagacaaguacacagaaagagacaggcacccucagugacuuacuguucuauuucaagaagguucagacuuccugccuugccuuauaagaaguguggggucugaccgcuacuacuuuccugccccaucaucucagcucuucacuucuacccuaugccccauguuacaauauggaaauuauaugguuauuuuuaguaauagaauaaagaauaaagucauaaaaaguuagcagagcugcuuucaugugcacucacugcuggcacaacguuguuuuucauuacuucucggaccuugccccaggaccuuugcauauccuguucucaauugggaaucgauguccucauugucacugguacaguuuuuccuaucuuuaggggucucucuggccuucugaucugccuuggaccugugcuuuccuccuauagugcuguugauaauuauaaaaauuauaauucuauugauaucauauggcacuuuucaaauagaagaaaauaguccccuuuacuagaauauucugggagcacagcagccgggauugcuuuggucccugguguauuuucauguggugccuggacauugucuucaguguugguguggguauucagcgggugccucaugggcggcauugccagcuuucuaaugacucagacauguucucugucucccugagcuacaccugaacuugaccccauuuuauuuuuaugcucuuacauuuuaaauacaaccagcauuaacuuuuucuguuaaagggucauguuguuuucccuucggacacccagcagucugcugcucuucuuuucuuccaaaagucugagccauagaaggcugcuccuuaaugcccaacucacugcacccuucugcagugccucugcugccugguuaucugcagugcucugcccauguggaaagucucuuggggcuaagcugggacacucauguuguccuugcucugguguuuccaugcccugaccucaugccacgagaauuauacccucagucuuuccuggccgaggugcuggaaagcucaaucaggcuuuugguccuggauuuguccucuguguguugaggaacaaucaacaaggaagccaacuguuuccugaacuuguucuggacacagaaguggagugugugaccccugccuauugucuaguguuuuguagaccauuagugugagcuucgugcccuucugcugggcucauguggcuugugggcugugaugaugguggcaugugcugauguucguacacccagugugugcuuucugcugacccugccucccuccauccauggcuuucuucuagccaacaucaucauucaauucauggaaaguagaagucacucugaaagggcaacucacauccugaggccaugugugucugucugucugucugucugucuacacguacgugugugugugugugugucugucugucugucugucugucugucugucugucuacacguguguguguguguguguguguguguguguguguguguguguggcugcaagugccagaacacguaaugucagggaacaacugugaagucugauccaucuucauguacgcucuauggacugaccucacauccucaguuguacaguggguuccucuaagucucuucaucuacugaauggucucacugcccacucugcauuugugagucucuuuauuuaguacagugcuguguguuagccgcccagcccugcaguaaucccucugcccaucccucagcaggccaggcuggccuccuggcucuucuggacugacccaggcucuugcaaugcaguuuuaacauuucuguucugagaguggagggggaagggugcaguccuucccagugcugccucccagaauggcuugcagcugacagaaccaagcugccuguggcgguuccucauagacuuucuucuucuuuguucauugcgcuucacuucuucuugcuuuuuguuccguaguugauuuugguguaagcgcucagcuggacaggacgguuggacggagaaauacguucauaggcacacccuacuggauggcuccagaggucaucgccugugaugagaacccagacgccacuuacgacuacagaguaagaacacccacccccuugccgggcauuuuuguguaaacuguaacuucucuuaaacaaauaaauugaagugauuauagagugaccucuagggacuugaaaccauagugcaccuuuuuauccaggcauaaaacucauauuucauuaucugauucagcuugacuguacuacuguuuuauuugucaauaaaaacaaaacuucugcuuuagugauuguuguaccuguuaguaguguuaaaauugaguucauaguuuaacuguuccugguguauuucaguauuuguugucaauauccauuagugagaauuaauuuaaaucauugcuacaccaagauuuucuuuuaauuugaauuauuuaaauauguauuacagacucauuuuucuacuccuuaauacauacauaaaaauugaaacacuuuucaccauuaucagaauaauaucaugcuuaaguaaauaaaagcgaucuaaucccuagggcuggagagauaauaauguccuagcaagauuuguuuuguuuuuguuuuuguuuuuuaccugaaggaugcuuuuauuccauuuguaugacuguccagaaauacaacuaggcaucuggaacauucucuuuuguuuuugcagagugaccucugguccuguggcaucacagccaucgagauggcugaaggggccccccgugaguaucuuccuuccuucugagcucauuuguucuguauaaagugauugccuguaagaacccaaggacacugggcagaaccaggcauggcugagugauuggaugagaaacccaccaucggggcggcugcaggugcccaggggucucucaguaaccaguuucccuuuuggagugcccugggucugcagccuauucaugugcaacaucugaaauuaauaagagcucuuuuuucuuugcauuugaagaauacugacugaaaggggucccucaucuuugaaauucuauuuauuuugaguuuacaaauggagaugcugccuuuuauuuacgggguuuucugugaagauuugaguuuguuuuuccuuggguuaauucaguagaucgaucagucauaaaauugaucuuugauuggaguugugauagaaguguagaaaaaaauaaggaaaacacucucggcguuucuccuggccugcuaaggaagguguguccagacacuguaugcugccucguacagaguugugaagaaauaguugccgaaagacugaaacgguccugacaguuaagaaucaguuacugugcagaaguggguguccaccgcgaguacugugucccucguguuuccuuauaugguauugagacagggacauagugcugggucauuuguccuaguuucccuucacugggauaguggugucagcuggucugguccccauuccuagcugccuuaccaguauacuguaagcaugugccucaucugcugugccaggccaguguguacgucugcagacagacaguaacugcacaggggucagcaccuccagucacagacagcagugugugggggcuccgaaugugcgcgcugcguuuaagcauugcuuccuuuugaagcaccgaaggccuuuaccaagcuguucugauccuuagaccaaccuuauaaacacggccguuuucauuauaauuuuaaaggugauuuaaacacuuaaauuuuucuccuuuugaauuugaguuuauauuuaucuuugauuuaugaaaacuuugcagugucaauuugaaguuguguauuuuuggucugcuucuauuuuauuguuuuuuaaaugguaaaauucaaguuauggccuaggguuuauaacuagauaucuuagcugcuuggcauauuuguggcaauuauuugugaaugaaguuguuuguacaugaaccccaguggucaggagaguaagccuuacugacaccgccaucuccuuucccagcucucugugacaugcauccaaugagagcgcuguuucucauccccagaaacccuccucccaggcugaagucaaaaaaaugguaagccccaccucccccucccuucccccacucugucggucccucucccccuuccccccuuuucuaugccuuucuuuucuuuucucccuaccucucuauaguuucauuuuguucaggaauaaaauucuggccacccuaacuucgguacuacaaagucagcagccuucaacagucuaaggcacaugaguucuuccuguuguucuugauucaucggauuucauuuagucgcuaauagcaagcaacuccgaaagccccauaauaugaagaaaaggcuauguuuaacguuuaagaguuaaacaucuuugaaguguaauauguugcagaacauucuucuucuaaaauggcaaagauguguuaaaguccuuugauaacacauuuuaacauugaugaagggugucuggggccaucggccauguuugcaggcccugacuacagcaggaggaccauuugaacauaggaguuaaaagcauucuggguaauagagcaagauccuguuggggguuaggguggguugcagcuauaguugugauguuuuauaaaguguaccaaccaguggcagggcugagucuuccaccccacccccaucgugcacacacaaaguaaaaccugucauuucugccuuuguccacuaaacucugggaccugaugaaucgagcucaagccaguguaaggcuggcugaagcauccauccguagaugcccugcguuugccaacagaggcaggccccuugcucaucucuguuuguuaugagacuuauggucaucugugcaccucccugacccccacguuagugaaggccuuucucuguuccugugccucugcuuguuccaugauuuaaugguuagugaguaguaguagacuuaaacucuguuccuuuaaaccuggcugcuuuuaucgcucuguaugauaauguuguuuguggugcacugcaggugugaccacagugacacugcugagugcugcaggacauuguuagugugcacugcagguguggugacagugacacugcugacugcugcaguacauuguuagugugcacugcagguguggucccagugacacugcugacugcugcaguacauuguuaguaugcacugcaggugugaccacagugacacugcugacugcugcaguacauuguuagugugcacugcaggugugaccacagugacacugcugacugcugcaguacauuguuagugugcacugcagguguggucccagugacacugcugacugcugcaguacauuguuagugugcacugcagguuuggucacagaaugguuuucaggcucgucaccaguauuuuugagcuuaacuuuggugauagaaguuugaugauauguuucacuuucucuuacaggucaaagaaauuuuucagcuuuauagaaggcugucuggugaagaauuacaugcagcggcccucuacagagcaacuuuuaaaacacccuuucauaagggaucagcccaaugaaaggcagguucgaauccagcuuaaggaucacauagaccggaccagaaagaagagaggcgagaaagguaugaaggcuccuuuaaguuugccuuccuaccauagcguuaaggggcccuagacuguguuaaagcagcaggcuucauucugacaguuuaaguacugcugcugcugcugagcugcacuccuuccccugugcucuuccucccuagcacccucuuuccucuuccugucucguggcccugggcuuuccugcacacuugcacagcaagagcaagaccacuggaugcuaacacuccucaacagcccgccuccccucucgugauuuccgccugguuuuaugucauauaccgcacacugacacccggguaaaccgugugaaacacaccucguuucccugagguugauuugacuacacagucuucaguuucauauguauguuuuagauuacuuuuuuaagcacaggaagauuuugcuauguagugucauuuucaaguggcauaaugacuucauggucgguucugccucagauuuauuccuggacaguuguuucuuucucagugaguuugugguugucauauaggaaagcuacugaguuuuguauguuaauucuguauccugcagggucuuuaagugucugagauuagcaauacuuugaguucuuucuugucuuuauaccuuuuacguauuacuguuuaguugggugggacuugaaacacuguaucaaauaagugucuaguucuagguuuuagagaauauauucacuauuccccaucuaguacaguguuguuuauagguuugccuuuacuauagccauuacuguuagaaguauaucuguagguuuugugcuccuucuuucuuggggacuuuuuuuuuaaguagggccucacuauaacguaagcugcagauucacagcgauucuuccgucuuauccuccccucugcuggguguguaccacgagucagaaguuuucuccucuuuuuuuuuuuuuuuuuuuuuuuuuuugguuuuucgagacaggguuuuucuguauagcccuggcuguccuggaacucacuuuguagaccaggcuggccucaaacucagaaaucugccugccucugccucccgagugcugggauuaaaggcgugugccaccacgcccggcucaaguuuucuccuuuugagcucuguccuugaguuuauuuacaccauguauuaaaauuggggggugugggcugccacaguucugcauccucgagauaaagccauuuugguugugucuuuauaugaucuugaauauggcuuucaaguauuuuguugagaauauaagaaacccaauguuccuuagagaaauuggccuuugauguucuuuuauuccgucuuuauuggguuugcugguaggucaucuuggcuucauaggaugagucugguagcgucuuccccuucuucuucguggaguggugagaguguugguguccggucauccucaacaauuuggcacaaccugcccugcaucugucccgccuuacacuucuuaaccccaucccagucucagugcucauaucuuacagauuucauugugguaaacugcagacauuuagaaucuuguucauuuuuuuucacuugccaaccuuuggaauauaaguuuucagagcauuuucuaaggaucuuuuggguuucauuggcucuaugguaacaauuugauuuuuaucuuuaugauacuaguauaacuuggaguuagucaaucuuauugaucuuuucagagagcuggauguggugacuacuuuugugugaccccucuccccgagucugccucggugcuuucuucgcugcucuuuauuucuugacaugagcugcguuugcuuuagcuucuugauuucucuagaccaguauuugagaucucugaauuuuuaacacaucugcuauuucugucaucuauguaucgauaucuguuuauauuugucaguguaauacuuucuugagugugacuaugcugaugcuguugaguuuuuugguuuucuuguuuuuuguauacacuuccucagauuuuaucaguggagaaugaccagcucuucuguagggaguguagccagcucagaauuccugaccuuugacgggaggucagacacgcuucuccccaugccguuuucacaaguugcaucuugguuuuggucauucugacucuggggaugcuugucuacacgggcaucugugaggaucugagcucuccuguuucucucggccuuguuuuucagaugagacggaguacgaguacagcgggagcgaggaggaggaggaggaagugccugagcaggagggagagccaagguacagacggcagccagcccaggcuuccccgaugccugcccacacucugugaggcuuucguggagcaguggacagcacuggcuugcuuccugucugccauuuuucucaccccaugacagaucucugugaacaauuucccaaacucuugccucguuuuuaguuuuguuuuuaauucaauuuuauguuugagguugaggauuuaaugcuuuuggcauuuauugcugcagaaggcacaaaugguacaagucugcugccggaccaaagucagucccacacagagaagcgugcagcucggaggccagcaggcccucugcugagaaacuuucccacagccuuauuuucccuacaugcaaauaugguugccagccuuugaccuccauccuucgggugucuucugccugcuuuagcucaguggguuuacuuucuuauguuuguacuuuaguaauagguucgcccacagcuguucuagcucuggccuuaccuuugguugaguacagaacaaaaccaagaugaagguuguguugagacccaugggagccaugaguugggaauagaaguucaaagagggacacggguuuaaggaggugugucuugccagucugugugauacaggcuuggggaacagcccccaacgcagaaaagucuccugugaggccugcugccaucucugaugauagaaaauagugucagggaacaaagcaggcuugguguaggccagaugagaacggagggaugcugagaccagugggugcuaguacuucugugccaugaugcaaaacuagagggccagaggaagacccgacaugaaagaagagucccgugaaagaaugcuuaucugcuaggacugcauuuucagacauuacuaagucauagaggaugaugugagccguuggagcaguaggcauugucauccuguagacuuguugauuugggucacuccugggcccagucaguagccccaugaagggaacuggguguucccauugggucacacccuacgaggcccaggugaugcauggagcccugacagacccuauccccugcaguuccaucgucaaugugccuggagagucaacucugcgacgugauuuccugagacugcagcaggagaacaaggagcggucugaggcucugcggagacagcagcuucugcaggagcagcagcuccgggagcaggaggaguauaagaggcagcugcuggcugagaggcagaagcggauugaacagcagaaagaacagaggaggcggcuggaagagguagaaaagagaaguucuguggguuuuuucccucuuccuuacucauguucacaucagacacccugcuagcuuguugaggaaauaacuauagguagggagguagucugccccuacccugcugcagcuucuguagggcuauguggcugugcacuagauggcuucacguuccuggaggaucugccaacauuuaugugcauaucgugaggagcaggacagcccaagacauguucccaugugcuuaaauugacucacuuagacuugaccucauuucuuugccauuguuggcuuuugugacccaguuuuauauuuuucugaaacuucagacuuuuucauaugaaaagcauuguucucuaaaugccuuagcauuuaagguggauuuaaaauaaagcauuuaggccagugagauugcucaauggauuaagaugcuugcacccagcacagcaacuugaguuuauuacuggguccccgauaguauagagagagaaagaauaacuccagcaaauugucucugacuccgcuguguguguguuuguguguguauguguguguguguguguguguacacgcccucacauacacgcacgcaauaaauuuuuuuaaagggguucagagagcagaauaguaaaguuacuuguauuuuaugguagguauaguuugcuccauuuucaugaaaggcauuuauauuauaaacacuggugauguaauuauuuauagguuauuuguauuguaaucacacaaauguacuauuucccuauaauucacuugagaaucauaacuuuuaauuuucuuuucuugacuguguuuuacuuuauaugccaaacccccacaacuucucaucauuugauuugaacauguguguguuuuuuguguuuuuuguuuuuuucugcuucuuacuguuuuuccuaguagaagaaacgucaaagauaaagcccuguaaugacauuucuggugggauuuaguuaaaauaacuaagcaugcugcuuguugccuaggucaugauagccuguguuggcaguggugccuuugauuagucuguggaucaguuugcugcuuggaaagccagugagccucacugcgggagaucauggaaaggacauucaguuaggacuuuuagggggaaaaucacugaguguagaacuuuuaaaauguacuugcugcaaaaucauuucuacaauauguaagauuauucucacuguucugugaccagagcagaaaaccggaaugagcuugguuuugacuugagguuagagacugguggcuguggccaugucuguuacuguguuccugggaugggcugcacugcccaggcaggugcaaagguuacccuggauugucguagggacuagaucgucagaguuuguuuguagcacagguggugaggggggcuuucaggcugcgguagugagacuggcgggcagcuacgucuguggggugaggccugagaaagaugcccugcaagcuagagauguuugcuucacaucuucucacugaccugcuaauucauauucaccucaggaucaccuuugcugucgcuuuccuuaagcacagaggagcagcuggagagacgcucgggggcuaagagcgccugcuccugcagaggaccucaagucugguucucagcacccacgugcagcucacaaccacucuugaccucacggguaccaagcacaugguuacacauacguaccugcaggcuaaacuuaacucgcuugcuaaacguacaguaaaucuaaaaaagacaagaaaggagggcagacaguguuagggaaacgagagcgagggauggauuucaucaaaacauauuauauggauugugaaguucucaaacaguaaaaaucaacccuuaaaaacagacagagcuaggcacuggggugauaagugugcucacaaacagguccccuuguuggggucuuggaggccuucuccuuaauuggaaauuaaaaggaaauuuccuugucucuggaggcugguuuuccuuaauuggagguagcucuaaguguuguuuguaccccagguuccagagcggucauuugggaaucuuugagguuaagugcuuuguagacauuucaauaacaggcaagucgggcaguuuggaauucuugcuaugaacaguguaggugaugauucucggccucacaagaugccugaguauuaaaaacgaaaaccugggccacugagucugaccugaguucagucccugggacccaccuggcagaaggagaaaucagacucuggcaggucauccucugaccucaugaguguguuguggcagcaugcuguuuacauugcacccugaauaaauguaauuaaaauaagggcaacccaaagccuaaaugacuuucuuucaguacgccagcauaagaugcuuaaaaaucaggaggaaaggaaaccgugaucuaggagucccccuuuggcacuugccauaaaccuucuugcugcagcuagguguguccucuucacucauuauggagguccuucaucuuucagaaguacuucucuuguguacuguugugcuuuguauggacacacagaugcagcuuuugccuccaagggaauacuaaagaguuugcuaugacgccagauuugaaugguaauggcucggaacagcucauuuuaccccaaauaccccagucccacaugauaacagucuuaggaaguugcaguuuucacaaggacagcuguagaugaagauacuucucaugaggugugugaguuugugugagagugugugugugugugagugugugugugugagugugugugugugugaguguguguguguguguguguguguguguguguguguguguguaggcauuauuuagugaagcaaggggauccuguuucacacccaggugcuggugaccucuuaaucuguagguugguggacgcuaggaguguuuguacauuccaaaaggauuuaccuaggaauccuggacauuaggucaagcacaaacgagcagugaaugcuuauugaagagacaaaaacccaggggagauaaacccagcucucagucacacuguagucacacuguagccagccucacgaucuuacgcacaggugacugcucuuggcuguuccauucacauagccguccugcagucugaucucugguuuugcugagauugaacuguuugcuuccugccuuucuccuggucccgggaagacacagagcgugcugagcuccugcagccucgucuuugcccuaaagcugcuagcgccuuucucugcuuguuccucuuccuguugacgagcucugcaguaggaaacccacucuucccuggccuguucuuucuguggguauuaaagaaaauaaucucuacucugugcucuuccuuuuguguuuaacccuggagucugagcuguggcuuugugccuggggauugugucccuccaggguugcgugaaccugugcccagugaaguucuuucuucuccuuccucucaucaggagacaugcagauauuccacuucagagauguggauagaaaugaauaaauuuaaaacggagagaaauaagagaaaagaacauuuuguuaggaaguaggguuagcacuaauguucagcuuuaguuagcaccagacagugucugaggaagaauuaccaagccgucacgugucugucguguuucguguguuuaggagggaaaauugaacuccuuugccucagaagauuuuccugagggcuugcacacauugcagaggagugggagccccuuccucucuugccauugcacuagcuuugaccucggggaucccugcuggcuuggugcugccuucucacagcucccacuguaauguuaggcagugucuccagggacccggagcuggagccccacagccaaggccuugacuguccagucagcagggcucggcugcuuccagacuguggucauguuuauaagaaccuuuuagaaguucuuacguguucuuuugacaugcucacacucacacacuauggcagccacacacguuacaaaugcucucucucucccccaaagucuuuccccagacuuugagacccccguccagugcaaagaucaugcagccguaggaacuggucaggcugugaguucuuaccagccauggagugugguaacacuccaugagagugaccgguuuuccguucaucaguuuucucuaacccuaaggaggguccuucgcagacagcauacaagauagucccuucugcaguggcccugcguugucagcugacuucagcguugacacggaugcucucagaguuccaucagccugugucuucagccuggguggacccuugaaggagaaacucacaggugccagacuuuaaaguguaacagagcagagagcauucccaaacuccagccucacacuuaccagaagucaucuugaucuauuuguaccacaguguagauaaccaaaaaagguaaaagacguuuuccuuuggaaaugguauccaaccaggaauauauaguggaauuaaauaacuuauacuugaaacugcuuuuucccaguuggcaaaaauucaguaauuguuauucucagaagaaugaucauguucuuagcuguugccuauuacacgcaguguccggcaagguuuucuuauugcuguguagggaaugugauaggcuguagcuucauuuacuuugaagggaaaacgcuccagauguucauuuuaaguaugauucuugaguuucuuucaguuuugcuagcuuguucauggagaccugugguaggaaaaaugugcugucuuagucaggguuucuauuucugcgcaaacaucaugaccaagacacaaguuggggaggaaaugguuuauuuggcuuacaauuccauacugcuguucaucaccaaaggaagacagggcuggaacucaagcagaucaggaagcaggagcugaugcagaagccauggagggauguucuuacuggcuuguuuacccuggcuugcucagccugcucucuuauagaaccaagacuaccagccuaaggauggucccacccacaaagggccuuucccccuugaucacuaauugagaaaaugccuuacagcuggaucucauggaggcauuuccucaacugaagcuccuuucucugugauaacuucagcugugucaaguugacacaaaacuagccaguacauguggguuuuuuuguaccuaguuuauaggaaagaauaaagguauuauaucucuggaaauuguggacauggagcucugcauuagaucugagcccaaaagacagagggcaggaggaguccucugcuucccccccccccaccugagcuaaggccagaaggcuggccaagcucgguagguaugugggaccuccuggcugaugaauauucauuucacuacacaguugcccacuuuucauuggauuuggaacauucauguguaguaagagauuucuuuuuucuaagauuuuuuaaaagcucuaaaggcgggcuaacaaacagcaggggauguguggcaagggugagccucucccugcucugcccaggcaccaugcacacaggacauuucuugugcuuccaggaaaucauugcuacuucagcaaacacgaguauuguggagagaauucagaauggguacucagcucuuacuaauccuuauauuguaacccauuauaaacuucugauauacuguuuuuauucacuuuguccugugguuagccucugugugagagggcuugugaacuuuaccacuuuucucuuucugggagggugagugagcuguagaggugcuauccagugcaguagccauuaguggaccugcuuccuuauccaugcaagcuccaguguaggcgcccagugguggggugugacuaguggccauauacuguugagugcuuauuagagacucuagcaucucucgcauucauggaaagaacugacaaagcuuagacuccauggcguggaugcccuguacugacagauggugugucauucugcauggacagucaaccauagaggagcugcugugugcugugugcugugugcugugucuagagcaggcugagucucugaguuggguguacucuucuaugagugggggugcuaggccacaugcagcuggaaaaggccuuacaggcggaauaaccauuccgacagaggcuuuuuggguggagacacuggacaggucaguucauuuuucugagccuguuguguucuguacaguagggaggaggguuuugaagggaauuauaccaggaacaucaacuagcuuuaaagguucaguguuugaaacaaagcccgggacagcaguauucacacuuccucauugguagcuuugauguauuccuagcagcgaugguggcucuugcuuucuucugcugauuuucauuucuuuuuguuguuuucuccugcauauuucucauuuuucagauauuuaccuuccuuuguccuuucuucuccccuuuauucaucucuucuuuuuguucugacuuaaggguccuggauaguuagugaugcccaugaaugacagaugugcugaccucugagcccugcaguggguacugacgaugcuugcuuucaaaguggaagacgagcccugcaagcacccacagaagcauuacaccucaggacaguuuguggggaagcugcagggagaugcagaaauaacugacuagugcagcuaggguccagaacucaccucaucuaccccugcuuaucgccgucagcaaaucuccugagagccgcagcuguagauuccugguaacuacacaguucuccuucugcagcaacaaagaagagaacgggaagccaggaggcagcaggagcgugagcagcggcggcgugaacaagaggagaagaggcgucucgaggaacuggaaaggcggcguaaagaagaggaagagaggagacgggcagaagaggagaagaggagaguggagagggaacaggugagcuuucaagaauguugacccagguauccguggccucuaaccguggagcugggucccggggaccaaaugcauaugcaugcaugcaugcaugcaugcucagggguuagguaucuaaacgugcugaagacuccaacgacuugacuuuuuaucuucaaaaagaauaaaaaauuguuacaguguagagacccugugagucuugaagaggcugacaugugacaggugucugaauauacacucacaggcuuggcuuacauccuuugagcuccaaauaacugggugagguuaacuuucagacagggaaauucaaaaccaacuuuaaggaaacuauugauaaaugccugaaguaucuacuggcugagugaguacuguagccuaaguguagcuuugaagauuguuuguguugcuuaguacaaaaaccaguuuuguauacuuguucuuuuauuauugcccuguggagcuuauuuguaaauuucuuagauuauuuaugcaaacagaaaauaacuuuccuuaguuuauauggcuuuccuaccuuugaauuggucaaucugugcuuugagcuuugaagaaggaagaaagucaaugaaugaaagccauuuugaauuggaguucauauuuaaaguacuaacaaacaugacuuuaucuuccaaacacagugauccagcuacuggccuugacacuccuccuggaccuugugugucuaagccugggucugcacaugaacccauguuccuagaaucuccgugguauagccuaccuguuauuaucuacuucuuggcccuaacaguagggcuuauuuguuuauguaguuaguuacuaauguuuuuauggugcuuauuccuggcggcuacaaaucugugaaaaugcuaccugcuacuuguuggaagucacccaggcaugauuccaaguuugauugugacaagaaaugugaugguggcauuuucguucuuaagauuuugugaauaaagcuggagaaauggcucagcaguuaagagcacugggugcucuuccagaggacugugguucaguucccagcccccacauggcuuccuacaaccaucuguaacuucaguuccagggauccagugcccuuuccuggccucuuccagcaaugcguacacauaguguacaaacauacacucaggcaaaacacucauaaauauaaaaaugugaaagaaccuugaaaaagaugugaauagcaaguacccugcacuuuuagcauuucuuaaaauugguuguuuuacucugcuuuuuauguuuuuauucauuuauuuauuuauuuuuguaaauaaucuucccuugcuguggugcgugguacauucccacgaaagcguguauaugcuguauucucuguucguugcaugucgagaucuuugugguuugcauagcaucugauuucccccaguauucuugcauuuuaaagucagaaaacauguuuauaguaacuugaucuuucaagcucugauuuaaauucuguuauuuucgaaaaaggaaugcucugagacacagauuucuuuucucaggcagcuaaggccacgugucugucacaaagccacuugauugaugccuuagcgugcucuuggcaugucagguguaagcuaaagggacuuggcuuuggguguuuggugcgguuuauaagaugugguguucugaguguuugcaggccacuguuucucuguugucugguauucugaccagaacuauugguuaacucaaacaucuggucaggcauaucuuuggcucuuuuuacuuaagggcaugugccaugaaauggggugguugggaggaggcgcucacuauagaaacagaagccaccuccaugggacaguucucccacaugccaguccauugcuccccugcuaggacaaguagguccuccugcuuaauguggggcugaaaguauacagcaggcgcugcggcuugucucugaugggcuuggguuaggguuuccugaugccuguguacuaauaggaauuguguaacugcaggguuguguguucucaccucucaccuaccccauccccagcacuggagccgaaaccucugcugugcucuguacgagguuaccgucuccacugugacucgguggucguucucgcccgcugucacgucaucagccugccccugcacucgugccuguacacacuacacagacacacaagcucaccagcgugggcuuggccagauuaccuguagagaagugcccauaguccaugacuccugaccacaucuuccgacuguagccauuauuccaggaacuuuuggagucauuagcaaaagcacaaauccuguuugguugguuugggauuuuguuuuuuuguuuuuuuuuuuuauuuuuaucuuaaacagauuuggguguuaguuuuuaaaaauugcugguuugugcuuauuuaaaaugaugccucgccauuucuguggugucuguuguccuuaagaggaagcuagccuccuuaaaguuccguauuggaugugaugagaguguaauagcagcagugcuugaacgccgcugugugcaucaugccaguaagcuagacuacuuacagcuuggagccuugcaaacacccucagcagcagguugucuucacuaaggaguccaguccucggcgagcuugcugccgagcuucuggagugccgguuacccacacaggggacucagucgcgucccuccuggauguacugacugcugggucauuucugugugacaggaguacaucaggcggcagcuagaggaggagcagcggcaccuggagauccugcagcagcagcugcuccaggagcaggccauguuacugguaacgccccgccucugucccguuccauaccacagggccguugucccuucccuaaguuggccagauguagugaccgucaaacuuuuuuggucucacuguggcagccagguuccagugaagcuguccucuggucaugcuaucaagcacagugaaaacugcccuuaguuuauuucccaauaguaagcuagcuccuuguuugguaaaugccugucaacucuuaaacagaaccuggcauucagugaaugugaaaaugccagagguaucagguucacagugcaugcugugggaauuuuugcugaguauguguguauauauaccacuguaucugauguuuaauugaauuccuuuacuccgcaaugauguuacaguuagcaaaugcugucacauuuuacacagguaacaugcuauuuaaaaucccagccauuuugccuugcucuuaaacaaugggggaagugcuauuuaaaaaaaaaaaaaaaaccaaagccaagaagggauccagagaggaggugagcucgccacgguccccagauucagugucacccucucccucuccaaggagugccgauggcgggagauggaggagcaccggcaggcagagaggcuccagaggcaguugcaacaagaacaagcauaucuccugucucuacagcacgaccacaggaggccgcacgcacagcagcagccgccgcccccgcagcagcaggacaggagcaaaccgagcuuucaugcuccagagcccaagccucacuaugacccugcugacagagcucgggagguaccugcuuucccuauugcuuacagacuggucccgagagagcuaggcguccccugaugacugucgagagcuguacugcaggaucucaccucuguuuucugcauggauuucuugguuaacaaaugcuagagagaucagaagaaaacuacacacacacacacaaguaccuggcaguguuagucuuuaccaugcgaaugagagaaaugucagucuuguuuaagacuagcaugaggaggcaguggacuuuuagccuuacuggaucagugguguuuggaugaccagagccucccauaaggaugcagcaagugguccucucugggcuagacagaaggacgugggugcguccaggagcacugugcgguucuggccugcagauggcucccuucuacaucuucccucacagggagcagaguccaggacagauucuguucuuuagagaguaaugaagcucuaggugcugaggauagucuagaagcugcuuugcuuaauuuucauuuucauaguuuuuaaaaguccucuaucaaaucuuagcccugcucagcaccgccacugugcacuuagcugccucucuucucagagcugaauagaacacauuuucucucaguugucuugcucuuacauguuccucaucucuccuuuccuacuaacauggagccgugucuucuaauucucugacgcagguggaagauagauuuagaaagacuaaccacagcuccccugaggcccaggcuaagcaaacgggcagaggacuggagccacccgugccuucccggucagagucuuuuuccaauggcaacuccgagucugugcacccugcccugcagagaccagcggagccacagguagcagcaguagcucccugugccacguguagcccguugucucaacagcuggugugaacaggaggcgugcauucagcguagggagaggaggcuugucguuuguuuguuuuguugucuaagauuuuuauugaacucauuauggcuaucuccagucaauacuuuuauuucccccuccuuaacucagaugugaagucccuccuuccucuuaaauacuuuuuuaaauuauauuuuuagaacguugguuuuauuguauaagcagguuagaagagaacuuuuaaccugaacauuuugaaguaaguacuuugugucuguggucccagcucccugaaggaccuuuggacgcuaaagguggccuugcauuucugugcaggcuccuauuuauuuggcugaauguguaaauuuccugggaaaagguuuuugguuuuguuuguuuguuuguuuguuguuuuaaaauacaaaaccagauucucaaaccugucaagauugaacacagguuaugccuaguggguugaauauugauuuccuguaagagauuaggacagaguuuaugacuuuuccuucagucugucccagagucugucuugucugagugcucagaagagaagcagcagccuugucuagaaaggacaguagguggcagacacacccauccccugaggguguguaggcacuccuccaugcugcucugccucacacacuucucugagcuuucuguacucggucggcccugguguuugcaugucaccuaggacaagaguuggugguuuugagaagaaauggcccuucugugacagaugcagucacaugagaauuugaauguguucugcaguaaccaacccuccugggggaugguugagcugagcaaaucugagguacagggggugggguuuaugcagauauagcagcugagagcuucagagagcuacaccagagaaugccagcagaggcagugggaagggccaggugccacuugcugcuccacuuagugccuguuuccuggugagaagcaugguuguccugagagcuaaacccaacacaagggcaaacuugccucugagcagcaggcucgagaagcuucuguuugaggagaugagacagacagccucucuuccuccgcugcagaguucuugccccaagcuuucaccugcaggagggaaacucguguggcuccuagcguugagucccacuuagcguuauuugguaacacauccguuugguugcucucccagugaacacuuagauguuuuaguaguaugggaauuguaccaaagcuaggauucuuuggaucugccugugagccacagagacuaugcacugggucuuaacugccgguuucaccugcagaagccaggcaagucagcacaagacacauugauuagugcgugcugaguuacagcucccauaaccgccuuagugguugguuauucuccagcagugagguacagguaccucuuacuaaaauaguuuauagaguucugagaggauguuuuuuuaaagugacugcagaaauucacuuggccaauugucauguccuugaguucucauuucaaaggcauauuccuacugucagcccagaguaucuugaugcuggucagccugggcuuucuugguacuggauauuuugguaaagaaauuuuaaucccacuuuuuucauaacuaggaguguaaacucagcuaggucuaaaacauuuuaagauugggagaaaaaaauauugguauucuugaaaaguuggcuguucuuaaguuucucugcuacagucccauaauaggaagagugugugugcacgcacaaauaagucccgucaguaagauucucagacccaggguucugaggugguggggagguuugcugaugagcagugucucugucaugugguccccagcucucugugcugacauggacaugcauguaucacucuccccucgggggucugugcaugccccuguucacugcugucugcaguuugugucugggcacuuucccuuaugcgugugccuuugcucuuccucuugccugucaccagcauggagccuauuggcugcuccaugcuugacacuaugccuccccgacucacacccaccuccuguuugggauuuaguguugaccagaaaagcuaguuguaugcagaacgcauugaauguuuuguguuuuguuuucuuguaagguacaguggucccaccuggcaucucucaagaacaaugucuccccugucucgagaucccauuccuucagugacccuucucccaaauucgcacaccaccaucuccgcucucaggacccauguccaccuucccgcagugaggggcucagucagagcucugacucuaagucggaggugcccgagcccacccaaaaggcuuggucuagaucagacagugacgaggugccuccaaggguaaggacagacagacagacgcgcuguuuucucuuuauuuaaacuuacuguuugcugugaugaugggaacagugacuuacuucaucagggcuaaagggccagaaguuucaaaugacuucucagggagggaagccauuccccaccucagcaguuacaauuagccaaugguuaguuagcuuuuuaucauugacugguuuuaaacguaguuuaauaaaaaguauuuauggaaaaaauuuuaagcaacaugcuucuaaauaaguagaauuauaaauguguacagaagcucuccauuauugugcaugacaucaagaauuuaagaaaaaaucuuaugaggaaaaauuaacaagaccaugauuuuuuacuuuaaaguugagcguauuguacuuaauaguacaugaggauuaaaaggcacaucucaguuuauuuuuuccuccacuuggaauuugcuuccucugaauauuuucucgcuucuuugccagucuuugcuuccugcugaucuauuuguagaccguuguuggauuucuuugagcuuacuuuugugauucucacauacuaucucagggaagcgcugcuguaugcucucugccacccgcuucaguccaaacaugacuucagcaugacaggacuguagagaugggccaggcugucuggaucgugcaggagcaggggaggcuugggaaagggaagagcuagcuucguggcaggcauuccggacugaggaaggcuguguuauaaaguguacugugaggagggggggcugggggggagcugugguguucuucuguugucugucuuaacugcuguguuuccuaccuaaagguucccgugagaacgaccucucguuccccuguccucucccgucgggauuccccacugcagggcgguggacagcagaauagccaagcaggacagagaaauuccaccagguaaaaaaagagaacugacaggaggagaugugcuguggcucccagucucucagaaagucaucuguugucuguuugcagaaaugugcaucucuagcacugagguucuagaccgaugugacauauuuuacacacucacacacacacacacacacucacacucacacacacacgcagcagcagcagcguuauugaucaguagugagaagcagauuugaaucuugauguguauuguaauuuugaaauguaaacuauauuucucuguaaagguagagaagggagaauugagaacagguucuaagaaacauaauuugagagagguuuuuagucuagaagaaauugugaggguuuagacugaguuaaaagaaaucacagccaaguuaguauucccucacaaccugccauagacuaccaugcuagccaagugaugucauugcugagguuuaggguggcucugucugaugcaguagcucuuggccaaugaggcugaguaugaauuuaacuuaauuaaaaugaauuaagcuucaccuuuuugguggcuggagucacguguuguuaguggcucugacguuugcucagguguggagugugcugugugugcacuuacugaaaacuugucacuguugcccugcagauaucauuaaguguuugguaauuuggucaucaguggaccugugguguuggcaguguugguacaagugccuagauggaugacaguccagagucugcaggcaacacuuuaaugcuggugaccagagagaucuggcauucuccuaugacagacaguguccagggcacagauucuucccaguguaugugugcuaugggucugaccauggcaggaagccucacggcuuugcuuccuccacacaucagaguggacuguggguauccaagguguggaagcugucauaguggaugagggcaaccuagauacagaaaaauuucugaguaauuauuuccaauuaagaguagggucuauagacagaagugguuguagguguaaacagucauauuucacuucauauauaacauggauuucaugugcuuuagcaagaagauacuguucagcaucuuuuggguuuaagauauugaagaugcuggcccugaauacagucuuuguaaugugcagugcgcucugugugcagugcacuuugugugugcagugcacacucuguguggagcaugcucugugugcaguguacuuugugcaaugugcugugugugcaguaugcuaugugugauguguucugugugcagugcacugugugugcaaugugcugcgagugccgugugcucugugcagugugcugugugugcacuaugcagugugugcuguguaugcaauguguucugugugcagugcacucugugcaguaugcucuguacaguaugcugugugugcuauguaaguauacucugugugcaguaugcuauguguauuguguucccugugugcagugcacuaugugugcaauguacucuguacagugcacuaugugcgcaaugugcugugugugcagugcacugugugugcaguacagacugugugcuguguaugugugguauacucugugugugcaguaugcuguguguauagugugcucugugugcagugagcucugcagugcaugcuauguaugcagugcacucugugcagugcacuguguuagcugcuguugcaggcuucucucugccuccacagugcaugucucugcuauaguaugaugggaugacacuguucucuccuuuucuaacagcaguauugagccccggcuucuuugggagagaguggaaaagcugguccccaggccaggcaguggcagcucuucaggguccagcaacucaggaucccagccuggcucccauccugggucucagagcggcuccggugaacgcuucagagugagauguaggcuaucucuccuauacacuuucucuagggacagccauggcugcaguuuguuauuagaagaacuccauguguaaaaggaggcccagcucugcauauagcugcauuuuacaaagugaugcuuugacauagauugcugaggauauaaucagugccaauaagguuacccagaaagcuguauuuucagugcuucgcacacgggugccaugguugcuucacagcugaguggaauuaaaugcuuugccuaaggugaauuagcuaaaugccucagcugggauuugaacacauuucuuccauuuugaacucugaggcugugcuguagucaguguguauuacuggugacaguagucaaaaaguuccuucacugagcucuucucacuacuuggaagcagguauuaaacagaggugggaagagggaagccuuucccucagaagggcugccagcgugucccuuggcccuguuuuaccccagaguucagacccuauggagaggggucgacugacgucagcagggggaagccagaagcuagacugaaggggaggagguggagagugugugacaugcguuuaucugugucucugcuuuuuuugucucuccugaacguaccagcaucauccaagucugaagguucuccaucgccacgccaggaaagugcagccaaaaagccugacgauaagaaagaaguauuccggccucucaagccugcgguaaguacuguguaaaaucacuuaguucugugucaagcuggagggaaaccuuuguguuaagaauauuguugaagggcugggguaugcaguugcaugugggaggucccaagcucagucuccagcgaaaagaaaggaaaagugauggagaggccugcagugguuugauuuuuguguggcccuucccugcuguggggaaauagaagaguugucugaugcaggaugccguuguggguucgcccuuaggcaucucaauucugaagucauuagcagggcaguucuguuccacuucagccuuccacuaguuguccaauuagccguacagagaagcacagaauaaaauauaauuuuauguauuggcaguuuuuaaggaaaugaguauuuuauaguaauacugaguaaaauucaaaagcuccaacacacgcacacgcacacacgcacgcacacacacccauacccgugcacgaugcacaaucauugcuugucaucgaccuuauucuugguaaguuugguguuugcaguacuggcuuucagaauaagugugaaugagcgcuccugugucuugagugcugcccuuggucucugggcugaugacuuugacugcuuccucgauccuuaucauggcagucagucaugugacuguggguacuugugggguuuuaagccuauugaaguuuuagguuccucuuuaacugauuucuggauacccccucccccuucuuccuguugccugcucccuucucugcauccuucaucaaugucggccucccucuccaccuccauggaaucgucguguccugaagggagaagugguaagcccgcaucccucccucccucugauggcuagcuucagcggugcucucugccucucggcucugcucagcucagacuugcgcucugccuuccgcuugccuuuaaugaccgucggcugcuuuagcugaugaaccaagcuuugggucuuuauugccaaaccuaccuggaacaacuguuguaaaggagcugcuuugucacagauagcugccaggacagagcaggcucaagcuugcuucugauaguucagaggcuagaggucaaagguaaaaaacauauucuuaacugcauaaaagaagaauacuaaguuggaacugcucuuuaaguuaaaagggaaaaccagucauauaguuacugcuuuuuaaaaugcuauugauuuuaaauaaaauucccaaguagaaaagggaguuuggacuuaaaugggauuuaaaucagucuaggaaauuagauauaaagaauugauaagaaucuuaaaauaucucaacaagguaaagagaaaugaagccaguuuuuaguaaacuuugcucugagguucucaaucauuguauaauugagaauguggcuaagucugggggaaggccaguggggauugccguggcacguggcagaugggcuuucccacugcggacgccccagcucgggcauggcagguacuaguagggaggugagggugagcgugugcuagcaaucugcugucuaggcagccugggauucuucaugaaccguggaggggaaaaggcccagcuaugucuguguaauuaggggcagugugcgcaguucuaaauaguccucuuagacaugcugucugggcuggagaggugccucagcggggaagagcacugacugcucuuccagagguccugaguucaauucccaacaaccacgugguggcucacgaccaucuguaauggggaucugauauccucuucugguguuucugaagacagcuacaguguacgucuauaaacaaaaaacaaacaaacagaaauccuaaaaagaaaaaaaacaacugucuuuauuuaaaaaaaaaauagucaugauauccugcaguccugucuucgcagcaaaagccucuccuaucuuagacuuacugaaagcaaugcugucagcucacccugcagaccacuguauggugggacugaguugucuguuacacacuguacagugggacugaguugucuguuacaccugccuucuuccuucuguccaaagccguagccaacaaacuccucacgaguccuuuccugaugcugacucugguuacucacuggcaguuggccugaaaggcuugucaccuuuucucucccuaccuuccucuuuccuaacuuccuuuuccuuccugugucuuaggacuugacugcguuggccaaagagcuucgagcaguggaagauguucggccaccucacaaaguaacagacuacucauccuccagugaggagucugggaccacagaugaggaggaggaggacguggaacaggagggggcugaugauucuaccucgggaccagaagacaccagagcagcguuagugcuugcugggcucaagagaagagccuucccacugggccuucucuccgcugcagccuucugcccuguucaugaacucaaugacauacagcuuuuauacacacacacacacacacacacacacacacacuauacaugccuccuguacacaccacauauauacagacacacacuacaugugccccauuuauauaccacacacucaacaccauaccauauacacacacuacacacacacccuguacacaccacacaaccaaauacgacacaugcccuguacacaccacaugcuuaacaccacaccacauaaacaaccacacagacacacacauuauaccacaccacacacacacacacacacacuacaucauacacauauacacacauacaaacacacauaucagcgucuuccccacaauaucucagcaugucucuuuuucuuuuaauuuaaggguucaguaaaagggauguuucagugugguaugacuuaauuagacauaagaacucauucuaauuaauguucuacuuaagaacaaagugaacagcaaggaacucuucugugggagaaagccacguacgugcuugcuguccuauaggaaacuuacacccgaugcuuccucuugccucaagcuuugagagggucacacggcuuggcuuguuauccgugacuugcagaucuugucucuucaggucaucuccgaaccugagcaacggugaaacagaaucugugaaaacaaugaucguucaugaugauguagaaagugagccagccaugaccccguccaaggagggcacccucaucguccgccagguaccggagccuccucuccuguugucagaggccgagcuucucuauggucauuaacccaccugcucauucacucacucacccaugcuauuucuacaucaucaucguuuucauguuaacacagcucugaggguagcguguccugggcgagggaggcaggagugcugcaugccacaaagguagccaguagucuuccacccacauugcuguuccucugcaugcccuuggcagccuccauccaagcaccaugcugagucucacagucuguguuggagugguagagaagccacagggacuccugggaaggcucacagagggaagguacagaucuggagccucuaauggccacccugaggcccugcuggggcaucuggcccugugucugcagcauuggggcccagggaugagugggucuccugagguccaaaacauaaucucuguuugugaugcaagauggauucugcuuggaccaugauauuuucuaacuguucauucuuagcuuagauuucauccaagugcuaggcuccucacugcagcaggacagggcacgcuccaggcucuggguuuuccccuggguguuucaugccacagcaguguauuuggauggaaacuaggaagaaccuaagaagaucaggauucagaggaaccacaggcugcucucuagagguggcuuagauuuucagagaaaacaaggggguggucucccaucaguugcuauugcugcaaaugaaccaggugaaacacuuucuacuuguauugggugguccccagugagguacucugacuucaguuggcucaaaauugggcauuuggcaaggaaguuugagcaauucuggcuaauuuccuuggauuuuccuugguaaucuaacacaguuuggaaagucacacagcaccuugaacaaagcaguuaucaguaggguugucggcaauaucagcaucgccugagcgagaccagugugccuguuuuuucuacagaguacaguugaccaaaagcgugccagccaucaugagagcaauggcuuugcgggucgcauucaccucuugccagaucucuuacagcaaagccauuccuccuccacuuccuccaccucuuccuccccauccuccagccagccgacacccaccauguccccacagacaccccaggacaagcucacugcuaaugagguaugucucacaccacagcuggcugcuuuccugggguuagaccagcacugccuaggagcuaguuugcaaagaagcccuucccagaagcccucccccuucccugcucccugcucuucugccaucugcccuccuccccaguccaaguaacauguucagaucugcauacagaucccuaacccuagauggauuguccccagacuugccaguucacuguuucccuucuagauaguagaguugcauggcuugcuuuauuauuuauuuuuuuaaguaaauaaaaugauugcuguguuuucagauccauuacguauuuggcaugaaauccuuguagucauuuguggaauuugccucuucauucuuuuuauccaguguauaaaguacagggaaaugugacuccauagacuuggccuuaucugcacaaacugcuugucuuuugugagaaucccccgaagauaggcauccguuguuguugguugcugguuucauuuguuuauuuuggggaggggguugguuauugguugacaacuuugguuucacccacccuuuuaaagggaucuguucccuugacauccacacguacucaggguuuaagaagucaagugcuggggagagaauguagaaaaggaugaugcugagcaaggacaaaggccagagcgcuguuuuaauuuaagguuuuguagaggaaguccugugaguucauggcauggcuguacugcucagucugggucauaggugggugaguucuuugucuugggcaugaccuaaugcccaagcagugacagagcccaccuugaacaccugcuuaguuaggcaaguauuugauuucacagguuuggggccuauugaguccauuguuuaauaauugagaggucuaaacaggcauuuaguuucagccagucuugucaacauaaacacuugguugacuguggacaagagcgauccuuugguucccucauuagaaaauacaggaacagccuucugcugaggucaggcacccgacagcugcuuucugagcagagucggcaucagacuggccgucauggcuuggccacucauugauagggcagggcgagaagccugcaagauggcagauguugugucaguggggaagcuuaggauggcaugggcucuaggacacagcgacuuucagguuccccacagcagaagugaguagaggaaaaggcacuugaucgguguguucuguccugagaccugugcaugcacgccuuuccuuggugguaucacaugcuccaucuuaccauaguuuuaacucacuaacuggcagguguuucuguuugauuuuaaccaucauuacaucuccacuuaacuguuucacuuucucugugagcuuuuuguuuguuuguucguuuguuuuauuuuuuugguuuuaaguuacguuauuaacaccagugcuccuaaaaggccagaaagucaugucuccugucauuuguauguuuacuaaugagcccuguugugugguauggacuuaauggugauucugucauaguacaaaguagaucacaccaauagucugucacaguagauaggagaucacaccagcagucugucacaguagauaggagaucacaccaguuagucuguuacacacaguagauaggaaaucacaccaguuagucuguuacacacaguagauaggagaucacaccaguuagucuguuacacacaguagauaggcgaucacaccaguagucugucacaguagauaggcgaucacaccaguuagucuguuacacacaguagauaggugaucacaccaguugucugucacaguagauaggagaucacaccaguugucugucacaauagauaggcgaucacaccaguuagucuguuacacacaguagauaggcgaucacaccaguugucugucauaguagauaggagaucacaccaguagucugucacaguagauaggagaugauaccuuuaucaauuguacuuuguaguaugggaaguaaauugggaagguagugaauugcuauuacgacacuucagaugcuguguaggaacucugaucguaaaguggugcuuuugcugguaguuugcagcaucacugcccuugguguguaugugucuuggggaagagaugcagcauuugcaaugccuugcugggcuuugggggaguugaugcaggaggagaaggcuuggguugggagaugguacuguguguaagugaauugagguggucuuuacuguucacguuuuaaaugucucuucuauuaaugaaauugaaauuuacauuucagacucaguccgcuaguagcacacuccagaaacacaaaucuuccuccuccuuuacaccuuuuauagaccccagguuacuacagaucucuccaucuagugggacgacagugacuuccguggguaaguacagcagcgucaaggagagcagcugucagacaggaccugguccccaggccccuucccacgggcccgagcguggcaugguuacuuaaggcgcaguccuccgccagcaaggccaucgcucccuuugccagggucacagugaggucguggucaguucccuuuccaugucuauguuuucuagaacaccuuuucuuugagaaagcaucaguugcagugucuagauauuuaucuggggcaucugagggugugaggcguggugucuguguacagaagcugagucuucacugcacuguguuucagugggauuuuccugugaugggcugagaccagaagccauaaggcaagauccuacucggaaaggcucaguggucaaugugaaccccacgaacacuaggccacagagugauacccccgagauucguaaauacaagaagagauuuaacucagagauccugugugcugccuuaugggguagguaccucacugcugucgggugacguaguuuuauucugaagcacagaguugucaugcagagaagcacacacuguuugauuccugcccugugccuucagcuuagcugagggugugcuaugcagcagaacgcaugcguaugacugcaguggugucagcaguaagaccuugggaagagggagcugucccuacuccuccugugagguagucaguaugaggagagaggaagaauaagucuggaugucuguguucaccgaguuguugacuuugaccaauuuccagaugaagcucuuggaagcagucuucagggggcuaucagccuggcuugucugugcucaggauagcugcaugcucaguucugccuucucaaauucaagcuagccuuccugccagcucccgcccuccugcccuugcccugacauuuacucccacaguuuuguucugcuguuaaaguacucuccuucuacccagaaguuucuuacuccugacacugcacaugcagauggcaugaagucauuguacaugcuaauggcaugaggugaccucacauacagauggcaugacuccccacaguccuguuccugagcauugcagccaccacguccccugcagcaguaaaucagcucuccuccccuccacaucucagccuuucuucuuucuguuuguuagggagaaacagcggagguggacacgagggcuugccuuuaaucuuuagaaccuuacacuguuguucccggcuccuguucucacccacguggccugaccuucucucuugccugcuuagguuccugcucuguccucuaccaaagucuuuugagaagcugccaaauucagagcagacccaucugcuuucucaggaucacaaauucugccugugucaugacugucuugaagcucauaugguccugcaguguaaggaccuuguugaccaucuggaucagugguucuccaccuuuugggagucguaggacucuguuacagaggcugccuaagaccaucagcaaacagauauuuacauuacaaaccauaacagugcaaaauaaaagucaugaaguaccaaugaaaauaaugucaugguuggagaucaccauggcaugaggaaccguauuaaacgguggcaguguuuggaagguugggaaacacugguauagauaaaaauaaaacuagcuauuuaagggauuauggggaccauacaacaggaagcuggcacagaagugugucuagcacacugcuguugugcaguagaugucauuugcuguuauuucagaaaguaggcuaucauuuauucacauugaaugguuuuaauguuguauguauguuauauuagcuauagagauugucuuaaauuuauguuauguugaaauugguaauaagugcuuagcccaacaaaguuacucgugggaacaagcaguccuagugucccaucaugugccucuaaugucucagcaagcccugggcuccauuuucuuuacuuugaucuagugcguugaucagucuaaaggccuuugcuuuaguugcuuccuuccugggacaagugcgugacaggcagcagcuagaccagaacuuuugacccugugucuuggaaggcauacauuuuaaagguguaccguguggcucaguggguguauaagaaaacggggaucaguuugugcaccugugagacaguggagguuaucuggacagucugagugaaggcuugugucugccagcugucacgugauuagaaagcauggaguauugggcagaggagggaaggaaggcaggcccaggaagaagauguuaguuaccuucagcgguaauccuggcuuuaggagaaaucuguuguguguggaagaacagagaaguacagcuuggccauaggagcugcugcccugccauagugggcauguguaugauuagcgcuggcaguguccauggaagaaauagagagagaugggagcaggugauguccuggcaggguaagcaggcuccuggaaagguggggacacagugcaguuguuucucaguggugggaacugauugagaccagcccauaagccaguggagauuauagaggcacgugcucucuguaagucauucuacaagguugccaguuguggggccauaguagcagauggaccagaaucuccgaaacccaagaaauagugagcuuacaacugggagcucaguucccugggggcaggugccguggggaugucuucucauugcuccccuauguauuuaaguaaaugucacuacugucgcuucugugucaggggguggggggaucauugcuuuaaccucacuguucugggcauuccuuuaggaauuacggucacugucaucuuccaaguagaaaauguuuuucuggucuaugguaaagcucuacacaaucacaaccuaaaauguaggccuuuccguguuuuugaacaggagugaacuugcugguugguacagagagcggucugaugcucuuggacagaaguggccaagggaaaguauacccucugaucagccgaagacgguuccagcaaauggaugugcucgaaggccuaaauguccuggugacaauaucuggugaguguucuuuaaagcagaaucauggccuuaguugcagugugccaagccauacauacugagcucagcucauucucugaacuggcugagauaccgaagaauugugaguuuucaugauguaaagaugcacacagccauggcacacucccagaugccugucauugacaucugugcuugaauguuaugcacugguggcacauugucucuuacuuguuaguaauaauacauuacuauuaaucaaagcacguaguuuauaucacuguggagagcauuugcuugguuuuggcacucuacagugauauguguauuucagucugucuaguuuugguccccuaaaaagcauuauuuguacuuccuccugaguccccaaugauagcugaccaacuguauuugaugacuuuacuauucuggaauguccuaucauuagauucaugaggauaaaacuuugugugacugaauauauggaucaugucauaugugggcuaacuucuuuggcagugcacauuaaguuaagguugcuucaugucuuuugugguucaguaucuuguuauuuuauacugccaaauguucuaccaccaaauguucagauguaucgcugcuugucuauucauauauugaaagacaucuuggugcuucuggauagcaaguuauaaagaaagcuuagauaaguaucuaugugcaacuuuuugcuuaagcacaagcuuucauuuuauguauuugguuaaaaaaaaaucaaaguaacacagcugagagacagaagcacugggcagaagucuauugguguggagagcugcugagcugucgugcagcgugggcccauugucuugcagcagacagcugggaaggacaguuucugcaccacaucccgaugucugagacugucaguguugggcgguuuccgucuugauagguugauggagugaugucuuguguaaacauggagcccccugguacgugaauguucugugcaguccuguggcuaagucccagcucucuccccaugugagggucugcuuauaccguuaccccauugugcgcuuagguuguugggguuuuuuccucaauuuuggauuccuuugaauauuuuagauagcagucuuuuauuacaugugcccugaaagugcuuuuucccggucucuggcuccucucuucauucuccacaucuuccagagcguagugaagccuaacacuuugugcuuguuuuguuuugcguucacuuuugugguugugcuuuugguguuuuacccaaaaagucauugcuaaauccaagauccauccagauauuuucauaugcuuucuucuagaaguuugggagcuugcguuuucacacuuaagucugcaacucguuuuuaguuuauuuuugucaaaggcuuuaagguuugcaaauaaauugccuuucauucauaacauuguuuauuuuagagaagacguuuuccuuuugcuuuguucacugugcucguuugugugccucuguugcugacugugugugugccucuguuucacacugugugugugccucuguuucucacugugcguggcaccucuguugcugacugugugugugccucuguuucacacugugugugugccucuguuucucacugcguggcaccucuguugcugacuguguguggugccucuguuucugggcccuuuacuccacuaacugacuugcucauucuuuugcuaauaaccacauggucuugguuaguaaaucuugaagucaagaacuguuuaaaaacuuugguuuucauuuaaauauuuuguuuagugugucacuguucugccugugaguauaaacuuuagaguauauuuauugaugcacacagauagcuuggcuaugguuugggcuggaauugggguugaaucuguaguugaaguuaggaagaacugaccuugugguuuucuauccaugcacacaguucuucugcacuuaauucuuuaacaucuuuaacauguuccuaauuguccucaaauagguauuuuaaacaagucaugugagacccaugucuauuucauuucuuuaguguuaauaugaauaguauuuuuauuucaguuccucauuauuuguuguugguauauaggaaaguaauugacucuuguauaaugggcuugcuauccaaaaucaucacuguaauuguuucaagaaguuuccaugcuuuucccagauggacugucucucucagaggaaaugugucuacuguuuuuguuuuuuuuucuuggacacuguuguuauugauaacauugguuuuugaccacacauuuaaaauacuucuguuuaucuuguuaggcaaaaaggauaaguuacgugucuacuauuuauccuggcuaagaaauaagauucuucauaaugauccagagguugagaagaagcagggguggaccacugugggcgacuuggaagggugcgugcacuauaaagucggugagugcuccggggggccuugcucugcucuucagaguuccauuagagucagguuuaaguuacugggcuguaugaaacuggugagguguccugugaccagcaggucucuucccuccuucaccuuuccagcuuguagauauuguaugcugggagguccuucacagucacuaggagaacacuugagccuuuaacugguaacauggcuuguuaucuuuaauuaaguacauugugcagagccccuaugcccuuauuuauaagugacuguggcuggucuguugucuuagcaacuguuuugugauuggcauuucucuuccuuggaacauucagugauucucacaaagucauguaacaaaacccaaggcaacuuugauuccauaagaaaaaaguaagugcugguuagaaauuaugagaaagaaugggccguaacauagaguuuuaagggaccgucaguguaauuuuauagaagucagcugguuacaguuacggaguccacugauaugcuugcauaucuuaauacagugcagacuauacgcaguuauucuguucaccucaccuaggauguuguaaucugacgucgucuucuuuauccauuguggcaguuugcugguuaauaaugauuacaguuggcauuuaggaugauucugaguucccaccaagaccaggaggcuaaaauauacuuaauugaaauuaacaggcuuuaguuugguucccauggggcccuaguaccuccuuaauguuuauagcuaugguauggucuuauagggauuauuagugauagcuaugguauggucuauagugauuagcagugcacacaggauaauuuccauuauuucagaaaagucuauuaacagugcccgcuggucauccucuuauaacucuguggauuugacagcaugugaaguuuaacaaagcuguguugguagcaaguccuugcuccuaggcaagcagcagugugauguugggagguccauguaggugggcuacagagcaggccagagcaucgcacuaggaagcaggaguagcugugaaagauggugcguguucugugagucacauggcuuacaaguuugcuucuaacauauuccucuguccgugugagcccuccaguccucaggguugucugccuggcaauacccuugauaauaaaaugucugugaaaucuaagacauuacgauuaucggcuaaacuauuaggucuuaguugauguaggaaacugaauuacacacugaagaguuggaaaagcugcauggguagcuuaaauccucuuguguuucucaccccaacuccuaguuguuuggaugaguaacagaggguauauuuauaaaguuugcaaauggcaacuaaaagaauuuauggcucguguuaauacugauaguauuucucuugcuuuuuauguuuguuucaguaaaauaugaaagaaucaaguuucugguaauugcuuugaagaguucuguggaagucuaugcaugggcaccgaagccauaucacaaauuuauggccuuuaagguaaaacugccaguuuuaaguuggcuuaaaggucugaacaguuaauauaaagcuaugcguuaaccugacaaagcugucaguucagcuauucuaacauaaaaauaggcuauauaacuauuuucuaacuucucagaugauuuauuugccaaaaugguauuuguaccaucccuaaaaaaguaguugguccccgauagacauagaugugcugaagaucuagccucgagguuagagggcgcaacaagagacggcugugccgugcgugugcuuagggcaguacaaucuaaagacuaagcaauaaccugggugugagagugcaugccagagaggcugagacaggaggauugcugugcggucaaggccagccagggauagcuagcaaaacaaagaucaacuacauaaauuacaggcuuuuaaugauauaagcaauacauacuauacauuaaauggaaggagggacuuaaaauauguauaauaugguccuguuuucauauaaauuugaaaaacucacuuugacaaaauugugauauuuacagaaaaaugguuugugcuaaacuugggacuguuuugguugugaguucacaggcacucauaauuggucucauucgcucugguguguggcguaggagggagcaugugaaacagugcuaggcugucagagucuguauauauccaacucccaaacugcagagaacuaacaggcuccgcguucuuguguauuuuuaguaauuuaucuuagggauugcccuaaauccaguguauaaaauucuuaauuaaaauuucuacuguucuagcauuagauagauauaauaguuauuucuauuuugagguauagaacuuuaacaguaaucaaggaacauuguagcagagaguaaggagaaacaaacaauuucaucuaaaaugauuguguuuaaaacaauuuugauauaguuuauugaaugaguaaguuucaauuacuugggaaauuugaauuaaaggguacuuccugcuugguuuccccuuggagucagagugaggguuaccauuuuugguaaguccuaguauuauugagaaaagacaguaaguuauaaaaucauuuacaucaucuucuggggucugguauucauauucccacgugcuagauacuggugugagcguuacuuuauaccacugcuggagcucagagccccagaccuaagaacugugcugaugugaagaacugacugcagcuugagucuagucacacagcuccagucuaucacucucauagcaccaacccugacagagucuuggugccuugaucccuacagcagcucagaguguucgaacccuguacuguacccguucuugcuguuguugaccuugccuucuguucuaaucaagacacaacuggauaggacagagcauucuucagcuagguaggagggaagcugugccuugcagaugcuaguuagcaauccacuugaucaaucaaaugccugcagcucgcuccucaucugacguguaaguuuguucuccugcuucugucuugauucccucuguagucauuuggagaacugcuacauaagccauuacugguggaucucacuguggaggaaggccagagguugaaagugaucuauggauccugugcgggauuccaugcuguugauguggauucaggcucagucuaugacauuuaucuaccaacacauguaagaaagaacccacacucuaugguugguugccuggcuucacuugguuucacuuuccccuuuacucugcucagugacuaacacaagcaggguuuccucauccccgugcuguagggugaguauuuaaaugaagcacuguuuucugucgcuucauguuuggggaaccauagaagccccugaaggaccucuagcacuugcuuugacuaacgugggauggagcugggacuguugcugucaggcagagcaccuugggcugggaauguuucucagaugaguccgccaucggcuuacgugcccaggaccucaaacacgugcaucagcagagcacacagccuguaaaugauagacucuggguuguauauugcaugggcuucccaagauucuugccuguuugguagggauggccaagggugcggcacuaccacauucacuggacauucuuggcugagcacguucacagcuccagagaugaccacagaccugcuucccuguucuuguucucuagauucaguguagcaucaaaccccaugcaaucauuauccuccccaacacggaugggauggagcugcuggugugcuacgaagacgaggggguuuacguuaacacguacggaaggaucaccaaggacgugguucugcaguggggagagaugccgacaucuguagguaugacacgucgugacgaggcauccgugagaggagccacuaggaccgcaucuguguguuguacuaauguugcauguugcucaugcugucuggcuguucggugguuaucagcagaugggagaagguuggaacaaauucccagucauucuaggcuacuuuaaaagcugugcauuugcugccucuuaaucugacucuuaaguuaccgaaagggcagguauuugggguguuuguuuguuuguuuguguguuuguguguguguuuuguuuuugaccaauuuguguggcaugaagagaaucagagaaggaaaugcugcuugcucuugaguggcuggguuccaggccccacaggccccugaguagccuucugcuuuguggucaggagcugaggcugaugccugacauugcauggcugugcuuauguccccagugugucugcucgccauucguccucccuucucucauggcuguuuguagaaguggcaugaaagaccccagggaaguugacuuguucugguacugacucaugacuacacagugacagaacaggcagacagcacacggcccucuuuuggucacuugaguaaagugaacccagggccucuugcauguuaaguaggcuuucagagauaugccuagcacugaggcagaacuccuggcaaaccaagucgucaugggcuaggacucagcauccgugcaugggaaucugaaguggcuugucaagacuccuccucguuaaugcuuucucucucucucucucucucucucucucucucucucucucucucucaaagcauauauccggucgaaucagacaaugggcuggggagagaaggcaauagagauacgaucuguggaaacuggucacuuggaugguguauuuaugcacaaaagggcucagagacuaaaguuccugugugaacgcaaugacaagguaaggcucccuuacggcgucugggcacuuguggcugcuguguacaguggcuugugguccacuggcagugaugaugcauucuaaaauaaaccaaggagacacuuuguuugggccuaucuggguuugggcaccaggagauagugaauggcugcugacuguguccucucauuguguugcagguguucuuugccuccguccgcucugguggcagcagccaggucuauuucaugaccuuaggcaggacuucucuucugagcugguagaggcagugugagcugggaucacugaccucuggagucggcaagacccugagcgagaccuuggaauuccuugcaacuggagcucagagcugugcuggugcagccaggacagcugucugcaggccaccugcgcgucgcaucgggucgggucgggcccucuccccucccuccuacacuuuuugccaguuuauucccauucucuccuuuuccuuucucaaauaaaucaaggcugcauugcagcuggugcugucuggacuccaccaucggugcuaggagugcuugggaauggacucagaccgggaagagcgagugagcgagcgagcgcugcgccuucccugcagcuccaggaggccgucuccgagcgagcgagcgagcgagcgacuguccuaugggugucugaagggugugaugagcgcaccgucagacuuuggcagugggcacaaagaagugaaaagugggcguaagaagcagcuugcagaagcagagaacagauuuaauauaguaacauuaacaauguauuuaauugacauuucucuuuuuguaaugugacaguauguggacagagaagaaggugcagguuuaagaaguuaauauuuauaaaaugugaaagacacaguuacuaggauaccuuuuuuuuguggguggggcuuaggguggggugggguggguuaaagggucccauuuuguuucuuugaaaguuuuuuggaggggauuguccuggccaagaacucagucauuuuucuguguaccaaguuuugccuaaauugugcaggugguucuuaaaaaagaaagaaaaggaaaagaaaagugugugucuuguuggagggccagaaguuugucgugugacaguauuagcccggccucggcuacagguuuaaagucuguuaggccuaagugcagcuccccguggccugcacacaccguaggagaaggucagcuuuccugugggguuuuguuucauuuuguuuuguuuuuugccuaccucacuguuuuuaaugcauugagaggugacuuaguuuaugguuuuggcagaaaacauuaauguuuaauuuaaccuuaauaccaaaacuaucugauuaaaguuugacuuugucacaagucuaaaucagguacaaaaaaggaaaaaaacaaaaaauaaaaaacaagccugucuaugacagcagggaguagccuuguagcugcugcagucugcuucuagcaugcagacugcucuguucucaccaaguucaccauuagcgggugacaggcagccagcugccaccugugacacauaagagaugucauuguucucaguuggguuuggaagcaggcaggggucacacuggggagucacacagacuguugauguugcaggagccuuucuugggagugacggugugucccuuuucuaagaaugcaaugcacuaaaacuguuuuaagaauguaguuugcccuacuucuucauagauggccccucccugccuguguuucagguguaaaaucgacacucuggcuuuucuccuuuucucacgugcucucuuguucucuuuuuuuaaaacuaauuuuucuuuaugaauaugucugugacauuuguaauaaaugucuuguaauaauuugcuucau

SEQ ID NO: 137 - RNA, 3073 nt, Mus musculus
agacauagauccaaacuauauaauauguuaacauacaaacgugaucuuaaguucacagagacagauauguacacaucuauaaaacuggucucaaauucuaagcuuucugguaccuucuuucagauugaccccuuagugauggaguccuuagacacggauaauggagaucgaaacugggcucugucuucacguggccauuuccuagcuaugugaucuugggcaaccccaaagucaguugcacaaucugagucacaguuucuucaucucuaaaauacaaaggcugcgcuagugagaccucacuaccaaggauagacaccugggauucaacguugaucuggauucgagcacaggucuuucuuugucugacuuacaacuuccguuuccaaagacucaaauccgugggucuuccucagacaauguauaccaagucagcuccuuugcuccaagccccuuagccagcaaagaacaaaaccaacccgcaggacuguucgcaguccuaggcauuggacuuucugccucuguuggccaacuucuaggugacuggguauucuguuggcacuggggcugaagucugacugcuagcacacauaacacaccuuccaucuccuguaaccugaauauaggaaacaacacaaacauccaaauaaccaaucacccguuuaacuuguccaccuaaaauaugacaggacaaggccagaaggauuguaagagcugaaggggccauaggucugcguguuugcucacagcagaagcuuagcagacucccucugauagucucucuauauguaaggcagcuccuucugcagaguggguuagccauuauagaugaccacagucaugucuuccauuccucggccuucuguaguguuaccaucaaccuacuaucgagaggaggaauccagcucaccucucuugaauguugacaggcuaguaacucaggugcggccaaaagaaugcagcagaagugaguucacugcgugugaauucugcagcuacgucagggagaucuaaacaguuuccaccugguucccucacagaaacccagucaccauagaagcagccugauuguccccagggaggccagguggaaggggucuuggcugagcugucagcaaccucuccaaccccaucaaggauaccacccaugugagguaaccaucuuagacuccacaaacaugcccauucauuaacugauaaccacuguugggacccgguugaaauacacagcagagaggaaugaucuggcuuuucucaaguguauggucuacgugauguaugaguuguaacaacaaagugacaaacggccacauuuuaguguaguuuuccauggaacaaaggguaagugcucauucaaaagccaguuccaagggacugcuagggucagaguggagcacaggcugaccauguuugagcuccuggaagacagaagggagacugaccggugguagaaaauuagaugguugacgggagaaaaugcauacugcaaacaacagguagcugccuguaacaggaaaagaacuaagauuacugcaaagaacaaagcaaaaaaccaucuagggccuggaagagcagacacaagaauugcccuccacauuagugucccaacaagaacacugggguggggguggggguggggggcacacaacaaucuuaggucacagagaacacucuacuucaagcucuuuucuguaagauggagcagggccuacguuuccugaaggcaauauugcaaucgcuuuccggagugucuuuauugcuaguccaagaugaucccaggaguguaagcauggcacauugcucagaaaggacagaaggaaauagguaagacauggaggaaacuccuucccaguaggaagacacaagcagaagagaaagguccuuugaagucugagaaaacuuggaaagagguguaccagaugaaggagacagauagaccuaaccuguguuugaaaccugaaagccaagaagaauagaauucagauucuuuuuaagaagccagaagcagaagaacuuugguucaucacaagugggucugugugggaaccuuggugcucuuaguagggcggagaugacagagaagaaaggcaguaaugaugagaaaugucggcagaaggaacacuggguuuuuagaagucugcucacuacuggucucacuuaacagaguguuuaaaccgucccccuguucauucagugaagaauaggaggcaaacuaagggcugggcuagggccaccaacaggaaauggauugguccaguugaggcugcaguuggaaggagaagccagagaaggaagcagggcagguucuacuuaucauuucccaaucucccaaucuacuuugccaagguccugagcuccacucacugauguuccaguuuucuuggugcccccagccacccccacaguccagcgacagauguggcaggauccauucagaucauuuggggugggucccccacugguugcugaugauuuugacugucacccagacauucugaaccagagagugggaaaaaaaaaacuaaguuuggccaaauggaggaccggaggacagaggacacauuggccagaacauuggcugucacauaccuuaggcauuagacuaugguguuucccaaccauggaucccaguaguagugacucuaggaccaggcagauauacacaaagcucugaggaagccgaugaguaacccccaagucagcauacacacaucuagaacacucccuaccauucaucaggaaugauccuagaaggcuagaagggacagacagaggaacuagaaugugcgucuacccugaggaaucugaugagcacaagagaauaacuugaggcaucugagacagagguaauacauauuagcaggcugaacgugcuccucuguggauaggagacuugggaacaaaaugagauucuucuuacaacagugaauaaguacacaagaggcagugaccacagugaguauaaaguuucucuauacugaaguuucucucuacuacaucuauauauaguagaacuauuuucuucuacaacuggcaggaugucagcacagauaggacuuuucuuuucaugcuuuga

SEQ ID NO: 138 - RNA, 35850 nt, Mus musculus
aguuaacaaauucuggugguucgaagcugaggaauaaagauggcuaggaccucuggcuaauggugaguaguuuucaagguuuauuuauucauuuauuauucauuuaaucaaagauggcuucaucucaaagggaaaagcucuuucuaauacaaacuuagguuaaagaugacaaucacuacaacuuuugcuuaugagaaagauaguauuauuaaugggaauuaaaaaaaaaucaacaacaagcaaaacccaaggcacagagcaauacgguugagcucuugaauucuagugugugagaugggauuuuggucugcaguguugagaaggauuggggugaaacucuggaaggaugugaaacuucagagcaugcgucuagagugcucauggauucuugaucaucccugggaaccagauaauucuggaaaugauguagugaaguguuccugaaugaaaguguugaguaugagguuguaggguaaggggagagggcugugagggggacagugagggauggugggagugagauaaucagucuaugugagagucaggaaucaccgagcucucccccacccguccucccccuccugccguccuggugccuucuuugacaaucgggcugacagucuacuucuuguuccucucaaggugaccagaagaguguguacagcaaaauaaccuagaacuggacuucaaacguucccccugaacaucuguuuuucauuguaguuacuuucagaaauuaaaaaagaaaaaaaccaaagaggaagugcacuucuauaucugccagacuuugggcacaccacugggcuaguccccuucugaacaucuagaugucaccuugaccauucucuacagagagugacugagacagacaguucagauuuaugcuauccugcauccaacucauguucuuuuucuugucuacuggggcucgggggcauugaaccuagcaccucauacauaguggucaagugcucuaucauggagucacacccccaaccuaguguucaacuccugaucuuguauucauuugcuuggacucuuuguuaagucuuggguuccuugucuagaaagccagcaagcauguuggugcuaacaccaagcucaaagggugguuucuaaagaagaauuggguguagaauccuuaguguugugauaagagagaacaagaaauacugucagaguucaucacuguuaugugucccuuuccugcucugagcacaugcuucuauuuguccagcuaucugggugcuggggcugcuaauuugaaagugucagaucuuccagaggaguuugggguucucccuauuucugauuaaguuguugagggaaagauuuugguccuaaggcauuuuucuaccugggugccuacauauuuguggacccagagagcaacugaaucuacaggaagagugaugggcaggaagggcguguuccugguuuuaagagcucuaaugauuaaaaaacauuuuauuaagcaaacacuaguacaagcuaguguguggauggguucggguccuuacaaacauuuacauguuugccugcuguauuuucauuccuucauugguugcuugguugguucauuuguuuauucaucccuucuuucccuccuuccuucucucccucugucccuccaucucucucucucucucucucucucucucucucucucucucucuccuucuagccacaucucuccguaucuguucuuuuucuuuugagacagagucuugccauguagccccagcuggccuugaacaggugaacccuccugccuuggccucucaacuacuaacacuaugucacuuccucuucucuuucugaauacauauucuaagcaguggagauguagcucggugaucaagucugaacuuagcacauuaaugaccuccucaacucccagcaucuccaaauaaauccaauccgaaugaaaacuauaaucuuuuauuuuucuguuuaucauguuuguuuuucuaacuaacuguaagagggcagguuuucaaagcaaacauaccuuccuaaaugccagugaucuguuuauuauccucuauuuucccaugaagcaaggguauuuucugccucacacgucuaucuuuccugccuccauacuuacuucuagccuuaaaaauauuuucuagaauauucuagagccuacaucaaaauacagacgugugccuaaaaucugccuggguuucuacucacuuagugaaagugcucaggagucaggagaugacucuuugacuugcucuuauaucuccaccuuuccuugcuucacuugggccacaggaccuuucugacugucagaccugggacauccaucuucagcaggacuccaggcuggccugguccuucugccugagcugccugagcugugcuucuguaguuuuucugcaaggcaccauccuagguagccuucuuagaucaucugcuguagaauuaccuugcuauaccuguccacuuugccuuucucuuuagaucaugguacaugaucuuuuacuuacuuaugcugucugcuaucccuugcuucuggggaauaauguuuauaacauaaggugguuuuauaucccucuguucugucugguacuuuccuauaucuccaaugucugaagcaaugacccgugucuaacccccacagcagucugagguucaacauguugcaguugaaagccuguuugaugcagaguugauauguuucacucuacaaaaugcuaaggccuggaacuccuuaccaaugaguccucuaaauacuccccaugacccuuucuugggaaacccucaaaauucaggcgcuugaccuggcuuucuuccaaugucuguuaucacuuccuaccaccaacuaucuuauaaagauuauuuccacauaucuuacuuuaaauguguggagucacuaaaagugaauuuuuauucauuauuuauuauuagagaggauccucccaccucaaucaacccaauagggacuguccugguugucuugggugauucuugcucuucuaaaguuggccaucaguauuagccaccgcagcacugaugguuacaaacaugacuugagaagguagcauggugguagcagaugacccgcucucuccuguucgucaugcccugugcagaaucaaagauccuccaagcauugcaucuccccaacaaagugacuuggagaacucaaaaugaaccugguucauagaaacaucagcaugcauagcaaauaagcaucuuuacuuuucaguggcagcaaugaagacuuggcauuauugucaggugcccuagguaaagaaguuagucuaugguugaccaguuacacugaaaauaaucugagaucaaacaaguucuguuggguugguuuuguauugauauaugcuguauuaguaaucucugaagcagcagaaccaauugguagucaucuuucuaccuggcaucucugaaucuaugcuuuuuuuucuuugacuaauacauaaauaggaucaugcaaguccagaguucaaaagucuggcaggcuuaaauauguggaguugauaaguucaucuugaaucugauccuaaagagcagcaggugggaaacugaggcaggauuucuaucacaauaaaggcacaguguaccuuuuggaagucuaucucugcccuucugguugucaugaugcuggcuguuggaugaggcaugcccuucacuguggagagcugucacucugguuugucaauguaugugcuguggaccugguaaauguuuuuaaggucaucuauacuuucaucuaagaaacuggaaauaaaucuggcugacugcucuuacuuuuaaguagaaaacugaaaaaaaugauaagggaaaacuuuuccaaaggguugaagaggaaaaauccaggauagaggggccagcaaaacgacucagaagguaaagacacuuguacaaaccucgcagccugaguucaauucccaguccuuagguaaagguacaggaaguaaauugauuccaugcaaguuauccuuugauuaccacauaugugcuaccacaucacauacaauaauaaugcuaaucaauucaaaacaugaaucaaaagaauuccuccuagaacaacuuguccuuggaauuuuuauugagucaccuguuccuccaggaauuguggcaagggguaaaauaauguggcuacaaccacauguagggauuucuccugcuguggcagaucccagaacugacuuuaguacugugagcuccugucacauguacagaaggaagucucuagucaagggaggguuauacacccuguugaaugaaauuggaugcugucucuguccacuaagccacacccagcacaggcuaugucucuucuucccaggaaacagaccuuugucaccucccuuuccagugaaccauccacaaggcuucucguuuucaucaccagaaucuguaauccccacuacucagcaucacauaaggaccguacauacuguucuguauuuggcaacuuucgcuugggauauuuuggggaagagcuugcucguucacuuugaaaugauuccauacuuucagaucaugcugucuuugagagucaucaguucaccauguccuuacagcagcaauuccuucccuuugucagugacuauugccuuuuccuuacccauucuguggauagacuucugagucauuuucagguucgguauuauggguauggcuuguuuguggaaaugugauuuaauucacuaggaguuaaaguacugagaaauguugcaguuuuuuuuuuauuuuagauauucuaucuuguuugucuaaaaugcaaaauguauacacuuuacacaugaagcucaauaaguuuccacacauguguagaugacgacccucaucucaauugugaucucccucccgccccccauccuucucacaucaaccucuacagauaaucauccauccuugccuuucacauugccuaaccccuugugguuuugaaagaguauauauaucccugggcuacacaauguagagucuuuuaaguaugaccucuuucuuucaguauaauguuucuuggauuaauucaugucgcacacauuggugcuuuauucucucuuauugcugggcagcguucugugaacacagaugguuguucauguaaauuccggugaacguugcugcauggccaguguuucuuauauaaaucaagacacacaaccacagaggacuuguuugugugcaugcauuauuaucucucucaggcugauacacagggggauucuugguucuuauagcaaauguuuaaucagaaaugacuguaguguggugcagucauggugucaguggaagcucucauggccaucuaugugcaaugucugagagcugggaccacacaugaccuuccaauauuugguauugcuaggauuuuuuaaaaauuggaugugaaauagaauuguauaguaauuuaauuauauuaaugucuguaaugauugauaaugcugaauauuaugaguucacuguugaaugaugaauuuuuucuuuuguuaaauuuacuuuagaucuuuuccucauuuuuuaauuacccgcuucacuuucucuauauuggcuuuaaagagaauuuugugaauuauagcuauagaagucauucuucagaauguguggacuuuauuuaucagaaacucuggguuagcauauuuaaauuucaauauccuuugaagaacagacacucuaacuucggcgaagucuaaguuacucauucuguuaggaucagugacaucauuucuguguauaugguuuaaguucuuuuccuguacuaagucaaagagauuuaauguuauaaaauaugauugauuuuaauuuugugugugugugaaaauuuuccacauagauagccaguuuucuaucaucauguguuggaaaaugauguuuccccauacauuugcuuguauaguuucgugaaaugccagaucauucucugagucuauuucuagguguucauuuucugccuuuguccacuauguauuauaacucugugccaacauuacacugcuauaauuauuuuagcuacauaugaaaucuuuuuaaaaauuuuuuuauuacguauuuuccucaauuacauuuccaaugcuaucccaaaagucccccauacccuccccccccuccccuacccacccauucccacuuuuuggcccuggcguuccccuguacuggggcauauaaaguuugcguguccaaugggccucucuuuccagugauggccgacuaggccaucuuuugauacauaugcagcuagagucaagagcuccgggguacugguuaguucauaauguuguugcaccuacaggguugcagaucucuuuagcuccuuggauacuuucucuagcuccuccauugggggcccugugauccauccaauagcugacugugagcauccacuuaucuuaaugucagguuguuucuauucuccaacucgauuccuuuucuuugaaacggcguuuuggauacuugaugcugggaaaaaucacagccacagugacuguuacacaaaggaaguuacaccuggauucaauuaaggugugacaaauucauacaccagugacacauggucagggguauguguugcaguaacugcuccaaggucugaacagcuuacuuaugucuuagucacuuuacacaugcaaacaauuaggacugcuugggguuucucacaugacugcacccccccccccccacagaguucuuucuccauucuugcugauggcuuuguucaugaccaagauuuccccauggaucuuuccagaugaccugggccuggccaaacaugagagagcaaagagaagucaauguuucaggagagcugaggucucugcauagagguccaucauucucucauugucaucuacacucugaggcuggagugucagaugcacaauucuucucuguggcugucuuggcucauucaaccaagugugugugugaagcuuucccuguuucacacacaaaucacacaguaauauaaaugucaaaaucacuuuccuuccuguggccugccugugaauccuguucccucacugggcugccuugucuggccucagugggagaggaugcacauaguccugcagggacuggacaagccggggaaagaaagccaguaaguagcauuccucuuucaucucuacuucaccuccuacuuccagguucuuaccuugaucucuuucugugacuuccuucagcaguggauuguagccugugaaccaaacaaaccuucuccucccugcuggguugcuuuuggucucaguaguuucuucauagcaucagaaagcgcaccaggacaccaggaugagccuugaggagaagaucugucucagguuggaggagacgaguuaguccaugggagaacaaggggggcaguggacucuguuuaugaacagaaaggacagaaagccacaggggcacggaguugauaggcaauagcauccugucaauaagcccacacggacacucuaggauauuggcuuuuccuccugcuaaaguagaaggguaccagagagaugcaugaauugguuuagauucuuagggguucucuggaaucagugcaucuagaagauacugaugaggcaccagaaagcucucacugaguuuucaauaaaacgcaaguacaagaugacgucauggauaagaugguggggguauguuguagguaggauaggguucacaggugauacuggugacucauccacaugggcugacugccugccacauauauggaggagggcagaucaagcgugaagaauuuugcucugugccaacgaugaggugcucaguacugacaugggaaaaguuguggagaagccagcuuucacgggggccaggaaacaaggcuagaggacaccggguauuagguucugcagguaggaagacuuuucucuugaugcuuguacuucuuauuguuggggcagagugaccuuuauagcagaaagauaaagaggaagcaacagagcccaaguaggugaaucaaaggauccaggagaaaaugugcauuuccugugaugacaggcuguaugagaucuguggcugacagauaacagcuauacacacaauuucauuaggaaaagaaaaaaaaaaccaaauuuaaaaauguucuuuauuuauaggagggcaaaguaauccauucuuugcuuguucugguaagaucuccugaaaguuauggaacuggugauauuuguuuguuuuuauuaugacaaaaaaguucccaacuccuacaguggacuugugauaagaucgggguacaggcagccagcucagguggaugacauuuguaguuuaaacuuaacugcaccguuggccaagucaaaugaauaagcuuugcauaauaucccuuguuacaaaacaugucagugccguggcccaaauggaaggaacugacugcccucucagagugauuuguuuuaauuuacuauauaggagaaaugucagagaaccagaugauaaauaaauucacauauagguucaaaacuguaaucccaaaucaggggaacuggugcaaaauuacguuagauauuuguaagguugauuuuuuuuuuuuuuuagaaugagguaguuugaagacauaaaaggguauuuuuuuuuuucagaaaaguuggcagaugcuagcuggauucugaaggacuuggcuacuuuaaaacuccuauuugguucauugauuggaggccguccuugcucagaugugccuccugagcuguguucuauguauucucaaauggcugcauuccaugucuacaaagcccaaacagaggcugagauggcuuauuguuucuugaagaaccugguuaagggacagaucuuacuuuaauaacucagucauggugaucagagaaagggguugaccaugacaguuucucucucucauuuuuuagucgaccuguggaaaaagagaagaaugcauguuuccuugcuucaaccacuugguuuuaaccccagccacaucugagugagcuugguugaauuauuuaagcauuauuauugcuaaugauaguacuaaauaacguagccuuggauuuugcucaaacucaugcugcaugcaauccugauaauaagagucaagagcagcaaggaacacacucaaggucaagcucccagacagcaaaaggcuugcuuuuucugccauguaaaguguaucaccaguggcuaagagcuggcuaagccacugggcagagaagauauaucaggagcauuccagccccuauaaggagcuggcucaagcuguguucuuagcuagcaauacuuccaugcuugucuuucuaugccuggcucacuuggauucgguggcuagccuuuagagccagccugcuuggguucuaauucucuuagcucuguguuguguggaucccuuacuuaaucucugugccucugggucaucauuuggaccauggagagaacaacagcauggcauugacugacuuggggaaugaagaauugauaugggagucacagagagccacauaaagcauagaggagauacugcauaaagauuucaauuauauuuuucuauuggugcugggguggggaugguccuucaauccuuccuaugcaugaagacauaaaaggaagucucauaauagaguuaagacaaggaugcuuggcacaacucaaaaccaaccguuaacauuguuucauuugaagccccaaaagaugauggccuccuuggaaaggcuugguuaucuucauccuagaugagauuauagaucaaaaucugagguacuagacuauacuuuggaccugagaugcucuuuccauuauccaacacaucuaagcacccaaggaacauaaacaucguuugccucucagggcucaucuccaugccccuccugcacucucccuaacaugugaugguuugugagauuguccacagcacaggaaacaauugugcccccugacaguaucagcagaggucaugaacagccuggaggacagccuggugcguguguguguuugagauuugggaauggacauuaugguaaacagcauuguuuaucucagcuucacugacccagcaaagacaggggcgggugauuuaauugguuccccugagguggauuaugacguugugcucaugguuaaauauuuaugugguaaguuuaggaauuuccaguaagugagacagcagcauuuuugaacaagucauggauuuuggcuaaaacuaaaauucuaugaugggcggguuaaaaaaaaaugccaagacaucuguguauuuaaaaagaaagagggagcaugcccacgugggucgucugcagaaaugagacgaaggagcgccaaguagccucacggcucugagcuuauucucuccagcccuucaucugggguaagaaucaaugacugucugaagcuuguaaaagaaaaaagugccugcaaaucaaagaaacgugcacucuugaaacuacuaaggaguuaaauauuuauuccuagcuuuggggaugucuguaucccuccucugacuggugaaggggaaagccacaguaauagauucuuuaaaagaaaaaggauuauuuauugugcacagaccucuggcaagccuccguggcuuuugagaacaagccuaggcaguuacuauucuuugaaaguuugggggaacagucuuggauggccuccuggcuaauguuuuaguucaaauuuuuccuuccuuaguuuuuuauaaugaugccuaucugugaguacuggcauguugcucuagccugcuacacggcuguggcuuugauugacacugugcuuucuaguaucuacucaauuuuaugguucuaaguuuuacaaaugcaaaaauuuguuuccuuuccucuuaauuuaguuuuuuuuuguuuguuuuuuguuuuuuguuuuuuauuuuuuuugaggaaauguucaagagacugguaagguauaaucaaucauggaaaaaaaaucuagucauuguaaggacugcugucugguuucacguucaguagggauggaugcaauauuguauaccugaaaccuacuauuauccauaugugaauuuaauaaauacgugucaaccgacuguccuguaugguaagaacaaaucaaaacaaguaaguaaaaagcgauacaaauuaauuauuuuacaugguuuauuuuucaguaucuacagugauuucucuucuggacccuaccucagagagcacuugucaaccgccuagugaacacaccauuacuauccugugccauugccauagagagaccucagccaucaaucacuagcacaugauugacagacagagaaugggacuuugggcuuuggcaauucugacacuucccauguauuugacaguuacggagggcaguaaguaccgauucucagaugagugguaugguuugaacuuaaguaauucugggaauauuuggccucauuuaagcugcuugcuuccuguuguuuugggcugaauuuuauguuaggaaacuauuuccucuucauucauucuuuaucguaaaucucucagaaggaauucucuauagggaguagaucauaauuuuugaguuauguaaauuaagacuuaacacaguacacgaacauggaagucauuagaagcauucauugauggcuaggagcaaacagggacaguagcucaaauugauuccuuagucuauugcaccaaguggcacauuuaguaaagggguuuaauuguugacuucuucuuccucaaagcauuacaauauaugauccauuuaaaaaucuaauccugaacagaaacuguagucuuuucacuuggacauuuuaggaucauguucauaccuuugacuuguagguaaaucguccuggggucuggaaaaugaggcuuuaauugugagaugcccccaaagaggacgcucgacuuauccuguggaaugguauuacucagauacaaaugaaaguauuccuacucaaaaaagaaaucggaucuuugucucaagagaucgucugaaguuucuaccagccagaguggaagacucugggauuuaugcuuguguuaucagaagguacuguucaggaaaccauuguaagccuugugccuauuccccuuucauuaauggcugguagcccaguuguccuugcuuucucugugucugcccuucagugaaacaguuaaauuuauaaaaugauuagaacaagaagggacgacugagaagaccagcagucugaggguugaugggcuggcuauugaauauguaacaguagaauauauaauuggcagccugauuagaagaaugcccaucuugucuagugacacauuagaacaaugaguaauugcucgaugcucucugggauuaagaaaaaacuaacauaugaaacagaagcccagacaucuaaaaccacaaagaucuguuuugggugaaaacguguagaugccagagccugacaaacagauagacugcagagacuuggggucaaugucugcagaucucucagccugagcugcagaucuaaacacugccacauguuuagauuucaugccaucucugauacucacaaagugucagauaagccuggguaugguuuggugaccacaguuuccaacucaggcccuuguaccaguuaggugugugcugccaccaagugaccucucugacucuagguuccucaucuguauaauucauacaguaguaucauuaugauccccaaaucaccacugugagaauaaaaugauguaauucacgaagagggcuucacucuguaucugguucaacaaacauuggcacaacauuguccaagaguuacagcuggauaaagcuauaucaugguaauaaguaucucuuuuuaaaucuuuggcuucuuuuaauagccccaacuugaauaagacuggauacuugaaugucaccauacauaaaaagccgccaagcugcaauaucccugauuauuugauguacucgacaguacguggaucagauaaaaauuucaagauaacguguccaacaauugaccuguauaauuggacagcaccuguucagugguuuaagguaaacguuugaaaucuggggagaaaaugauaacaucugcacaagugauguagcugagagugaaaauugaguggaagaagguuggaaagucuucuuguuguuguuguuguugcuucagaacugcaaagcucuccaagagccaagguucagggcacacagguccuacuuguucauugacaacgugacucaugaugaugaaggugacuacacuugucaauucacacacgcggagaauggaaccaacuacaucgugacggccaccagaucauucacaguugaagguaagcucuuggcuucaacaagggauaaaauucaaacaaaugcaaucagggagaccugugcacuucugguugcauuuccuacccucuccccuuagucuauucccuucuacuucuucuuaacuuccauauuauacucuaacaugaaaggaaguugccaugaagcauagguuuaagaauuccagggaaagauauuguugaaucaaagccauagcuguuuuuuugggggaggggggaaggcuuaauuuucaagaauaacccagucugaauuuccuccuuccuccucccugcuccccuuccuccucuccuccuucuuuaacaacuccuccuccuccuccuccuccuccuccuccucuuccuggcuaaucuccagaaugcuuauauaccuaaauccuggaugauccagugucauauauuuuucucagagguuccucaccuccucccuuaaauuauaccccaucucuggauuacuugcaauaaccaauacaauacugaaaaaaaaaacccagguguccugcuucauagagaauaauacaucuacaaaacaaaagucuacacaagaguuaucaaagaagccacuauauguagcuaguugaguuccuggauauaaaagccacaaauuaagaggcuagaguguaacagggcacaguacuuuuauacacacugcuggaugguuuucaguccuggucuauaaugcuuuugacaucaucaguguuuucaaagcaggucauuuguuuagaaaagaacuuuuuccaaauaugaauucaacguuaaagaagacauuagaggggaagauucccuaaucauaguugaugguauuuauagaauugagguuuuuucugggugcaguuccucuaucgaagacauggggucucacuaucaaguggcauggaacaagaauaggacuaagcaauacuggagacaauguuuuguuuagagccuuucugcacuccauugcuugagaguaagcaucaccaaaccacaguugugucugucccucucauuguuuaaugucaaguccugcaauguuucuuaaucucaauacccagaaagaaaaugagcauauaagggugaaggguucauccaugcucccagagaccucccugcuccccacucccaccccaucucagugguaacaggagggaaaacuacugcggaggaagaagaaaccucuccauguacacaugggcacagugguggagagcugugaacaguggaccugugggcuccugaacacgucuuugucauggauauauugacagcaucuucuuugaaugucuaugcuucuucuauagaaucauaguuaucaaauaauuuauaaguuacagagucauuggaucaggcaguauuugucuugaugauauagaagauaucaaaaaauaacauaggaauaguaaucagaagaaguguggcauaaauuacuuguuccauuuggguaucugcacugccaaagguuauuuuccaagaguugacacacugcugugaaauuaaauagaacuucaaaagacuugcuuuauauugaugacuaaucaauacuucaauaauuauauucuauuucuguuuuuaauuuuuaagaaaaaggcuuuucuauguuuccaguaauuacaaauccuccauacaaccacacaauggaaguggaaauagguaagaaaauuuaaacuacucucuguugaccugggaaaacguuuccuuaggauuucaggucugguuuccuauggaagggucacgaauuaguagaggggaacuuggggaucaugugaggugacaauaugaaaacaccugcccccgucacagcaaaaaucagcacugcauuuguguugagccuuggaguucaugguuaugucauagaaguauuucuuguuaucaucaguucugccuagggagcaguuguccucacuucacuguugaggaggaauauaggcucagagaugcucaaaggagcaccaaaggucauggauagcaaaagagcgagaguagaguuuuaugaaucugcuucugcucuuguugguuuucauuagaugcuggguccaauggaaagaacuuggugucugaaacaccaugaugaaucauaccucccucaccacacucuguaaccaaucacucuccuacacucuuggccucagcauaccacugucugaugagcugugugcuugcauucuucccuauucugcccacauggccguuccucaucucuguggagcgagaucauacguaaccucccaugugcaguccuuccugccucccucuuccuugccaacaagcaguuucuagcugcaucaucagcucaagucuuggcuacuagauuuuauuuuacagugugguagccucuaauccuuucuccacagcuuugccuuuccagagacugucagguccucccucaugccugugaugugacucauuuuuaggcaagcucaaguauaagucugagguucugaaagggaagauugaauguauaacuguagccaaaaucagcucugauguuuucuuucuuuuuuauugguaauuuaauuuuuuuacauuucaaaugcuaucccccuuccugguuuccccuucacaaauccccaucccauccccccucccccugcuucuaagagggugcucacccaccuacacacuccugccucaccacccuagcaguccccuucacugggacaucaaaccuucacaggauuaaguaccucuccucccauugaugcccgacaaggccauccucugcuacauaugcagcuagagccauggaucccuccauguguauucuuugguuagugguuuagucccugggagcucuggggaggggccuaguugguugaucuuguuguucuuucuaugggguugcaaaccccuuuaguaccuuuaauccuuccucuaacucauuugguccccaagcucagucagacaguuggcugccagcauccgcaucuguauuggccaggagaucacucugugaauguugacauucagguuacuugauaguuggcuuggguaaagcuguuuuagcuccagagguagccugugaagagauaagaggaauucuguaggaagagaaagcuguggaagagaccagugaaaaagaaacucacuuuuuaacuagcagcaacuccuaugugauuaugugaggccagagcaagcuuuguguucccugaguuaagagggugcuagggcuauaaggaacauggagacauuggggaggaggugugagaacaaagaggcacaggacgaggauaaggaagggaugugagcagaacuacaggucuauuacacugugugaaacuggaugccacuagcagaauucaacuuuugugaugaaucucuucacuuuuuuaucuaggaaaaccagcaaguauugccuguucagcuugcuuuggcaaaggcucucacuucuuggcugauguccuguggcagauuaacaaaacaguaguuggaaauuuuggugaagcaagaauucaagaagaggaaggucgaaaugaaaggcaugucaucuaucauaucuaucuaucuaucuaucuaucuaucuaucuaucuaucuaucuaucuaucuaucuaucuaucaucuauugagacaaagccuuacuagguauguccuagaacucucuguguagaccagcuuaaccucaauuuccugcuuccugaaugaugggauuauuauaucccaucauugggauauaauauuaccaugcccagcaauuucuauauugaagcugaaacaucccucugugccuccucacagcuggcacuugccaggaaaacauuaguaauauguugcuuucucaguuccagcaaugacauggauuguuuaaccucaguguuaaggauaacuggugugacagaaaaggaccugucccuggaauaugacugucuggcccugaaccuucauggcaugauaaggcacaccauaaggcugagaaggaaacaaccaaguaaggagugucccucacacauugcuugaauaaauuggcugaaucagcugugcacugcauccguuuucuccgaggacuguguguuguagcuuggucccagggaauccaucaugaucaagggaauaguuggccuguuucaucaaguguucuucucacguugaggaagcuccuuaaaucuggucuuuccagaauguuucugucuuccaacaggaaucucugucauuguauccuuccccucucuguguccccuccuccuuguucuccccgcaguccuccccaucuccucaccucccuuaauguguucuugacccccuucucucuuuuccuucucucugagcuccuucucacccaauaguggcuuuugcagucauccuuuguaccgacuacaagggacauugguauugguaguggguucagagcaguaauaacucugcugugucucuuuguauaaccuugucauggaaaacaacuuacaaacuuucauucugagcaguuauuaauucccuugcuugguccuuggguugacaggugcagccaucaugauagauagaugaccaaccugauccgauuuuaaaagaguaaacaucuuuuuuacccuuaucacucucuuaugauacugaccacugccuuacuggcaauacaacuaauaugaaaacauuuuuaauuucuuucaaauaucaagagggcaugggagggagagagacacuaacucuaagaucauagcaauauguggggcauuuauuuggaugaauauauugauuaaaaggguaggguggagguaccuauuagauucagucaugcugugucucugccugaagugguauuugggauuuuuguugauucuguuugucuucuuuuguuuguuuuuacuauagaaacuauucugcccuuguacuccuagagucaccugucuuugccucccaguuacugggacuaaagcuaugugucaccuuacugagccaggguguuucuuguuuugguuuugauuuuagagccucuggcuuguaacauuuuuauaaaacagaauuuugauuccuagguggccagaguugugacucauagagggauuuuugugcuguugugaucagugaggucuuggggaucugccccugauaaugguguuacuccgggugacuguggaccacagcacuguguucccagauggugguggucacugcacauucugcaggaaaagagaauccaaaccccuauucucacccaguuugaccuugauuccacaaugccuuccucuguaacaggaucuuuugucuagauuucugaguguacuuuaguucacguuuguauuagaauuauauuuuuuaaucaguaauuuuguauuuguuuuguuugugugugauuucuuuguuuuccaguuuauuuuuaauucacuuguugcuauucaaaucaauguguucauacuguuugaacaacacagcguauuaaauaaaauucgugucuauuguucuugaaugaucauaaugaauucuucugauauuucuuaaauuauaaaaucaaaaaccuuauaaagccucccucuguauuucucaacaccacuagguacaaguagagugucugugauaacaauaauucauauucauguucaauguuuucuauguugaagccagaugucuucaacauaugucuuagaauuucucauuuaucuuuuuaccccauacuauuugucaauuuuacugacuaagucaaugaagcaagggaagagugggccuaaggccuugccaagaacuguaauucuagacccaggaugcaacacagacaacauuuuccuguuuauaaacacugccaagaagcauuugcgucuggucauugacgugaaaaccacuuguaguuuacaaagucauaagcacguagauagauguugagcaucaacuuccugggucaccuugaaucacagucuugccuaggguaaacauuucagccacccacacagguacuucacccacagcaguuccuauaagaagucuaucuuccauacccucuguaccucccuagcacgcauccggugggacuuuuagacaauuuuucugaacaagcugcuugggaaguucuuacuuaaaccuaaagaagugaagacagcaagcucuggccaguuuugagaucuuuucucauuuuuuugggucgcaagacuuuagugucuugaguuucuuuuuccuggauuuagagagaaggugaacugucaaggaugguagaggaauuugucacuacuagcagggauuucacgccaggucuuguggccuaugcguggggauuuacaaauaaaauaaaaaagaacuauuuacccggucugaccgaggaaucuccucauauucauggauaaacaaagucuaugaggaucauaugguuccaacaggcaagcagaccaggaaugguagcaguuccuguguccaaccuguacaugugucuuacaaguuccugaaggugaaagccauguuucuugcguguuuugugaaacaagggaugugggacucggcugagagauaguugaaggaggaucucaauagcagaaggcaucaggaugauagaacccagcaauuugaugucuccaucacagcacucugugaccugcaacugugcguguauccuauauuccccacccccuagaugcaaccauuuuccugaucuacugacucacaugccuuagggcugcccauaaacaccgaccuuaccaaucgaauuccuaucauuucacaaguuccaagccucauuuccccccacaaauacccuguuauauuccuugaacacgucaucccuuccuauacaaaugaacguuccacuacugucagauuaaucuuacugaaaagcacuuucaucucuaauacccuuucacaucaggacacauucccuagcaagagugucugaucaugcauagcccugaccacgccuuccacgaauuccccaaacgcaguuacuacaguucuuagaacacacacuuccaccucugcacaugaacucagcauucucucuggagaggggaguguucuuuuuuuuuuuccuagaccguucugagucuucuuuguccuuuaguaauccauucuauaguaagccuuccuuccuuccucuaauauagagcaguuucuguuuaagauggcugucagcugaaaucccuuuugccuccuaucuuagcuggguuuuccuguaucuaugagcuuccuuaccuuuaagcacacucuguguuacuaagccuuaagacuugugccgaguaugugcuaagaaaauugauuuguugauuuugaaaguauuguugaaaauucaguauugguuuauuggguaggaaugccuugugguugguuucuagggaugucggaguucaugcaaccauccauucugucucauuuugcuauuacuaaugcccguuucccccaucuccccaucucuugauaguugaucaccgaagcaucuacuacauaguugcuggauguaguuuauugcuaauguuuaucaaugucuuggugauagucuuaaaaguguucuggauugagguugcucuguucuggagagauauagugacaccuuacaaaacccggaacggugaguaucuguuuucaagauucucuucacaaggaaaagucccacugacucuugauuauuucuuuaaugauauuuugcuccuaaacccaaucuccguuuccuuuuaaccucaucugugagauuuuggagucuacacggaucauuuuccaugccucugugucacugcuuauacuucugacauucagacauucaucuccaagauucuccuugccgagauugcuauuccuagugagcccccauaacucugccugagacccgaacagguucugcuguuuugaaaaaugcauguuaauaacauuuuacaacaggacaauagaaucauaccugcuuuucaagugugagcagguuauggagagaguuggaacacaugcucauugcccuugaauccucauuccaugaguacacacuugcacaaacuuuacacaugaaaaagaacagucccagugaaguaggaacuuugaagccuguuugugcacgaagcaaucaauuaacuguagauugcuugauuugugggaaauacagaccccuuaagaaguccuacuucuuugccacuauuugccauuggcauauuaccuuccgaggaaguaguaugguugccauaugcccuuucugggguuucaauugucuaaggucaacugaaguuuguaaagauuaaauaagcaaaacaaaugugaguuuuaaguugagcaugagucugagauaugugauuguccugccugggaugugaauugucuguuuguucaguguaucuauguuguauaauguauaauaaccuagcacuaaucaguuacccuauuaguuaacaggcucacugccgaaguuccguggugccuguguuugagggacaguuauuuuauguugacgucacugccuucacugcuggaguagugaugccauggauuuuguuguaguccauuguccuauguuuauuacuagcuaugguuguuaaacucuuacugugacaaguguauuaggucugugugugcagaaguaaguguugaauggagggcacaguauuaucuguggcuucagguacucacuggaugucuuugaaccugugcucuguggcuaaaugaggaauguugugugggaaaacuguaacagucaauagacagagaagacccuuccccacccaugauaauagacacuaauagcuuauaaacaaacuugaaguauucugaagacucuuuguucuuuaucauucaagcuaagaucauaaaccaaccaaccaaccaaccaaccaaccaaccaaccaaccaaccaaccaaccaaccaaucuuugguccagaucgcuuauuuccuagucacaauuuagagccauaguuugcugauaucucuugguuuuagaguaugagaggggugaaagccagauauuagcagccauaaaacuugguaagaauugcccuucagaagacaggcaggaagucugagaagcaguaaaugaagcgguacuucuugauuuccuucucagauggcaagcucuacgaugcguacaucauuuacccucgggucuuccggggcagcgcggcgggaacccacucuguggaguacuuuguucaccacacucugcccgacguucuugaaaauaaauguggcuacaaauugugcauuuaugggagagaccuguuaccugggcaagguaaaccgacugagacacaucagggguugaaauuauuugaaaaaaaauucaggaaaggagacuauggguagauaaugcuagguagugaggagggggugggguggaggggaaggacagguagaucguagaucaugauagcuaauaauaaagugugcgagagauaggaaaaggaaagccacagaaacacaguucguuacaaaaugucauuaugaugucgaaugcauuauacaucgauuuaauuuuuuuuaaauauaaaaaaaaaaacuuuaguacauggaguaaguacugagaguuauauauuugcauuugccuuuugguuuaucaggugaaccauacauauauguucucgauacugcauuuuuaaacuuaacauucuguuuugaaguccauaguaacuucauaguaaugagcagagguaauucugauguucauacccuacacauaauaggaauuauuuauuauauuauauaauuauuauauuauaauauauuauuacauuguuuuuuuuauuauguauuuucuucaauuacauuuccaaugcuaucccaaaaguccccccuccaccccacuccccuacccacccauucccauuuuuuggcccuggaauuccccuguacuggggcauauaacguuugcuugaccaaugggccucucuuuccagugauggccgacuaggucaucuuuugauacauaugcagcuagagucaagagcucugagguacugguuaguucauaauguuguuccucugauaggguugcagaucucuuuagcuccuuggauacuuucucuagcuccuccauugggggcccugugauccauccaauagcugacugugagcauccacuucuguguuugcuaggccccggccuagucucacaagggacagcuauaucaccauccuugcaacaaaggcuugcuaguguaugcaauggugucaucgcuuggaggcuaauuaugggauggaucccuggauauggcagucucuagauggaccauccuuuugucucagcuccaaacuuugucucuguaacuccuuccaugggugauuguuuucaauucuaagaaugagcaaagugucuacacuuuggucuucauucuucuucaguuucauauguuuuacauauuguaccuuauaucucgcuauacuaaggaucuggguuaauauccacuuaucagugaguacauuucauuugaguucuuuugugauuggguuaccucacucaggaugaugcccuccagguccauucauuugccuaugaauuucgugaauucauucuuuuuaauagcugaguaguacuccauuguguagauguaccacauuuucuguauccauuccucuguugaggggcaucuggguucuuuccagcuucuggcuauuauaaauaaggcugcuaugaacauaguggagcauguguccuucuuaccgguugggacaucuucuugauauaugcccagaagagguauugcuggaucuuccgguaguacuauguccaauuuucugaggaaccgccagacugauuuccagagugguuguacaagcuugcaaucccaccaacaauggaggaguguuccucuuucuccauauccucgccagcaucugcugucaccugaauuuuucaucuuagccauucugacuggugugagauggaaucucaggguuguuuugauuugcauuucucugaugauuaaggauguugaacauuuuuucagguguuucucagccuuucgguauuccucgggugagaauucuuuguucagcucugagccccaucuuuuaagggggcuauuugauuuucuggaguccacccucuugaguucuuuauauauauuggauauuaguccccuaucugauuuaggauagguaaagauccuuuuccaaucuguugguggucuuuuugucuuauugacggugucuuuugccuugcagaagcuuugcaguuucaugaggucccauuugucaauccuugaucuuaaagcacaagccauugcuguucuauucaggaauuuuuucccugugcccauaucuucgagacuuuuccccacuuucuccucuauaaguuucagugucucugguuuuauguggaguuccuugauccacuuagauuugaccuuaguacaaggagagaggaaugggucgauucgcauucuucuacaugauaacaaccaguugugccagcaccauuuguugaaaaugcugucuuuuuuccacuggaugguuuuagcucccuugucaaagaucaagugaccauagguguguggguucauuucugggucuucaauucuauuccauuggucuacuugucugucacuauaccaguaccaugcaguuuuuaucacaauugcucuguaguaaagcuuuaugucaggcauggauauuccaccagagguucuuuuauccuugagaagagcuuuuguuauccuagguuuuuuauuauuccagaugaauuugcagauugcucuuucuaauucauugaagaguugaguuggaauuuugauggggauugcauugaaucuguagauugcuuuuggcaagauagccauuuuuacaauguugauccugccaauccaugagcaugggagaucuuuccaucuucugagaucuucuuuaauuucuuucuucaggggcuugaaguuuuuaucauacagaucuuucacuuccuuaguuagagucacaccaagauauuuuauauuauuugugacuauugagaaggguguuguuucccuaauuucuuucucagccuguuuauucuuuguguagagaaaggacauugacuuguuugaguuaauuuuauaucuggcuacuucaccgaagcuguuuaucagauuuaggaguucucugguggaauuuuuagggucacuuauauauacuaucauaucaucugcaaaaagugauauuuugacuuccucuuuuccaauuuguauccccuugaucuccuuuuguugucgaauugcucuggcuaggacuucaaguauaauguugaagagguagggagaaagugggcagccuugucuagucccugauuuuagugggauugcuuccagcuucucaccauuuacuuugauguuggcuacugguuugcuguagauugcuuuuaucauguuuagguaugggccuugaauuccugaucuuuccaagacuuuuaucaugaauggguguuggauuuugucaaaugcuuuuuccacaucuaacgagaugaucaugugguuuuugucuuugaguuuguuuauauaguggauuacguugauggauuuuuguauauuaaaccaucccugcaucccugggaugaaaucuacuuggucaggauggauuauuguuuugauguguucuuggauucgguuagcaagaacuuuauugaggauuuuugcaucgauauucauaagggaaauuggucugaaguucucuaucuuuguugggucuuuuugugguuuagguaucagaguaauuguggcuucauagaaugaguuggguagaguucccucuacuucgauuuuguggaauaguuugugcagaacugggauuagaucuucuuugaaggucugguagaacucuacacuaaacccaucugguccugggcuuuuuuugguugggagacuauuaaugacugcuucuaauuccuuaggggauaugggacuguuuaguucguuaacuugauccugauuuaacuuugguaccugguaucugucuagaaauuuguccauuucauccagguuuuccaguuguguugauuauagccuuuuguagaaggaucugaugguguuuuggauuucuucaggaucuguuguuaugucucccuuuucauuucugauuuuguuaauuaggauguugucccugugcccucuagugagucuagcuaaggguuuaucuauccuguugauuuucucaaagaaccaacuccucguuugguuaauucuuugaauaguucuucuuguuuccacuugguugauuucaccccugaguuugauuauuuccugcugucuacuccucuugggugaauuugcuuccuuuuuuuucuagagcuuuuagauguguugucaagcugcuaguaugugcucucucccguuucuucuuggaggcacucagagcuaugaguuucccucuuagaaaugcuuucauugugucccauagguuuggguauguuguggcuucauuuucauuaaacucuaaaaagucuuuaauuucuuucuuuauuccuuccuugaccaagguaucauugagaagaguguuguucaguuuccacgugaauguuggcuuuccauuauuuauguuguuauugaagaucagccuuaggccaugguggucugauaggauacauaggacaauuucaauauuuuuguaucuguugaggccuguuuuguggccaauuauauggucaauuuuggagaaggucccaugaggugcugagaagaagguauauccuuuuguuuuaggauaaaauguucuguagauaucugucagauccauuuguuucauaacuucuguuaguuucacugugucccuguuugguuucuguuuccaugaucuguccauugaugaaagugguguguugaagucucccacuauuauugugugaggugcaaugugugcuuugagcuuuacuaaagugucuuuaaugaauguggcugcccuugcauuuggagcguagauauucagaauugagaguuccucuuggaggauuuuaccuuugaugacuaugaagugucccuccuugucuuuuuugauaacuuuggguuggaagucgauuuuauccgauauuagaauggcuacuccagcuuguuucuucagaccauuugcuugaaaauuguuuuccagccuuuuacucugagguagugucugucuuuuccccugagauggguuuccuguaagcagcagaauguuggguccuguuuuuguagccagucuguuagucuaugucuuuuuauuggggaauugaguccauugauauuaagagauauuaaggaaaaguaauuguugcuuccuuuuauuuuuguuguuagaguuggcauucuguucuuguggcugucuucuuuuugguuuguugagugauuacuuucuugcuuguucuagggcgugauuuccguccuuguauugcugcuuuucuguuauuauccuuugaagggcuggauucguggaaacauaaugugugaauuugcuuuugucguggaauacuuugguuucuccaucuaugguaauugagaguuuggccggguauaguagccugggcuggcauuaauguucucuuagugucuguauaacaucuguccaggcucuucuggcuuucauagucucuggugaaaagucugguguaauucugauaggucugccuuuauauguuacuugaccuuucucccuuacugcuuuuaauauucucucuuuauuuagugcauuuguuguucugauuauuaugugucaggaggaauuucuuuucugguccagucuauuuggaguucuguaggcuucuuguauguucaugggcaugucauucuuuagguuugggaaguuuucuucuauaauuuuguugaauauauuugcuggcccuuuaaguugaaaaucuucauucucaucaacuccuauuauccguagguuuggucuucucauuguguccugaauuuccuggauguuuugaguuaggaucuuuuugcauuuuguauuauuuuugauuguugugcugauguucucuauggaaucuucugcacccgagauucucucuuccaucucuuguauucuguugcugaugcuugcgucuaugguuccagauuucuuuccuaggguuucuaucuccagcguuggcucacuuuggguuuucuuuauuuugucuacuucccuuuuuaggucuaguaugguuuuguucauuuccaucaccuguuuggauguguuuuccuguuuuucuauaaggacuucuaccuguuugguuguguuuuccugcuuuucuuuaagggcuuguaacucuuuagcaguguucuccuguauuucuuuaagugaguuauuaaaguucuucuugauguccucuaccaucaucaugagauaugcuuuuaaauccgggucuagcuuuucgguuguguuggggugcccaggacuagcuggcaugggagugcugcguucugauguuggugaguggucuugauuucuguuaguaggauucuuaccuuugccuuucaccaucugguauucucuggagcugugcaggauacacuccgcgggguccuggaacuaagaugucugugcaggguacacugggcagggucccggaacuaagaugucugcugccaaugcucaggcaaagcgcucccgugccggacaggucccuauccucuggccgggaaaauggucaccugccuguacaggauacacucggcggggucccggaaccgagaugucugcugcugaugcucaggcaaagcgcuccugugcagggcagaucccaauccucagaauucuuaugaucgcguggcugguguuguggguaucuggcgguagucagccgacugugcgcccuagcuaccccggugcugcucggaccgaaaggggcuugugccccuacucagaccggguuuuugcuucccugacuaaugcagucucaagucccacucgaauggauuggagcagaugcuguguuccacucgccagaagucuuaagaucgcuugguggguguuguggguagcuggagguagucagccgacugugcgcccuagcuaccccgugcugcucagaccguauauuauuacauuguuauugcaucuuguuacauauauaaugcuaaugcauuauauuauacuguaauauguuauaucacauuaaggaauuuagcuuagaauuuuuacuucauaguaaacacauagucauuaacaaaaaauaauuuaugcaagugaucuagccuuuuugcugauuggugaaggacuuacauugauagucagguuagauuuaagaucagagguuuacuuacuaccggcuaacuguuauuuugagacaggaucuuuccugguccccuggcuggccuggaacucacuauguagaacaggcugguuucgaacacaugugaauuaugauauagcaugaacuaccauacuugacuuagagcagagauauuuaaaaauuacauauauguugugugugucacacaugccugugacagugagaggucaacuuauaaagagccgguucucucuuucuaucacgucuaggucuuggggauccgauucuuguucucagacuuggcggcaagcaccuuuacuuacuggccaucugguugucccaagaccagagcuuuuaggcuguugcuugggcgaugcucaccuucaacucuucucccccacugcuguccuaacaaugauguauucacagccauguggguggaacaugguagaugaguccaaggcuucagcugugcaauagccaccauugccgcaacuugauuuccacuguaucacacuaggauaacucggacgcuuuuaaugauuaaauauuacgacauuuccacccuuucuucccuccuuccaguaccucuaccuugcugcuucuaaauuauguucuuuuaaaauuuguuauuguugcauacacacacacacacacacacacacacaccuauauacucacaccacacacacaaacagguacacacacaugcacacacaugcauacaccgcuacacacauguacacauaugaacauacacaugcacacacaauacaaucauacacacaugcacacacacauacacacacaugcacacauauaaucuagccuguuucuccaauuugguauugcuuguauauauauauauauauauauauauauauauauauauauggcuucacuugguauugugugaucaauuacagggcucauccaaguaacucuuaugaugucgaaugcauuauacgucgauuuaauuuuuuuaauauaaaaaaacuuuaguacauggaguaaguacugagaguuauauauuugcauucgccuuuugguuuaucaggugaaccauacauauaugcucuugauacugcauuucuuaauuguauguaguucuuugacuaugguuggggccucaugagauuucugcccuucuuugauagcaugucuguuguaguguucacauccuggccauauucaugauaaggagucaugggugaagcuucucuggcauuucuaggagacacaaccucacagcagcugaccugguguucuggcucuuagaaucauuccacccucuguccucugagccuuaggcaaaggagucauauuguacauuaccaguugugacuugggaccccaccauugauugcuuucugcuuuuugaccagugguuuucuguaauggucuccaaaaucugucuuccugugcuccaugggcgagcuagaaaaucucuggcaagaagguucagagucugaaggcuugcgucgugaggagacgguuauaauccuuuacaguugggcagagccaucucugaaacuugcuaaccucuucaggagaccuaacagaaucgagaaaaagguuuuuuggguuuguuguuguuguuguuuguuuuguuuuuguuuuuguuuuuuugcgacaggguuucucuguguagcccuggcuguccuggaacucacucuguagaccaggcuggccuucaacucagauauucaccugccucugccucccaaguacugggaguaaaggcaugcgccaccacugcccggcaagaaaaagguuuugauucugauauccagacagccuauggcaaagauauuugaaagaccugagaaauguccugcugguuuucuucaugaugccgacacaguuuacaaaucuguauuccaaggcagcagcacagcagcuuuuguuucuuaguuuuguuucuuaguuuuguuucuuagcuaaucucauguacuuuugacaguuuuaucucaacuccagccgugucagcagagguuuuauugucuuucugcccucgauacauuuaggauagccuacaggaguguucuugccuucccugucaacucucccuugauuccucagaaacccugguuuagaaugagaacagagacagaucaucacaagccuaggccuuauaacuauuuaaauugacauaucuacuaaagaagaggguuguaaguaccgauagguugacaggcaugugcacgggucaaccuauuuucuucucaaauauccaaucaaugcugacacuguuauaaaagaccugaagaugcacaaguuaugaggguagucugaucuuacucuuccuagggcccccccuugcuucuccagcucuccugcugacugcugugaugguagaaaauaucaggcaacgaucauuaggguucuuucugugucucaaaucuuuucaaggaucuguaggcucuccacuugucuauggggcuguauguagcugccagauccucacuucucuaucccacuuccauaucagccaaacucagacgcuugaacguucucuuggaaucaagcuuguacugucuuugucaguuggcaggacucucuuggguaguuccuacuucucuccauugaugcaugaacucugaucucuccuccaaccaguuacaucaaagcugccaacacaacacaucucuucccuuagagaaaguugguagcuggccagugcacugugcauagguuguggcuuccugucuuccaugcuccggagaaguccacucugcaucuccuaugagaugauagacuaagagaccuucacuaucccagguaucugggacgacucuucguuagcacugauuuaucugaguaaacacagggcccuuggaaagauauuuuuguagcaaaauuggcaacucacuccuacuuuaugaauaugaugcuuucagcucagaaucuucuuauguccagaacauucaugauucaaacauuaaacguacacaaggaaugauaugaggucuccauccaucucuugacuguagaugcagccaccgugguggaaagcaguauccagaauagcagaagacagguguuuguucuggccccucacaugaugcacagcaaggaauuugccuacgagcaggagauugcucugcacagcgcccucauccagaacaacuccaaggugauucuuauugaaauggagccucugggugaggcaagccgacuacagguuggggaccugcaagauucucuccagcaucuugugaaaauucaggggaccaucaaguggagggaagaucauguggccgacaagcagucucuaaguuccaaauucuggaagcaugugagguaccaaaugccagugccagaaagagccuccaagacggcaucuguugcggcuccguugaguggcaaggcaugcuuagaccugaaacacuuuugaguugagagcugcggagucccagcaguaggcaccggagugcaggugugcagacuugaaaugccaagggugggggccccaagucucagcuaaagagcaacucuaguuuauuuuccugguuaugguaggagccacccaucguuuguuuccgguuuccuuuuccuacuucacucuuguggcacaagaucaacccugagcuuuuuccuuuucuuuuauuucucuuuuuguuccuucuuuuaaaagcuuuuuaaaauugauuaucuuauuuaucuaccuuucaaagguuaucccccuucccggugcccccucuacaaauccccauccugcuucccuccucccugcuucuaugagggugcccccccaccugcccauccacuccagccuuacaggccuuguguuccccuaugcuggggcaucgagccuccauaagaccuccccucucauucaucaauuaucuacauucugaauaucaagccgacacuuuuguuuuuguuuuugauuuuuugagacaggguuucucuguguagcccuggcugucuugaaacucacauuguagaccaggcuggccucgaacucagaaaucagccugccucugccuccccgagugcugggauuaaaggcgugcgccaccacgccgggcuaagccuacacuuucagaauaaaguucugauucaccucaaagagcagucucauucccagaggcagagagccggaaagagccuccaaugugcuuguccaggcagagcugaccuuauuugcuuaccagucacagguaaacaaagcguuucuccguguugccucuuguagacaucccuguaauagauuaggaagggaaugagccguccuacugaccaguuugugaauugugguagaaaaagcguugacguuuguuaaauacuuguuagcaauguaaaccucauuccuaacacaccagaauuucuuacuuuuuauucgucaauuaccgaguuuugucaagucaguauuaacagauuuggucgaauaccuuacccaaauugccauuacagucgagcauguuuucaguucuaaaugccuuuuauauauuuuuuauucuucuuagaaauacuuccucacuuuaaaaguaauguaaagauguguuagaaaacauaagguguaagagaaaguaugauaaaauauaaaaaauaauagaaaggaaaggaaauauaaugaaaaucauaacucuuaagauuaauuuugguaggucuguauuuuaaaauauaauuaaauuuuauaccgauaacuuuuauagcugagauuguacacuacagacuaggcagcuuuuccuauuuaccaccauaaugaaaacugguggcugauuucuuuaacauucacagaaguuccaaaugucucauuuuagacugugcugcagacuauggcugaagcagccagaaugagaaacaggucugccaugucacaucgggacauuuuccuacuuacugaaauguaucugucacugugcgacagcuaacuuuugugauacuccuaugaaauguguagggaauuuggacagaacagaaucaaucuauagucagagguccucuggacagucuuuuccaggagcacacacagaccgugagguccuaggcacccaggaaacggauccagagcccaggcaagugucuuacagguaccuugaauuuugccaauagauaugagcccugccuuagcugaguugcucagucggugaugggacuccaggcugaggugacaaugaacacagaauuugggagacucuugaaaggaggggaauguugaacucacggucaacauaugaggcugcagagaagccguaugcagaaguguguguagaggaucuagaguagcccguuucucuggggacagugugcucuuagucuguacccuuaggcuggguugccagguaaacauuugcuaguguucaguucaaaggcugaagcuugagcugagggugaugaggaauucaaacuuccccucgcaugcauccacccugugguugccugguuugcuaaguccaccugcucugcuguaguagaagguuuugaucuucugcagcuucaucuacuucuuagugaguugccaaaacugaccacugaaaagcaugcuguguacauaacugucucaugucccagaacgugcaaucaggaggaaguccucacucccgauaacggaauccuugcucuguggcugugaggacgucccuuagcaaccucagauaguaauuuuucuuagguuggauggaacauaguaacgugcuggauucuuugcuaacugaaaauagaaguauucggauuucagaaagaacuggauaaauauuaauguuggugauuaugaaaucucauugugagccgugugaguuugaguguguauuccaugauugugcugaaugaagaccucuaaaaaugaaauucucuccaaucucaucccugggaauaguugcuuccucaugccugcugcuccauccauggaaaaugacuaaagagaauuauuauuuguucccgagauucuucugauaagucuaaacuauuugcauguaauugagcugggcagcauggcacacuugggaggcagaggcagguggaucucugugaguuugaggccagccugcucuacagaguuaguuccaggacaccagagcuacaaaaagaaaaccuguccuaacaacaacagcaacagcugcagcagcaacaacaacaacaaagaaaaagaagaggaggaggaggaaaggaaagaaggaagaaggaagaagaaagggaagaaauaauagauuuuucuguaaugaacacacauaugcuuugaugcuuuugcuaaacucaaaauauuaguuuuauuuuacuguuuugaaagguucaaagcaugauccauguaaaaaugucuucuguggggcuuucucccauuucuacuuuuguuccccucauuucuucaaagugcuuguccaggcagagcugaccuuauuugcuuaccaguuacagguaaacaaagcguuuccucguguugccucuuguagccaucucuguauuagauuaggaagggaaggagccguccuacuguccaguuugugaguucugguagaaagaguguugaaguuuguuaaaugcuuguuuuccauguaucaaaauguuaugccuuuccuauuuauuauuguaugacaaauuauuuuucacugggcaaaaauaauugugccauugacuccuuguguguuuucuucauguguguuugaagaguucuagcuuauuaaaaaaaaaaaucuagaaauac

SEQ ID NO: 139 - RNA, 546 nt, Mus musculus
aaugcggcacauuucacucuacagcacguguuuuuauaaagaguauguuuccugacacaaccgaaccauagucaucaccucucauccagaucagauugucaagcauggggauauaaaaugugugcuaaaugaagauaugccaauauaccaucagccauaugaaaagggaugucuacucauugaauuuaagguaaacuuuccugaaaauggcuuucucuuuccugauaaacucucuuugcuggaaaaacuccuuccugaaaagaaggaaguagaagagacuaaugaaauggaucagguagaacugguggacuuugauccaaaucaggaaagacggcgucauaauggagaagcauauggggaugaugaacagcaucccagagguggcguucagugucagaccucuuaugggccaguaacucuuugacauucuuuaugcaguagugaaugugggaaggacuguaaucauaauaugcucacuacuuggcuauuguuuuuguuuuaauauucaacuauaguaguguuuuaaaaguuaaaugaagaauaaau

SEQ ID NO: 140 - RNA, 2274 nt, Mus musculus
caugaucaccggcgugagggugcagcaggcaccacaccagccacucucugcccagcaaucuccuguuaguagcagguacgaccccucgcagagcagccuugcccuccucccacacuccuccgugucuucccuugccaccacuuuaauaucaauguugccuacuugcccuccugacccaacucgcccuacccgaagcuccugagugcucaaucguaucugcucagacuacaggccucaacuaaaaagcacugugugaacuccacuucugcauccaaguuguauccccaagagcagcgaccugucagacucaaccaaccacccuuugacagaagcaacaccaggaggcaacuuggacagcccucauaaaggaagggaaccuccucguccccgaccaacacuccccuaucuaaucuccuagucucucaguucagacccaagucugaccccaauuucaacuccuaauccacagaccucagcaaacuucaauuacaucacgcaccccaacccuuccaccugaaggguggaggcacaccggcacgauccuucccgaucccucuccccaaaaacucaaguucaaggacgaggucucucggauucuccccuuccuuacacugacacacccccagaccacagcguacacagugacccagcaccggugaccaccccuggcuccccaaagccugcacgccggcccccagcggcacaccuggcccagucaugcaggcacccgcccgcucccgcuccgcugcaccugcgcgggcgcccgucaaagccgaucgcgcacccgccgcuccaacaagccgccccucgcuucucacccgcguagcgcagccgucccgcgccgcccgcggccuggggcaccgccgcccgcuccggccgcggcuccugggcugccggccccgccgcagccgcuucccgucacgugggccgccgcccggcgccggcggagggcgggcgcucgccggugcccaggccgccgcgcgccgcugggaggcuccgcgucagggcccgggggucgggaaggcgggcgagcgcgcgcuggcgagugcgcaggcggcgcagaccgggaccgcagcccucgggaggggagcgucuccgccgcccgccugggaagcgcgaaggaagcgccgccuugucuucucgaccguccacuccauguuggcuacugcacagcugcguuggucagguggaagcucggagaaacgccucccggaccgaccaguagacggacucacagccgggccccgacuugcgggcaggggaugcuugcuggacuucagugugccaaagggggucgggggaacggcccuccgguuccuaggccuacugcuaguccuggcagaaggaaagcuagucccggaggggaggugcauaugugcaggcuaucccuucugcgcugggagucccagggcaguuccacucacuucuuugagggcaguccaucaauggccacucccuugugucaagccauaaagaagaauccuagaauccuccuuccuuauagaaucaaaacucaaguuucccgaugaagaguuaggaagcucuuccagagucaucagugcugccagugcacaaaaaaggccagguuucuucaguuauucccuuugacuugagaaacugcuaaagagguggcuuuaggguacccuaccaucccggccgcugacccuguccccagagguuggauaagagauacuauucuguagcuuuguuucaaaggaggaaggcguguagggguagggaccuagaaaagccagcuaugaaggggaccucuucugauuauagaacccaaguucaguucuguuuucuaccuugucguauccuuaccagguacacaccucaauucccgaauuuuacugaggcaaaaagacguaaaugacuuauccugaaucuuacacuaguaagugucagagcaagaacucgaaauguguuuguaacauaaaauuaaguccuaaugauuaaauaguuuaugggacaacuuuuacauuccacucuagaugauccaggaguggagauaaauacuaucaaaaacgagguaaaucaaaaacaauuauuuucuuuauaacggggcuuaccacagaauuuuuaaaauagcaagcucuauuguugaaauaucuguucuugggacauauugauucaucuacaucacaaauaacagcccccuuuaggucaugccuagacugugaaacaugcuuggguaucuucauaagcuaacuaaauucuucacauuguuucuguuggauccauuuaaaaacaaauauagugucaugcuuucca

SEQ ID NO: 141 - RNA, 2274 nt, Mus musculus
uggaaagcaugacacuauauuuguuuuuaaauggauccaacagaaacaaugugaagaauuuaguuagcuuaugaagauacccaagcauguuucacagucuaggcaugaccuaaagggggcuguuauuugugauguagaugaaucaauaugucccaagaacagauauuucaacaauagagcuugcuauuuuaaaaauucugugguaagccccguuauaaagaaaauaauuguuuuugauuuaccucguuuuugauaguauuuaucuccacuccuggaucaucuagaguggaauguaaaaguugucccauaaacuauuuaaucauuaggacuuaauuuuauguuacaaacacauuucgaguucuugcucugacacuuacuaguguaagauucaggauaagucauuuacgucuuuuugccucaguaaaauucgggaauugagguguguaccugguaaggauacgacaagguagaaaacagaacugaacuuggguucuauaaucagaagagguccccuucauagcuggcuuuucuaggucccuaccccuacacgccuuccuccuuugaaacaaagcuacagaauaguaucucuuauccaaccucuggggacagggucagcggccgggaugguaggguacccuaaagccaccucuuuagcaguuucucaagucaaagggaauaacugaagaaaccuggccuuuuuugugcacuggcagcacugaugacucuggaagagcuuccuaacucuucaucgggaaacuugaguuuugauucuauaaggaaggaggauucuaggauucuucuuuauggcuugacacaagggaguggccauugauggacugcccucaaagaagugaguggaacugcccugggacucccagcgcagaagggauagccugcacauaugcaccuccccuccgggacuagcuuuccuucugccaggacuagcaguaggccuaggaaccggagggccguucccccgacccccuuuggcacacugaaguccagcaagcauccccugcccgcaagucggggcccggcugugaguccgucuacuggucgguccgggaggcguuucuccgagcuuccaccugaccaacgcagcugugcaguagccaacauggaguggacggucgagaagacaaggcggcgcuuccuucgcgcuucccaggcgggcggcggagacgcuccccucccgagggcugcggucccggucugcgccgccugcgcacucgccagcgcgcgcucgcccgccuucccgacccccgggcccugacgcggagccucccagcggcgcgcggcggccugggcaccggcgagcgcccgcccuccgccggcgccgggcggcggcccacgugacgggaagcggcugcggcggggccggcagcccaggagccgcggccggagcgggcggcggugccccaggccgcgggcggcgcgggacggcugcgcuacgcgggugagaagcgaggggcggcuuguuggagcggcgggugcgcgaucggcuuugacgggcgcccgcgcaggugcagcggagcgggagcgggcgggugccugcaugacugggccaggugugccgcugggggccggcgugcaggcuuuggggagccagggguggucaccggugcugggucacuguguacgcuguggucugggggugugucaguguaaggaaggggagaauccgagagaccucguccuugaacuugaguuuuuggggagagggaucgggaaggaucgugccggugugccuccacccuucagguggaaggguuggggugcgugauguaauugaaguuugcugaggucuguggauuaggaguugaaauuggggucagacuugggucugaacugagagacuaggagauuagauaggggaguguuggucggggacgaggagguucccuuccuuuaugagggcuguccaaguugccuccugguguugcuucugucaaagggugguugguugagucugacaggucgcugcucuuggggauacaacuuggaugcagaaguggaguucacacagugcuuuuuaguugaggccuguagucugagcagauacgauugagcacucaggagcuucggguagggcgaguugggucaggagggcaaguaggcaacauugauauuaaagugguggcaagggaagacacggaggagugugggaggagggcaaggcugcucugcgaggggucguaccugcuacuaacaggagauugcugggcagagaguggcugguguggugccugcugcacccucacgccggugaucaug

SEQ ID NO: 142 - RNA, 740 nt, Mus musculus
aggacuuuccggcggugucggcccuauuucccgugcugcacugcgggccuuucucuuucucuuccggucuccggugcugcgggagccgcggguuaccgugcagacauggccaaguccaagaaccacaccacacacaaccagucccgcaaauggcacagaaauggcaucaagaaaccacggucgcaaagauacgaaucucuuaaggggguugaccccaaguuccugaggaacaugcgcuuugccaagaagcacaacaagaaaggccugaagaagaugcaggccaacaaugcaaaggcagugagugcgcgcgcagaggccaucaaggcccuggugaagccucaggccaucaagcccaagaugccaaaaggccccaaacucaagcggcuggcuuucaucgcucacccuaagcuugggaagcggauucgaagcuacauggccaagggucagaggcucugccaaccgaagccuaagguccaaaccaaggcaggggccaaagcuccagcuaaggcccaggcuucagcuccagcccaggcucccaaaggugcucaggcccccaaaggugcccaggccccugugaaggccccauagaaaugacuccugccagugugaagacagacggacugcugugacacaccuccccacacgcuauuugcagaugaccaguguccuaugcuguucuuacaaauaaacucaggcaagaucuguuaaaaaaaaaaaaaaaaagaagagaggcagaugug

SEQ ID NO: 143 - RNA, 2659 nt, Mus musculus
gggguugggaggcccucauuuuccagaggacagccgaggagaaagaggagugaaggcuuuguaccagguacauauaaugaugccagcuuuggccaccucaaaagaugagccacuuaguggaaagccacaaccuggggguggccuccuaaaggggauauacaauacauaucaaguauuuuacucgguuuggccaaaccaauuuugguuuuuagaacuuagauauaguaaggguauuaaaaaaccucucccucccuccccccccagcuucuucuuccucuuuccugcucucccucucucccuuccucccucucccucccccucucuguguuuauguguggcugugagagagagagagagacuguguguuugugugugucugagaguguguguguauguguuugugaguauguguucugagaaugugaguaugcauguguaaaauuuguaugugucugugaguguguaugucuaauagugugagugugaauguguaaguuguaugcguguaugcuugugaguguguguguguguguguguguaugcacaugcgcucagagucaggcaugcuaacugccagaguaaugcauguaucuucuacuguaauguccaccaugcugauuugguggcugccacacauacugacuauauauguugguuagcaaagaaaggaugcuugucagagauggcucuggacccaauggaaacagaaccagugacuaaacucccaagaauggaguuugggcuuugaagccaccagcagucauagggggccaugagcagcaagggcccuagccugccaugaaccugaaagaggugcugaccuaggcuuuaauaccgccccccuccucccugcacacacaucuauuagucacuggauggagaauacccucuggaagaacuauggacuugaacaaggggacugucuucagcaaaaauagcuccacagagcugauggccaaggaugaucucuggcagcugagagaacaagccuugauuccuuaacgaaaccauggccucauuacagaggauaagugacugaggaucgaacagugagaaaucauguguauguuuaggguggggagggguuaaucuguuuucuguuucuauagugaaauaccuguguucauuuaaaaaaaaguuuaauuaccucauacuacugaagcuagaaaucuaagagcagucagcuccaucuacucagcuucuaguugccuccaaccuacaucugugucacaacaugaggaguggcacaaugguggaggucuguguaggaaagagggaccaucugaugaaacuggaagccagagacagagagggaccuuucuugaagcaccccucucuuauagggacuaaccaaugauccauaaaacuacauguaucccuucugaggguacugugccagagagagacaugucagucuuccacaaggucuagaucucaacucuuagugcugcuauucuggguaccagguuccagcccugacccuuuggggaguacacuauaggauaaggauuaggaaagggaagaaguagauauuuauauuaugcaguaugauuguagggugaacaagguccuuuuaacaucucaagucuucaauuuuuuuuauuuguaauauuaucuuuauauauuuuuaguuaauaugaagaucagauauacauagauaccauugauaaaaugcaugaaauuauauuuuuguaugguucucaaucaagaagccuuucugaaaaguguucagcucuggagccuaguaguugaugguugucaaacucaaaaucuggcaaccuccugaauaagaucuaacagaacuccugagccaccucuagaacaucuggagcugcaggguuuggguuguaaguggagaaucugcauuuucaucaaguuuccagguaacacugaugcugcaagucuauggaucacacuacucgaaguacagggcaccaccacuuauuuucaugacugcugauauagaaaacuuuuuguguucauugacugggcaagccacugggugcucagauauuugaguuaucuuauucuugguguguugugggggauauuuugggauuuauuagacaaguuagguaaagcagauacccucagcauaggugggcuucuccuacauugugggagaucuguauggaucaaaagucgauacauagagagcccagugucucaauggcugucuucuccugccuuuggacuaagaccaggacugaaacuagcucauuaguucuucugggugucugguuugcugccuguggaucuugagaauuuucaguguccaaauuagauuaucuaguuucuuuuuauuaaucaaauaaucaauuaauuuguugggagccgcgcccacauucgccguuacaagauggcgcugacagcuguguucuaagugguaaacaaauaaucugcgcaugugccgagggugguucuccacuccaugugcucugccuuccccgugacgucaacucggccgaugggcugcagccaaucagggagugacacguccuaggcgaaggauaauucuccuuaauagggacgggguuucguuuucucucucucuugcuucuuacacucuugcuccugaagauguaagcaauaaaguuuugccgcagaagauuuugguuugcuguguucuuccuggccgggcgugagaacgcguuuaauu

SEQ ID NO: 144 - RNA, 12027 nt, Mus musculus
cucuuuuuuuaaaugcuuuuauuucuauuuuuaagugagacauaucguuaagcacaugcaugaaaugcaaaaagcacuuauauucuuuccuuuagccugauggucacgugguauagguagagaaggccuacugaagcaggcacaagcucugugggcaccucaggaagcuuaauagucauuauaguugacacuggcuccaugccugaagcuuucccggcuguggggaccaauggccgcaucuucaucauaaugacgcugguaguagucaccauaguagucauggccguuucgauuucuguuuagccaauaguugacaucaucuucaaauuucuguagaaaaagagaauguuaaaggaugguuuugaagacacauaauccucaaaaacacacagaaacuguggcuuuucucagugauugagaaucaacaucauagcaggacagcugcucguuacaauguuuucuucacaggucaauccaggaucuuaggauaccaguauguccacuaaagaaaucugugccugugcuuuugauaauuuccaccgugccacgguaucuucuauaccugagccuuuuuucuccuuacaagguaaauaaagugugcaucugcccaaugcaguaacagccuggcuggcucucacuaucauccacauugcuaugguagaugccuccuuaucccgcgcuugaccugccaaaggaauuaaguuaaccacuggcaccuucagcucuggggcaguacgucugggccaccucaugcauguucuuggucugagugugcacaggcacaggauugugaagugggcugugggugucaggccccaugaagacacuggaagaugcucaaagcaagcgagagaguccuggcuuacaagaagccugcagucuauuggagauaauuaugaaaggagagagcuacuguuaauaaaacuuaaaaggcaaagaaaaggaccagugguuuguaugaccaccuccagcaacugcuuuuugcuauaaauugccuuuucaagagggagaagaaugcuucugaagggauggugaaaauccaagauggauggugaugacaacuuucacuuauugaucuaguucgaggaugaggcauugagaugaccaagacagacuggauggggaaaggcuugugcaguuaggacugcaggcaauggcugugagacccugccccugaauaccacugcuacugguacaugcagauucccuagcgccauacuaggcucuuacacugaauuuucuagugguugggucucaggaauacauuuucauuuuaguggaguggcuaggaauacuaaauacaguucaauuccgacuuggacauuuuaucuuuguguuaagaaaauguaaagcagugugcauucacugggaaccacucuggauucuggaguuggauuuuuccccaggugagugcugugugggaugagacucuccgggaaagcugcgagagucagggcucccaguugucccuugaccaugugucugacauaagggguggugagauaggugugcuggaggcaguuuaaacuguagugauuccaacuuaccauagacagaggagaaucuauccugaagaccccgagacugaaaacccuaugcuggggccaggaaauggggcucuggagccuacuuuggcuuagugguagguccccuccuguguaccccucacccugggccuuugacucugauaccucauuuguuugcugcucaagaccaucauugucagagccucccacaaccugugugccaaggaggaagacacacauuuuuaccucccugugccuuuagccuuagacuuuuuucacagcaccacauuuuggggucagaguaaaaugaucuuacugccuauuuucuuauuagguuugagauuucaggaucaaauguguauucuagauacacuuuaagaucuuuuaugaauauauaagacaaguucaaguuugaauauggacaggagcaaaggugaagagggauggugcuauuccagugaaaagaacaccacucauggcaucugagcauagcuucuuguggucuuuuaauguaaacuuaacucauuauaguguucucaguccuugucuuuuuaagauuuuuguuaccagacauuauguuuuagccauuuacccauauuaaaaguuuaauagcuauuaaaugguggucaucacagagauacaaacuaccaaaagaugauauaacauucucaucuaccaaauaaauauaugugcuuaaauauuccaaagacaagaugcugaagacucuagaacauggguguccuucugaaggacacuggagauguguaacuugacugugguaaggacccuucaucugagcccaccuguuucccaguaaccccaccagggagaacauggaccuaagaaaggaacaauugacgcagugauguccuuugaguugugaaaaaugcuuaauaaagucauuuuuaaguacuucaaaucacuccugacauagagucuagcuuaaguauguagcuacuugcacagcaaaagaagagcuacuugaguagggaagggacuggcauguguagaagcuagggaugggaaggcaggggauggugcagucacaugguuugaucuaaugagagggggccuuucuacccugcauaguacgucaaacacccucugugagucucauguucaugaacaugcaaacauguucagcugcccgcugcagaugcucccugcagccugaaggcaggcuuugaggucuacccuggacuccucagccacucuguggauggucucuggugaguggcaucuagagugccuguccugcucccuucuugccugucccuguagcccagacaaugacgugaccugaaauagucucauaagauaguuaacuugcugauuuugcucacuggggcuuccuggcccauaugaacugcaaagcagcuuuacucgugagugcaccgaugcaauuuccccuaaacaucugcaagaaccaccucuccuuuauggucuucgugaguccauauacccaccuuguuguuucagccgauucugggcaaagaugguaauauuuagcgaguuguuuugaggaugcccaguugaaacugaacagcagggcugaaggcauuucuaggaaaauaagauucuucgggaagcuagaugcagccuuuuggcucacagauucccugggucccuccucuccaccuggauggcuagcaugcagugaagagugggcccacacauuuggaauaaaaagcccuguggcuuggcuaugguuugugugcuucuagaagcuagaagcuugguccccaguauggcauugcuggagagccuuuaagaagugaggcccuggugcaaaguaguuaggucaugaaggcuuuaccuacugaaaggacugaugcugugguguuucacagugggugaguucuuguaaggacuggcgguugugaaggucagugggugugcugauacacacccauaaugucagcacuaggaaguucaaggucuucccugacuguauacaaguuugaggccaggcuaggcuacaugagauccugucucaauaaacaagcagauaauaaaaaaaauuauaugaaaaauaaauauuaauauaacaaguuuagacuugcuucuugcuuuuuaugucacaguuucuuaacacuugcuccugcuauuaugacaccguguaccaagauguucuuacuagagccagauugugacuucagaccuccagaaccacaagcuaaacaugaacucugauauuuugacagagcgacagagaacacacuacuaagaagcaaagucuaccaucucaggcccucucccucaggccgguccucugucccacacagccugcccuauaguguccaaggcucucccucagaaaaguauacucacagccucaucaaagcccauguagaggaacugcugguaccacugcuguaccucaggccgcguacggucccacagcugucguuuggcacgcuucaggccaccuaggaauuccuuugcuguguucucggcuacagcuacauuagucuuugacgggacagguccugaaaagguucguuccaaaaagacaaagaaugaauuauuuuuugaaaacaauauucucuuuacuauugaaagaaauuuuuccuucuauguuuuacaagguuuguauuuuauguguauggguguuuugucuacauguaugucugugcaccauguacauacaguaccaacaaaggccagaagagggcaucauccccuaaccagaguuauacacaauugggaaauaccacguggaugcugggaauaaaauccuaaacuuaaaaaacagcagccagugcucuuaacuacuacugagcauuucucuagccccaggcuauuacuagaauuuuaaugugguuuaacuacgcuguguuuugaauuaacacauagaaauuguaaauauguaugcuauauauacacgcaaggaucaaaguggguucauuggcauuucccuccguugaaaugcuuaucacuucauguuaggaagcuuuaaacucuuuucuaguugcucauaaaaugugcaguggguuguucugagcuguagccgcccugcagugaugcagcacauuguguaacguacuccccuguaccugcuugucauccaaccuccccaccucacucccucuucaggcgccacuacaagcuaggggggaggaggguaaaugguugauuaucacaucagaaauggggcucacauuuucuaaucucuucaacagcuaauuuuauagagggagauggagagaagagaaaggauguucacuagacagcacaaugguuccauuugaccuaacugauaacagugaccaacagcccacauuuugacuucuagaauauuuuacuucuaugucuccuuguugcuaucauauaacucagaaacugccuuuucguuuuuguuuuuuguuuuguuuuguuuuucaguagaaauuaguaauagaaagguuuccccaugggaaugccuuuuccuaauugcugacuggauaggcagagcuucaacagugccauucuauacccaccccaccagguaggguuagggcccucagacccuuuagauguguuucaccaguauaaaauaaucaaaauucaauuaacacuguuucugcauuuacacugacagcuuuuguuguuguuguuuuuuggugggggaaggcaaauguuuacuaguaauaauacuuaccuagcagaaugccacaccacauacccacagaacaagcccuccaggucugcaagccuuucucauauuccuaauacaagcccuccaugaacacagucaucauugcuguucugccgcuugcaguuaccagugaacacauccuuacccgcuugaggcagaccuaccuucucguuucuggagcaucuucuugaguuuguuuccacuuaugccaucuacagaaacagaaacagaaacagaaagcaguuucagaguccguaauuccugcgauuuuugcaccuuauggaaugcaaaagucagaguuguaaauaagagcugcugaucccuguccugauuuaacagcuccguaguaaaguauuuaauggguuuggggauacuugccauacaagaaaaacagugcaugguaucgagggcuaauacugauaacagagacgaauagaugacaagggcauuacugauugagcuuuucucacuaaaacagugguuuuaguccuaaugucuuccugcuuaucacaugcagcuuccagcaaacauuaucuucaggguguaauagauccuauagugcccuccucccaaauucauaauccuccaggaauaaccagcugggaauuucagagguaacauuuuuuuuaaggauauuaagaugguucucauuggacucagggugggcucuaugcccauggugcagacccauacaggcuaggcagccccaugagaaagagccaggcagaggugagccuucuagggcaagccugggaauuuggcucuuuaaaaucgcuguacaguuuugcaacuuucucuaaaugucuuucauuuaagcuuuauuugggggggggcauuagcuguuaaauauguuuaguuuuuaaagaguuuaacuaaucagcuugauaauuugauaggaaauagugugucuagccugaaagaguacaccaucuauucggccaacugguaccuaagaguuguacacaggcuaguuggucucaugaaggguagacacaaagccccuggagagaaaacacuaaguaaaaaacagagcguuuaaaggggucugggacugccaugagaagcuaggauagagaaggccacagugagguaguagugcugucuucuccucaggauuauuauccucucagucuauccaggguuucugagaaaaggacaaaucugugcuuacaucugcaaaagggguccaaaugcaauuaagaacuugcuuugaguauacacucacaaguggaauaacugggucacauaacaauuccauuucuagugcucugagaaacguccgcacugauuuuccauagcggcuauugcccguuuacucagcagcagugaauaaagguuccuguuuccuuacauccuguccagcacaugcuuucauuuguucucuucaugauagccauuuugacuggggcaagauggaaucaccucuguuuuaauugguaguucccuggugcccaaggauguugaacacuuugaaaaugcaccaagacacuugaacccucauguuuauugguacaugagucacgauagcuaggaaauggaaccaguguguguguguguguguguguguguguguguguguguguccacucacagauaaauggagguagagaaacugguacagagacacaaccauaaagaaaaacuaaaucauguuauggucagaaaaauggauaaaacucgacaucauuauguuaagugagauaagccagauugaguguucugguaugauuucuuuugcuaugauaaaacauguccaaaagaaacuuaggagagggaaggguuuguuuggcuuacacuucaaguuucgguucaucacuaagggaagucagcguagacacucaagagccuuaaacaaggaacaguggaggaacacccuuugcugccucacucccuggccaucucccucaggcccgugcucagcuaguucccuuauacagcccagaaucacuuucccaggaaaugucacugcucacaguggucuugcccuccucuauggauuaacaaucaagacaauauguaaaagacgugacuacagagcaagggcaguuacucaacugagacuuucuuuuuugcuguuguuguuuuuuguuuuguuuuuuuugugagucuaggcugugccaugcugacaauuaaaaaaaaaaaggacaaauaacauacuuuuucucaugcugaacccagauuuuaauuuauaugugagugcuuuuauauguauguauacagaguggauauaguucauaaaacuagaaaggggggaccaugagagauaaaggagaaaaauuuuaaaagguuggaggguaauuuauuugaauuacuuuucuauugcugugacaaaggaccaugaccauggcaaucuaaaggagaaaucauuuagugggagcuuacaguuccagaggauaaguccauaacuaucaugggggacagcauggcagcaggcaggcauggugcuggaauaguaguugagcacuuaccccuaauccaugagcaggagguagagagauaaagauagcuaacugguaauagcaugggcuuuugaaaccuugaagcccacccuuggugauauaccuccuccaacaaggccacaccccacaauccuucccaaacaguuccaccaacuggagaccaaacauucaacuauaugagccuaugggggccauuuucauucaaaccaccauaguaauaaagauguaucuugggauaagaaaauaggaaggggcugucuacagagagcaaugaugaaaggcucgccaggaagauauggaguggggguaagaaaagaggagaggaagagggccaaaguacuuaaugaauggacaaaaugagacguauuacuccguauaauaauuuuaaaauuaaaaaagaaaaugaagaauauccauuugggguucuggguuuaguucagugaacacccacuuagcaugaugagccgugggauuaauccucagcacuucaaaucaacuaaaaaaccuguacucugguugucaacaauacauaaggcugaaaaaacaucuuuuuaguaagaacucuugcauaaaugauuugccauguuguugaggagaaaaaauagccaauauucaaagccaagagucagcaccugguuguuuuacugugugugugugcccguguauauuuguguguguguguuagugcacuuaaugcucaccauguuucuagauccacaucacucuuauuaugucaauccauacagagccucaucacucagccucaucacugcagcaugccagcaugccaguauagcaguaccaucuagagagccuggccuaugcucuuggauagaguagggaaauccuagagcuuguccaagugccucccuggugaucuuaugggugugguggcaacacuuucugggcuuuccuaggagagucuugauuuacagcaccuccucucauucucagaaguguucuagccugaacgauaauaucugggcauccuaauguuagagaauggauagcauagaaauauccugagaagagucuguaagagccaugcuaaggaaugagugauagcaguuauuguccugacaucuugcucagaggaaccggcaugagcuaggcagggagcuaaggaguuaguguagcaggcaucagaguauggagguuucuguagucuguaugcaggcuaccuauggugauguggcuguuuuaaaauaacaucagaguucaguguagucagcuaucaagaauugacugucccgagaggcccauuggacuugcaaacuuuauaugcccccaguacaggggaacaccagggccaaaaaggggaagugggugggcaggggaguggggguggguggauaugggggacuuuugguauagcauuggaaauguaaaugagcuaaauaccuaauaaaaaauggaaaaaaaaagaauugacugucucuucucugcuuugucaucauccugaucaggccacaucucugcaguucaagguaacaggaaaccuggagaaaggaaacgcccuaccucccacuaugguuuuagaugaucucagcugcuccugcagccauaccuucaauccaucaccgugggcucuaacucucuggaacuguaaacucuaaaugucuuauuuuauaaguugucuuggccauaguauuuuaucucagcaauagaaaaguaacuaguaaguuaguaauauuuccaguuccugggccaccacauaaagauggagcaagugccucuaggagauuccugauuaagaauuaaugcaugugagcauaaaucaacacaguugagaacuggccaagcuacuggaaaaugauuaucuagccaguaaaguggggcugcuguugagugccauacuucccuccaaaucuuaaaacucaaugaagaaaucuaugaaaauauuugccaaagcugacagauacauucucagcucuaauauuaacaugcaugaauaucuuaacauuugucagucuuuaacaagccaugggacagcacacacagaauuaagcacugcccuccaucuguuugccuucuguagaugugcuuaacgguuaaugaaugaaauguggucugaugcugaaagagacaugagauucaggcuauuccugcaagccugaaauuucuugcaaaugugagucaugaguacuucaggaaugaaagcuccaccacagcaaaucuuagcugugcaacugaaaggcuugcagaggcuccaagccaugaauuaugaaugcugcugcuaugccaacccuguacauucagcuguauauuaguacauacaauuggacaucacacuaaaucugcuuggggaaaggaggaaagaacaaaagaagaacuguagcccccuuacuccaacauccccagcuguccuguccaggcugugaugaaaagcagucacauauguagcaaaucugguuaccuggaauuagaauacacaggggacuggacacauucagagucucaagaugucucacucugaagaugaaaacccacaacaggcaaaucaagagggagcugugauccuucucuucaugaaaugugcuuggaugccaugaagagucauguuuggggcauggagaccacgguggcucuucugcuaagagcauugggugcuccuccaggggacccugguuugauuuccacaucuaccuucugucacuucaguaccggagugacagcaccuucuucuggccucugcagguacuacaugcaugaaguacacagacacacguguaggccaaacaccaauacacauaaaauaaaagggggcgaggaaaaggucaucuuugagacucaaugcauuuuuaucuuucaugauaaaguucacauuucaguucagugaugcugauacugugacggauuccacucccucacuucuuggcauuaacucguaaaauaugaguguugaaaaugaauggccuaacgccauguucacgaagcuagcucacaagaggguacugaugucauuugcaccagucacccuuccaauaagaacaaccuccccuuuauuuucauggucucucaugcugugacccugccuccccucauucuggaguuagguuuaccaugccugcucugagaaagcaaaaaugaaacacagagaaacugagugcgucuucuauuuacaucuggcaauggccaccccuucgcacugggacaaacaccagucucaggugauagguaaauaguuuggugucuuccagcuacuguucucuuggcaguaaaccuagggucacccuacugccucccagaguuauaaaccucaaaggcguuccuaugcacaggaacucacuugugaccucuaaagggucacacaaaagaagaacuuuccagguucagaagguagagucuguggagcucuggguauaguauuuacgguguacugcuuaagugcuuuuaauguagagagaccuggggauuuucaguuaauucagcuaaauauaguagauauauauuugcuaauauguagauauauuuaauguuuaaauauaauagcuaguagaaauacaauagcuaauaauuccgcugaauauaauagaaaaaguuaaacauugcucagcuuugcagccugaacgcucuuagucagcucuguugccccaaacugccuggaagaaauuggaagaauuuggaagaaauuuggaagaaauuggaagaauuggagaaagacagcaguguguccugccucagaaugauacucccuucaagccuccaccaucccugauuuagcacuucuugugguucuuucagauccuuacuucauuugcccaagguugccccucagucuacuaugcucucuuugaaucugagucccucacugccugcccaagugcacucauugggacuuacaugaguguaaaauacuagacccgguuccauugucuucuugguuuaguacagguuaagagcaggaucauauucaggcaugaagcaccccauuuccaaucuccuuccccagcacccucagcacucuccgccagguauccuccacuuaccuggacccaggcacagcagaaggagcagagccagcccggcaagggccaggacugcaggccgcgcagacgaggugcucauggcgacagagugcugcaaaguagcuggagggaugacuggaguggagacccaggcucagugaggcaggcgaaagcuccaguauccuugcucugggcgggacccacagggugggcaacuagccagcaggccaggccgagagccaagcuucaguucaaugccaccgaggcacacugcccugcgggucugcugcaaaucgcugagaagggccgcguggccaaaggggagagggcaagacugaugccaggcacagcccaaccagccuggacagagaauguuggcucacuccucuuuuccgcacgccccccugagccguuccucugcagcacaacccuccccu

SEQ ID NO: 145 - RNA, 1761 nt, Mus musculus
aguucuuuuuuuuuaauaguuaagagacuuuauucuaacagcuauaauuacagugcuuguagaaaugaaaacugaaaacaaguauacaaaacaguugauuacuaauuguguauugaaagcgguaagagguuccacgacaccaaauaaaccaguucugagauuuccccaagauaaauuuaacagcuccagcuucuucaguguuuaucaaaaugcaaaagaaaaaaguagaggucgucuuucgauggcaaaucggacccuugcaggcugagggaggaagcuacuucacacauggagaugggggugcuccaggaugugggucuguaaugggccgacccucccaccuugcacgcacuccugcuggugagacccaggccuccugccagcgcguccaagugggcccaagaguaggcuggguaugcaggcugccacugggccuugcacacaccaaguacaagccaggcccugcaccccacaauggcucccagccuacccuacguaaucgugugagcacaaguacaagcacaaugcuauggaaugcaggugacccaaagacaugcgagucacgggggcucuacugugaccaugcggcggaugaugguuuguuugucaccuucucuccuguucccacagcgagacaggugaucugauaacuagcauucaggccauuaacugcaaaaccuacacuaggcauagucuccguucuguguguucaaguguucuuguccugaauuuuuaacuauuuuuuuaaaaaaaugcacugaguuuggguuaaaaaccaaccaccaaauggauaccgacaccaguuuacagcccaauggcucccggaggccaggugccccuacacccaaaucccuucucaguacugacagugaguugauucucuuuuuacaauaaaaaagcuaaguaauauugcauaggaguaccagaaacugccucaguggaaacagaaacuauuuacauuaaauaaaaaccuggcugcaggcugcgucugcacauguacagcacggugcgaugcacaaugugaccaacccauggagacagcuucuggcacuuaggaccacagaguugcacguuugccacaugagaggaaagcugagggcagagaagaggaagugagggggauggagggggucugguucacuucugguuccggagcugauuagacagccaaucuaguccuucauagagccuguccccgcugguggcacagguggccugaauguaccaguuccuguggcguagagagugcagccccagcuugugaccgcugugauuuuggccgcuuucacggcauuggggagguucugcuugcuggcaaacaccaagagaacagcaucucggagcucaucuucagcuagcauccucaugagcucuucacaggccucguucacacgcucucugucauugcuguccacuacgaagaucaagccuuggguguucuggaaguaguggcgccacagcggcgggaucuuguccuggccgcccacaucccacacagugaagcugauauucuuguauucuuguauugaaaccaauagugggaaugguggucacaauuucgcgcagcuucaguuuguauagaauuguugucuucccugcagcauccaggcccaccauaagaaugugcauuucuuuuuugccaaaaaggcccuugaagagguuugcaaagauauuccccauguuuguggacagguggaaucgauauuggccaaagaccuccguggcggcugcucccagccaggcauugguuucgcucuccau

SEQ ID NO: 146 - RNA, 69605 nt, Mus musculus
cagaaaggccgggccgcuaaaucugagacuuccgcgcucgacuuuacaggcuuccgguccgcagcggguuaagccaaccucggcggcgucgcgaggaucccacgccucaggcagacagcccguuccucucgcugcuucucacggagagugacagcucggaaggcaagaaccucccuccagugcguugucauccgcagcagcgcacacuccguuccagcucugcagccuggguaacauucccucgucgugacucguagcggcgccguuagcuuacguugaagcguaugauuggcuagacaccucugaccgcacacgauuggguacugguggccaggcuccgccccuuccccaccuccgucccgcgguagccggguguccucgcgccgcucguccgcgcgcugccuggcaguuugccucuuccucgucuguccuccagcuugcguccauggccaccgccgcgaccgaggagcccuuuccuuuccacggucuucuaccaaagaaggagaccggggccuccuccuuccugugccgcuacccggaguaugacgggcgcggggugcucaucgccguccuggacacaggggucgaucccggggccccgggcaugcaggugaggcggcgcccaagggcccguagcccagagggccgagccuggaacaaggcggggaccggacgggccggggcggcccggacagcucugggagaccuccaggcccuguucccuguccacacaaaagcgguguggucagcguggcuguucgggaucgggggccgcggggaagcuuugcuggucagccugggcguuccaggccccacaccucuucaggguccgcacccgaccucggcaugggaaaauuuuacaguuuuauaggucugggagggcgcgggagcguggggggcaccaacgauagggguaacagccuugaagagauccuuagugauguuuaagagauacucguuuuggcaaggccagcaaagugaguucccagaauucgacccaguccgcuuccggaaugguuucuucugauacuuuuguucuauuuuuaaguuauuugcugguguuuguucaggguccuugaaaucuuuuggguuagucuuuuuuuuuuuuuuuuuuucaaagggcccgacuaauuuguuucgggcgaacuuuucaggccuuauaaaaugugcauuuuaaacgagagaacauacuuugauuacgacuuccuaaaaaugacuucauuuccuuuauucaaguuagaagucuuuaagagcagggaccuuacugauguuaaaaaaaaaugccugaauaaaauguauucuguguuuaaauagccucuuacuaaaacccccucauaaguacucucuaaccuuuguugaagagcuuaucugacuaaaacuagaguuuauuuacccucuuuucgguccguggucaguuuaucaaauagauagauuagaucacauugauaccaucuuauccuuguuccucacaaaagagggauacuaauuccucuccuccuagcccuugauuuguuuccuccaaucuuuaguuuucucauugugcugccuaauaauugacauaaauggaugggaagguaauugacguacauguuagagguuauuggaaaggauaggaaagaagccuguguggacacucugggacucucagggaauccugcuuccaaguguuuguuacuucuuccccuuucuggugcacaccugagcccugaagcacacagugucagagucucugauuagaaguucaagugacuacaguuauuuuauuaauaguaauugcuaagguuuaaaacuugguaacagcaaugacacguugugaauuuauuacacaguggaagugcuucccaauacacaggaguguguguuuacuuuuuguagggugugggagaacaacuaggguaaguggcucacuaguucuuagcguuagagguucagaaaauccugaagauuuuggcguaguacuacucaguggacauuuguagaauuuuugguucugguuagaguauuuuguuucuguaaaguaacaguuuuuaccccauaggauuacuugauaauugagcagccaacacacaugauuuuacagugcuaaaguguuaaguacuuuuuuuuuuuuuuaaaguccugaauaaacacuaaaugcuagcagaaggaguucauguugggucauugucugaagggaaaauaugcuugauauuuacacaaacauuaacauuuagucaauaaaacauugaaccaaaagaaaacauaagaucauccagcauuuauucucagauucuaaacaugaucuuuuguuuaaauucagcaaggaacuuacaugggugacuuugauuuuuuuuuuuuuuucuuaccugaggaaauuauuuuguagcucuguguguacaucauuaagguaaaaagcaaauagaaauaaaaagagaaggaggccuuucuggcuauuugaguugucaaaugggaucuaaguaaaggacuagagguuacaaaugagaacuuggagaaaccagccagugucuccuccuuuaacuuccuuagaccaaguccuuuuuugucacagcuucuggguguaugcaaaguagagggcagagucaggugugauagcacacuccuguauacagacugcaugaggagauuaauaauuaccuaaauguuuaauauucucucagcaaccauucaaguaccuaguauguggcuacaauuccauugaauaaugaaguccugcaaacuaugacuguuauagagaugcagugaaaaugacaggaaaacugacugagaucgugagugaguuuccugacaagaugaaauuugguuuaagccauauagauacagaagcagugcucacugcuacuaaucucaccacugauccaugguuugcuuuuccaaaccuacuauuuaucaagagcaaaccaaguaucaacaucuuugcucaaaguuugcuuuuuuaauaaaacucuaaaauuucaaauuuuauuauaaggcccuuccccuacuaacgcuaaccuuugaguguagccucagcaacacccuucacuccuauacuucacucuugaauauuugauuucucucuuucccagguacccagaugucucagguccuaauacguguguuugcaugugguguuuaaauugcccaacaguuuucuauagucacuugcaagcugcugcuucauucuuuuaagacaucacagauuuaauucagcccuuugccugcucuacuguuaaggucuguggcuucagagaaaauauuuccacuauuaccgauuguauuuccuacuuaucccaaagcucgacugcaaaauuuucaugugguuuuugccuuuacauucuuuucuaucccucaauuuuguggucucuuugaaaaaucuccaguggagcauauguauuuugcuugccgugugugugugugugugugugugugugugugugaagugcaggucacuucuuauaaguaaaacuuauggaaauaguacaugguaaauaaaccauuaaaucccgucuggcuuuuuuuucucuuacuguuuuugcucacauacugauaaugaggauuuauuuuacuaguuuaauaugauuuugauacuuacuuuuuuuccugauuugugguauugagccuucugguuaucaucagucuucuaguauaaauacuuaaaaaaaacuaaagaauuguuguucagaaaaagaauagcugaaccugucaggcccuuugaagcuucauacuaucaugcucucguuuuuuuguuuuuuuuggggggggugugugguuguuuuguuuuuuugguuuuucgagucaguguuucucuuuguagcccuggcuguccuggaacugacucuguagaccaggcugaccuugaacucagaaaucugccugccacugccuccugagugcugggacuaaaggcgugcgccacaaagcucucgguuuuucaaggugacaggacaaagaguuuggugugggauccaccagcuguaccuucuuugcccuaucaagaaaauaaauucuguccuccuauacgagccacuucuuccuugaguauauguuaaauacaaagcuuugcauaggcuauagagggaauacuuugugugggagaaaagguucauagugguaaaaaagacucaguagucauggccauuaacuaugauuuuaaagacuuacagauuuucuagguugaagaaaagucuaaagaguuugugguuguuaauuuuugauauuuuuugacauuugguauuuuuuucuuuuuucuuuuuuuuuuucagacuuuguguuuccauaccuuauuccagcuaguuuguguguguguguauguacaugcaaauacaguuuuuaacuaguaugugacuauauauauauauauauauauauguacaaaaugaugaguuuuucaugacaguuuuauauauguauaucccaaaagacuucaaguaauaaaugggaaaaaaguuagcucucaaaagaacaggacuuuugaguuggcucauugaauaaguaugguugcugucaauccugacagugaguugaaucuccaugacccacaugguagaaagagagaaccaauuccuacaaguugucaucugacuuauacucaaacucugugcuaugcuuguuuucacaccauacccauacauacaaaauaaaugugauuuuuuaaaauauuugacuauucaaaaaauaaugaaaaacuauucagcauccuuagccaucagagcaacaaaugcuguauugagacuuuagcuuaacuaacucagaauuucugucaucaagaaagcaauagaugcugaugaauugggacugcagagaagauauuuauauauuuuggguggaaauauauauuagaacagccacuguggaaauuaguauugaaguuccuuaaguauauauuguguuuuccuuaaguauauauugaaugcaacaacuugcuuuucaaaaacaagcccaaaagagcucaucaauugcucaaugcgaguacaccacuacaguuacccguagcaauaauauugugucuccaugaaaguuuauggcuaauaaagaaacagaccuuaccagaauuagagcuaauggcaaguaaucaaugcuggaucacucaguagucaacaaaagaaaagcacuguuguugaguguauguuggcaaguugaauugcauggagauaucaccugugcccuuagaacuuaaacucuaauagaagaaacugaugagagucccccuaagguguauucauuacaaguuggauuaugucuuaugaagugaaaaauguaugagaaucaaguuuaggauauauuaaauaaucauuggagaguuuuuuuucugaaagggugaucaacuuuuaauuugauauuuaugugcugaggaaugauggaaaauauuacaaauuuuguuuuuugggaauuggaccauuagguuucuauaagaguagaaaauuucaugcaguaaaaauauuacagucuguagacuacaguagggucaagucagccugagguguuucaaacaaguauucaaugaacuuugugguauaauggccugcacaguacagaguauguauguugacuguuuaaagccaagaccacaauguuuauacagugcagcuggcauuaagugcugccacaaacauagcggauucauuacacauguaguuuugaauuaaguuuuaguuguuguauauuagugaccguauacuguugccaggguuuuuuuugugacaccacaggagauuguuacaggacccucacaaagagugaguuucaacucaguuuaagaagcugauacaugcuuuacgaaaggaagaaaugcuauugguuuggcaaguuggcacaauggugauaaaaaguagaaaaauagauuuaaauuuuguuagaggaaguacuuccucuuagcugugaugcaagguguaagcuagauaaacagagaaacacuucuguuucugccuugaacaacugugucuaugaugauaccuaauaagagcauuugaagaaaaacaaauuugggagugugcuaccuuugaaguuggaacuuaguaaauuucaaguacuggugugacauucaguaaugaaauacuauuuucuuucuauucugaagcucacauuuuccagauauuugcucagaauucaccucagcaaggccuucuuugaccaaccaacuuaaaauagaaaaauccguaccacucuugucuucuuguuuaauuucucucaguauauuacaucuuuauauauuugucuacuuccucacucugcaauaucuaagggauuuuuguguacuaucagcugcuauauccaacaccuaaaagguuguaaauauuaaagaaauaaaugaaaccacuugaguuguauauuguuucuaugacuaauuuuuuucauuaguauuauacuucaauuaaaguuuuaauauaauuuuuuucagaggcaauuuuauuuauauauauguacauagggauuugcauugcauuucuguaaagacaauaacuaauauuuuauuugccucaauuuuuagguuacaacugauggaaaaccaaaaaucauugauaucauugauacaacaggaaguggugauguaaauacugcuacagaaguagaaccaaaagauggugaaauuauuggucuuucuggaagagugcuuaagguuggaacauuucucuucuuaccgaauguguuuuuuuguuuguuguuuucucucccucuuuuuguaauguugccucaaaacauguuuuuuuuuuuuaaaaaccuaagcaggauaguaguguuuaccuguuacuugcaagcgaauuauuuccaaaccccaugguuuaaaauaaggagguguuccauuacuguguucuaggagcuuaggugugaucuugauggauguauauaguugcggauuucuaaugaaguuguaaauuguugcccaaggcugugcuuuuauuuaaaggcuuaguuagcuuacgugcauugggaaguuaagcuguugcauggauguuuuguuuuguuuuguuuuguuuuuuugagacagggucucucuguaguccuugccauccugaaauucuagguagaccaggcuggccucagaccagaucugucugcuuuugccuuccaagugcugggauuaaagcugcaacacuacuaugucuuguuucuuugccacaugaccuucuccacauaguuguuuuguaguguagcuaccuucucucagggcaagaggugugagaaaguaaggugaaagucuuggucuuuuuauaagguuaacuuacaagugacaguccaucucuucuuguauucuacuuauugaaaauggccaguaaauaaucagacacauggaagagguaucucauagcugcaugcaugcaugcauauaguaagauguggaucaugagggccaucuuagaaguuauuuguucaagaaaguacuuauaguagggguuguuuucuuuaauugaguucaacaaaugguuuuaacuuuuaaauagaaaaacagaaaguaaccaccuauacaguuuugcuuucaucuuuuucucagugaccccgaccaugaagaaauauuuagacccuaaucugauuaauuuaaaugacuggcuuuguuuuaauuuuguccuugguauucaugaguuacugguuaauagauuuagagaaugacaauuaaaaaauagauuuaggagugauuuuuuaaaaaaucuuuuaaaacaagcagacuuaguuuuaaaugcguuaguuuauuuauucuaagacaguaaaucacauuucuagugagccuugcagauuuagaucuacauaauuauucuuaguugcuaauuuuuggauagcgguaaacacuuaaacuuuaaauaaaccauagaaacuguugucacuagugcucaaaagguagaaauuguagccgccugcggccacgugaacuagguuccccagaaaggcgggcuggagcugaaagagaucagacagcaaaaagaacggggccaagacaaaccuugcuguucaaagccucugaaguuuacugagagagucugugcuuauaaagaggguagguaggcccaucccgccagcccauucuuggugccuggagccagcccauucuuggugccuggagccagcccauaggcgaucuccagggagugucucaggaccgucccaaggaucuuucagcaggaagcagagucuuggagaagagcaaauaagagccaucaagaucagaaggcuuuacccuagguaaucuccuucuuaguggcagcaaggucaaagucuggaucagccugcuucaaggcugagggaggcuacaagaaauuauguguaauauaucauuccuuacuaaauaagauaaaucaauuaaggcugauaauuuugcuuuuuacccacaugcagucugauauucaguguguuucauugcuucauuugcucugcacauucuccaggaaguuggcaucuaaaccaccuucugagucuacauuggggugugucugcugaugauugguuaaguauagauagcuuguggaauggaaugguggaaacuaacugcauuucauacacuuuucugccagccuuucccuucuucauccauguauaaugcacuuacggauguuuuucaguagucaggaaggaauaauuauuagucacugguaccauagcuacuuggaucuccuaagcucuuuaggauaccuaaaagcucuuuaggauacugaaaguagcacaauaaguuucucugacuuagccauguguucuagugaaguaaauaacugucucuuuuucuccuucuuccaaauacccuuaaacaaccaacagaaccucaucuuguaguuuaagaccagguacaagguaaugcuugaacacauugguagccauugucuauagaugacaauccucuguacaauccuucuuacucucuucuuccagaucacaaccuuuuuuuuuuuuuuuuuuuuuuuuggguuuucgagacagggcuucucuguguagcccuggcugcccuggaacucuguagacuaggcuagccucgaacucagaaaucugccugccuccgccucccaagugcugggauuaaaggcaugcaccaccacgccccgcugaucacaaccuuuuuaaacuuacaugauaaucauuucuuuuucuuucauuguacauuuauauaaaauacauuauuaauuuaaccaaccuuucauuaaugucuucauuucuaugucaguucuuccuguuguugacguugucaagauuugagauucuuaagacuggccuuuauuauuguuguaacaauaguuuguucaguuucacuguugagcaguauguuaugguuucuauacagcauauucuauuugcuuugcuguauuaaacuguuucuuacaguuuggaacuguuagcuaacagguauuucaaaagcauuaggcacaguuccuguaccuuugugcagauguuuccaggacauauggcagaaauagaauugcugagucauggagauacagcuuuacuaggucauggcuaacagcuguaucguuuagcuggccuugaacucuucugauaguccugccuccaccuaccaaauuuggggauaacgaguauauucuaccaugccuugccuacuauuaacuucuaauacuuggaauuuucagaccuuuuuucaguuuuuuaaaauaggauggcaauauuaggauggcaauaucagugaaucauuuuguagguuuaauuugcauuuauauaaugaaaucagucauuuuuuuuccacagaguuaggcuuuuaggucaccucauagugcucuuaaaguucacuuaccuuuuucauuuuucuguuuuuuuguuuuuuaauacugcuaaguuggccuggcaugguggugcaugccuuuaaucccagcacuugggaggcagaggcaggcgaauuucugaguucgaggccagcuuggucuacagagugaguuccaggacagcccaggcuauagagagaaacccugucucaaaaaaaggcgaaagauuuauacgaucugaagagaaaccagagugagcagaagauggccuagucggccaucauuggaaagagaggcccuuggucgugcaaacuuuauaugccucucaguagaggggaacgccagggccaagaagugggagugggugggggaggguaugggggacuuuugggauagcauuugaaauguaaaugaagaaaauaccuauuuaaaaaaaaagagaagaaagucagaaaagcucaaaaaaagaauacugcuaaguuguucauugcuuugacuggugaguuuuuuuuuuuaauauauccauuuucuauuuuauacuugaaauuuucaauuuuuacauaccaauuuuacauauauauacauauuuaaucaaugaaaacucuuuuuaaauuaauuaaguuuguaacuguauuccuagaaaauugugguuuuucuuacuuguucuagagaauuugacuggaagugauuuuuaugcuuaguuugaaguugguguccuauuuuucccauaagaauagcccaugugccaacaucacauuaacauuccauuaguuccccaguaauacucuugucuuucuuuuuacauugcaaucuucaaaguguguuagcagguguguccaaccugaggcacacaggaggcauuucagccaagagagcuauuggugugaccccagagaaagauuuauguaagguauccagugagggcugggguaggguggguucuggguuguuaacuuuguauacaacaguguuguguaagcaauagcaaaagguugggcacaccuguaugaagugaaaacuuaagaacucuuuguaaagucaguuggauaguguuuuguuggggcaaacaugugaaggcaaguuucguugaaguggacauaggcgugaaagacugaggcagacucgugaaggaacauuucgaugaagcagacacaggagagaggauguucuauuaaagcaaacacaugaaggguucuuugcuaacaacaugcauguauugguccgucuuacacuucguaguugagcuccauuuaucuggaguccuuggaauggagcugauuggaugcacauacuaaggcaagacaggugcugagaacaugugaucuuuggaggauauaaauaggacuugauggaaugauggaaaggagcuuggcuugcugguacagcuagcuguucagugugggucucuggucuucucuggcacagccaagaacuucugguguucuuccuagucccuccugaucaccagagcugagaggcaaaggccuggcugacuuugcuaggucauguugcuaagcugacuguacccaaacuggacugcugcguauccaugaaguguuugugaguggauugagcugccgcugcuaacuuguaaagugaacugccgauuuccagacaacauagauggcaguugcuccaaagaaccuuucuaaacagguccacuuccccccacucccucccauccguucuuucccacuaccucugguggguggauacaagggagguuacagcauuuaagagcuaacauuaaaaguaagguuugaaaaaaauuaaaguuuaguucuuuuuguccuguaguuuuccaguaguuucucuacuccauucuaacauucgaagcauuuuggaagggagcaccaugcuguuuuuucacuuuaacacacuaaguuaaacauuuuuuaaaaucaucuauauuugguuucaaauauugacaaaucuuuuaaaaagcuaauguaggcauacagaauagugguacuagauauaguauagccagagcagauagaaucugaguauacaaggaugugcuugcuauuauaaagcuggaaagacugaaauaacauggucaugaugacacuugauucauugagaaaaucauccgauuuauuagggacaucucuuuaagaguuucagaaaugaacuguaauuuguaauuaaagagauuauguacuccagacauagggauuuugaguuccaggcaaaguggauuuacauauacaacaauauauuauuuuuaaaagaagagacagcaauggggaccuggggagauagcuaaguagauaaaauaucuauuaugugaguaugaaaacgugagugcagaucccagcaccuauguaaaauugaggugugguaacauauguuuauaaugucagcgcuugaagguagaauuaguaguagaauuaguaguagaauuaguaguagaauuaguagaaucccuggaucucaguggucagcuaaucuuugagcuucgguuuaggcagagacugucucaaaaaacaaaaugaagagcaauagaggaauucuccaucaaccuuuagcauccaugugcuccaugugugcaacacgggcauaacccccccacacacacacacauuacaaagagaagaaaaucauugugauuaugauauguaguuugauccuuuuuaaagauuucuuaaaauggugaaaacaugaacuuuugcuucuuaaagguaucacacauagcuucaaaaugugaacuaaauauaugaaauggcauuucauaauugccuaaguuuagauagcaugacuuuaauucucugagauuuuuuuguauaauuuuuaaaacuagucuaccuuuaaggaaaacguauagucauugucuuagccaggguuucuauuccugcacaaacaucaugaccaagaagcaaguugggguggaaaggguuuauugggcuuacacuuccauacugcuguucauuaccaaggaagucaggacuggaacucaagcaggucagggagcaggagcugaugcagaggccauggagggauguucuuuauuggccugcccuccccuggcuugcucagccugcucucuuauagaacccaagacuaccagcccagagauggucccacccacaagaggccuuucccccuugaucacuaauugagaaaaugccuuacaguuggaucucaucgaggcauuuccucaacugaagcuccuuucucugugauaacuccagcugugucgaguugacacaaaacuagccaguacagucauaaauuuuaagauguauaugaucccauggauccuguacauuuuuuuuuguuuuauuuauaguuaaauauaaaucaacaacugaauuauugucauugugucauauauaugcuagcuagugugauuaaacaugucuaauggcuugagaguuuuucuuuguuacauuucagggccuuuugaauauugugaaguuguuccuaggcagaggucacaaagguacauguacaauggcaauacuuuuuuguuaugucaagagcacugcaagacuaugaagaacauguuuucugaagaagauggaaggggucauuagacagccgauugauacagaaaguuuuaguuaaaacauaggccucuuaauaauuuucauacaucuaauugugugaaauuuucacccaaaaguuuucuaccugggaaauaauuccuauggaacaugggaguaagcugugauacuauacaagugagacaagugaggauucuuuuuaaauuauuuuucuuuuggguuuuuaaaaacagggucucugucuauguaucucuggcuauucuggaacucauguaaaccaggauggccucaaacucacagagauccaccuaccucugcuuucaaguguggaauuaaagguguaagccagccaggugugaguuauuaguagucaacuuuguauuuauauuuaguacauagauagcaguuuuuuuauacuuaggaugaauagaaauuuugaaauuuuaaaauaguuggugcucauugcucuuauucauauaagucauagaguuaugacuuuuuagcuucgcuguuugguagaagaucaacaugagugguaagagcuagacaaccagggugauguucucugagcagcuuaccugucuauugcgaaucccagauuucaugauaaauuaagcuuuaaauaacagaugaucuuaauccuggagagguagaauguaucaaccaacagagaacaugagaacagucgugaacauuugagucagucucaaagggaguuaacuaagaaacugugauguaucuuggcauuugaauuuucauaaugcuccauugugauuaaauaaccuugaagcugcugauagauagauuaguuguucccacugugauagauagguuguucucaguauaucagaaacuaacguucaagggcauuuucccaugcaugcacuaaugaagggccugcauccucaaaagacccuagcuucauuacuucacuuauuuucugguuuuguguuuccaugauuugggaagagaagaugaucucuuuaccccaugaauaugccacccaccucauaaauauucauagaaaugucuaaagcguauauguuagcccuacagugcugcuaacucacuuuuuaauguuuuuuauuuuuaaucauuuuauucauuuacauuuuaaaugauaucuccuuucccaguuaacucuccacaacucccccaucccacccccacccccacccccaccaccuuugccucugugagggagcuccuccacccacucacccacuccugccucacugcucuagcauccuccuacacugggacaucaaacaucccaaagaaccaacggccuccccucccauugauuccagauaaggccauccucugguauauaugugucuggagccaucggucccuccauguauacucuuuggggguuuagucucugggagcucggaguggucugguuaguugguauuguucuuucuacgggguugcaauccccuucagcuccuucagucccuccccuagcucuuccauuggggucaccaggcuugucugaugguugccugugaguaucugcaucuguauugguccugugcuggcagagccucucagggaacggccauaccaggcuccugucagcaagugcuucuuagcaucagugauagugucaugguuugccgccucacuuuugagucaccccagucuccccacuucuuuggagugcuuccuugcuuugcuguaucagcuuucuuuaaacugugucuugcaacugguauauuugcuuccaaaaacauuagagagaccacauacaugcccccugcccccaauaaauggucauuagguuuggauuauggaauaguuuucccuuguacaaagaaggaaaucauuguauccucccuucccacacuagugaaguuuagaacaauacccacauuuaucuaauuuuaaaucucauauccuuugaacuaaauuuuuugguuucuaugauggaacuagauuccaauuuuuaccuuccuguuguuuauauaagugguuuaauuucaucuuucuauuaaaaacuuuuuaaauacuaugagauaauuugagagaguguuauagaucuuauaugaaauuaacaugauuuuauagugcuuugucuacaagaauucaaagauccuuguuuuauaucugugcauuaucuauacggugcuguuauagaagaaugacacucuuacucuaaauaggaaaucagauugugaagaaaguccugaauauuguucuuccucccugcuacuuaauucacucaagugagguaaaaggagagaugagaugucagcaauguaaagaacuguuaaaugaucauggugguuuaauacauuuucaaaggauuuuauaaacuaugaaaccauagugauacuuuagugaccacuuagaauauuacaaguauuucucauaugcauaagccuguuuacccagugugagccaguagauagaugugaguuuguucucgcagugguguaucauuggcauuggaaaaugagugaacaauuuguuuuaccuacagauuccugcaaacuggacaaauccuuuaggaaaauaucauauuggcauuaaaaaugguuaugacuucuauccaaaggcucucaaggaaaggauacagguaaugacauucauuaucagcuugcaaauguauaugcuuagauuggauuccuacuugaagaaaaacgauacucucaugaggucuuaaagucuuugagggacuuggacuuugaaagacuguccaagaguauguuuuuucuuaaagugguucuuagucuucgguacauggacuaguuuguuuaaggaagguuaaaaccaaacuaagcuaaaguucaagcgcuugucuuuugaggcagggugugggugggcagaugauauaaacugagcuuuaggguuuuuuuuccaagaguuaauguauagaccucuauuuuguuuucuuauugucuagucuuuuuccucugagguugucaucauuuaguauuauucuguuaaucagaucuaaugcuauugaaguauguguauaagaaacaagucuggaacuggagagauaguguagcaguuuaaagaucuuauugccuuugcaucaaaccaugguuaaguucucaaugugcacauuagaugacucauaaccaccuguaacuccaguuccaggggaucuuaugcccucuucugguuucugugggcaucaccaugcauauagugcauaaaaaaauaacagacacacauacaugcacauagaugagauaaaaauguauaaagaagaaaguauguuuaggagucugcuguaaagagucuauucuauauaaaguggaacuuucuuugaugaugaagauuuuugaguuuuuuuuuuuaauuuuuguguuuuuuuagagagagaggagaagacaggagaggagugagagcaauuuuugaaguuuuaaauaucugcucuauuaagggaagugcuauggguuauuguauugcauagcaccauuucugaacacugugacacuaaucacugaugugaguucaguacuucaacaaugaaacaaaguaucguuuuugacaguaauccugauguguugauauugucaucuaaucacaguguauucuuccuuuuaauauccaugaaccaggacuuauuuuaaugcacuuagcuuugauugaauaugaaaacacagauguaaugacauuuuuaauuuaguguauuauacucaguuuugguaaagacaauaucaacaugugaauauagaucaaauaguugaaguagagucucccuagauaguccaguuuauuaguuuaaugaaaggauucuuuuaucuagcagacucuuuuuaggagauacuaugugaugaagaauggagauaagacaauuucagaagcuuggagcccuguccaaagaaagaggaugaagcauuauggacaggagaauugaggauaucuacccuuuccagugaagcuguagccugucuuuagucaucaccuuguauuuaccuauuugcauuuuccaauuuuguaugggcccaagaucauuauuuguacuuuaagugauagggaauucaguuuguuuccugauaggauacacugcauuuuggagaaguguggguauaaguugaggaauaacgauauaaaacuauuuugguaugacuugauuaaacuuguucucuuaaccaauuucauuuauugauccacuacuuuuaccuucacgagaaaugguuuuguaagccuuuguuuaauaacuuuguaguaucugaauugcuagcaaggcaaaagcauaaccauguagguuuaccugcuuauuuugccugccugauuguggggugauuuuuuuaucuuugcagaaagaacggaaggaaaaaaucugggauccaauucacagaguugcacuugcagaagcuuguagaaaacaagaagaauuugauauugccaacaauggcucuucccaaguuggugcuacucauuucuguuuacauguuucauagaauuagaaugcuaaaggguucaauagacugcauuuucauagggugcaucuguugacauuuuuuuccagugaguuaccaguucugacauuauuuauaccaggucaauuuacauauguauuuaugaauguuuuaaaacauggucaugaagacuuuccuaccagcucacauagaaauuccucuguaccucuucuuagccaccaucucaguuguccuugaaauaaccaugauuuuguuuucuaaugauauagaaugguuuuccucuuuaaaguuuguaaaaugaaaccauauaaaacuuuuaugcaguuucuuuugccaagaauguuagaauaucuucuguggcuuggguuuuaaaguuuauuuuacuucuauuuuuauaacuauaauacagcuugcucaucuugcacauagguacagguuuguuuguuugguugguuuuuuugacaguuauguauaauguuauuuuaggaguuaaagagauugcucggcaguuaagaacacuugcugcucuugaggauggcccaaaaauuaguguguagcucuaguuccagaagauccaauguauucuggccucuacaagcaccaucaggcaugcagguggugcacauauauacauaaaaaacauacacauaaaaucaaaaucuuuuaaaaaagagaaaaucauucuaaauauuguuggcuguagcuuuucauagaccauaaggauuaugccaguuuauauucccaccauaggcauauaaauguaccugcuaauguuuuuaaagauuuuguuuaucuuuguuuuauauguaugaguguuuguccacaccauguguucauggugcccucagagaccuagagaggguagugcaucaccuggaaauucaauuagauaguuaugaguuaccauguggaugcugggaaguaaaccuagaucuacuuuacaauacucccucaccccuauuaaguuuuaaaguagucaaguaguuuauagaugaaaagaguguucuucuagaugcuuuugguuuuaugcuuuuucuuuaaaaagaaaaaccaaggaauguuuaugcaucaacaguguuacaguuuagacuacaacauugaaagggcaaacaggcuucucaguguuuccaacuuccugggauuuuacucugagauucaggaacaauaaaucaguauuccaguuaaaacuauauuuuaaacaauucuagcaguugucguacuauaauuugaauagcuauaauucuucuguuuuuuuuuguuuuuuguuuuuuuuuuuuuugguuuuuugagacaggguuucucuguguagcccuggcuguccuggaacucacuuuguagaccaggcuggccucagaaacucauaaauccgccugccccugccucccaagugcugggauuaaaggcaugcaccaccauacccagcuauaauucuuauuuaaagaauaaaauacccuuacauuuaguaugacuuacaaagaacuagacccuauggaaaaagucaauaaaaacauuuaaauuucccgucuuucaguaagauaacagcuacucaugguaucaaagguagacagugcugauuuuaggggcuuaccuugcagugaaaauguauuaaaccuugagaaugaauucaagggacuuccaugaaaaauacuauauaugugaacucauuaauaguaaauauuuuguuguuauugugaaaauaauguacuaguugcagcaacuuuggacaauccaggcaugaaaauaaguaacaaaaaguuuuugaauuguucuuuuauuaugaauauacacuuuucuuaaucaaagguggaauuacggacuaaggauauaaguuagugguagagcacgucccuuauauauacaacacccuagauucagucuccaaacacugcagaaacauuuuguuuccuuauuauuuuuucaaagugaagucauuuuuuucuguuuguucaacacugucuuuugucauauguuaauacaacugucauguauacagaguuuuaucuaauguuaaucuguuuucugacuaauaggccaauaaacuaaucaaggaagaguugcaaagucaaguggaauuacuuaauucuuuugagaaaaaguauagugauccaggcccuguauaugacugcuugguguggcaugauggugagaccuggagguaaucucaaguauucugcagaucuucuuuauuaaaauguuuuaauuuacccugaagaacuuuaaacccucagagcuuuauauagucugguuuauauagucauaucacuuagcaacauuaugugaaggacauaccagcuuuuguuaguuguggacaagccuuuugaacuuaguauuuuucacaguaaacauuaugcuuaucuauuuuuuaaaaacuuacuucauuagccacauuuuggcagauugaucacugauaaauacagaaaugcuccuuguuaagaacuggacaauuuggagaguaaccacaaauauugcaggauuuuuacuaaaaacauguugaagguacaaaaaagaaaauuugggcuuagaaguuuuaaguagagauagaauagcuaaguuaacuuggcaaaauaaaacagugauuaaauauucacuucuggcucaggcaaaaugacucaugugugcagccuuacuacuugguaggcuaggcaggaggauuacacaagcugcuuacugagugucaguccauuuggggcugugcagcaaaacugucaguaaucacccaaacaugcacauacaaacguacgcaaggaggguuggucuuuacguaacaugcauuucaucugugaccuuuagaugcaguuaaacagucugauaauguguuuaaaauauguaucuuuuaauuuuuagcaguaauaaaauagguaaagagcagguagaaagaaaaacauaaaauuagguagaaauuguauuuuguuuaaaaaaauauguuuuccuaaagcucuaugugacuaaaguuuaaaguuuauagucauguggugucagaaagcuccaaaggcugcuggauucacuauggcagcaauaaaaauaguagcaggaaguaagauccuucauguggaaccauccuaaaacuagucuacacuccaagcuaagcuuuaguauauacuuuucacuugcccugaugguucucuguaucaucucugaccauccauguccuuguguguggguuagcauugacuucuggggaacuucugaccuaagccuaacugcuuacucugugaaacaaaggaauguagucauuggauuugaguggugggagaggaaagcaaugagaaggugacugagaaacuguauugugugaucuuuaaaaaggagugggaggauaaauuuuaaugccuauuucuccuucccaacagagccuguguugauucaaaugagaauggggacuugaguaaaugugccguauugagaaacuacaaagaggcccaagaguacaguucuuuuggcacagcugagaugcugaauuacucugugaacauuuaugacgaugggaaccugcucuccauugugaccagcggagguaucugucucaaauuuacuagugagauagucaugcaguagcugaaggauaaacuccugcagcacagaguaaggcucuaguuaauucauuagagacauuuuuauugacggaugaagccuagaaauuuugugacuuuuuuuaaauuauacacuguguagaaguaguccauaaauaaaaccaaaccuuaacaucugaaaauccaugaauaaauaugaaaugauuuuacucgcaaauauuaaccuuugagaaauucaacccuaacuguggauauuuaaauaaaaagacucucauuauaguauucuaugcaaguuuuuaaaaauugucuacuagcuauuuguacuacuagguaacuauccaagacagauucugcauacuuacauuaugauguaaaauauuacauaaucaaaaauaauauauacaaaaugcuaaauaaaugaguuuuagugagaauauauccaucauaaaaugcuuguauaaaguggaagagcaugcugaguaauauugugggcugcagauaggcuugggugcuuuuaugcugagacuguaaaaacaaguggaaaugccaugcugcuuuuagaauugggcaggugaggagaaaggagaauaaagucaguuaugacuguuaagaagaaagaccagagagaugggaguucaaaagaagauaaugaagacacaguguaauuaaaauacgaugaauauauacaaauaucauaaugauguuuauuauuuuguguguuaacauuagaaaaucuaauaaccuuaauuucauucucccaagguaacuaucuugauuuucauuacuacacucuucauauggggauauuuauguuacaucacaagugauaaaauaguuucaguuuucacaugauuuauccuuuuuccaauuacauaaauggaauaaacucaguuuuuauaugagacuaacucaaccuuaugaacuuuauuucaaugcauauuaauucauauugauugucaacucuguggguuaauauauuaaauagccauuuacuuuccaugugcccuaaguuauuuggaauuuugaauuauauaaauaaugcagccaugaacauuuuugugaaugucuugguaaauauguuuauacguguuuguuggauacugggacaaaggugagacuacuaaauuaauaaguaugccucuucagauuucuugaacaagaacagugugugguauuuucuaaacuguugucaaccuuuaacaucuuaguuauguuguaaaguacauaggcauacugccuugugacaguaauuuguaauucucagaugacugauaaagcaaaccauguuuccaugcuuucugugccuuguggacauccugcuugugagaugacuuuuucacauguuucacccacuuugcuugguggacaggguguuucuacucauaucuuccuuuguuguauuugaaagauuuuuuuuuuauauacuuuggauaacauguuacuugugaauuuuauguauuacaaauaugugcuguguucugucgcuuacauuuuuuuucuuuuacuacagagcuguauccaggguagacgaaaaaauaaacauguaauugaaauuuauuuuguuugacaugaauauauuugagauaauauuagauauauaauuggguuauguuuuuauagauuauuuugucauaaugcacauguuggaaugguuaaaauuuucacaugugaugacauuuuuugucaugcacuaacacccuauuucuguuuauaggagcucauggaacccauguagcaaguauagccgcagggcauuuuccagaagagccugaacggaauggaguugcuccuggugcucaaauucuauccauuaagauuggugauacacggcuaagcacuauggaaacaggcacaggccucaucagagcugugagugucuaggaguucuugcuauagguuaauaauguaggggauuagaaacuuguguuuauaaaauggugcugguuuaucaagaguauaugugacaguaucuugauguacaguguuuucagaugcaaaccaaugcugauuaguugaucuuaaacuuuuuaaagcugcuagguggcgguggcgcuuguuuuuaaucccagcaagggauuaaaaaccaagacaggugaaucucugaguuggaagcuagucagaucugcaguaaguuucaggacagccaauacuacacaaggaaacacugucucaaaaaaaaaauaaaaacagcaaaauuuaaaguuaaaaauugccaagaaaaaguuucuugauuuaaagucuuuauagaaaaaaaaaaaaaaaagaauacuuuauacucauuguaguaaauaucuuagcaaacuuuuaaaggucauuuuuuuaaaaauauauaacuugauccaguacucuaaaagaaaauuaaagcucuaaguaaauuuaauauuuuguauauuuguuugucauauaacuuaaguacuuuuaaaaucuaaucagaucauuguauugccucuacccauuuucaucuaugguucuuacauucuuaaaagaauagcuucauuuuuaacuggcaguuuacugaauuuguuccccugcuaccuuuuggcauuaauuaguguaugccuaaaaauacuuuauaaauugggauaugauuagucuggacacuguaggauuauaaacuauuucuugguuaaucuguuucuaaaaaagacuuccuaaaccagagucuuaaucuuuuaauagaugauagaaguuauaaaucauaagugugaucuugucaacuacaguuauggagaagcaacucauuggccaaauucuggguaaguauuuuguggggguaggaguuguuacaucauagaaccuaccuaaugaagaugaagaugaucaaauguuuuauguaagugaacugaaauuaaaauaaaauaaucaugaucagaaaauuguguuuuguaagucagacucucacuugcauguuaugccuuugauaccgggucucaucagugcacuuugccagaccauuccaagcauggucacuccuccauaauggugggucugaaacucaaagccuuccaggcacucuggcauuggucauugauucugcauuuuccuuccuuuccaaacaguuuggauuuguugggccauccaucaccaaaauagcucauucacagagauccugggauuucccagugguacuuaccugacaacugcccagaugugcuccuuguuacuuccuuuagucacucagcuauaaaccuuucuguuguuacacacuggcuccacuuaagcugcucaguccccucagucugugcuacuuccuguccugcuuccccuccuuucauguaauuuuguuuugugacaaagguuuccuaggaagaugguacacauaagaccaaaauucagacaccaucaaaguccaccuuggugaaccagugaguuuaauugggguuauuuacaggaguaugggugagaggguauuugcaggagcagaaauacucaaagacagcugcaucaccaaagcccacuguagcaugagugacaacuuaagaaaucugggaauuuagagcauucacaauagccugcaagcagcucaacagguugggaaaucucuuccaggcacuuuggcugguuucugcuuauccuacacacagcuguucuggucugaguguacuuugcagucuagcucuucugagcaucuucauagcuguuuagcuucauuccucugggagggacucccagcuuucuuggcuuacucuggcagggaggggccugguaaauuuagucagguuacugccuuccugaaggaagccuuuuugaguuguuuaccuuccugcuuacagaggagcuucacuucaggaugaaacauuucaaccucagaggaaacucuugcauaugucaucuauauccuuucuucuaaguacaguguuggccuuaacuugauauaccguagcuccuuuccuuuauauuuuauguaucugaaauauuuagaucauuuucuuagugaucaauguaucuauaacucucagcaccaaaguaugugaagcuguuuuaagguccuaucaaaaggagagcucuaucaaccuagaugcuguuuauuguuaccaaaugguucaccuuuuuuuuuuuuuuuuuugcagguaauuggguuucuugugaaguauuuuuuuuauugcccuuguaauauguacgcugccaguuuucaccauuucuuucuauacugugcucuuuuaccuugucaucucauuaacuuuuucaccugagugaucuuuucuccuuugucaguuacacuuauucucucugucucugucucugucucugguguuguuuguguguguguguguguguguguguguguguguguguguguuucucuugugcauaacaucuauggaggucagaagagggcaguaguguguguguguguguguguguguguguguguguguguguguuucacuugugcauaacaucuauggaggucagaagagggcaguagaucccugggaacuggaaucauaggcaguuguuagccacaauguuguguguguguugguaacugaacuuggaucucuuguuagacaucacacauuggauuuugcaaaacuguuuggagcuggguaauuuauaaucuccaauuucuucauuaaucuuaacagcaugucccuuauuuaaugccaguaaacuuucuuguuuguugucgaucuuuaacuugauuucuuugauuuuaaauuucuuagguuuucuauuagucucuccccaucccaucccucguggaacuuugucaaugaagauacuagcuagcuuuuuuagucaauuaauccauagucaaaauguaugcaggagucauuucauuguuuuguuuucuuuuguuugguuuucauuuuucgcucaauguuaccacuuuacaaccccuuuuaauauuuuaaugcucuguagguuugagguuuuguuugucuguuuuccacauuggguauuguuuguuugcuugcuucuuuugagacagggucucacuauuuacccuuggcuggccucaacaucucuguguaaaccauauugaauucgaauucauaaagcuacuuuucuuacugccucuggcgggcugaaacuaaaggugugcaccaucacccaggcuauaucuuguuuuucuugcauuuaaccugauuuuacaauuccaugaaacuuaacuaggauauacuaguuguaauagcauugugucuuacuacaagccuaccuguccauguauaguuaaucgcauaacugaauguaccugauacacaucuccucuccucauuuaaagcuacugucaguuacacagcuuggagucaaugugauuuguuugguuauaaauuaaauauggaaguuguauuugcucaaaguaauucuuucuuuuucaggagaauuugugaaguaauuaaugaagcaguauggaaacauaauacaauuuauguuucaagugcuggaaauaaugguccaugccuuucuacaguggguuguccaggaggaacuacauccagugugauagguuaguaagcuuuaaauacaagcaaaacaagagacuaaaggaggaaacgcacacauuugauauuagcccaugauacuagagagaccccguaucuaaaaauauauaaauuaaacaauaaaccacuguuuaaucaaauaucauauccuauccuuuauauaaaacacugaaggcccagguauuuucagucacuuuacauugugacaggaaguuuucauguauagagucaaguuacauaaacaaaccuucauaauguuuuaaguaagcuuacaguuuugugggcugcauauguccugugagcugugggguuguacauaccuucacauagaccuuaaauguguuccuaggaaagucugaggaacuguguuaccuagaauuuauuguaauuuagggaaagugguuuaaugugcacacaauuuggcagguuuucuuuuuuuuaaugcacauaauaauccuggaaguuaugugcccaaaagcagugugcauaguauaacguaaacuuacuuuguuucuguauuaaauguuuucccuuaacauuuacaagagagagagugugcuaaugaucauguuaagcauaguguuuuucacuggggaaaaaaauuaggaugcaugagaugaaauguguuccccuuuguuaauggcaaaauccauccuaauagguguuggagcuuauguuuccccugauaugaugguugcagaguauucacugagagagaaacugccugcaaaucaauauacauggucuucuagaggcccaagguaaguauaaguaauuauugggaguaauacauguauuugauuaaacuuuguacuguuuggaggguggcuuauagauaauaaauauugauagccuuguuuugaccagauuugauauuuaaacuuuugugaaacaaauguugugcuuuuauaacggaucauagcaacagauccuauguucauuuccacauaaacuucuuugagcauuuugggugagaucuauaaguaagcaaauucugauugacaaguuuugguucucuaacaucauuugaaauauaugagaagcuuuuuuuuuuucaauauguuuaaugaaagagcaucauacuuaacacccuggauauaguguaagugaauuacaauacacuaaagaaaauaaucaaaggaauucacaugaguguuuugauuccaguuuugauuauaagaaagucaauaccauaacaacuaaagacagaucaauaucuguccagaguuuaggguggagagaacaaaggaagauaucagucaucaaauguaguuuaaauugauuuugauuucaugaaaacguaagugacuauaaaacaaacuaauaaaaauuaauauauaaucaaagacugaaaaacauuaauauauaaucaaagucaaauauucuaauacuguaacaguaaauuacuuacaacccuaguaugaaaaggugacaacauuuuugaaaggaaauuuaaacacauuuuacaaauaguuuuuuaauauuuucauacagaauaauuauuuuaagauauauuuuguugcuaugucuccauuuucauuucugauuuuauuaauuuggauacuauuaucugugccuucucguaagucuggcuaaggguuuaucuaucuuguugauuuucucaaagaaccagcuccugguuugguugauucauuuuguuucuacuugguuuauuucagccccgcuuuugauuauuuccugccgucuacaccucuuguguguauuugcuucuuuuuguucuagagcuuucaggugugcugucaagcugcuaguguaugcucaaucuaguuucuuuuuggaggcacucagagcuaugaguuuuccucuuagaauugauuucauuguuucccauaagucuggguauguugugccuucauuuucauuaaauucuaaaaaguauuuaauuucuuucuuuauuucuuccuugaccaaguuaucauugaguagagcguauuucagcuuucauguguaugugugcuuuccauuguuuuuguugguauuuaagacuagucucagucuguggugaucugauaggguacaugggauuauuucaaucuucuuauaucuguugcagcauguuuugagacugauuauauauggucaguuuuggagaagguaccaugaggugcugagaagaagguauauucuuugguuuuaggaugaaauguucuacaaauaucuguuagauaguucauaaauucuguuaguguccaugugucucuguuuaguuucugguuccaugaucuguccauugcugagagugggguguugaagucucccauuauuauuguauuggguacaauauguacuuugagcuuugguaguuucucuuaugaaugugggugccuuugcauuuggagcauagauguucagaauuuagaguucaucuugguagauuuuuccuuugaccaguaugaaguguucuuccuuugcauuuuggugacuugguugaaaguugauuuuauucaauguuagaauggcuacuucagcuuguuucuugggaucauuuucuuggaaaauuguuuuccaaccuuuuacucugaaguaguaucugucuuugucauugaggugcauuuccaguaugcagcaaaaugcuggguccuguuuauguauccagucugucaguccaugucuuuuuuauuggagaauugaguccauugauauuaggagauauuaagaaaaagugauuguuacuuccuguaauuuuuguuguuagagguggaaauagguuuauguggcuaucuuuugaguuucuugaaagauuacuuuuuugcuuuuuucuaggguauaguuuccuucuuuguguugguguuuuccaucuacuaacuuuuguauggcuggauuuaugaaaagauauugugauuuuuguuuugucauggaauacuuugguuucuccauuuaugguaauugagaguuuugcugcguauaguagccugggcuggcauuucuauucucuuagggucuauauggcaucugcccaggaucuucucgcuuuaguggucucuggugagaagucugguauaaugcugauagguaugccuuuauauaugucacuugaccuuuuuccuuuacugcuuuuaauauucuuucuuuguuuaaugcauuugguguuuugauuauuauguguugagaggaauaucuuuucugguccaguagauuuagaguucuguaggccuucuuauguguucaugggcaucuauuuagguuagggaaguuuucuucuauaauuuuguugaaaauauuuacuggcucuuuaaguugggaauuuucuuuuuuuaaagauuuauuuauuauauauaaguacacuguagcugccuucagacacaccagaagagggcaucugaucucauuauagaugguugugugccacaaugugcuugcugggaauugaacucaggaccucuggaagagcagccagugcucuuaaccgcugagccaucuccagcccuuaaguugggaauuuucacucucuucuauaccuauuggucuucucauuguguccuggauuuccuggauguuuuggguuaggagcuuucugcauuuuggauuuucuuugauaaagaacucuugucaguguuuuuucuauguuaucuucugacccugagauucucucuuuuaucucuucuauucuguuggugaugcuugugucuaugacuccugaucucuuuccuagguuuacuaacuccaggguugucucccuuugugauuuauuuuuucuauuuccauuuuuagaucuuugaugguuuuguuuccugcaccuauuuaauuguguuuuccucuaauccuucaagggauuuuuguguuuccucuuuaagggcuucuagcuguuuaccuguguucuucuguauuucuuuaagggaauuauuuaugucuuguaucaucauuuggagaagugauuuuagauccgaaucuugcuuuucuggugugaugguguauccaggacuugcuauguugggagaaguguguucugaugaugccaaguaaccuugguuucaguugcuuauauucuuaugcuugccucccaccaucugauuaucucucaugcuaccugcccuugcuauaccugucuggagccuguccuucuugugauccugguugugucagaacuccucuuaguucagcugucacugggauccuaugauucugugauccugugauccugagauccuugguguaucagagcuccugggcgucaagcugcaucugggacccugaguuccuggugugaccaagcuccuaggaucuuguuauccugugguccuguguguguguuagagugccugggagcaucuuuuggcaguuguaggacuggcugcagaguucauacccaagguguacucagggcacuagcccagaccugaagaaaccaguuccacuggucgggcagaguucugcgugccuggguccugcuggucccaguuacuuuugguguugggacagauguuguauccuucucaccucugauccuaugauccuggguguguuagaguuccugggaguggagcuuccucuggguguugugggacuggcuucucagggcgcuggcccagaggggaaggcacucuugccacuugucaggcggaauuccugugugccucagaacuuguucuuuaauuaagagauuauauaagucuuaauuuuuaauaauaccucauuaggacuucagugaguacuggcaccugauuaaaaaauaauguccauuuuaauucaucucuuuauuucuuuagagaagauuuagaagaauuuugauuuugauuuaccaacugacauugucagaugguggaacaauaggaguaagaugauuugguuaaacugguucuagaggagguggucauggucuugaaggauggauuaaauguuaagauacaggaagaaguucuauaugcaacagugcauggagucaaagauaaguagguuuuuguguagaacuaauuuacuauacuaaccuaauuucuuaaguaucaggaaaguuugucuuguaccaucaucauaggcugcccuccuccaaccauauggugucaguaacaauagguauagauugagaauccaaaguaugaacugaagagaugucccaguaucucagaauacauaguaagaagaacccuuacagaagaucuguguucaguuucccacaccuaugucaggcagcucacaccagggugcaacucaccagagaacauaauaccucuguccuccagacagacaguuacacacacacacacacacacacacacacacacacacacacacacacacacacaaauaauaaaauucuuuaaauuuuucaaaaaaaauccuaaguucacaaagguuguauguucaguuaauacaaaaaguuuauguucaguuaauaaaaaaguuauuaaauuacuucugaaucugauuucuaaauuacaaguuuuauguugcaauuuaaaaugaaauuauguuuaaaauaaaaacaaaguauuauggacuuauuuaaacuaaucuuugcaaaugucacuugcuguagaaaauuuaaggaguuucuucagaugauugggguauagugcagugauagaauauaugcuuagcauauguaaggacuuagauuugcccuuuagcaccaaaaccaaaacuaaugcacaaagaauuauuuuaguaaaaucuacaacaaacuaauugaucuaagaauugaguuugucuuuaucugguauauaacaagaaauaccuuagcagauauuugguuaaauuaucaagguauaaaguaaaagaugugggcuaauuauuacugcgaaaaacauguuugauagugcucucugaaaaacuguccuaccucucccucagcauuaaacacuggauauauagaucugauuuugauuucuuguguucucuauugcaacugaaacuucaaacaguggcauaugggagccuauuugcaggauuguaccccuaucacagugucuggugucaguuauucuccaugacucccucauucuuggcauuuaaaaaaaauuaucuucaaaaccaccugcacaauauuuauuacacugccauuuucugcuguacucuaaagagguggcccaugcuuuggacuacaacuauaucagccucugugugcuaacucuagagaaauguuucucaugcagugguuuucuuguuguuguucuugauuauuauuauuaucaucaucaucauuauuuauuaauuaauuauuuacauccuauauaucccucucaguccccucugacaauaccccuaucucuccuccccuuggccucugagagagugcccaaccccaggcaucccccuucccugaugcaucaagacuuuacaagauuaggcaaauucucucccacuuuggccaggcaaggcaguccucugguacauaugugccaggagucuugguccaucuuuggcugguggcuuugucucuaggagcucccaaggguucaaguuaggugacacuguuggucuuucuaugggguugccguuccguucaguuccuucagucuuuccccuaacucuuccaugggaauuccugacuucaauccaaugcuuggcuaugaguuucuacaucugucucaguagcugcugguagauccucucagauccagaggcuccugucugcaagcacaacauagcaucaggaauuguaucaggauuuggugaccucccguggaauggaucccaagaugaaaucacugguuagccauuccuucagguugugcuccauuuuugcccuugcauucuuuugacaggaacauuuuucagucgaagauuuuaaagguucuugguguccccauuucuccacuaggggcacuagcuacgagagguagucucuucagguuucaucuccccacuguuggucauuucggcuaagaucacccacauugaguccuggaaaaauccuccaucccaggucucuggaacauuuuagggguucaccccacccuuggcagcugcauauuuucauucauaaacauggcccucugggcuuaucuccugucuccccauauacuugauacaguuccaaguaagguccaucagaccagggaaguuauggguucagaagcuugggagaacagagaagaauacaugcuucuuuguagcucuguucacuauuuucauuccagggcacugccacaggaaauggucccauccaccuuuaggcugggucuucucuuagucaccuacaaacauucccacaguccaacccaaucuagacaguuacuuguuagaacuuuagccaaaugauucuagacugucaaguugacaauuaaaaguaaccacagaaaauauuuuuccaaauuuuaaacauuuguugguucuuacuuaaacucauuuuuagauuagcaauuucaacaauuaaagucacuuuaugauuagcuacuuuacaagguagucagaaauuaguuaaaaaaccaauaggaaaucauuacauuuuuaacucuuuguaauuacuuucuucuaguugcuagauaccuaguccucauugugacuauugguugauagauacuguagauauugugagcaagaaugugaaaauugucccuaaaucuucauaucuuguauauaaauuuauggaugacauugugaagaacauaguguuauuuuuuuuauuauccaaacacuguugucuuucaauaagugaauuauuuugcagacuaacugcaccuagccuaaucauauuucagagagguucugaaagcacugccacccacccauuugugcagugguggagugcauuccacuuucuagggaacugaagucaaaucacccuaguguucuuagcuaggaguuuuuuaaaaauauaacaagcaucacucacuuuggguaagaaucaugauaggaaauccaacaaucucuguggggaaauagcauguccuuguaucuuuccaugagacagagaauagagcugugcugggugcuauugcgaucuuacagcugauaagauaauugauuaaagguguucacugccuauacagaccacuggaauuuaauacuuaggucccagucauggagagagccaaauccuguaaguugucuucugaccuacacagauauaccaugaugccaguuuauggccugcucccaacagcuuaucuuucuauuucccugucucucuucucuucucuccccaucucccuccuuuucuuccucugugugagguugcacacauacacaggacgauuuuaaaauucuuuaaugugccaggugguggugguguugcaugccuuuaaucccaauacacaggaggcagagacagucagaucucugugagguuaaggcaagucuggucuacagaaugaguuccaugauagccagggcuacacagagaaacucucaaacuuuaaacuuuagaacauuuaaaauuagguauaaggcaauguuauguuucuguuagacaaagugaaauuuuucugguauaggugaaagaaauacccucauuaaggguuagauuagagcauucaaauaacugaccccuaugccuuucucacauaaacauagauagcuacacacagacauuucacuuacaaggaaaaaaguaaguguguugagaaaugagcaguguuuggucauuuuccuuccauuauugucucauaauaauaucuuuguccuuuuauaacugcaauuauuauaucauuuagacuauaauuaggaccuuuuaaagauuguucaugcucagcuacccucaccuuuuuucuguuuagugcugauggagcccucggugugagcaucagugcaccaggaggugcuauugcuucugugccuaacuggacauugagggggacucagcuaaugaaugggacaucaaugucuucccccaaugccugugguggcauugcccugguacuuucagguaaggauauuacauacuacucucuuuauuguaggcuauacuuucugaaguucucaugguaagaguguauagaauagaaauguccuggacacaaaauaagauguaaaguagaaaaugauuuaucuauugaguguguauucaaucauucaggaaauaaaaucuauugacuacuacuaaugauuuucaaguaauaauuuaguucuggagcuaaaucauuggauagaacaucaaaaguacuuugaugaaaaagaauuuauugcagaaagcagacgacuauaaacaaauugaaaauacuaauacuacauuaccagguguugaauagugugcaguauuaaauagggugucaccagguuacuuacaacuuagacuucugccugaagccuguccucuucaagucuuaccucccaccugccucuucuaguucacuccuuuucugacucguguaacuuucuccucugcccaguauggaugagucguacuggggaguagucugccuccauccccagucaguaaucaccagacagugagucagaccuccaggacagauccuagucucuacucauuuuuacuccuucaaacucaccaaauagcucaaggucagaugucugucucucuuugaauacucagcucucucgccugcaaauccuuucugccauguuucagauuugaaaacucauacauucuacaagaaucagcucaucuaccaguuguuccuaauggacuuugaucuuuuuagaauucucauggaggugauuauagcguccuugguuugcaucauggaguauuuauuccuuucuuuuuuuuuuuucuuuucuuuuuuuuuuuuuuuuuuggcacauuacaauauauuacugguggauaauauauuggcaauagccuucuguguuugaaaucugguucuacgcuguaaucacaugguacuuaagucauugaagagucuggucugcugugaaacaugacagguguuuuugauuuguuuaaguuccacugguaauuauaaaauauaauugaguugaaaauugcuguuaccaacuauagugcugaaucuaugauauuuuaaagaaaaugccauuacaaugccccuaagaugccugcuugguacauccaugucauaucuacguagccugcauugaugugauuguggguuggcaugcaaugaauuuuuuucuuaaaguacuugugugaugcaagcaguuuaaaucaacuuuaauuuuuuuuuucaacuuuaauuuuuaagaaaacauuuagaagugaguguuaaaagaaaacagcagaaaagaauacauauuaacaucuuggugaagggagaguguuucaacuagugaguucauuaacauuaguuucuuagguguuuguuuguuuguuuuuagggcugaaagcaaauaauguugacuauacuguacacucagucagaagagcucuagaaaauacugcaauaaaagcugacaauauagaaguauuugcccaaggacauggaauuauucagguacuuguugucuguguacuaaaauaacuagaaagcauugagauaauguuguaaauauugcucuguaauagugauucagcaugucuaaacuuuagauguggccauuauagaacuauaaucaaaaagggcacaaaggcucuuuguagguaaaagagauuaacugcauuuaaguaaaagaaacauuuggaguauauagagauuagaaaaucaaaguguuuaaaagucagacguaaguuaccgagugaucuuagcucaugugagaauaacugugaaugcagacugaaguagaaacuaugcaucaauuaaauuucagaaugguauuuucuuuaaaagcacaaauuuacuuuuccuuuccuuucucuuucccuccccaccccaccccccuuugguuuuuguuguuguuguuguuguugguuuuuugagacaagguuucuuuguagcccugguuguccuggaacuagcucuguagcccagguuggcuucaaaacauagagaucucccugucucccacaugcugggauuaaaggcaugggcuaccacuacccagcugauuugccaucuuaacuguguuauugauuuauuuuagagaaaugaauauagagauuagcuuugcuacagcuaaaauuuaauugaugcauaauuuguugguuuuaauuuaauuuuauuuguaauucauuuuuuacacuccauauuccauuuccugccccuccccuaccacccuucaacugcuucacauuccacaccuccugaccacacccugucuccacguggaugaccccacccuccaccccaccugaccucuaaacucccuggggccugcagucucuugaggguuguuagguguaucaucucuguuugaacacagacucggaaguccucuauugaauguguguugggggccucauauaagcugguguaugcuaccuguuuggugguccaguguuugaaagaucucggggguccagauuaauuaagacugaugcauaauuuguaauaaaauauuuucuuuaccuagccauuuacaugcuaccauuuauauucuuuuagguugacaaagcuuaugacuaccucauucaaaauacaucauuugcuaacagauuagguuuuacaguuacuguuggaaauaaccgugguaucuaccuccgagauccuguccagguggcugcuccuucagaucaugguguuggcauugagccuguauuuccagagaacacagguaaguacuaggguggcaguaagcagaagcauuuguauuuguggcuuaaaugaaugguaaauaaaagaagaaugcugcuuugcuugucugaugucuaaaguaauguuuacccaccuuccuaauacuguuacccuuuaauacaauuccucauguuguggugacucccaaccauaaaauuauaacuauaauuuuguuaguuaugaauuguaauguaaauaucuguguuuucugauggucuuaggcagucacugaaagauuugucaugacccaaaccacucacuguucuuaggagaaaauacaaauuaacaagugauuauuuuaaaauuuaauagauuugguggaaaauauuuauuagagaccccaguaccauggcaguucauucaggaucuugacaaugaaggaaaagagugggccccggccuucaguggcccauaauuuauuaagccuauaauaaaauuauaguuuauuuucuuuccauaucucauuccuuggauagaaggcagagcuuuaggugagugugggaaguaaacacagcugugaguuggugaggaacuguuguuuuguaucuggcaguuuauuuuagucagcugcuugaucucuacgugcaaugauacaaaagguccacuaaacuguuuauaaggcuuagcagugauggaugaaaauaugugugaaucacaagaagauucugcauuuuuauuuaaguuauaauuuugguauccuaucuaauguauuauacaguugaccaaacuagaaaaagaggaaaugcugagucuuaauuuuuuuuuuuuuaaugccagaaaacucugaaaaaauauccuuucagcuucauuuagcuuuaacuucaaauucaucuuggguucagugucccagccauuuggaacucaugaaucagugucggcacauaaacauacguguggaccccaggggcuuaagagaaggguuacauuauacagagguauuguaacaucuauuguuuuucuuuucucuuugaaauguuugagaaggugaaaguaaauaaucucugauguguuuucucucauuaaaaaucuaaccuuuucacuuacuagauuuucuaacuuuucuguauccauuuaagcaguuaguuauauaguguugcauucuucugugaagaaggcugagggagauagaaauagcaaagccuuuuuuuuuuuuuuuuuuuuuuuuugguuuuucgagacaggguuucucuguauagcucuggcugucccuagaacucacuuuauagaccaggcuggccacaaauucagaaaucugccugccucugccucccgagugcugggacuaaaggcaugcgccaccacgccuggcuacgcaaagccuuuuugaucaggccucuguacuuuguuaauuaugcaguguagcuaaacuugugcuguaguuagcuuuacuauuuagaggaaacauuuguuaaaccugacaguuguaaauaaacacagaauagugucauauagcuaaucuuuauauuuuuuuaaacuugauaccuuguuaccuguucaucucagucaugauuugcuauuugguugcuauuugcuuuggguuguuauaugaauuaaugucaguaaucuaguauuaacuuaccugcuagaucuuuaaauuuuaagacuagauuauucuaugcuuacauuacaccuuuuacuuauguuuugcaacuuuuuucauggguguugaaacuuaccauucuuucuucaagguauguggcuaugauauagcaucccccaaugcagguccuuuauucagaguuccaaucacugcaguuauagcagcaaaguaaguaagauguuuaguuuauuauuauguauacauuguuaaugccuauauuguaauacaguauugauuuuuggaggauugcuuagaagcaaguaacuagaaauauuaagacagaagcagguaaccaguuucugcuucuagcuagcauccuaguuggcauauaguuagcaaugcuuucuauuaauuauuaguugaggguaucuggcaucugcccaccuucuauugaaaugucuuugcccauccuaccacugacuccauauugcccuguugagaggcuauuucugccuucauuguaccucuuuccucacuuacucagggauucuucauccucguccuuugcgccccgcuuaccuucccgugucugugauucugcugcccugaugcuucuaguugcuuucuauuuccagccuuauucuuuccaucucaagcauccuggaaucggggaguuuacuuugguguauuaacuuccugcuucaaacacaccagcaguguuccuuaaagauccgguuucauuccuuuaaaaagcccacaagaacaacuuagaauuaacaucucagguggcuuccuaucacugaguauaccaaaguacacauuuuuagcuaucucccucucuugacacucaaugguuuccucaguauuuaugcauuuguuccuuugccucguuugcucguauguuaaauagccagacuuacuucugggcauucuccguguggggauuuccuuccuuccucacucuaacacuuuuuacaagcuccuggacaggcuucagcuaauguguuccaauuuguuuuuuaauauaauauauaucauuugauugcaagcuguauuuacacauucuaaauuaauaccuuugguggggguuauuugaguuaaauauuaauuauguaauaggccucagccaaugaggccuacaggauaaaauugaugagauuaaaauauccaugcacaugggaaauuuacaucacaguuaaauucucuguuacauguuuuguguaaguucagugggaauuuggacaagacuuuucaaccaucugcaggcucacucuuaggauccaaaccauucuucuauuuuucuguaacaauucuuuuauggagcuugcuauauuaaauguuuuuucuuucccuaccaguuguuauagagcaaagaaaggguuguuuuuuacucauuggaauauuucuagcuacaaauaacaguaccucauacacaguagguauccauugcuuauuuguaaaauuaaagacaauguaauugcaacccgcauuuuauuuccauagcacauaguuacccauuugauguuuacauuucuuugauugcuuauggaaguaguuuggagcauuuugaaacuucauguggggauucaauuuauuauguuuuacucauacaucuguaagacuauugcugacacaaaauauagugugauuuuaacauucaaaaaucauagcugggugugguggugcauaccuuuaaucccagaacuugggaggcagagguaggcauaucuccugggaauuugaggccagccugguuuacaaagggagauccaggucagccaggggauacaucagaaacccugucucagaaaauuuuuauuuuuuagaaaucagaguugagagucuuugaauuuuguaaaauuccuuuaacaggagacagcauaagcuuuuuacuguuucuguuacaauguauaaaaauaggugaguagaucaucugugugcugcugucagagguuauaucuacugcugugguacagaaugagggaguauuguccaggguuuauuucuagcaaacucuucacuugccucuguuggauaacaucuagaguguugaugaguguauuguuuauauagaguuuuauuuuuagaguaucauguuuaauuuuuuuuuuuuuaauuuucagaguaaaugagucaucacauuaugaucuagccuuuacagauguacauuuuaaaccuggucagauucgaagacauuuuguugagguuccugaaggggcaaccugggcugguaaguaaaauuuguuucuuaucuuuuuauuuuuuaaaucuguuagagaauuuguaaacugguggugaugugcuauugcuguguugauuuccugcuaagaguucucaggaauuacucuuuguauaucuaugucuaugcuaggcccuuaggagggcugcuucuagaggguuuuucuauagaauaccuuaccaaaacugaccgacuuguugagaaagagguagaaugaagugggaagacaccacuuuagggaaugagucugggcuccgguauagacuacuacuuaacuuggaauaccuaguuuuacauagcugacuuucuaucuuaacugauacugcuuacccucaucuguaagaauagacaaucauaaaguguuucgucuguguuaaauuaaucuccguacucuuuaacaguuugguguacuucacucuuaacaguucgguguauucagugacagaaagcuauuuacagcuauaauugugaguugucauuauaggcuauuuuauggucaaguuguggagcuuccugugcugcaguauuuacauaaagccuauugggguucuauagcucagggcucugauaaauucauuacuaguaguacuaaagaguaaaacuccuacccauagaaguuucuuguuucugccuagcccuugcaguuuacccagagucuguuuucuuuaauuacaaaaagaaaaagaaaaacacuuuguuaguuaugagucaguaaauauaaucuuaagaauguagaaauguagaauuugagaaugguggguauuguuauaaaacauugaaugggauagaaugaacaugucacaucauuucaguguuagcuuacaaauguucugauggcuucuauuucacaucauucaaaauacuaucaaaauauauacguccucguagcaaauaguuauuuuccccucugugcucccuggucuguaaaaaccaaaaugaaccaaaccuuauuuugaugcccuuaaauuagagcagguguuccuuaaauaaucuugccuccucaugacuuugguuuacaucuggccaugcaguacaguaaagcuaauaaauggugaaacuucggggaaagaaguaggaauacauacacgaguaagcagggaugacaauuuuggcaugguaaauaagguuuucuaaaauuauaaucuuuuuauugggaauuaauuuguuuuccaauuaaaacaagaaaaaggguugguugguugguuuguuuguuucaaaguccugguuauaauuguguauagauccagaaacaguuuuguucuuuccuaaugccugcaguaagcauugagaguggauuauuucuuaguucuguaucaccuauacacauacuuuguucuuuguuucuucacaaagcuuacagcuuuacuuugaagauccuaguuuagggauuggagaaaagaaugguuaagagcacuugcugcucuuccagagagaccuggauuugauucucagcacccauacagaggcucccaguguuccuccagcaggcaccagauaugcacauguuguauagacauacaugaauacaaacucauauauaaaauauaaauaaaucuaaaacauaauaaagaagauacuauuuuuauuaucaccuagacagaugaaauuuuaauaauuaaccauuuuaugagcauuuuaauucuugccaguuuaaaauuuaauuucuuuauuuuagaaguuaccguguguucauguucuucugagguaucggcaaaauuuguucuucaugcaguacagcuugugaagcagagagcauaucgaagucaugaauuuuauaaguuuuguucccuuccagaaaaaggaacacuuauugaagcuuuuccuguuuugguaaguuuauguaacaagaaaaucgagagcacucccaagacauuucuauguuuugccuagaccaugauacagauucagguucuuuucaugccugucagauaagguaggaugauagguaauuuaaugaagaauacugaaauccaaggcuggcgagaaggcucaggguuuaagaguacuugcugcccuuguggaggagucugcgucagcucacagcacccacugggcagcuuacaaccaucuguagcucuaguuccaagggauccuaugcccucucugaucuguguuucagaagugaauuuuccuucucuagucuccucuucuuaaagugcuaugguggaacucggggucugggcauucagggcaaguagaugaauuguaccccaucgaauauucaucucucuuuaauucugauacuucugauaaagagauguucuaaucuuggaccuucauuuacauggcacuuguuaucuuacucaacguccuacuguuaagaaucucuauaagguaguuuaauuugcagacagaauuguugucaggucucugcuuuuccccauguuuggaaugauaaguccuucuucauggaaggcgaaugcgcagcugugcuugccgugcuugcuucuuugugcuuucaguuccuuuaguaacauuaugucucucaugucucuguuccuuugaaauggggugguguuagcuuuauucaucuccuuaaauguacugguacaacagagcuuaggauacucuuuuaaaauugauccuaagaguaggauaugacuguaacuuuauugauacauacucauggcuauugagcaugccuuauaaauuuuauaauauuucuucucauuaugaauguuaauuauguuuaaauuggguccuaggguuuuuuauuacuaaugugcuaugugcauaaauaaguaaauauaaauagauaaugauaaaauauuuuguuucuugcuacaaauaaaaauuuuguuuugaaacagguaauauuuggugauaugaggaagaauuagaaaacagauucauucuuuaacauucucauuuuuauuuccagggcggaaaagcaauugaauuuuguauugcucguuggugggcaagucuuagugaugucaauauugauuauaccauaucauuccaugggauaguguguacugcaccacaguuaaacauuguaagugcuauaacauucucauuauuuuuagugucauuuuuguuuugaaaaaugacuucugugguagauguaaaacuuaauuagaaacuaaucuauaaaucugaauauauucauucauggauauugaaaacuugcauuuaugaacauauauauaaaauauugucuauuaauauucaagaaauuaauuuuuaaauauguuuuguagcaugcaucugaaggaaucaaucguuuugauguucaguccucuuuaaaguaugaagaucuggcuccuugcauaacuuugaagagcugggugcaaacgcuacgguaucucauuuuuuuaagagcuacaaaaguuaaauguuaaugcaagaauucuuuuaauugcuuuuuguuuguuuuucuaauuuuuaucuaugugauaguauauuuuaaaaaaaaaguuuuauuuugcugucuaggaauccucuugaguuuccaaaacaugguucaguauugcuuucuacccucacugauccuaucaucaguagugucccuauauguuagccauuucauuagcauuugagacugaggcaggagaaaagcaaguucaaggcuaccuggauaacucaaaaaguugagaaaaaggauugaggaacugcuuaacaauaguguucacuuuccauaugcaguacccucaguuuaaucucggauauuacacaaagcaaauuaacagugucaaauuuuuauuuugugaauucauucuucauuguuugaaaaauucagaaucagaaacucuccuugacaauaaaagaaauuuguguccugagugugagccauaagcgcccugcggaagcaggguuugccaaggugguguucugcugcagauaccuuugcagugucaucuccuuaggacaaggacuagcuauacccugcauacgauguggcccaggccacgcgcaugcccagcaccagcaaguaugagugaguguacacaucagaaauguucuuuaacucuuuugguaauugucuuagucagggucucuauuccugcacaaacaucaugacuaagaaacaaguuggggaggaaaggguuuauucggcuuacauuuccacauugcuguucaucaucaaaggaaaucaggacuggaacucaagcaggucaggaagcaggagcugaugcagagaccauggagggauguucuuuacuggcuugccucaccuggcuugcucagccugcucucuuauagaacccaagacuaccagcccagagauggucccacccacaagggucuuuuccccuugaucacuaauugagaaaaugccuuaaaguuggaucucauggagguauuuccucaacugaagcuccuuucucugugauaccuccagcugugucaaguugacacaaaacuagccaguacaguaaucaucgcccaagaguugagauuugguucugcuaagaacucugugguaacauuuuuaagacuucuguucaugucuuuguaguauuguagcaauuuaguuaauauagacuauauauuaauaauugcaagauuguacaguuuacuauaaaagacaguuuaagaaguggucuucaccuugcauguuuaacugcuuucuuuaaaugaagucuuagcugggcagugguggcgcacgccuuuaaucccaguacuugggagguagagacagguggauuucugaguuugaggccagccuggucuacagagugaguuccaggacagccaaggcuauacagagaaacaaaaaaacaaaaacaaaaagucuugacuuaauucagugaugcaguugccuuguuacagcccaguaaaugcaaaaaccagaccuuuaggaucaagagauguuuugccaaauaaucgccagcuuuaugagaugguccuuacauacagcuuucaucagguauguguuuucuaguaaaauauaccuguguaguaaauucucaucuuauguacuaugaaaucacaguuggaaagaugugacuggucuuugaggcuucguuuuuauucauaauuuauugagguuuuuuuguugauaggacagguaacaggaagaaagaaaaacauaaaggaaggacuugcuacucugccacacuguuucagaggguacucucugggcucuaugugucugggcuuguaguccagcaguacacuguaccggagcucaccagcacaaguugaacaaucucugaggagagagcaaggauuaaagauaggaaaggcagaaagaagacagaggaggacugcuggucaguaccacaguagcagcaguaagaccucuguucccauccaaaugccuuucuguuccuaccacuaaggucaauagaaucuucagcccuucacuugagccucaaguguaccaccucuuaucauuccaugccucaguaggucaggaaauaugccaacaaaugcugacccaccuugacucugucuggcaggcagacuauuuuauucuuuuuuucuuucucucugcuucagagaaacaggcaaacuauuacucugcuuuuaaaaauaggcaaauggcuccagacaguauacaauggcaguaugaacauuuaguagacucagcucaguugacaaaggacagagagaagguaccaagaaaaaaaaauuuagagcauggccccugccaaccaacuuccuccaaugaagcccugccuccuagaauuucagugaucuccaaaacaacacaacaucaccagcuggguaucaaguauucagcauaugugagagauacuacaccucuugaccauaacacaagucuccauuuuuaacacccaggccugauuaugcuuugcaaagaguuaauagucagaguacuugagaucauuguaaauguuggauccagggggguuuuagagucaaugagauuucaguucauuuuaugcuuacuuuauuaaagcauaaugugacuuuagucuuaauguuacauacugguagauuucaauaaauuguuagauuccaguuauauaaaguaaugagacuguuuuagaacuauauguauuuguuagaaauguguguguguguguguguguguguguguguguguguguguguguguguaggaagagcacuagguuauagauuuuaaagugcaucuauuuaaugccaagauaguaacucucguauacuuugaaaagaaauaguuauaagaauguauuuuggauacuuuuuugaaaaguguuauugguauuauguauaaaucauaucaauaauuuuuuuuaauagcccaagagcggagaaguaacaccuaguuguccacuccuuugugaauuguuauaugagucagaauuugacagucaguuguggauuauuuucgaccagaacaaaagacagaugggcucaggcgaugccuauccacaucagguauaaauuauaaaaaguaauaaaucccaaauuucucguuaagguguaacauuuaaaagguuuuuuaaaaaguaccauaaagucacauucaauuuucugacaccuauagaaaucucuuuugcucauuguaguuauuaagcaacagacuugacaacuuuucugccaugugacuagaggauguugcuuacaaguacuggccagcagugcacuuuuagcugagaagggacuacacuggugacuuugcacaugcucggcaugcacucuuccacuagauuagaccuccaguccuagugugucuaccuguugcauuacuucucccuccuacgcacugcuucuacucaagauagacagugaaugggagagcguaaugugaccccaggucugaguggaacacaagggcuugugaguaccuucaaaucugaaaccguacugagcauugacugcgugcucuggacuuuguuucccacugauacuaaaggacauggaacuacuuggcaauuuugucucugguuaaaauuguauuugaagaaauaggagauauuuuucugaaaugcucaugauuuuuugcugaauaauuaauuaaguaauaaaauaauaaaaauuguuuauggaagcuuuugcauuuaaggaaugguccaguuuucccgucaagcaagcagcaaucucaucacuauagucuggaauguuacuugaguuacacuucacauuggcucaaaagacauugcuucugcaaaauacugacaguauccccauucagugagcauuuuagccgagagggauguaguagcuuuacaauccuugaucucuacuggcuccuuguuuucccugcuugucauaaagggaugugacacuucacaguuaaaacguaacguuuuacagaagucacacaugugcauacacaugaauguuuauuuuagauaauauacaaaucuaauuuugacuuuuuugacuaccacuucauguuucuuacaaccuauaaacaaaacuauacuugcuuuucuuauguauaacacugauugugugaauauguugauacgcuuggggucaggcgagccacuuaauacuucaaauucugccccgcucacuagcaccuuagauacuuugaguauagaugucucauaccuuguacacucuguaaauggaacugugucuuuuauccuuuuacugagcugaacuuacuuuuuccaaauguuuucuuuuuuaguauucucugaaauuggagaaaggagauuauacaauucgauuacagauucgucaugagcaaaucagugauuuggaucgucucaaagaucuuccguuuauuguuucacauagguugucuaauaccuugagcuuagauauucaugaaaaucauagccuugcacuucuaggaaagaagaaaucaagcagcuuaacauuaccacccaaauacaaucagccauucuuuguuacuuccuuaccugaugauaaguaagugcugauguugauguauguuacucuacaucuauuauaauuugcuaucauuuuagucugaaguuguuucucaguuugauuuuugaaaauuuggacaugggaaauauuucaguuugauuuugaugguuuuccucuaaguguuuuugugaaacuuuuucuuuuguuacuuuuuccccuuuuaauucucucauuagaauaccuaagggggcaggacccggaugcuaccuugcaggcuccuugacauugucaaagacugagcuuggaaagaaagcuguaaguacuaguguuuuacacugaaaguaccuguuuaaaauuuuccaucccuuugaagaugggcuuuaaguccaucguucagaagggguaaaagaauacuugcagggagggaacaguaauuguuuuucuuuuucuugagcuguuaaugaagguggauuaauauuugguaccuuuuuaaaugugucauuaaaaaguauuuuauguucuuuuccacaagccccaugcccuaacccuauuccaccucagucccuaaaguucuugacauccagaucacaauugguugaagcaaaugggauguguaaaauuauagcauacccuagcauuucaaccaacauguuauagauacuggaauaagucaaguucucuucauuuguuuauaaaaaccaaucugaaggauauuuauuaauggauauuggcucucacauuugugaaggcuugcuguggucuacaagaccucagcaauuacguggauagauguaugguguuucuugugauucugcuuuuuauaguuucaaaaugaugcuuuuuguuucuaguuuagagauaacuuauuuaaagcuuaaagguauuuauuucagguuuuuccaucuuguuuuuauuacagauuuguugcagagaauguuuuuuauguggaucugucacccuuuaucauaggucauuuugguguaauacaauucuuacaucugugcauuucucauuuagcauuaguucauacaaaacuauguaagucuacuuaaccuaauccugggaucuauaaaugcuguugucagagugaauucaucucauuuaucuugaaauguauuuuuuucuugucacuguucaaccaaggucauauauucauagccauaaggaguaauuuggggauuuugugcuugacaucucucaggaugcauuucauuguguacucuuacucacacauacuucagugucauuuggaguaaaucagcacuugauacuggacuuuguucuugaacugauuuaagaaauccucauagaucuuuuuggagauuuaccuagguggcugcuucuaugggacuucaacugaguuuuucacccagaugauagauaacucaucucagaaguccacuucucauggaaaguauagcagaaaagaauaauuggcagaaauauucuuauaagaauucagaaauaguacuuccugacaauacuaucagaggcaauauugaaauuauaagugcuuggaauugacuguugcuagcuuucuauagauagaaagguuguuuauaagaaaauagcaauaaucuaaaguuauugaguauaauugccuuuggguucuuuauuuaaacuuuccucagcaguuuuauacuuccuacauuuugguaguuggaaaggaagugccauuuuaccuuacuuugccuuucauuguagcccugguuuuuuucuuuuuucuuuuuuguuuguuuggcuuuuuuuuuuuuuuuuuuuuuuuuaagaaugauuuaggcuuguguaauggucaugaccuccuguauacaaucagacucugcagacugucagcuaaauuuaaauguuuuuuuaauguuuuaaugauaauggaauuuaaucacuaaauauuuuaaccaaaaugcugaaagaauuuugccuuaaaauggcauauuugauugcauuuuuguuuuuaaaaauuggcaugguagugcugcuuucuuuaaaagcaugccauuuuggucacagaucugacccuucugaguacugugacaacauacagauggaauguuaaauuggaagaaaguuaggcagaggugguaucuccauccuguguagauuaugcauguuuucuuacagaaugucguucuaacucccaggggcagucugcagcaaaacgacaaggaaaauuuaaaaagguacugauugucaguucuuaaaaacgaugucuuaaagccuuauuuacauaguuauuaaacuuuuuucucucacuauuauaaaucuuuauuuuuaaagaaucucucccuuaguuuccuuucuuuauauucugcaguauaguucucuuaguuaauaccuacaagcaguauugacauagugucuuucugaaaaaggcuuuuuaaaccauacccuaugguuuauuuuccauauuuauggaauauggaaaccauauuuauuaaaccauauuuuccaaugguauggaugauuuuuauugcuucucauuuguugguauagauaagauaucaaauuuaaaaguuugaaguuuugcauauccaaagucauaaagagaugaaugcaauggagagcaaagucauuauuuuuaaaaucuaggacugacaagaugacucgauggguaaagguaccugcugacaagucuaacaaccugagucucaucuccaggacucacaugauggaaagagaguuguauucugaccucucuauguauaccauggcacucaccuguguauacacacacacacacacacacacacacacacacacacacacuaaauaaauaaauaaauauuugaaauuugagaaaaauguaaaaaaaaaacaaacuucuauauguguaccauggcgcucaccuguauauacacacacacucaauaaauaaauaaaaauuugaaauuugaggaaaauguaaaaaaaaccuuaaacucuaaaagccauuuuaaguaaaaugauuuuguuaauaaacuagucucugcucuugcaucuauccuaguuaugggaggacagauacaaaaaauagugaauaagaacuucuaacuaaauaaaaguugagucuguaauaaaaauacagacagauuugaugcuaugaguauugauucuacuugauuucuguuaacauaugagagucuguauugacugcuggacccccauuuaacuugaagaucucuacuccgaguacagagaaagggauacauuugaggaagagccauucaguggccuauuuauccaagagguauuguaauagaagaaacaguuguguuuuauaguauugaaauguuguccacaauguuuuuuuuguguguguauugauaagcucugguucaccaugaaaaaucuucuaguuaacaaacugaagaugaguauuucucagaugguuugauuugacccauuugugcacaaucauaauccauuuaauagaucauaacugagcauuuaaaaaaucuuauuuaaugcauugauaugugccucugaguugccaugaagacaguuuuaaaaagguuugccaggaacucaacuacaaaaggaagcauauuucaguaagguuuaggcauugcuuuucuuccacuuguauuuuuuaguuggccuacaaagucuugggcuaagguuguacaagguauaauagauaauacugaagugugagauuauuauuacuggaagcugaauaaagcuuguguaacaaacuuggaaucuagaauuacuucuguccaucccuuccucucaguacaaguacauggcauaguacagcucuuuuauaaaaaacaaauacaaaguuacaaagagaaauacuuacacauauaauauaaaauaauuuagauacuuucaauaaaccauaauugcaccagugauauuaaucuuuaaaauaguugagcuuuuauaaaucuuuuaguuucauaacuaaauuaauaauugaagcacucaagaaacagccuuuugaaccagaucuaagugauguguuaugcuguccacugggcaguuacugauuuuacagguagcauugcuucugaaaaauauucucaguuugaacacuguugaaaucuuuauggauggcuuacaaagacuuuuuuuucuucuucaauuuuaauacuaaguuucuuuuauugagaacuccauagcuuuucuucuaugaguauucuugaauaucuuuuuuaaaacaucacagucguucaugauuuaagguacaaaaucauuaguauuaaauuaacuauauauuggucccuuaagugaguugaaaaaaaaauuauuagagagugugaucauggugacacaaucuaaaacaacucucauuuuccuuuugauuaggguuuauaaauacugcauuuauaauuuugauaauagaaaauucuugugaaguauuuuuauaauguuuuacuauauuuuaauuguacugguuauugauuuuuuucuaagaucauaaacuuuuuaaacucauuuuuaaugauaguucaagcuugcuauaauaggauuuuauauuuucuuaggugguaccuuuuauccuacauuaacauauuacucauauuaaauucuauuuuccguuuuccauacuaaaacaguaauaaaacaugccuuaucuuugaaauucagaggagaaaaugccuuccaaaacauagguuucucuauguggaaguguuucccacuuucuagccugcuaaaugaauagggacugucaggcaaguggugauuuauagucuguauaucaugcugugugaagaacuugauuccaaaagugauaaaacuauauuuauaguaaauguuggagacuccuuauauccuccuacuuagacaguugugaagcugcuuucuugagaauuugauacuauagggucagguuuuucaaauaccuuuuacuuuguuuggggcaauacccacucaagaaagcaaucugcaagcaagcaguggagaagaaaaagagcugagcaugguggagcaugcccauaauuccagcacuaucagaguuugggaggaaggacucugagacaaaaucaugaauucagagucaacauggcuucuauugcauguccuagagcuggucucaggaauagaaacaggagugguguugaggaaagaaggaaugguuagguggcaggguccuaaagaagcaagcccaacaguagaccuguuucuuuuucuagucuuggaucuugugugaguuuuucuucuugggcuuuggcucccuuacccagagaauauaacagugggcugcagauaaauuucuagggcuuucucauuucuguuuucugcuuuuuaaaugggucaugaagauauggugguguuuauuuuauagugaauuaauaauaaagcuacaacagucauuccucauauacuauuguaucauuuuauaccccagaauugaguaucagauaguguuaaaauagaugucuugcuuacacauaaaaguccaauuugugggucucauguuuuucugaaauaaugucaaaaggguaguauauaucccuuugguaauauguuuguucuaauguuagaaacuucauuaaaauaaauguagauauuaacuuagcagcauuuuaauauaaacuugaaaacagaauuugaaaauuaaugacuuacuugaggacaaucaguuuguugcuagaaauuaagucuaagcauuggucaauauuucccaagcgauguauguuuauaggaaagauuuauacuccauagacaaaguaaucagcuaccuuuuuucugccaucuucaaagcagaacguucucagaguuguaggcuuauucuccucuucucuguaucuuuaguuuuugucucaggauaguacucuugccaaggugauuagcaggcuccuugcagccaagucucuucuacauuauucaccaucuuccaucugguuuagcaguugaucaccccauucuuucguuuguuugaaacucauuuauuuauucugugugaggaguggaggagaaaaagaaaagaaaaggaaagguaaggauggcaggaaggaagucaguuuucuccuucuauuagguaaggccaggaaucagauucagguuuucaugcucagcaccaagcaccuucccugucucagacaucuugccauccuuacugauucuuucugcauggacauccucaaggauuucaaaaacccacauuccuuuugguuguuccugucuuagagcaucuuugggccaagcaauaauaccagaucuacucuauucuauucucuuacuucuguuagccuuauucaugucaugacuguaagcacuauuggcaaacauucuuagcucugccuucaaagaauaucuguucauuuucuuuuguuuucucaacuuauuauuuaguuccacacaauguagggaguccuaggcuuguuugcugguuuguuuuccuaccucuacuuuucuauagucuguucucaagacuuauaccaucaacaguuauaaaacauagcccaauuuuuaacauauauauaagaucaaaucauuaaaaagcaaagucuuuaaucacugccuuacauaaaauauuugauaggcuucuuuauagauuucaaauaggaucuacauuuuuaaccauguccuaucaaacucucugugccuguagcccccuuucuugguuuauauaacuuuucauauacuggguucagguuuuuguacuuguucaguuucuacuccuaggcuaacucuuggggaggggcuuuucaucucuucagcuagguaauucaaauguauucauuuaucuucgcugaccuuuccauuaccacuuuguuugcaugguuuuccuaucuuacccaacagucacuguguguccuuuauugauucauuuuuguguauuauaugucacuaucagaaauuauuuacuuguguguuugucagacuaacucuagguagaacauguauuuauaaauaaguaugugucuucucugcccucuuacuaagaaaaaaaaucuuauuuuaguuuuaacuuguuuucuucuguucagcuuuaauugugaaaguacaagguacacuguaauuaaggugucaaguacaacuaagaaugagaaagacacucauagagaaaaauucuuaccucuuuuauuuuaauggaauggauuaaaacuucaguguuuuuaagguucagagggaaaacucuaguaauuacagauugguauucuuuauauuuuugaccuuucagauuuggaauauaauucaggcaggcacaauccauguuacaaaacucuuagcuuuugacaaugauuuuuaaagugugugaaaugaaguguauuaaccuaaaacuuucuuucaccuuccuaggaugugaucccuguucauuacuaucucauaccuccaccaacaaagauuaagaauggcagcaaagauaaagaaaaggauucagaaaaagagaaagacuugaaagaagaguuuacugaagcauuacgcgaucucaaaauucaguggaugaccaaguaggucauuuuaguggauuccaagacauuaucuucuuuugacuuagcuucauuguaccauuacuuacuuacccugcacagauucuuauuguuugcugggggcuuagguccagccuaaagaccuuauauguucucccuccaucaaaagugcucagcucauaagcugggaaaauaacucaggaguuaagagcauacacugcucuuccaacagaccaaaguuuggaucccaacacuauauuaggcagaucaaaacuaccuggaacuccaacucuguauauauauauuuugaccccccucuucuggcuucuguggacacccaaauacauaugauagacauccacacaaacacaagagcauugugaguucccacugagccaugucuccagcccaugucaaugccuaguuucaucuaaauguuuuauaggacucuuaacugaaguaauuuucagguagauauauuauguguaacuagucccuauaauaauuauaacuuacauuauaagauauuuuaaugacuacaacuguaaagcaauguuuacauuuauuuuuaaccaaaauuugcuuguaauugaaaauuacuaauaagacucuuuuacauaggcuugauucuacugacauuuacaaugaauugaaagaaacauauccugcuuaccuuccuuuguauguugcacgucuucaucaacuggaugcugaaaagguuagauauaguaguuuuuuacuaauucgcuuuuuguacaauaguagcuaaaguguguaauuuugaguaaagguauaucucuuucugucuucuuuuucugccuacugaaaauuaaucucuuccacuugauaugccauugagauaaugauaagaacuggccacuccugaguucaguuuugguaaugaagugcagcaugcauauguaauaaugauguaaugacgggacuugaaugguuaauacaggaaaaaguauaaggucugauuugaugaguuguccugggcaaguggaaaucuaagcacugucaguaacuacuuuguuacgaaaauuuuuauaauuccagguugucuaauguggaccauaggcuagcuguuguuacucuuaauggaaguuggaacaugccaaaaucaugaagauuuagagugaauuaaaauagaauauuuaaaggaggucucucaaaagcaguuugacaaaagggaaaauaacuaaacuauugaagaugguuauaguuaaguaagagucuugguuauaauccucuuaucuuucuuauuuuaaugauuauuagcuuggaaaugaggauuugggggaauuuuacuuucugcuuuuuugugugacaaggcauaaaauagagauuguuaucucuaaaaucuuaaugauaugauagaaaggcacuuuccuuguuuaaaaauaagucauuuugguaaacuuuauauauuuguuuuauuuugaguucugaacuacagacuuaaguuagguauuguuaccccucagccuguuucccaggaauacuggaaaugguaaaagucacaucagaagauaguacagacaugcaguuucacggcugggacaguagaaauaaaaauauuucaaugcacuauuuuauacacuucuuuuuuuucuacccaggaacgaaugaaaagacuuaaugaaauuguugaugcugccaaugcuguuauuucucacaucgaucaaaccgcucuugcaguuuacauugcaaugaagacugaccccaggccugaugcagcuacuauaaaaaaguaccuaaccaguaaauaaucuuucuugcaucucauucuuaguuauuuguuuuuaauaauuagggacuaguauuaaaaauuuuuuuuaauuauuagguauuuuccucauuuacauuucuaaugcuaucccaaaagucccccauacccuccccccccacacuccccuacccacccacucccacuuuuuggcccuggcauuccccuguacuggggcauauaaaguuugcaaguccaaugagccucucuuuccagugauggccgacuaggccaucuuuuugauacauaugcagcuagagucaagagcuccgggguacugguuaguucauaauguuguuccaccuauaggguugcagaucccuuuagcuccuuggcuacuuccucuagcuccuccauugggagcccugugauccauccauuagcugacugugagcauccacuucuguguuugcuaggccccggcauagucucacaagagacagcuauaucaggguccuuucgauaaaaucuugcuaguguaugcaacggugucagcguuuggaggcuuauuaugggauggauucccggauauggcagucucuagaugguccauccuuuugucucagcuccaaacuuuaucucuguaacuccuuccauggguguuuuguucccaauucuaagaaggggcaaaguguccacacuuuggucuucguuuuucuugaguuucauguguuuugcaaauuguaaauuauaucuuggguauucuaaguuucugggcuaauauccacuuaucagugaguaccuaucauuugaguucuuuugugauuggguuaccucacucaagauaaugcccuccagguccaaccauuugcuagaaauuucauaaauucauucuuuuuaauagcugaguaguccuccauuguguaaauguaccacauuuucuguauccauuccucuguugagggacaucuggguucuuuccagcuucuggcuauuauaaauaaggcugcuaugaacauaguggagaaugugucuuucuaaagauuuuuuuauuucuuuuaaaacauacaguuaggauugacaguuuuuuccaacucccucagaaauuucauaaauuucuucagcuuuuuaaaacccagcacaagaaaauaacucaugcucagccuuugguuggugguuuaguuucugugagccccgaugacuccagguuaguuggcugucuugugguguccuugacaccuccaacuugcucaguccucuuccccaacaacucaugaugauuagauagggcucgcugcauguuuuccauuggcugcuggauaaaccaucucaggagacucugcaagcauagcagacuauuaguuuuaauguuguggcuaggcucuuucccaugggauggguuucaaguugggccagccauugguuggccauucccuuaaauucugcuccaucuauaucccugcacaucuuguaggcaggauaaauuuuggguugaagguuuuguggguggguuggagucccccuccauccacuggaagucuuagaagugaccaaccacuacagucuucauguccccagcugguaggagucucagauagggauacuccuauagacuccugggagcuuccuuguuccagauuucauuccagagauguccaccauucaccgauuuacauucucucucccauuccccaaacuuccacaaugcucuggagaccuguuccccaacccaugccguccacccaguucccuugcuucuuccaccuccauagccuauuuuauuuccucuucugagugagagucagucauccucccuauuacuuaaucucuuugggucuauggauuguauaacaugguuacccugcacuuuauagcuaauguccacuuauaagugaguacauaccauguuugucuuucugggucuggguuacgucacucagggugauauuuuccaguuccauguauuugcuugcaaauuucaugcuguaguuguuuuuaguagcugagaaguaguccauucuucauuugagggacgucuagguuucuugcuauugcaaaugcagcugcugugaacacaguugaguaauuguccuuguuguaugguaucuuuuggguauugcugagggggaauauaacuggcucuagagguagaauuagucccaguuuuuugagaaacugccaaauugauuuccaaugcaguuguacaaauuuguacucccaauaacaaugggggaguauucucuuugcuucacaauuucaccagcaugugaugucaugucacuugaguuuuuaaucuuagccauucugacagguauaaaaugaucucaagagucauuuugauuuccauucuccucaugauuaaggacguugaacauuucuuuaagugcuuuucuuuguagagaacucuguuuaguuuuguacuuuauuuuuuaauugagcuauuuggauuguugaugucuaaguugaguuuuuaguauauuuuuuagucaucugucagaucuuuucccauucuguaggcugcaguucugucuuauugaugguguccuuagccuugcaaaccccuuucaauuucaugagguuaauucaguuaauuuaguuuuucuuagugucugagccaggaaauugucuccugucccaaugaguucaaggcaguuccgcacuuuaucuucuguuagauuuaguguaugugguuuuaugguuaagucuuugauccauuuggacuugaguuuugugcagggaaauaaguaugguucuauuugcauucuucuacaugcagacauccaguuauaacagcaguauuuguugaagaugcuuucuuuuuuuauauuguaugguuuuggcuuucucaaauauuaagugucuguugguguuuggguuuauuucugcaccuucaauuguauuacguugaucaaccugucuguuauuaugucacaugauuuuuauuacuguugcuguguaauacagcuuuaagucaggaauagugaugccuccagaaauucuuuuguuguacaguauuguuuuaacuauccuggguguuuuuuuuuuuuuuuucuauaugaaguugagauugcucuuucaaggucucuaaagaauugaguuggaauuuugggaggaauugagucuguagacugcuuuugguaagaccgauguuuauucuguuaguccugcagggaaugagcaugagagaucuuucaaucuucugagauuuucuuuuuuagagacuuaaaguucuucucauacaggucuuucacuugcuugguuagaguuuacaucgagauauuuuuauagucuuuaugacuacuguaaagcaugucgcuucccuaauuucucccuuggccuguuuaucauuuguaugaaggagugaaggcuaaugauugugugugugugugugugucugucugucugucugucuguauguauguguguauguguaugaaggagugagggcuacugauugugugugugccacuucacugaagguguuuaucagcuaggaguccucugguagaauuucugaggucccguauguauaccaucuuauuaucugggacuaucuguacuuugacuuauuccuuuccaauuuguauccucuucaugucuuuuagcugauuuauugcucuagcuagaacaucaaguacuauauugaauagguagggacagaguggacaacuugucccugauuuuaguggaauugauuuuaaguuucucuccaguuaauuugauguuggcuacuagcuucauuuuguuugcuucauuuugccuuuauuauguuuagguuuguuccuuagguccccugaucucuccaaaacuuuuaacaugaagggguauuguauuuugucaaagcagucugauaagaugaucaugugauuuuaaucuuucaguuuguuuauaugguggauuacauagauggauuuuuguauauugaaccaccccugcaucccugggaaaaaaacauaauugaucguggugaaugauaguuuggaugugaccuuggagucaguuugcaaguauucaguuuauuauuuuugcaucuauguccauaagcaaaauuggucugagguucucuuucuuuguugacucuuugugugguuaagguaucaagaguaacuguggccucauagaaugaauuugguaguguucuuuuguuucuauuuugugcaauaguuugaggaguauuggcauuaacucgucuuugaaagucugguagaauucugcacuuggaaccgucugucccuguccuuucuuuugguuggcagguuuuuagugacugcuuguauuuccuuaaggguuauuggacuguuuugauaaguuucccugaucuugguuuaacuuugguacauguucugaaaaucaucuauuacaucuagauuuuccaguuuuguugaauauaggcuuuuguaguaggaucugauaauuuuuuuaauuucuuaaguuucuauuguuaugucuucauuuucauuucugaguuccucuaguuagucucugugcccucuaguuaaucuggauaaagguuuaucuaucuugaauuucucaaagaaccagcuuuuguugauucuuuauauuauuuucuuuguuccuaauugacugauuuuuagcccugaguuuagcuauuuacugcccuuaacuccucuuggguauauuugcuucuuuuuguucuagagcuuucaggugugcuuuuaaguuauaaaggcacugagugguaagauaguuuuuuuuuuuuuuuccucuuaagacugcuuucauugugacucauaaguuggguaugcugugccuucauuuucauugaauucuagaacgucuuuaauuucuuuauuucuucccugaccaaguuuucauugacuacagaguuuaugggcuuucuguuguuucuguuuuuauugaaguccagccuuaguccauggugaucugauaggauucaagggauuauuucagacuuccuguaucuguugagguuugcuuugugucugauuauaugugucaguuuugaaaaagguugggcaaggugcugagaagaagguaucuuguuuugguuuuggguuaaauguucuguagauaucuguuaaaucaacuuggcucauaacauguuaguuucauugcaucucuguuucguuucuguuucgaugaccuacccauuaguaagagacagauguugaagucucucacuauugcuugggguucaauguguguuuugagcucuaguuaaguuucuuuuacgaauguugguucccuugcauuuggguauaaauguucagaauugagacuucauugugguggauuuuuuuccuuugaugaguaugaaguguccuuccccaccucuuuuguugacuuuugguugaaagucuauuuuauuggcuaucagaauggcuaucccagcuuguuucuugagaccauuugcauuggaaacuuuuguccaauccuuuacucugagguagugacuaucuucuuuguugcugaaguguguuucuuguaugcagcagaaugauggauccuguuuauguaucuagucugucuguuagccuguguuguuuuauuggggaauugaguuaauugaucuugagacauauuaaugccauauuuuguuguuggaggugguagucucuguguguguguguguguguguguguguguguguguguguuccucuucuuuuggguuuguggugagauaguuaauuuugugugcuuucauggguguuguuaaccuucuuguguuggaguacuuccuucuaguauccucuguagggcuggauuuauaaaaagauauuguuuaaauuuaguuuuaguuuuguuauggaguuucuugguuucuccaucuauggcaauugagaguuuugcagggcauaguauccuguggucucuuagggucuacaagacaucuguccaggaucuucuugguuuuagauucucuguugagaagucagguauaauucugauggucugccuuuguguguuacuuggccuuucucccuuacagcuuuugauauucuuucuuuguucuguacauuuaguguuuugauuauuauguggugagaggauuuucuucuuuucugauccaaucuauuugguguucugaaggcuucuuguacaguuuaugcccaucucuuucuuuagguuagggaaguuuucuucuaugauuuuguugaagauguuuucuggcccuuugaagugggaauccccucccucuucuauuccuguuauucuuaaguuuggucuuuucagugucccaaauuuccuggauguaucugcacuaggaacuuggcaguuuuuugaccgaugugucaauaucuucuguguaucuuauaugccugugaugcucucuuccaucucuuguauucuguuaguuagugaugcuuuugcuauaguuugcauugccuuuccuagguuuuccagcuccaggguugccuuccuuugugauuucuuuauuguuucuauuuccauuuuuaggucuuguaccauuuuguuuugguuguauuuccuguguuuaauuaagggauuuguuuccucuuuaagggcuucuaacuuuugccuguguuuuccuauaugucuuuaauggguuuauucauuuccucuuuaaaggcuuucuuucuaagacuugauuuaaguucaucccuugugcuuccauuguguuggugccauauggccuuggcucuuguugguuguguucuuacccugacuuagccaucugguuguccuaguugguccuauguuccugaugccagcaauacuccucauggaguuggggagagccauggaccuguaucuuccuggguccucgcaugccucuucaggaugguagacaggcucuuaggccagacauuggaggucaggguacugagugccguucaauguuuguuggcucuaccccagguaaaccagguagucagggaauuguugggagggcgcuccacuuuuuuuuuuuuuuuaaauggaaagacuuaacugcccuucuuaaaauuuguguagcuggcauaacaacugaauaauccuucaacucugacauucuccuuuaaccaaguacaauugccuuaacugauuucaucucuauauaugauaagccuuaugauacuaauaacaaugucuuuugauguauaacacaauuuuguuacacaucauggauguuaauuuuguuacacaauauggauauauaaaauuuaugcaugguaaguuuuagagaaaagaaugucuauacuucaaguaaaaucauccuuuggaaaacauuuaacuaacgugugaaaaaaaauuuuuauuugcucuccagugauauggacaagcagaaauccacccugauagaugcccucugcaggaaaggaugugcccuggcagaucaccuucuucauacacagccucacgacggggcagcagcuggagaugcugaagcaaaggaagaagaaggagaaaguaccauggaaucucuaucggaaaccuauugggaaacuacaaaguggacagaucuuuuugacacuaagguaacucacccuucugcuauuggucuugguagugaucuuucauuccuucuugugcucugucugccaaagaggaugaagaugagucuccacucucaagaagaugcaguuuaaccaaguaccuugcauuuguccaaacuguuuuaaaguguucaacaaugauuuugaaaacaauuuugaugauauucauaguagccuuuuaagauauauauaugaucuucuagaaaguuguccuuuuucuucccuaaauuuuuuaauguuaauucugagggugaaauaugcucuuuagauauuauuuuccugaaaacucugaacucuguaacuucuauaugucuccguuuuuagccaccaguuuuaaacaaauguuuggaaaagcaaguugaaacucuuuggauuuggguuuuuaaaaaauacauuuacugucguuugucuuuuuuuuuuaagcuguauuuacucauauaugugcguacacuguugcuuugucacaaguuacugaacauugaugccuauuucuuaccuguaaguuaugaguauauauuaaguuaauggaaaguccuuggucguauugaugguauugcuguuaauuguuaacaguuauugaaggucuacucuuuucuaaauacugcuuccuccuugaaauagaaauaacuagucucugucuuugagaacuguaacaaggugguaaauacuuauaaucaccauagugagauuguuacacauacuucugucuucauagugacacugcugaccauggguaaugcacuacaguacugaucuguuuacccuguuaauugaacauuuuuuaauacaugucuuggcccuaaaggaacaaauuaguauaacagaauuucuuucuuugaagauaguuuccagacucugcaguucaggcaaaacauagaaacagugugacagaaagauauguuuauguaaaacauguccuuuaaaaauuuaaugauugguguuguccauuuuuauuucuacuguuuguuuucuguaauuauguaaacuaugguuuauuuugcacaaaguaaugguuuaaaguagauuuuaguagcguauguaauuauuugcccauaaaagaugccuuuuuaaauuuuucugauacaacauacucagauuaaaagcuauacuuucagaggcuggggagauggcucacucaguaaauugccugccacaaaaguaugaggacgugaguucaaucccuugcaccaacguaaaagaaaagccaagcacuaugacgugcacccauaauuccagagcugcugcagcaguauuggaaugaucugugggaccaccacucuggccaaaccaaccuuaauaagguuucgcaauuaagaaagagaccuuguacugauuucuggccucuacauacacaugugugcccacacacaaaaaacuauacuucugugaaagccucauuucauuguuaaagccauaugccuuaaaauguauguaugccauaaauaaucucuauuuuauuuuauagguuuugauauuugcauacaagcaugcauuaguaaauaagauguaugggagaggccuuaaguuugcaaccaaacucguagaagaaaaaccaacaaaagaaaacuggaaaaauuguauucaaguaaguaauuauacuguauauuacuuccauacuguguagugacuagaacacuggggggggggggggggccggggggaccugugugcauuauaaaaaaaauacuuauucuacuguggucuguuguuaccauuacuaaaccaguuucaaaauuacuuucuguaguuagaugauguuuucucuuuugaaggaagaagcauuccuucuuaauguauguugcauugguucuaaaaucauugaauuuguggaguuaauauuuucuuuuuugucugagaugauuucuaacuuuauuaauuuaccauauauugcauaugcaaaggaaaacuaguuggaucuuuuucugugaguuagcuugagauaugaaggaaauuauuuuaaugccaucuuguuuucugucuauguucaucacucaguacaaaugguaagacaguuuaaguccuuugggucuugauuagauuaaagaaccucuuucuggaguuuguguccuaugaaaaagauuguguuuuguuaggaaggguuaggaaggauauucaguggguagauauacuaaugaaugauagccuaauagaaggaaaauuuauguucauugugacuguuacuauuaaauuauucugaaauuuggguuugggaccugucacguucuuuacuaacucuuucuuucauuauagcucaugaaauuacuuggauggacccacugugcaucuuuuacugaaaacuggcuccccaucauguauccuccugauuauuguguauucuaaaauaagaaccaaaacuuuacauuucaaaacagaaaauuuuauagugaauggauauaugaagaauuguguggcauuuuuagucugacuaaugcauguuuucaucuaccauucaauacugaucauuaaaacuauauguauuuaucagagaacucaguggcguguggcuuaauacauguaauacagaccucugacaucaugcugcuuuccuacugccuccgacacucggcaaguagagagcacucccugccugccagccccaccugaguuggaugcagcugcacacugcaugagagguuuucauguuuuaauuuuagcuguaaaaugucauccuguuuuuuauuuuauaaaucacaaagguuaaaacaugcuaaauuuuuccaauuauauagaggccuuaaaaaugcuacauuagguguagcuaaauuauuuauuugacuaaaaaauaugggaacauaauuuccagacuuuuuuucuaaaaauaaauucaauuaguggggaugguggggggcauaaacaaauggcaacugggaaaagaaacauguuaaggaaaucuccauaaggagucauaacaaaaacaagguguuuuuagagcacccucaauuacauagcaucagaaugaguuaaaauuucuuguguuggugacagacagcugaaucuaucugguuuuguaaagaaauacacaguauguuuauaacauugaaaucauguaaaauacaugaauaaacgugcaaaaccacaggcacaguacaccauaugcacucugauaccuuauuuuuuuuuuauaaauaaaaguaaauauuaaagcuauucacaauuggucuuaauuuuucauaaaguuugggguuagaacacagacuuaauuuauuacaucuguagaccaaaaagugaggugauuuauuuuauaauguuuccuauggguuugcaguuauuugaauauauuuccagugcucaacaugugguuaagucuuauauauguuuaauuuguguguguguguguuuuuuugugagaucuuuguuucuucauuuacugcuauaaaagaucuaguuaaucuugu

SEQ ID NO: 147 - RNA, 33549 nt, Mus musculus
agguuucaucguuuggucagcgggagaaaucacucgcgaccggaggaaggcucggcgcuggcgucaccggugcugcuucucaguacuuuuaggcgugccaguacuggggcugaaaccuuucugcuccucccaccacauuuaaauuccgcuguucuuucgggagaccggguccgcuccggaagugcgucagcgccguguuccuccuucaagcccuggugacagcggguuccaggcggagagcggugggcucugcgugaguugguggcgcugcgugcuggugcggggcgcguccuuuauccuaacgggaaacaaaggccccgcgagcccggccgagagagagcgccugcgccaugggagugcaggggcuguggaagcugcuggagugcucgggccaccgggucagcccggaggcgcuggagggcaaggugcuggccguggguauccuucaaggcggcuccggagcgccggaugagcgccugcucggcgacugggcuucguccgggacuuggugcugggggucgauugggugucugucuaucuagagugcaggccugcgcuccuuaggccggcccauuuugugcccccuaugcuuuaguucucacagcagaguggcuacagaguugucgcggagaauaaggagauuuaaaugauaaaauuugguauagcgucaggcuccguaguacuguacaucugagaagucauucugucagaguagagggggggaaaaaaaagaagaguuccgaacccucccacccuccuuuuugaauaguuaccucuuguuuguuggaauaaaaaaaguucauacgguguauagugaauuaguuuccuccagcuucugugaugggugugugcauuuuaguuuugugucauuggaguuuuguuuuucucccacuuugaaaaugugauaccaauuuugaaguuuuguuuacguuuaucuguuccacggcccguuucacagugccucuuuuaucuuagaagguacuuuuacauaguuuucuuaaugaaaacuagaaauuccuguaaauaguugcugaaugugcguacaugccuggacguguguccguaggugguggcaugccaugccauucuguaaacuaugucaguucuucacgaugugcccagcuuauaauuaauggagaacuugcaguuuugaaaaaucacauuuuaugccaaauacaucaaugacaaaaauuaaaaauuugucuuacaagucuuugcacaggguaccauaaacccuagugguuucucggcgucacugcuguuuaaggauuucuucauuauuuaugauggaagaacaauuuuuagugaggggguucuuaaauucucaucaaaggguuuuaguagugguagagcacuuucuuaguauguaugauaaaccagaguuccauucacaucuuugugagaaaguauugcugacaacaccaucaaggaguuacguuauuuucucuuccagcccuuauaaacaauuaggaaguuaagcauccuagcauucaggguugucaaaugaaaaguaauccauguagauuauucauaaauggcuguguuccauuuggggugugaaguuauguuuaugagguuauuaagcucuucugaaauaauggaucguuuaaagaaaaucgugagggauuuugccuacacucacauguaaucugguuacuucuguaauuuaauuuucuguguuucaucaugagaauucugauaucugaaauuuagguguuagaaauuuauucgguuugcuaauaaauaaaucauccacaauuaucucagguuuguaauuuacauacuuuuccaaauaaacuguuuggguuuuagaccaugugaauagcugaguguauuauuuaaacaguuuaugucugugucaaaaaaauguuaggaaauaacagauuaguuuuuccucauuauugaccuuaacaucuguuagugcauuggcaguauuaagcagauaguacccucacuggacacaugaacaacauggauuaacuuagucuccagucaccuaauuccaggacuaaggaaaauucccauuuauuuucagauguuauugguucuuugaguuuaaauucuaaagcaaguuuugacuuugccuuugcuucauucuuuaauucuucuaacccuugaggaguuuaguuuugccacauuuguguugaagcuugacuaaucaaacuguguaaauucuuucagccuaucugauuuuaucuguuuuuuuuuuuguuuuuuguuuuuuguuuuuuuuuaacuaagaguuucauguuggaacucucggccuuccaugagaagugguaagcugugguuaauuuaaaugugaaaaggaauuauuucagugugauuuaguguuuuaggaacaugggguuuaaucuuuucucagaagcuguaggcccuagacucauauauaugaguuaagagguaucuuaacucugaaauugaguuuucucaauucuaaagucaaaagugauugauuguauagacacuuuugauggcaguguagcaagcagaaauggaccaaguaugaguagcuguccagaguagaacugagacugcagaaggcuugcucuaagcuggauccuggaccugaucacucaugucugagaccuaccaucacuaucaucuccuuucaugugggcugcuggaacauucuuuuuuuuuuuuuuuuguuauauggauuuucauacuucuucuuucuuguauuagauauuuucuuuauauacauuucaaaugcuauccugaaaguucccuauacccuccccuacugcuguaacauucuuaaaacuacucuccuugcaguugauuuuuacaugucuccuaaggcccgaagucauucuggaaacugcucagauguguauauuguauaucagcuuccauacccaagugccccaccccugcgcccaccacagggaacuguguagacguggcucugcccuaggcguuuguauuugcugcgucucgucucccuucuguaacuagagugcuaaacucauaacuacucuccugaccuauuauuucuuggcacuuaaugugucaauucuuuuaggauaugugcaucucagacauaggggugcauuugucuugcucacaaauacaauguuuaauguaucuccguagggucuuggauuuacuuuuacaugggagcucuuuaacauauagggauggagauacacacacacacacacacacacacacacacacacacacacacacacauauugucaacuuggcauggcaugagagucaucaagagucaauugagaaaauuccuuuggaagaccaagcaagacuauagggcuuuuccuaauuagccauuaaugggagagggcccagccaauuguggauggugccaccccugggcuuguguccuggguucuauaagcaggcaagcugaguaagccaugaggagcaagcagcuaagcagcuccuguacccaaguuccugcucucuuggagucgcugccuugauuuuccucagugauggacugugauguggauguguaagccaaauaaacuccccaguuugcuuuugguuaugguguuuuaucauagcaaguagaaauccuaagauauuggcuuaaaacacaaaauacacuagcaacuuuugcaguaguaaaugaauaacuguacauuaauuuuuauuuauuuauuuucccuuaauuuuuuuauuauuuaaaugcauuuuauacaucaaccauauuaauaauauugaguauuuuuauaauacauaaaaauguucaacuuuuauauucauauccuuucaaacccuaacaauaucauuaaugaauacuuaauacuauccauaacugaggauccuauuaaauacuaaauuguuucaaagcauacaaaauauucuuugggaguuaagcaugguaaaagagcauaaaauauugaaaaugaaucauuaagaaauauauucaaaagcccuuauuugauaccaccugacauagugagagaguauuuaaacugcauuauauaucuguauacauugucuaacagucaguuuauuuaaaaaagauuaucuauuuuucuaggagagaaauuauuuuaucaguauauuuuaaaauuuucaaacuagcaaaaacccuuugaaguuaaacauuaaaaaaugccaauuucaagcacagugagaaaaguuaucaacaauauuuccaugauguuagagaacgugauuuuaauauuuucaacuguuaauauucaacaaacagaguaauuauuuuaagauauauuucauuguuaugucucccuuuucauuucugauuuuauuaauuuggauacugucucugugcuuucugguuagucuggcuaaagguuaucuaucuuguugacuuucucaaagaaccagguccugguuuuguugauucuuuuaguucuuuuuguuucuguuugguugauuucagccuagaguuugauuauuuccugcucccuacucuuuuuggcuauauuuguuucuuuuuguucuacagcuuucagguauacugucaagcuguuaguguaaacuuucuucaguuuauuuuggagccacuuagagcuaugaguuuuucucuuaccauugcuuucauugugucccauaaguuuugguaugauaugucuucauuuucauuacauucuaaaaagccuuuaauuucuuucuuuauuucuuccuugaccaaguuaucauugaguaaaauguucagguuccauguauacgugugcuuucagguauuuuuugguugguauuuaagaccagacuuaguccauguugaucugauaggguacaugggauuauuucaguuuucuuguaucuguugaggccuguuuugugaccaauuuggucgauuuuggagaagguaccaugaggugcugagaagaagguauauucguuugcuuuaggaugaauguucuauaaauaucuguuagacccauuugguucauaacuuuucuuaguuucacugugucucuguuuaguuucuguuuccaugauuuguucauuguugagaguggaguguuaaagucuccuacuauuauuguguggcgugcaaugugugcuuugagcuuuaguaaaguuugucuuauuaaugugggugcccuugcauuuggaacauagauguucagaauugagaguccaucuugguagauuuuuuuuucuuugaucaguaugaaguguccuuccuuaucuuuuuuugauaaauuuugguugaaaguugauuuuauuugauauuagaauggcuacuccagcuuguuuccugggaccacuugcuugaauaauuguuuuccagccuuuuauucucagguagugucugccuuugucacugagguguguuuccucugugcagcaaaaugcuggguccuuccugguuauguauccagucuguuagucuauggcuuuuuggggaaauugaguccauugauguuaagagauauuaaggaaaagugauuguuauuuccuguuauuuuuguuguuagagguggaaucaugucuguguggcuaucuucuuuuggauuuguugaaagauuacuuucuugcuuuuucuaggguguaguuuuccuccuuguguugguguuuuccaucuguuauccuuuguagggcuggauuuauggaaagauauuguguaaauuugguuuugucauggaagaucuugguuuuucuaucuacgguaauugggaguuuggcuggcauuuguguucucuuagggucugggugacaucugcucaggaucuucuagcuuucacagucucuggugagaaguuugguguaauucugauagaucugccuuuauauguuacuugccauuuuccccuuauugcuuuuaauauucuaucuuuauuuagugcauuuguuguucugauuauuaugugucgggaggaauuucuugucugguucagucuauuuggaguucuguggguuucuuguauguucaugggcaucucuuuauguuagggaaguuuucuucuauaauuuuguggaagagauuuacuggcccuuuaaguugggaaucuucacucucuucuauaccuauuauccuuagaauucuucuucucauaguguccuggauuuccuggauguuuuggguuaggagcuuuuuuucuuugauuguugugucaauguuuucuaugguaucuucuccaccugagauucucucucccaucucuuguauucuguuggugaugcuaugacucuugaucucuuuccuagguuuucuaacuccaggguugucuccuuuugugauuucuuuauuguuuuuauuuccauuuuuagauuuuggauaguuuuguuuguuuccuucaccuguuugauuguguuuuucuguaauuuuuuaaaggauuuuuguguuuccucuuuaagggcuucuagcuauuuaccuguguucucuuguauuuuuuugagggaguuauuuauaaccuucuuaaagcccucuaucaucaucaugagaaaugauuuuagaucugaaucuugcuuuucuggugugaugauguauccaggacuugcuauggugggagaauugguuucugaugaugccgaguagccuugguuucuguugcuucuguucuuaagcugauuaucucgagugcuaccugcucuugcuauauaugaccagggccugcucucccugugauccugguugugucagaacuccucagaguucaacugucucugugauccugugauucugggauccuguaauuuugagauccugggugugucagagccccugggagucaagcugccucugggacccugagauccuggugugaccaagcuccugugauccugugguccugugguccugugauccugugauccugugauccugugauccugugauccugugauccugugguccugugguucugugguccugugguccugugguccugugguccugugauccugugguccugugguccugugguccugugauccugugauccugugguccugugguccugugguccugugguccugugguccugugguccugugauccugugauccugugauccugugguccugugguucugugguccugugguccugugguccugugguccugugauccugugguccugugguccugugauccugugguccugugauccugugguccugugguccugugauccugugguccuguaguccugugauccugugguccugugguccugugauccugugauccugugguccuguguuccugugauccugugguccugugguccugugauccugugguccugugguccugugauccugugguccugugguccugugauccugugauccugugguccuguguuccugugauccugugauccugugguccugugauccugugguccugugguccuggguguguuacagcaccugggaguggaguuucuucuggguguugugggacuggcuacagagaacaugcccaaagucugcucagggcacugguucagaccagaaggaccccaugccacuggucaggcggaauuuuugggugcccagguccugcugguuccaguuacuucugguguuggggcugauguguccucuucaccucugauccuaugauccuggggauguuagagugcuugggagugaaucuuccuuuggguguuuuggaacuggccgcaaggucugcucagggaaucagcccagaucggaaggcacauuaauuuuuaaaaguccaaauuuuuuaaacaaauaauacauauuaucuacaauauguuaggccuuauugggggcaggguuguauugcaaacagaauuuguuuagacaaacaagguugcuuacaggcuuggugcucccccuacuggauguuauacuccagaaagguacucuguaaggguucaguguuagaugcucauauuucugccauauaauaauacacaucauauaaguguauaucuggaaguguuaguugaggccaggagaguguacauagcuugcgacucaguaggagagcgugaguugguaugggagaagucuuugguggcaggaaacaguugaaugguuucuaacaggaauguaguggcuuaaaauaugacaauagauaugagcacaggccagaucauuuauagauuuuauuggucaugaaggguuugggcaugguaucuuaaagucaaugggaagcaucaaaaggcucuuguuaaaagagcuuuuugguagggcuggcgagaugguuuauuggcuaagaguacuuacugcucuuccagaggucuugaguucaauucccagcaaccacaugguggcucacaaccauaugggaucugaugcccucuuuuggugugucugaggacagcuagaguguacucauauacauaaaauaaaucuuuuuuuuuuaaguuuuuuuuuuuuuuuuuuuuggcaaaccucacuguacuuccagguguggcaaaccugcaggucacauguaccuauaauagcuaaugagugugaccaaacaaaaucuuuaaauuacuuaaaacauuuugaaaaauucuuuugcuaauuuuuuguuuuugauagguugauuacacaggucuuaggcaugaacuuuguugauaauaauauagugcugcaauauuaaagauuggaugugcuugcaagguagaacuggucucauacuggcuggaugaggaggauacaagaacugauacccagaacugaggccuacaugaaaagcgauucacugaggugggacaggagcagcuuaauggaggaaggcauagaguuugaaugugagugugaaaugccuucaagccgucaaguagauguuugccagguuaucuaggacagggcacggcucuagucuuggagacacguuugcaaggugugguaggugguuugagguagcgacuacaaauggugcagacuggauagaagaaguaggccuaggaaagauuauagcagaaaaguccucuuaagguaaguuacaggaucuggcaaagaggagauucaugcuucggaacaaaugcaaaguauauuaaggggggaaacgcaucuuugaaaaaaauugagaaagaauaaacuaaaagaagagaauauagcgacuuguuuuaggagaguucgcuaccuuaauauggcuggugucuggccaaguuuucugcauuuggcacgcugacuggcuuauagagagaauuacacuguuuaaguuuauaacccauuaacuuuucucuauuaauguuuuguaauguguuuaaugcucucuuuuuggcgguaucauaucuuggauauugaagucuugaggaugaagcugaaaauugccaacuguuuuccuuuacugguucccccagauauuagcauuuggcuaaaccaagcacuuaaaggaguccgagauagccaugggaaugugauagaaaaugcucaucuucucacauuauuccaccggcucugcaaacucuuguuuuuucguauccgcccuauuuuuguauuugauggugaugcuccgcugcuaaagaaacagaccuugguaaguaucaugugauuugauuuucucuuuagacaccauuagcaaauuuuaaaauauuaaauucaguuacaacauuucucccuucccuuuccuuccucuaaaucuuuucauauaucccuccucagucuccuucaaaauccugccaucuuucuccccaguuguuauuguauacauacauguauaugcaucuauuguuaaccauuuguguacgucugccuguaugggccuuuuguuucuuuuguggagauggggaguucaagaaaggguuucugucuagcccuggcaguccuagaacucauuguguagagcauccucgccuccaacucagagauccaccuuccugagugcuggaaucaaagauguaccugucaaccccccagcuuguauguuuucuuuucuuuuuaaaguuauuuuauuuauuuacauccaaauguugccucccuuucuaguucccccuucaagacuucuuuacccuguagcuuguauguuuucaaugagcaguuuugacauguaccugauuuaauuuaaauuguuuuuaaacauuuaucuuuaccagucuucuuucuuucuuuuuuugagacagggucucuauguagcccuggcuggacuguaacucucuauaaaacucaggcuggcucuaaacucacagugauccacuuuucuuugccuccugagugcugcuauuaaagccuugcaccaccaugccaggcuuagaacaguuucucuuuuaaaaacuuuuaugagucuauuauauauguagugcucaaauuuaccucuuaacugagaugaccagaauccugaaagugguuucuuuagaguaucuguuuagguggugcccauuuuguugagcugggcugcuaacugcucauugcggcgccccugcuuaagagauaccuuucugaggauguguuugaguguccuuggugacagggaaacgaaccaaguagagaaggaaucacuagagcaacuguugucccuaauuucagaugauaaauugcuguuaguagaccccacaugcuucauuuucacaggcaaagagaaggcagaggaaggauucugcauccauugacucgagaaaaaccaccgagaaacuucugaaaaccuuucugaagagacaggcucugaaaacugcuuucagaagcucaaggcaagaggaagaccacaguggcugcagacacucauuggacucugcuguucucucuuuuugucucauuuaacaauagguagagucaggagaggagugagcagauagauagcguuggacuuggggaugaggaaucgugacuaaggagaaagaagugcugucguagugcuuccucuuuuaauuaacuaguuuacugauuuauguguuuuuuaagaguugugggaaauggaacacaggacuucacgugugcuguguagguguuguccuaugggguucacugcaacccagcuugacuuugauagagcccuuccugacuguagcuggggcuguggcaaaggcugugagcagcucuacggaguuucgcuuuucuuccacuugguuguugugacaacaguauaggggagacccaggcugggaggggagagccagacaaggaaaagucagccauuguccuugagcaggguuugaauaauaagucagagaagaggauugacccaagaugccuuucuuuuauuuauuuauuguugaccauucuguguguuucccagacaugaagcgccacccagucucacucagguucaaagacaggaugacaucuauguuuugccaccuuuaccagaggaagaaaaacacagguaaaugcuugacuaccaagaaauaucacuuuaggggcuggggaaauggcucaguuuguaaaagacuugacauacaaguaugagaacccaaacucuaugccucgcacccacauaaaaagcugggcauacuugcaucaaaugccuauaaugucagauugggaggucucuaaggcuucuuugacuuauagggguauccuuaccuacacugagauuaucauuuaguggaucugucuucuaggauaacuguccauccauguagaauaucuguguuaaacuccuauuuuuaaaaaguauauauuuaaacuaacauguaaaguacuggcuuucuauaugaaaccuuuuuagauacuuuugauuaucccaccuguacccugaccucugcccuuccuccgccucuacccaugcuuacacuauuaauucucagcaucccucaccuuucauguguuuguacucaugcugauucuccuuacuuuuuagcuuccuuucaucucucucacugccuagcuaaauuaccauucacaauggccuuguugcuagacauguugacacuuagaucuucucaguguacuuggcucugugcccauauggcuaccaugucaugcugaccugcguuccugguaccuuccuacuugauccuuuccaguguuuccaugagucucugcuggcgguuaguccucaaggugucuguuuaaagaauuggcggaccagaaguuuagacaguuuuucuuuccccuccugccucucagucucuguaguggcucccugcccucuucuuucucuacauuguugugcuuacucucuccucucagacaucucaguagugcuaaaauuuauuucuguuucauccuugaaaacuuucuguuucacaucuuugccucaacuccccacuucccagcacaguaugcuuuguccuuuaaauucugauauugugguuuuccuucuuacaaacuuaauacuauuuuuuuucuggagucuuuuuugguuuguuuguuuuugugucaccagcucuggcugucuuggacgcccuuguagaccaggcuggccuccacugcaaggagcuccaucugcuccugccucccaagugcugggauuauaggcaugcgccaucacacuggcuuuuuuuccucucccuguguuuuuuacaagacaaauacucaauauauauccuagucuagccuggaauauuucugugugguccaggcuggccaugaacuuauaaucuuccugcuauagccuugucaaugcugggguuuuaaaccuguauuaccaugccuggccuauguuugucauuucuucaggauaaacuuucuaaccuuuaaucacucuucuucaucucaccccccguucuccucacugucaugggcagauuuuccucuccuucuuuccaagguacuguagaacucaguucauggacuuagagcacuuccuugcauguaccucccuuauagccuacauuugggucccuuguuuguucagugcaaauccaccaaggucggagauuuuggaaagccuccacgacugucuguauuagucacuuuuauauuucugugauaaagcaccaagaccaaggcaacugaucaauguguuuaguugggcauaugguuccaaaggguuagaaucuauuauggcagauugauggcauggcaacaggaacagcugagaacuccugcccggaagcuuaguggaaggccuagaguacaccggggaugggguggggacuugaggucucaaacccugaccccuguaacaugccuccucuaacaaggccacgucuccuaauccugcguuaauaguuccaccaacuagauaucaaauguucaacuguaugaaccucuggggguuaaucccacuuaaacuaccgugcuguccaaagcuuuucaggugauuuacucuuccuuucagcauccuucucuuccuuguggauggaguuaggaguuccuugcaguugcuugcuugcccgugcccucaccagauggagucacaguccucucauccuccucacugcuguagaccuugagcucaggaaauauguuuuuaaguauuuguuaaaaucauagauguuaacaucauauucuugacuuacaguucagaagaggaagaugaaaagcaauggcaagcaagaauggaucaaaaacaagcauugcagguacucacauaacaugggaauucacaacggcuguuguuacuugaaaugaugaaaaugaguaaugcuuaugagguaugauggcuuaugaaaguucccaauaaaaagugaagauaacuuuaacuguguguguuucucauugcacguguguauaugauguauauguguguguauauauaaaauccacacuuacccaugcauuccaugcacuuguauauuggauuugccauuaauggacuucuuuccucuuuuuuuugaguauuuggagacuggguuucucuuauauuuuggguugggagccuagccuucaauggcuaagccaucucucuagcccaagacaggguuucucuguguagaccuugaacucacagaguucagccugauucugccgcuucccaugugcuaggauuguaguuguacagcaccaugucgagcuucauuaugucuucccguauauccaaaguaagcucuuuucaaaacaacggaccauucacgaaguaaauaugcuucuugagaauaugagaauacuuucuuggggccaagaauauguaacuuggugauaguguucacuuuacaugcaugacacccuggauucaaucccuagugccacaaguaaaugcuucuucacugugaugccugucacagagcauauacuucuguguacagauuauauaaggccguaucuaucauauaaacacaaugaguauuuguaacagugacuaggccuaaaugggugaauauaaauguaaugauguuaacauuuuacucuuuauaggaagaauucuuucauaauccucaggccauagauaucgagucugaggacuucagcagccugccuccugaaguaaagcaugagaucuugacugacaugaaagaguuuaccaagcgaaggcgaacacuguuugaagcaaugccagagguaaaacacccagcagugcacaguggcacaccagugcuuagaacuaagaacuugagcaaagcuucacagaaggaagagaaaaaugggaagugguacuuagagucuaagucucuaauuuagguaggucccaguugcaaggacacagcaucuguguaucucaggucacaugagacauuguuuaugcauuuacuauaauccauaaaccgucaaagaaggcuucugcacucgguaggccuuuucuugugugcguccucaguacccuguaacauagugcucagcacagagcaugccuguccgauaauggcuacauucucagcaggccacucagugucucacauaguaagugcccagcgccaaaugguucuugggcuaguucauaaaaaguuacuucacaccacaacauacaguaugcacaaaaaguaacuaacauggaaaauacuuccaaaguggaauuccggauacaggaugcguguucaucgcuuucuuugugaauaguagaaacaggccugaauguggcgauuucaaagucacaggaagcuggagcgggggugguguacauggcuggguguuguugaauguguccuguuccuguagcuguuguagucuugguuuaugcugccuuugagcauuugguauuuuuaguuccugaugcaugaguuccacuucccuuccuuuugccaccaccugcuguuuccagcaguucuucuccaacagugagguagaauguaaacuuagcaauuuagguaguuguuugguuuugguuuuuguuuuuuuagcuugcuguagacuuuaggaugcuuuuuacuuuggugucagaaagaugaaaaagauggauguaucacucccuuuugguuuucuauguauuuaggauaagaaaauaguaauaagugaauggaagugauguuauuacguuuuuggguacaagaauaacuuuguuuucauuuugggagaaaacaaucuagguuccaucuauuuuucacgcucaugucuucacagaugugaagaaucauuaaguaugacugauagaaauuguguuugaguggaaaggagaaauauagccucuagugguuuucucuuuuucuuugugcaaacgugauguugcuagggcuagaaggcugggauggucccauaaguagaaaaguucugaguagucuagaauagaccuugguaugacuuaucuaucauguacaugggauguugauaggagaagauccaugucuuaauagcagggauagucaugagacuaauaauagacucaguuguaguaagucaacuuucugaugucuaguauugaagucucaagcuuaucauuugcagauggggaauaggaaaaugucucauuggaugucuguagaaauaauucaagguaguuaauauaaaaguacuuggaauguccuccaugggaaagguuuuauucauauuaacuaugauuauuaauaccucugguugauuuacuuguguuaccuguggaccaaagacaaugcuggagacuucacuuauauucuggaagguuauguuuugcugagccaccaucacaugucuuaccacagccauguagucuaguucagcaaauaauuuuaaagauaaaguauuucauaauuucuuuugcuuaauucuuuuuuuauagucuguuauaaugccauguaugcuaaucccaguacuuuggaggcagaggcagaaggauuugcacaacuucaaggcgagcauguucuauauagugauuuccuggcuagcuugggcgacguauuggaagacugucucaacaagaacaacagcaauaaaacaaaaaaugaaguugacaguggaacccccuuaauuuucaaguuuuauuuuuaugcuaugaaauuaaaccuuuugaaauaaacuggacagugguggucuauucuguguuaguguaaagcaauacuuuuuauuucccccuaggagucuaaugacuuuucacaguaccagcugaaaggcuugcugaagaagaacuaccuaaaccagcacauagaaaauguccaaaaggaaaugaaccagcagcauucagggcaaauccagaggcaauaucaagaugagggaggcuuucugaaggaaguggaguccaggagaguggucucugaagacaccucacauuacaucuugauaaaagguaccaggcgccaucauugauuugacagcuuaaaaaucaugauagguaugcagugcucuccuguugucaugccuucccugcaaugaugggcuucauucuucugugccagucaaagcagaggcagagcauaugggagcuuuuaucaagauaacugugcugucccauguuaugucguauucagguaacuacagcugcugggugcuuguaauucugauggccgucccauuuucagaacagcauuuuguaggguuucuuuccaucuucaggcucccucauucuuucuaccccaacccuacuuuugcgauguucccugggcaugcauuggugugugugugugugugugagauuuaaggcugagcacuuagcaguugcuuguuccagcacucugcauugacugucacccucuucagggaggagcuucucuggcccaggcuagcaacaacgcuagucuuuagguacaaauguggguauuugggaagcagucagacuacuuaucaaguuagaaaaauagcagcagccgggcauggugacgcacgccuuuaaucccagcacuugagaggcagaggcaggcggauuucugaguucgaggacugccuggucuacaaagugaguuccaggacagcuagggauacacagagaaacccugucuuggaaaaacaaacaaacaaacaaacaaacaaacaaaaaaaaaagaaaaaaauaucagcaguauguucuccuuuagagccugagaccucuuuuuuagccaugaguuuuuuauaggguuuucagucuuagacaugucuuuccuccuguggagugggucucaaauccaguugagcagcauguugacugaccccagaguauccuugccacguugcacuaauguguaugucuuguuuguuaggucagaauuguagugcagaguucaccacugggaggcagccugccuagcaccucuuaguacugugcagagggagaugagggggggcaauuccagcuuccuuucucuguguccugugucucggguguauggugucauuugcaauaggacuuuaauaucuaguucugggggagaacaaagagcaacagcaaugggcuauauuguuuugggaacuucaugggggugucuggugagagacugauggggaaugucuugcaguuggagcugggauuuuuguugaagacccuauggcuucuggcagcaacauugucaacucauucaggguacuucaaacuguuuauuuauuuuuuaauuguguuuuuuuguuuuauacaguggugcauuuccaugugguuuuugcaugcaucuuugauuugauugacccuucccaccuacaaucuuuaccuuucuucuauuccucaaacuccguuuuuaguuaaaccuuuuugccucugguaugccuccuuuucauaucauauggaggaaagcuacuuuucaaaaaugagaggaaaugaaguaacacaaugaguugugguaugauagagagaacagaaguugaaaucauagaauuuagaagagagcauggccuugguuuucaguucugcugcuuaauucaugagcaaguggccuaaccuaaaccugacucuuugcuuucaugccagguagguugagaacccugauacagguuuguucuguaagcuauaugagaucuuauuuguaagugguggcuucucuuauuuaucaauuuauuaugcacuacguuaagguagaguuuugcucccauugacccuagaacaucgcaaacaucucagacuuuugaccuuuuuuuuuuuuuuugugauggguucaaauguaauaucuauuuuaaagugggauguuagcauuaaaaauauacaucaaggagcuucagagacggcucagaaguuaagaucucauccuacguuuucagaggaccuggcuuugaggucacccacaugaguggccuaaaagugccuguaacuaacuucaagggacccaacauccucuuuuggcuuccccagguauccacaaacauaugacaugacauauacacacacauacaccuacccacccacucacccacacacacacaaauaaauaaauaaguaaaauaauaaaaauguaaaaaguuagucuauaaagccagguuugagucagaaggccauuucagacuaucucauuacuccacaccauuaauaguuucagcaauucuaucaaauaaauauaucucuguuuucuuaauuguugcuuuucuugggaagggguuuuggaaguuuuuuucauuuaaaauuuuuugauaaagaacuuaggcucaacagcauuuuuugaauuuuacuagucauugaaaugauacauagaaagaucauuuuauuaauuuaaaugcacacgugugaaaacugacaccaggauuugcuuucuuguugucuacaaaaacaaauaagaaaaaaaaaucaaaaguggaauuguguuuuaugaaauagguaaaaaguauuuugccuuacuuuugccuauauaguguggcaaaauaaaauuuccaaaugaaaaauaaaaccuaggguacuuuguggcucuaaguucuaugaaaaggccucacugagguaauaaggguuguacuuagccacuaauagauuagcuacuacagagcuaagcccuuuagaacuagugagcggauuuuaauaaaauguaucacuguguuuaugauccaggguucucuuguucaucuucccagaaauacacggucacacugugaauugcauagugagaaauauuuugcuuucucucagguauucaagguaagaaagucauggauguggauucagaaucucuuccuuccuccagcaacguacacagugugucuuccaaccugaagucaucaccccacgagaaagugaagccggagagagagccagaggccgcgccuccuucuccaagaacucuacuggcuauucaggcagccaugcugggaaguagcucagaagaugagccagagaguagagagggaaggcagucuaaggagaggaacucaggggccacugcagaugcagguuccaucucaccccggaccugugcagcuauucagaaagcucuggaugaugauaacgaugagaaagugucuggcagcagugaugaucuagcagagaaaaugcugcuuggaagugggcuggagcaggaggagcaugcugaugaaacggcagaaagagguggaggcgugccauuugacacagcgccucucacacccagugugacugagguaaaggaguguguaaccaguggcagcagugcaaacggacagacagacucagcucauucauuuacaaccgcgagucaccgaugugauacuccaaaagaaacagugucucuugcucgugccgugaaagaagcaucucagauaagcagugaaugugagguggaggguaggccagcugcccucucaccagcauucauaggaacuccaagcagucaugucucuggaguccucagugaaagggaacccacccuggcaccuccgacgacaagaacacauucugaucaggggauagacauacacccugaagauccugagcuacaaaacggacucuacccacuugagaccaaguguaauuccucucgccuuucaagugacgaugaaacagaaggugggcaaaacccugcucccaaagcauguaguacaguucaugucccugcagaggcaaugaguaacuuagaaaaugcguugccuucuaaugcugaagaacguggagauuuccaggaaaccauccagcuacgggaggugccugaggcugcugccagggagcugauuucagcuccaaagcccaugggaccaauggagauggagucugaagaaagcgagucugaugguagguauuccuuuaaggggauggaaugagaacuuauguuuauaaggacugagagacucuacaguguagcccuauuuuuuuuuuuuuuuuuuuuuuuuuuuuuacagucaaggaacugggaagaaaggauaaaugagcuuucuagggacucacauccaggauggugucgcccugcuuugcugggcuauccuugggauuuuaagauuuuacuuuauuuuacauguaugauguauggguauuuuaugugcaugugugucugugcacauaugcauguagugcccauggaggccagaagagggcaucagaucuucuggaacuggaauuaacacaugauugugaacugugcugugggcacugguaacuaaacccagggccucugcaagagcagcagacauuuuuaagugcugagccauaucuguccuugguauucuuaaaggaagggaguaccgugcuuggagaaaagaaagcugaauuuccuuuagcuuuuguuaacuuuuuacugugacauaauuauaaaaauuaaaaacaauacugacugauucacaccuaaccuuagaggucaguauuuugcccuauuuguuuuauauucucugacucggucugucugucugucugucugucugucucuuucccucccucucccuacucccucuaccucuucuucucucacaucuucuucauaucuuugucucugucucucuccuauccauuuucuccauguaucucuccuuucuauguuuaaguacacacaugccagugcagugaugcucauugcuuauaguuuauuuauuuguguagucggcacuuuguuuucuuuaugggcauuugucuagucuuucuacugguuucaguguacccacagaaacaaccaaaaguccauugguaggguauuggagucuugaacaggaauauccagauauggagcauccccauucugcugcccuacugugcguacucucaggcaagccacauaacauucugaaccucauuucauaaugaaagaauguacacacacaaguacacacacaaguacacacacacacacacacacacacauaaacacauuuguacauauauucauguauguuuguguaugaaacauauguauuugcuuaaauuagcuaaacuauauuugaaaugacuuuauaggccauacuucaauuaguaaagauaacuauaugcauauguuuauauauaauauguguucugcaauuggucaaauuuuucuaucuaucuaucuaucuaucuaucuaucuaucuaucuaucuaucuaucaucuaucuauuuaucuaucuaucuaucuauuaucuaucugucugucagucugucuaucuaaucuaucuauuugagacucauguaaccuaggcugcccucauacuugcugugcaguugaggcuugucuuggacuccugacccuuuggccucuaccugcuaagugcaggauuauaggucugaacuaccauaccuggcuugauuuucacauuuguacuuucucccuuugucaguguuucauggaaaggaauuuagggccuggaagaauaugcagcacgcaagagaacuuccagugauuuguuucagcauccuugguuggucucugucugaguagaaagcuacuaugguaguugccaggugguguuggccaaccucacccuuccuuaggcauugauuaguuguauccuacgguaaggaagacccuucucccauuuguuguuguuauugucauggauugcuguauucaguugcagucuaacacuauaacguacuuucucaaagugucccugcuuuggcuggguguggguuuuccuucaagcaaacucuuguggcuuuugccaguuccuaaauguuucaggcuuuucuuauguugacuucgcuguagcccuggauuucaucacggagcccugacucuuauuggagauuacaagucaggcacugguuucugggugagcuuuguuuccucaguaacaaccaugaaauaaacaugcucccucuuguuugcucucucucucucugucugucugucucucucucucucaccauguacauaugcacacucacagcugcauuuauuucuguacacauucaucuuuaugcuuaugguuccauucuaacauccuaggagguuauucuugaauuucccuucuuuuuaguuccuccuugucucuagccucucuaauguccugacuuucuacuaaaacucaggcuagcaggccauggcaguccccucugcugaagagaagaaagguguggagagagaggauauccuugucuuauugauuuuaguggaaucgcuuugaguuuuugaccauuuaauuugcuuuuggcuuguuggcuugcuguaaacugccuuucuuauguaccccuugucacucaggacuuuaucaugaagggguguuuaauuuuaucaaagccuuuuuucuacaucuaaugagaugaucauguuuuuuuuuucccuuucaguuuauuuauaguuucauuuacuaauuuucauacacugaaucaucccuacauuauugggaugaagcauaucugaugguggaagauaauuuuuaugauucauucuugaauucgguuuuuggguauuuuauguaguauuuuuguaucuauguucaaagggaaauuggucuguaauucuuuguugagucuuuaugugguuuggguauaaugguaagugugacuucaugaaaugaauuguucuaucuucacguguccaguuuguggaauaauuugaggaguauuugugcuaacuccacuaugaaagcugagccaugugggcugaccaguuggaguuaagagaugggugugauuuuucuuuuuguuuuaggucuuucagauuugcuauuacauugcuaggaugagaucucuccaggguuguauuuauuuauuuauuuauuuauuuauuuauuuauuuauuuauauguaugcacuuagugcuaugaauuuuccucucagcacugcuuucauaaauauggguauaguauuuauucauuuuuauugaauucuagaaagucuuuaauuuuuaucuuuauuagugucuugacccauuuuucauucaguagagaguuguucagcuucugugaguuuguaagcuuuguguuguuucuguuguuaauauccuguuuuaauauaugguagucugauuggauaaagggaguuacuucuauuuuuuguuuuuauugauacuugcuuaguguccaacuacguggcuaauuuuggagagaguuccaugagguguagguaugaaaauguaacuuuuauuuuccuguaguaauugucucugaggcucagugccuugucugcuaaccuaggccuggaagcuucuagccuccauacaaucuaauuaaggccuagaguuuuuucagccucuuagaguuacugcugaauauauuugcccauucuagauuuuucuuagcucuggcuaacugguucaacucagcuguucuggcucaaaacuccucucugagcugaccaguucaaacuggcuucucucagcuucugacugaauggcucugcuuggccuuauacuaacuuugccaaucugaucuaauuucugcuuccuccucauacucuggcuugcucugucuuuacaugugucuaguuuauucucucuacaaccugccucugugagaaugcuccuuucuucucucggugcuguucucucuuaagucaccucuucuuccucuguauucucguaagaguugggcagauuugugcauuuccuauucugucauuuuuuuuucucuaauucaucacuuugucugccacucaaguaggcaucacuuucaaacauggaugcuccuucuauagacuaauuuuacugccauugcuuggguuuaaagguguguacuaagggugugucucuguuccagcccaaaggauuaaagguacuaaaggugagccacaccacccuuagaaacaggguuuucuaguaaacgacacaaucucaguuucacauugugaucagauaaauccuuuuguguuuggugaaguguucuauaaauaucuguaagguccauuugguuucuacccuuuguuagcuccagcaucucucuguuauaguuuuugucuggaaaacuggugguuugaauggaaauggcucccauaggcuuauagaagaguggcaauauuaggagguguggccuugucagaguaggugugaucucguuggaggaaguaugccacugggagcaggcuuugagguuucaguaacucaagccaaaacagugucauucucuguuccuacugccuaauaauguagauguagaacucuuggcucuuucuccagcaccaugccugccugcaugcugucaugcuuccugcugugaugacaauggacuaaagcugaacuauaagcuagccuuuauuaaauauuuuucucuaugagaguugacauggccauggcgucucuucauagcacuagaaauucuaacuaagacaaugaugagaaugggguauuaaagacucucacuaugaguguauuugucaauauaugauuuaagcuguuguagugcuucuuuuacaaacuugagugcccuuuuguuuugggcaucaauguuaagaguugaacuaucaacuugguagauaugagugaguauuuaguguucuucccuaucucuuuugauuaguuuugauuuaaaguuuauuuucuaagauauuaaaauggcuacaucagcuugcuucauaggucuguuuacuuggaauaucuuuuccaaccuuuuacucugaaguaaugucuaucauugauguugagguguguuucuuggauguagcaaaaagauggaugguguuuucacagcaggcuguucgguugcaaagagagggaugagacuagggaguuggguguggaggagaggagggaguggugaagguuuuuaguuagcuuaccuguuucccuagccugcucagcuggugugcucacagagaaugcuaguuagagccugggauacuaggaugaguggaggcaaggaagguuggagaucuuugugauacauuugggauggggugagaggaaagugagacagcagcagggagguguccugcuacagaguaguggaugagacugagggaaugggacuggaggagaaaauggagaggugaagaccugccgucagccuaucugcaucccuggccgucucucugaguuuuaauaacagaauuagucaauguaacguagcuuuucaaaguuaauaugcaaaucugugagaauuuguuuccuacuuuuagugaccaagagcuuaauagaucauuuuaucucauugaaaacgcuugguuggaaguggcagauaggcaucuguggugcacuguagcaaacuagugaguugaauguuuauagcuauccuuaagucauuuccuuugggguuugacauuuuucaggacugcucagaaagcuuugaugacuucacaguggcucuaauguucucaugucagaugaagugacaucaugauuuuuuuuggacaggaaguuucauugaggugcagaguguggucagcaauagugaacuucaaacagagucauccgaggcuucuacacaucucucugaaaaagaugcagaggaaccaagagaaacucuggaggaaggaaccuccagggacacagagugccuccuacaggacagcucugacauugaggcaauggaaggacacagagaagcugacauagaugcugaggacaugcccaacgaauggcaagauauuaauuugguaauaucacauucuaacuuagugccaaggaagccaagucuauggcuuuugagauuuuaaaagucgcuagauaaauauucacuagcuguuuuuaauucaucuuguuucuuauagcucccuuuuaauauguaaguuauaccugggguuuuuaguuagguucccauaugauguaaugagaccacugaaaggggcagucuugccuggaaaucccaaguggaaaacacuguaaggcuuauuggucauuucagccagaggaaaugcgugcuuuauuguaacaaaugagcauaauuggaucaugacuguaauuuucugcggcugggaacauguuuuaggaggaacuggaugcccuggaaaguaaccucuuagcagaacagaauucacugaaagcgcaaaaacagcagcaagaucggauugcugccucuguaacaggccagauguuucuggaaagccagguaagugugacuuuagcuuggucuuccuuagccucgaccuuccucucagaagggcuguguaauacugucacacccccuuguggucaaggcccacagcacauuccccugcuuguugcuucucuuacugcaggaacuccugcgccuguuuggcguucccuacauccaggcucccauggaggcagaggcacagugugccauguuggaccucacugaccagacuucuggaacgauuacugacgauagugauaucuggcuguuuggggcccggcaugucuauaagaauuuuuuuaacaaaaacaaguuuguagaguacuaucaauauguggacuuuuacagucaacuagguaagagucaguguggucaucucccagacuuccacacauucacucuccugauuugccucaugugguuuuucuucucaaggaacucauuugaugcaugagugagaggucauaggguauuaaaaacuggguuuaagaaauuaaaauccuagugucugucuugcaguuaaaucaucugacaagguuaguugaauacuuacuuggcggugaaccagaaauguucucauaguguggggaaggagccauugugacuucugccacagugagugucccugacacucacauccaucaccacucucucauucauccauucauccacuugggaaaugcacacagaaugacucucaugucagucauucuugacaauagugagaaugaaauaucuuucucuaguggaggagaaagaugcuggccuuguuuguaagucauaaucugccaguuaguguauaccauggggaaaagaagcagagagagggugaggugcagcugcaggaggguacaugcuguuccucacaggguugucaucaacggaggcuuuguuuguggcagucuugggcaggcuccuuaaggaaaucggaagaaaacuguaacuacaguuuugacaaagacugugucagagggacuuaaagauuucaaagccuugaggcagaaccuuguuuauauacauauucuagagaggcaaggagaccaaugggaaugggggagguggugauaacagugguuaauauuggagagaagaaacugaaaccuuguagugucugguacaucagagagaggagugugcaugucuuagauguaggaggugggaggaaagguucuagauuccugguucugggccaguaguagaguggagaagaggaagggagaguuaaauugagauaaguucaaccugagagucucacuagauacacaggcaggaguacucuguugguaauugaaugcauaugcuuguggucagaguaagcagucuagauaacuaaauguagaggucagcuuauauagaaaauuucacauaagacuacuuaaaauuuaaaucucaacagaauauuuaacaaaagaaccuauuuuuaaauuaaauauguccucggauguugguuuaacauauacagcuuauauaauauguuauauaaaauuuauaaaauauuaaaacuuuauaauauauaaauuauauauaauauuaauuuuuauaaaauauuaaagaaugcagugguuuaugccuuuauucccagcauuugggaagcagaggcccauuggaucucugugaguuugaggcuagccugaucuacaaaaugaguuccaguacagucagggcugcacaaagaaacccugucuugaaaaacaaaacaaaacaacaucuaucugucuguauguccuuucuucugucugucugucugucugucugucugucugucugucucuguauauauauauauauaugaucgauugauugauugcuauuuauacaggacuggaccguaacaagcuaaucaacuuggccuaucuacugggcagugacuauacggaagggauaccaacuguaggcuguguaacagccauggagauucucaaugaauucccuggacgaggccuggacccacuccuaaaauucucguaagccuuuuucucaugccuuuaauucagguauauauauauauacucagacuaauacauggauuauuuuuaacugagcucuuacugugcuguugcuuaggcugagcucaaaguugcaauccuccagccucagcuuccuauguagcugcuacuguaggugugugccaucacuuuugagaauauguuucuaaaaucacaagcugucccaagucauuguacauugaggcaguaguuggugacaguggcugugguuuccagggccuuggugaaucuguuuuuggucuauuuuagucucguuuuggucauggcugauuuauccuaguccagggacacaaagauggucuguagugcucauuaaugugugagcugccucugaguucauuuagaugauuauagaguagucaauaugaguaagauauucaggccuuaucaguggaaaagaugaguaguuauauucuacacccuugccgcuucuugugggaguaaauggauaguggagaagcaaaugaaauuguucaguauugcuagugaaauuuuucaccacuuguucaguguuauaaaagaagucaaccauaaaugugcuuugaggugcaggugcaggaacuuacauuguaaagucacuuuccaggaaaacccacgugcugacccagaguuugcuguacuuaaggugcagcuucugagcuuuggagaaguugacauauucgggaucuguuauuguuaugcccaggacucgggauucuuuaagggguguauuaagggcagauacuugugugcuuugccaguauuauguuguaaaacugguuaagaaaacauuucccucuagaggacucaagugaguucccagcaccuacauuagauggccuccgagggcaccugcacauaugugacagucacauauauacucaaaacaaaacaagcaaaaacuuaaaaagaaaagaaagcauuauuuuccucuugauuuugguauugaagcccacuguuaagcuuuugaaugguagauggcacucugaaguugcucacugaaguggccugcaggcuggaacccaguugcugguacuaauaugugaagacauagaauugaagggaggguagguauucuuuacaaacugcugcaaguuggguaggugaggagcauguuugaauuuccaugguauuaucucucaguuuucuguuggcacacugcaguuaccuaccuuaaaccuccuuagccuccacuagcagcacgugguguuuuugcuccugacucugaaacuugcgugggagucuuuuauucuuauucucugucuuagaacaggucaaagcucaaggaccugcugcaaguuucacacgccaggcacugucaguagacagauaaaaugcugguagaccuuggcuagucuccauugagaucucugcagugagcacagguuucucaaggagugguggcugcuuccaagggcaguuuuuuccaaaaaaagcaggaagugaacaggcauguuuucugcuccacagcuauagcuucuugaucauuauccaaagucacagagauggaauaaugaucucuucaucagaggagcauuaaaagaaaaaagaaagugugccauaauaaauuaucauuaagauugaaaauauuuuaaaguggacuuaauauuuuaaaaaaaucaaaauuagcagucuaauuuugcuuaaagcauugcccaucacaugagagcaauaguacuugccacuguuuauaauuuaaaagaccuauuuacugucucucuuuguacacauacgccuuguucaucauauccuacuugguguugaaugauaucuauacuaaaucaaccaguauacucuugacauuuuuggauccaugguacuuuccauuucacugaccggggccuggagaaauuguggcuuugugcugcuguuuuuugagcaggagcuguaggaguuugucaucugagauucuagucccauuugugaaauauugagcaagguacuucugaguggguuuauuucuucuugagagaugagaguaaugacacuacacaugaaguacuuaacaugcaguaagaucuuuaccuugcaguuuaguauccuacaccacauauauuugaauuaugacuugaaauuacauuuccggacuuuguauuuagcuuuuccccaccaguguggcaacuguaacaucucccuguuuuguaaguaauugcuccuguuaucuuacagagagugguggcacgaagcucaaaauaacaagaagguugcagaaaaucccuaugacaccaaagugaaaaaaaaauuacggaaguugcagcugacaccugguuuccccaacccggcaguugcagaugcuuaccucaggccugugguggaugacuccaggggaucguuccuguggggcaagccugauguggacaagauuagagaauauccuuucuuucuuaauauuuauggguauauuaagccucugucuuaguuagcucugucacagugaccuagcuacuucaacaagccacaacuccuaauagugccauucccugggccacgccuuuacaaaccaucccagcugcagaccugauagaaucaaaacuuugggacaaggaagcuguuuguuuuguuuuguuuuguuuuguuuuguuauuucccagugcuggggaaugaaaucaggguuucaugcauauacagcaaguauccuucagaauagaucuuaauuugaaagaagcagcaacagcaugcauguuaugaacacauguuuaagauuaauuauucugaaagaauauggaagauugcuggccuuccauucuguguauuuaaauaauaaauuaguuggcuguuucaacaucuacaauagauucaacccacgaacaacuuccuuucuuaaagaaguacaaaggauaucugccccuugcuuuuauucuagguuagccaugcuuuguacugaggagucuucaaugugcugguaugaguuguugagugucaucugccuuuggagauugaugagagcuuacugcaagaugaucuuguuggaguggcuuguuuuuccagccuuuaaucuuuauaaaaacaauuaucuuggaagauacagggaauggcaacaaugguucgcuuuugaaugcuauuauuauuuuauuauuauuauuauuauuaccuguuaagucuauuaaaaaaaaaaacuucuauaaaccuuaacugccagcacauuuugucagagguauuuuggcuggaacaggaugaagaccgaugaaucccuguauccaguacuaaagcaccugaaugcccaucagguaauuguggauuuucuuuauguacagagugaugacuacagcuaguagcuguuguuuacuccuauuucagggcaagaagcugaaggcuugaacugaugacaccuuaaaaucagagugaaacagaagaagggauuggguccuaagucuuuuuguucaugcuagugcugcaguguccuuguuuuuuuuuugacuuugaaaaaauucuaguguaauacaugacuucauaauaagauguuuaauauaaaauauauuacuccucuggagcuaucuucaguuuuuaaaagcccagaaaauauucacuccaaaacaauuucuucaaauacuaacauuuuaauuuacaacuuaggaucuggucuuuauacuaacauuucuacaagagagguuuuuggcuaguaaaaugcccuuuuauguggccuucuguguuuccaaaugggugugcuugucuaauucauggguaauuuaggaaaaacauucaaauggacagugauuuaauaaauauuuccagggguuuccuguugucugucugaugauauuuaccuaccagcaauagaaaccuauuaagaaugaaaauauuuucuagugacuaauuauuccuuaauuucagauaaaugcuaguguaauauauauuuccuuuccaagacgaauuuuuucucucugaaaagcaaagauagucuagaaaguaacaauaguagauuaagcuacuuccacucgagguguguuuccuuuguguuuauuuuccuuugccucccaugcuaauuugcuccugugcauaaaucccacuugacagagugggucuccucuuccccuuggcucaugaguggauaccaucuucugugaguugcguugcuuuuuauaguuucagaggaccagcuuacaguccaugaaaguucacacuugcuguuucuauguuuuugggcauuuacuuuucaaguaguuaugaaugaugccauaauucacacucgguuuaagaguaucucucaacuguggauuugcugaauuaaaggcuugaccuuuguuuccuggcaucuaaugcaucagcaaacuugugucuugaaggcacugauuuuaaugauuuuaaaagaaaggcauugaaugacuuaggcauagacucugugaaauucuguugcugccaaagaagaggauacaauuguuaugaaaaaacaaacaaacaaacauagcuagaauugccuucuggaggccauaauugcaaauuguugaaacguaguaauccacaguucgacgcguuaguugguguagcaacuacucacuuccuugcuuuauugcuuucuuuuguuuuagacccagcuccggauugauuccuuuuuuagacuagcucagcaggaaaaacaagaugccaaacucauaaagagucauaggcuaaacagagcagugacauguauacugaggaaagaacgggaagagaaagcuccugagcugacaaaagugacugaggcccuggaugaugcaaaaggaaaaacccagaaaagagagcuaccauauaaaaaagagacuucaguuccaaaaagaaggagaccuucaggcaaugguggguuucuaggggaccccuacugcucagaaucaccccaggaaucuuccugugaggauggagaagguucaucugugaugagugcacgacagagaagugcagcugagucgucaaaaaucagcugcucagaugugccugacuuagugagagacccuccucaugggaggcaaggcuguguguccacuaguagcuccagcgaggaugaugaggacaaagccaagacuguccuagugacugcuagaccuguauuugggaagaaaaaacugaaacuaaagaguaugaagagaaggaaaaagaaaaccuaauuuaaagagaaaaaaaaaagucauuuagaaacagaaagugcuuacaauguauugagagcauaagauuaaaucuauuuguauaaucucuauuuugaauguauaguuuuauucucuuuuuuauuuucuugaguuuauuaaaaaucaaagaacagaaaaauuuuacauaaaaguacaucugu

SEQ ID NO: 148 - RNA, 45248 nt, Mus musculus
uaugcauaggcugauguacacaugcuccagaugugcuguuucugugucuguggguuguguccucuacacacagggaaaaauauauuaaucauugcuuuuacugcugaggggauggguucugcucucauauuucagaaaggggcuggaaagugagggaagccaaacuuuuuccuauuuaaggccagagcagagggaagcgagcggcugaguuuuaugacgggcccggugcugaagggcagggacaacugauggugcuacucugagcugcuucuuccucucuccucuuuugcacaaagagucucaugucugauauuuagacaugaugagcuuugugcaaaguggaaccugguuucuucucacccuucuucaucccacucuuauuuuggcacagcaguccaacguagguaaguagguaccgauuugaacaggcuuucuggguuaauuuugccuuaacuucuuacaaaggguaagauagugggaaaaucagccuccuaagaauuuccugucuagccucugacuguggaauguuuuguuaaccuuaauuuuguuuucuauauuugauuuuuuuaaaaguuaauguacauguauaauauucucuaguuguuuaagguaaaaacuguucuuaaauuaacuugauuucauguucaccuuuuaaaaaauguuuuaaaguacuccccuccugcauugugaacaucuuggcaugcucccaggccaucuggaauuuauuggucucuuguaauaauuucauguucuccuuuguacacugcucucuuuacaaagauaggauauuuagccauguuuuucaaaagaaugcacuagaaaugucucugaaaugaauaacccuuaagaagauacuagaaaauaaauagaaucccuuauguauuucuguaaaacuauaaauguggacuaucuauggaccuuccagaaaugagcccaggcugcaaaaacgugucauuguuucuguuuuuauugcauuccaugauugcacacauucaaugugcucagaguuugccaaaaguuguuuuauguucuguuuagcuggauuuccauuacugaagauaacauaauuuaacaggaauauuuuugcuuuccuccaaacaagguaaagauacaaguuuugcucaaaaaggcagacuugaaauaguuuugguagccaaauguaaugaucuuuauuuucuugugccccaaauuaaaagcaacugucucauuauuuacuuaaauacuuuuaaaaaugcauauguuccuugucaucaugaaaauuuggggugcacacuuuuuucaaaauaauuguguugauguaaaucuuaucuguggcuaaaagaaguugcuagcaguucuuuucauacauaaucaaacacguugguauuuaaaccuuuaguuuuagcaaaugcuucaugagcauucguuuuuccacugugugcagugucuucacuaguuucagaaguuaucuaugcaagaguaagggaaggagacacuuuauauuucuguauguucaguccacagauacacagagaaggagcucccagauugcuuguuucuuaauucuguuccccuuaacccacccuuccaucccccuccaucuuuccccccuccuuaucucuccaccccuuuuggcuccuuaggaacuccccucccaauuuuccuuccucacucaucaccccucccccauccuaggcuuauccaccucccuccccccaccccaguccucaccccucccuguucucagugacucacucucugcuucccaucuuuauuuucauccucucuccuccccagcucaucuuacauuuucuuuucuuuggauagucaauuccuuuuuagcuuucuuuuuucacuuucucuucacauccugcccuccuggaagaugaaacaaccccaagccuucccuauuaauaggagacaugauccaaagaaauguuaauuccuuagcagcccaaacuuuuauucugaaaucuagaugaagaaucauagaaucuuaauuuuuuuuaaagaaagaaagacagacagaaagaaagacagacagacagacagaaaggaaggaaggaaggaaggaaggaaggaaggaaggaaggaagaaagaaaggaaggaaggaaggaagaaaggaaggaaggaagaaaccuaugucuuugggacauuaauuaaaauaucaacauaguaucuauaguuucuuaacaguuaaaguaauaugagaaauacuauaggaacaguggguguguuucuucccaaucuaacuccaguaagaagagaaacauguuugguucucaccaucuuaacaucauccuaagcucauuugcuuccaccuuugggcuauggucuuuaaaacuccaagaaggauaaaaaggauuuaagaucauauauuucacauuccuugcagguuuuuagugaaaauccuacugaaugauuaacuuugaggagauuucaguaaguagcagacauucagcacacugggaacacucagagaacucuaaagggguuaucuccuauguucuccagaaauccuagaagucguacagaauugcuagacacuaacuucugggaguuuucuggaauaugaaacaugucuccacaaagaauucuugucucuuuacaaaucugugcaagucuuacuuuauucaugccuuuuauuucagcuacggaaaaaacguggucuguuuuauauuuccugugguuuuuaagcaugcuggauuuuuaagugcuaaaccaugccaccuaguggcuaacaaagacaccauuuccauaaccaucgccaacaugacucuugcaccacaggauccucauaugugugugugugugugugugugugugugugugugugugugugugugugugugugugugugcgugcgugcgcgcacgcguguccgugggggggggggagacagagagagagagagagagaguuuuaaaaacuaaacauuccuuuuauaaguaaaauaauuagauaaugaaauguuaccagacauaagaauacacaaacaaacugguaauauauugugagacuuuuggaaaugaaugucaaaauaauagacaguuuccagccaggcauggugacacagaccuucauucccagcuacuugggaggcugaguguagaugaauacaaguccaaagucuuccugaguucaaugugagugucugaaugagagugagacucuugucucaaaaugaaaaguuuauagaagucuggagaugcaggucagugguagagagcuuuuccagagcauaugacgcccuagccucaaucuccaauacugucaaagaaaagauagaaacuuaucuaaauucauugcaucauuuuuuaaauguauuuuuccuacucauuggcuaauaucauccuugcuuaauauuugcauucugcugacuauagguccauaaauagauguuaguaauauugcuuccuuaggacagggacaaaaaacuaaaugucuucuaaaguuuaagcuucuacauuuugcuauguugauaauaucacaaaaauuaacugugaaccaugaacugauuugugauuucaaaacuguaaauggacugagagaaugaacucuuguuucauauuuuuuaguuuauuucucauuauguuuaaaaaggaaaauuauagcuaagauuaacauuuacauuuucucuuguuuguguuguccgaauuacuaaucacauagaaccaauggaauaaaauguauuacaaagucacgguaguaaccuuacuucuaacagaagaaaauacacaauuauguacauauuuaaauaucagucauguaaccuacaguguguuuguaaagcuuaaaaacaggaauggaugaauaguuuaguacugaaacuaaaauuuaaugaaauacuacaugauuugagaacaaaagcauaaaccuugaacaucugccuuuuuuuacuuuuguaaguauuuguaaauaauagagauuccaaguuccauaccauuuuugaaaauuuauuuauaaaguuuuuuuuuaaugguaguccuuuuuucuauuccuuacucaauuuuuaacaaauuaaucugguuuauuaagcaaaaggcucaggagcuaaugacuuaaccagaaauuaucauucuuucuguaaaaauguacauuguaaguaaauaaaguauuaccaauacaagauuuuguuguuucuauucauaacccccuuuuauuuccucagcaucucaacaguacucagaaugauggguaaagggccuauaacagacccugcaucacauuuagaucuaggauggaccagucaagcauuguagaagagagcaagucuucggaaaccaugcugggagggagaaguggagaggaaaggcccauuaaugagugcagauucuucggugacuugccuuuggauuucuuuuuuaaaagauuuguccagaacuauaggagaugcuaaaagaaagcaaggccucauuagaaaggccuguuucauaucuacaggcucagaccaggccuggagugguaacucagaaaagacugccaaccacugaagcucuguggugaccacugaggaugacugucccuagugccggguuccuauguguacuuugugacaggcaauaacugauaacgccaccuugaagccauuaaagugauugcuuguaagucagagccgggaagaucaaagaugagcuugccuuugcuggaccuggcagacacuaaagcuucggguacacugugacuuucuggcaaugugugugagcuaauucucauaaaauguuucguucuguuucuuagagcuaaaagcuuagugucauuauuuuccaugcuuaggaaaaaaaaaaauccacauuguuuuuuuuuuuaauccaaaaguuuuaaaggaggaaacuuugccugucaggaaagcaguggaaacucugagcuagcucugcacagcagucguuuguuagcugcacuuuggagaguuacauuaaccacuagaaguucugucugugccuaacaaaaacauagcccaaguggauuccuuucagauuaacuaaucaaagccuugcuuuuuccauggcugaggucaagcccugccauuucaaauguaaucucaaugaacaaaacggaaaguucaaauggaagaaauacuaaaauugccccaaagaagaaauugccacaacuaauccaaaacuuauuaauaguuaaauuagcuuugauaauuagcauugaaggaugacuuucucaguuaacauaguugugagacauuuuuuguucuuauguuuguuauuguagaggccaacaagcuauguuucucacagaaacacuuuaugauguugcacagaauuuauagugcccaaguagcauucaaaggagacuugugcucaaguuagaaguuaacaaaugcaaaucaagcaaaaacuauaguuuuugaauaguagugccuuagccauccuaaauacaucuauguaucugaugaagaauguuuauguuuguuuuugucagucuuagugccuggcuuccaagucacacauucaucuugcugguggucuggaucccaucaggguggccuuggaaauacaagccuuuuucauaaggucaagagaaauaaacaguaggauuccacuccagaugguaucuucccauuuuaagauuagagaaaaaaaagacauuuuggagaucacuguuauuccuuaaaaaaaaaaaaaucugucugcauacucgagaggguacagaguucacaaaccaucugggacagggcacugaaacaggucucuuucauucuauaguauccuugaaagcaguaaaaacauaauggaguuaggaguaucagauuuuagaaaagcauacuagauucaaaucugaauuccuuuaaguauuuuaccuggauaauuacucaguuugacccagauucuuugugugcauucaggauugugacagcauucagcucaaaacaugcaggaaggagaucauaaaauugauauaaaccaucagguauagugaugaacaccugcauucccagcagucgaaugcagugauacacaacggcauuucgagcaguuugauauuagugaugcauaccugcauugcuagccgucugcaccuauguucccagcaaucugaaaccuuggagcaaggacugugguuucaaggcuagccugguggcaucuauaauuugaaagaaaagaaaaagaugucagccacucaagaguaguaccuagaacagaggcuugaucuaucauucguuugccaaguacugucaacuaccaugacaccgugaaaagaauuaaaguaucauguaaugauaggaaagauuacaugaacaucugcauucucaaaguauaaaacuaaaguugcuacacaguaaauuaaauauauuaaauauuuucauaauuugguaggauccauuauagauguauuucgaugauuauacauacuuuacuuuuccauuuaucuauuuuuauuuuggcaaaauaaauaucaaucaaguuguaggaaaaguuuagggacauaaaaagcaugugccuauacagaauaaaacaaagaaacaccuaagcaucauucauuuaguuuucuugguggaaaguagaauaaccagaaucuaccuagccauguaaaacaacacuuaaaaaugcacuucauuucuauuucaaaagacugucucuucagcaucucugugcugaugcuagaaagguggcucaggagugcagagugcguccugcacuugcagaggucccaaggucagcuuugagcaucuuacuuuauuacguuguccagaauugaaaaugcaauuguauuuauuuaauauuucuuacaaaaguauucagcuuccucuuuaucaaaguuucugugaacacagcacccuaauaagugaaagggacacugugagguaacuuagucccgcauggcagguguuauccuaucuuuaaaugcugcaaagcauagagcauuccaggaaauguccucuuucccugcuuuacaauaacuucccaaguuagauacugaagcuggagucaugagguacauauaucauaggcucagcuucugguauccuacauugguaacaguagauugccuuguaugaggugaugaaucagaagaaguugugcaacgcccccuuuuuaggcaaagaugacuaagauaaauaggaagugcuagcuuucagaugcaagaucuacuugugacuuuucagaaucugauguuucaagcaugccaucuuuguuucaaggggacaugaaguaagucugggcaacaaauuagauucauuauuucuuauuuuuuagacauuccaaguuuauuuauguagaacaacacaacuuucuaaagcaaaagaccauaugcaauaucauuguaaauguucugagcagauuaaaagaaagaacucaccccaaaaauugagguuacauuaggauuacaaugguggucucuagaggcaaagggcaggagaagaaucgaggauugcgcagaaugggugccaaugagaauugaccauuagauaacaccaaaaauauucugguguagaacuacacaguaggacaacuucuagcaauaaaaguguguaguguauuuuaaaggcuagguggaaguauuuucaaagguuuuaccauaaauuacaaauuuuugaggagauaaauaugcuuaaucuggauuaaacauaauauugguuuauaugugucaauauaauacaugagacuccauuaagguguaggguuuuuacaacuugauauauuaauuaaagugaaguaaaaauguuuuuaaaauauaagaaguaaagauguacuaagauccacugaccauuauguugaaaucucuacacuuuaaaaaccacucaauaagauuucuaagaaaaacuuagaaacaggaagccaaauaacaguuuucuaucauguaacccuggguuuaacauauucauuuaagcuuuuaaugagucagcguaaacauuccaaacaaauaacaaacacugucuuucuucugaugugagaauaccuucaaugagguauacacuugugaagaagaaugcaugagaaaaacguuucaugguauuucuaaggucauauaaaauauaugauguuuuuuaaaauaugaggaauuuaaaucuauuuuaauuauauuuuaaauaaaauaauaauuuuaauaauuauuauaaugaaauaauaaaaugauuuuaaauuuauuuuaauguauuuuauuguaguuuuacuuuuuaaaguauccauuaguuccuuuuaauaaccugcacacuuuauuaaauguggcaaaauauuucucaugcaaaaauaaauuuuugaaagaaucauuagcucaauuuacuaguauuuuaagaguugagaucaggcaguuugauguccacauguucauguggaauauccuaaauugaagcuaaucaaaugaguaugugucagucuaauacagagcaucauuuuuuauucacauuaaagaaggaggacccaugagaagauuuuaguguuuucacugauaaucuuuuauuucagcacuuuaauuucauuuuuucuuaaauacaaaauaucaguucuagguaaauauacaugggguuaggacuuagcuuuuuucuuuaaaacagcaccccagacagcccugcaucaauuacucugagguauucaguuugguauuuagcuuuuacaaucauuaagaaugaaguuguggucuuuaaagccuuaggaauaucuguccuguucucacagucuguuacagacaucagaggaggaucuaagacaacuuugcuaucuaacacaguuugguuaguuugucuugguuugguuugguuugguuugguuugguuugguuugguuugguuugguuugguuugacuguauugucuuuguuacuuauugaaaaugucuaaacugucuuugacuggcuguuaaaucaguacauuguuaagauaaaaaauaaaucuuacuucauacaagaagcuugagcuauuuaaugacaugauuaaaguaguauuggcauacauacauaaaagagaauuagaagcaacucuguagucuauacagacuggauguucugaaauuugucuuauuguauuuaagauuuagauuauuaaugguuuuagauuacucaaaguaucuaaauaugaagauagggaauuagaaauuuuaaauuauaauugggcuuaugagaaaauaaaguuuuacucucugagaaaauguaaaagaacucagaaaggcauugcuuauauucaaaauuauuugcagauguuugaaaacuuauuauuuauucauucauuauuggcaaacucucauagcaauuuucaagcugcauuuaaccauacuacacaguuaacauuucaagaauucaggccagguuuuauuuuggcaugacuuaaguugauucacuguaaaugacugcugaaauuucaauuucuuauauauaauuaagaaccaagucuaaaauuuugguugaagguauuucucuugccauaguaagccacaaauacacaaaccaucauucguacuuccccuauuauuuuuacuuauucauugucaauauuuguuuuaaaguaucacuuuauuuuggggcauuuggaaaacucuuuuguucuuguaugauauacaacacauuaugugauauaauacugacccacuaauguccaacagagugagcagugacauucaacacaaaucagcuuuguuaguucucccaggacaauauggaagagguuuauacugccaagauuagcucaauuuuuccauggauuuuugaaguggguuaauaaaauccagaaggccccagaauuaguaacaaaaggcauccuucuaguugaauguucccauauguuauuagaacauagaagagcaauuggguaaaacuguucauuuccagcugcauaaguaauagacaagaguuugaauguuaucuacugguguuaagcuuuuuaauguaaaugaaguaaaaacaauugauuugaugaaaaauugcacugugccaauuuuaugauaacaaguaguuccuugguacauagaaaauauagaggggaaacauuaucuauucugaaugaaagaagagcauuucuuguuccaaacuuucuucacuuuaacucuuuuuguaaauagucauuacugcacaaccaaaaccaaauguacauuuugucaaaacauuucuuaaauugccauaucuucucauuuaucuucccacagaugaauugggaugcagccaccuuggucaguccuaugagucuagagaugucuggaagccagaaccaugucaaauaugugucugugacucaggaucuguccuuugcgaugacauaaucugugaugaggagccacuagacugccccaacccagagaucccauuuggagaauguugugcaauaugcccacagccuucuacaccugugagucuguagaauauauaaacucuucaaaaucuacaucuucaagaaccauauuuaaacauguaaauagucucuacugcauagaggucugaaagaaaugcaagccaugucuguugccaugacaagugaauggugucacuuuuaacagaaagcaggagauuggguauaaucagauuuaagaaauaaagauguaaauugugcuacaguuuacauauauuaaucucuauauucuuuauauguuauaggcuccugugcuuccugauggccauggaccucaaggccccaagggagauccgguaaguaacaucuccccaaggacaauaguugcuaacgacauuucuagaaaaggcugguuuuccuuguuccaacugaauuuucaucauucugaauuuucuucuguccuaaguauaugaaaaugauggcaaacucauacugaaugucuauaacugaucacauauguaaagguucaguuuucccaaguuugaaagucuucaacccuuuuuccauuuuaaagagaaaauguaggucaugauauaaaggaaaacgauaaaccauuauucauaagacuuaguuugaaauauacuuaugccuaaggacagauuauuguacugauaacuaguuugguaaagcauagaaaaauuccuaauaaugauucugaaccacuucauguuuucucuguuuuguuguuuuguuuuccuuguuuuguuaggguccuccuggcauuccugggagaaauggugacccuggccuuccaggacaaccaggucucccugggccuccuggcuccccuggaaucugugaaucauguccaacugguggccaaguaagaaauuacagaauuaaauucucuucuauauaagugccugaguuugucauuguuuggucuauauuuuuaucucauaauggcaacuucuguccucuaguuuucuauauuuauaaaacccuuaguguuucuaugugcuaagagccuuaaaaguauucaacugucaucauguaauacaauugcuacuauauccuucuaaaguuucccaauuucucaacauguccacauuacacucacuagguuugauaaacagacuauuagcuccuaaaauaguuaucuuagaguauuuaggaagugcgauaauuacaggcaauucccuaaucuuauccaagcacaaauggcaaagacuuacaaggcugggcacuaaacagcugcuccaaaaacugccuauugaauucauauaaacagaguugcccgugcuucugugcagccuuuaaugcacaucuuuuucccuucugauuuagggcaaccaaucagucuaggaauaaaauaaauaacuaagaacauaaacauuguaaaguucugcuguauggguuuacacgaacuuauaaaacuguacaaaccaauauguaugauuuauaaaagguauuuuccaaaacaauucagcagcaaggagcauccuagaaaucaaauagagccgagcuagcccuagaacucaaagcaagcucugagccuuucugauuuguuuuauuguuuacaaugauucaugacugaaguucagcuuuuauuuuauuaaaucauaggcauggcauauauauaauauauauauauauauaauuuuauugacuucuugaaaaauaauuuuaauacccauuuuucgucagauauuagaaacuuggauuuuguugcuucaaaguuauuuuguccucaaauauuggaggauucuguguauagugcuauaacaauuguguagaaauaaugguuucaguaauaacauuugagaccaaauugaagaggacaguuuuguuuaauaucuaaaguuaaaaucuccuccauacauuacacaagcaagcauuucuauagugugucuaauauuuaaagccauaaaaugaaacaauaagcaagauauacauaucauauaugacaugcagaaaugucagugaacaguacauguuacacacacuaacuacaaaugcuuuggaaaauaacuaugaucuuuguauuaaugugaucugaucuauguacuuaacccuuuugcuacagaauuauucuccccaauucgacucauaugaugucaagucuggagugggaggaauggguggcuauccgggaccagcuguaaguacaaauguuucugaguguuuucaaguaucacacugccuuuguuucuucuagaaauacaauguuggcaugcaauuguacaaaaagauucauugacuacuaagguuggaagagaaaacagcaaccuguccaugauuuuucuauccuaacucauucccucccuguggcguuuuaugucauuccauauugcugcuuccuaaugcccaccuguacuagggcuuuuuccaccaccaugcucugguccguucuuuuuucaucuaauguguaacuaaauguaguuuuguuagggauugcuucuacuuuacauccucucacccaaguugcaucuuuuuucaucuuguucacugauuuuuacauucuaaaugaaguuuaagucaugaauguccuauaucacagucuguuuuucauucggguuuuaaauccagcauuagcaucuuuagaaugcauugaucuuuuauguuccacuaccauaaacaauaccucaaccuugacaguaaugggcuuucaaaacuuucuaaaugaccgagaauuuuaguaacagaaaagagcaaaaaguuugaaaacuggauuugaagucaccgauguuggugacuuuugcuuuggaauagcucucaggaaguacaacaauauugaacccuauaauucagagaaagaucagcauaaauaaauacaguauagcauauauuugucaagguaaagaaaaaauuuuuaucaguaaauccaaaguaccuacaaaagaguacuguauuugguauaaaagaaauugaaauauauauuucuucuacaguuuuugauaugauuuuuaaaacuauuugaaaaucaaauggagauuauauuauauuuguaaauauugguuauuauuacacucauguuauaaauccucccuuaaaagauuaacaaaaccaaauaaaacuacaauuuauugacauuucagagagauaaccuaaaguuaaguuaaaauuuuguuaucagaauauaaaaauaguauaaaucuguuuuucuaguuuggugugaauuucugaauaaugucuagauaaauuuguuuuaaguugugagugccccaugcauaaugauucauguuuauaucuaaaucuucacaucaacauuacugugguauaucaugauagcuaugagguuuggaguugacugacaugguuauuguagaaacuuauaccauaauaucuauaguaugaagauauuuccacaauaugcuuauccaaaaaaauuuauaaccuagagagguaucuaugaaauauuauaaagcuuaucaucacauuuuauacugacuuucucugaauucccuuucuuauguguuagggcuaacauauuuaagauuaauugguaaucuagacugucucucuaauuucaucugaaguaaaguuuucaugcaaaaaucuuuauugaaaaugucccagaacuaaauaugguauguuaucagauaacaagauauaaaguuguauauguuauaauacauacuggcauuauaugggaauagacacuacucuacaauguggacauuuaucuacuggguuuguuuaucauacaaauuuacauuccaggguccaccaggcccuccaggacccccugguucuucuggacauccuggaucuccuguaaguaucauucuuuuuggugcuuucuucuucaugaauauaugaagcaagcuaaugcaguuauggauauaaaucagccauuucaguauccauaaucccaaccaauaaauaauucacuccccaacaauuauuagcaauuaaaucuuugguaaaauuaaaauacauauuacauguguauacaacagacuuuggaguccauaaccacucaauuucggugaaauaaaagaaaacuaacuuuauugugauccugaaaaccucuuaaaucaucauaaaauauaauaaaauuucugccuacauccacuaaccaugacuucuuacaauaauccagaugugauuuacucaugugaagcucuuguuaccuaaauauauuuacacuauucuucuauuuuaggguucuccuggauaccaaggucccccuggugaaccuggucaagcugguccggcaguaaguaacacuugagaauugcuaaacacauugaaaauucauuucccacaugaauucuaucaucaguuucuaagucauucauuguucaucuagaguguagauugcacacaugcuugaauuuuccaugacaauauagcuuuuuuucugugaggaacuugaggugaacucaaagacuuuagagauuccugacugguuaaccaccaaaaaucauccacuucccagaaauaacaaaauuuccuaucuaggaaauacaugucuaauguuucuguagauucguuuuauaugaauucuaccacaaugccuacaaauauacauacaucugcauagugcagagagaaagacaagaauauccaagaauaauaugccauauagguaucaaaaauuaaaauaaauguuauuuuaagacaauauuuugaaauauugcaaaauguuuuuauauuuuuguauagucauuaucucaaaauauagaaauacaaauauaaauauacauauuuaguaugacauagauacaugauauuuaaauauuucacuaaaauuuauucaacacuaaaacuuaaauauaaugaagguauaauauuaauucagaauaauuuucauggugaggacagagggauguuucaaagacacauuugcuuccagaaugcaaauaucauacaacaagaaaauguaacacaaaauauugaauauuucuguuucuauuuucuuauuucagggcccuccaggaccuccuggugcucuugguccagcugguccugcuggaaaggauguaaguacuuauaaguuaaauagaaauacagcaacauucauguugaaugacagacugccuuaaauguauccacuuuugaagaaucuuaguaauggaagccucuuucaaaaaaauuguacccaacaaacauuuuagcucauauuagagguugggaggauucccacagcauuuuaaaauggauguccuagcucaaauuaccuuucuuaagaguuaugucuagcacugauuaguacuuuuuauugcuucuaggguaauuugauggagagucacauucucuuacuguaauguucauuagaaaucuuguuaaauuuauucaaucucugaaucacugugugaugagaugauuguuuuuuuucacuuucaggauauuaucauugcauuuaaguaguaaucucuguguuguacucacaaagcuauacaucauuugauaaguucuauacuaauagaacucucagaucgacucuauuuucauuccaggaauggcaggauuuuuuucccuuauauucugucacauagacuccauauauuaauaucauuucucuauaagcauaaauuuauaaauauuaaauauucucccuuuuugccuauuuaacuuccaaugguaaauuccucuuauugauuugggaaagagcugaacauuucaggaauaugagacauuuguacuauuucuucauagaguuauaucaagguaggagaagccucccugaguucuucuauugagaaaacuggugucacauugagcaagagacacucacuuguaaucugagcacucuagagguguggcugcaagguucaagaguacaguaccagccagaguuaccuagggagaaugugucuuaaaaaauaaauaaucgaaaaaauauaugaucucacaacuauacguucaguccaaccagauugcucccuacuuauugcacauuugcccauacauaaaccuuuauauauucuuuauuucucugccuagggagagucaggaagaccuggacgaccuggagagcguggacugccuggaccuccaguaagucuucauuaaauaaacuaccuagaacauacaaaguauuuuaauuuuaacuucaaaaaaaaacccaaauaaucaaauuaaaauaaacaucaaaauaaaugcauuuuuaucacugaauguugacuugaauguuaauuaacaucuuucccauucauuacuuuuaggguaucaaaggcccagcuggcaugccuggauucccugguaugaaaggacacagaguaagugacccuaauccuaacccuguauucaugaacuuagauauaauuuauaaauggacagagcacuuuuaguuuuaacaaacuuuagauaaagucaauccauccaaaaucuaucaaacuaagaacaauauccaucaaacuagaguuuauucuucuauacuuaagacaacuuuuuaaucauacuaaauugaauguucucauuaguuucucuuuuuuuuguaauaauacguugccaaauguucagcaguucaaaauacuuuacaugaauuaaauuaucacuacauuagccauauauaauaaaaacagaaaugaaaagccaauguaaaacuuacuaacuauacugaguuguuaacaaauuuaggccuuugguccugugaagacuuuaugccucaguguaggggaauaccagggacaggaagugggaguggguggguuggugagcaaggggguggggagaggauggggagggguuggagaggaaaccagcaaaggggguaacauuugaaauguaaauaaagaaaauaucuaauaaaacaaaaaauaaaaauuguuuuuaaaaauauuucuagggcuuugauggacgcaauggagaaaagggagaaacaggugcuccuggacugaagguaaauugcagcacacagcguucaugaguaaacuccuuuagagucuggaacuauguuaagauuuaucuucugggaccuaacuuggucuuacaacuguucuuuucauauagccauugcuuagcuauauguaaaucuuaagucuuccaugaaagcuaauaacaaagaauccggcauaaaaauguuuguauaucucagugugucuaauaaacaauauguuuaucccucgugcauuuaaaaugcagaaacugaaguaucugauaaugaaaaucaaauucauucagaaauuugauauuacuaaaguacacauuuuucuuaguauuuucugugauacaauauuuguaaugucaaaguguccguugcacaaaauaguaacauuuugcauaucccuagggugaaaauggucuuccaggagacaacggagcuccuggccccaugguaauuauguuuccucucaugugauuaucaauauuaguauuaaacuuccaauccgauugccuuucuccuuuccagcuguucucacacaugucacauuuacauuaaggucaugcuuugaauuuugguugcaggguccuagaggggcuccuggugagcgaggacgaccaggccuuccuggagcugcagugaguauugccacaguguacccagauaaaaguagggguggucagcucagucaagcuuuggauguaaugauauggaaaggaaugucuuacaauugcucucucuggucauaauuuugauggcuguugggauauuaguuucauaauucauuagagcaacauauucgcauucaguucuaaaagcccagaaucuaguccugauacauaucacuaauguggugccccaacauucuaacacugagucuaaaaauaugugaugaguaagcaaauuuuaauauauuugaagcaaauucaacucaacugagcuuggauuguaguuauaacauuacuuguaacuaaacuuucauaauaaaauguuugaaaccaaacuucacuuucuuuuuuuguuuuuguuuguuuguuuguuuguuuuuguuuuuugcuuuuuuguuuuuuguuuuuguuuuuguuuuuguuuuucaagacaggguuuccucuguauagcccuggcuguccuggaaccaaacuucacuuucuuuuuuuguuuuuguuuguuuguuuguuuguuuuuguuuuuugcuuuuuuguuuuuuguuuuuguuuuuguuuuuguuuuucaagacaggguuuccucuguauagcccuggcuguccuggaacucacuuuguagaccaggcuggccuccaacucagaaaucugccugccucugccucugccucugccucugccucugccucugccucugccucugccucugccucugccucugccucugccucugccucugccucugccucugccucugccucugccucugccucugccucugccucugccucugccucugccucugccucugccucugccucugccucccaagugcgugcaccaccacacacagcucaaacuucacuuucuauauuugagagaaauucaguuuaaugaucuugaauugcagucugauacuuuuaauuaaucuuucauaaguaagaaaauauugagacaaacuucucuuuguagggugcucgaggcaaugauggugcucggggcagugaugggcaaccugugaguaacuuugcaucuaauccugcuuuguucuauagugcuuagaaauuuugaauuacauuuauguuauauuauauuauauuauaucauuauauagcaaauccauacugcuucuugauuauuuuuaaccuuggaaauggaaacaauuuguaggugucauacuagguugacauguacauggcauuuguguuuaauauccaacauuggacaugccgauuaaaagaaaugcaaaguagauagugauaguaucucuaggauguaaagauuacaaaggcucagagguaaguauccuguaagucacaggauuaaugaaaaaguguauaggaauacucauguucaaacuucagauguaaccccuuucuuaucuuacacaacuuuguuaugugcaaauuguacguuguuuuuagggucccccuggcccuccuggaacugcaggauucccuggauccccuggugcuaagguaagccuacaguucuuuagaagaauguauaaaauagacaaaaauucauucgauugcuucucagaauugaccaauaaaaauaaucaaauguacauuuauuuucauuuacagagagcuuuagagcuccauucuagucuccuuucucucucucucauacauaauaugugugcauacauauguaguauauggcauauauaguauauaauauauaucauauauauaugcauaauauauucucauuaguauuguaccauccugauaugucuucugagugcuucgacuuuuuccaacgucuuuucugggaaacaccuauaacaugggcagacccauauuuaccauuguccuuuguugcuaugauuaauaauccuuuguuuuaacuauugcauauaaccauaguaauauagcuuuagggaaaugaguuuaaacagagcugaaagcuaagcuaaguuauuaaaaaguggaaaggaaaacuuacauguuggaauuugucucuuuagggugaaguuggaccugcaggguccccuggcucaaauggcucaccaggacaaagaggggagccuggaccgcagggacaugcuggugcucaagggccuccuguaaguagcauauaagagggaauucaagcugcuagacuuaguccauccgugcagguugcuuacacuaaccaccaagcaggaaauaaacaaaacuaaaguucucuuauuccuuuauuuuuaauaauuuagaacaaguaucuaucugacuuaauucauauauacacauauauagguauauguguauaggugcuguugcuagagaaauaacauauucucugcaauacauaauaccuaucaguaaauauauucucuaaacagagaacuccaaauccaugugcucugauaauaugcucucucaccuuguguuccuagggcccucccgggaauaacggcaguccugguggaaagggugaaaugguaaguaagcugccccacccucagcucuuccuuacacagaagaauuaaauauuuaagccagacaguagaaaggaagguccacgcuuugcuaaugagaguguuuguguuguuuuuaggguccagcuggcauuccuggagccccuggacuaauaggagcaaggggccccccuggaccagcaggaacuaaugguauacccggaacacgagguccuucaguaaguucgucucuccuucaaugccuggaaguuuauguuuaacucucacaacaaaauauugacauuccuuuugcuccuucuccauuuaaguuauccagcucucccucuagcucuaugacaguauaacaucuagcuaauugugauuuuguuagucaaauccuuguuguuuuuacauggagauuucguuucauuuuagggugaacccggcaagaacggugcgaagggagagccaggagcacgcggugaacgggucaguauuaagccaacaggacuuagcuacucagacaacugcagagugaugagaaaguaaugaguacguuucucaacgaaaucuagucaaaauucuuuauguugucagggcgaagcugguuccccaggaauuccaggaccuaagggcgaagauggcaaagauggaucaccuggagaaccuggugcaaaugggcuuccaggagccgcaggagaaaggguagguuuccauuuuuaccuguuucacuauucauugggacacaguaaccuuugauuuuuuuuguguuuguuuguuuguuuguguguuuguugagacagggucuuacuuauaaacuagguugccuugaccuuuacucuguggcuaaggcuggucucaaagucauggcaauccuccuaccucaucugccccugcuacuuagauuagagguaugaaccuccacaacaguuuaagacacaaggaaagccuguaauggugaauuguuuuuacacaaugacucacugaagacuggccccaaauuuagagauucuccuaacucugucucucaaaagauuaaacaagcgauauaaauugugaaccacccgcccuucuguccaguguuuuucuuggcauguuuagcuuaaacuuaaaaucugagugcuuauuucuguuuuguuuguacauuuuguugauugguuuuccugugauucaggauauuucacuguuuaggaguuuugguuuuguuuuuuguuuuauuuucucagugcuaggaacugaccccaugauguguuuuguggcaaugcucuaccacuaaauuaauucccacauucuguaauacuuaguaauacaagaauacuauauuauacuuagaacuuaguaauacaagaauaacuauauugcaaccuaugaaguaugaauagguuuuaaucuuuuaaacugaaauauuuaacugugauuguuucuaggguccuaguggcuuccgaggaccugcagggccaaauggcaucccaggagaaaagguaaauacuucagcuccuaaaauccauuacuacaaauagguauuucuuucauauguuauaccacuaaugggagaauaaauaucugaaggacauguaaccggauaauaaaacacaaaccaucaccaugugacucuagccccuacuuugauacuuucauggcuaucugacaaacuaaaucuacuucaugcaugucauguccugagugagaagucacuaaccucagggucacugcaagaauuauagaaaucaucugcacauauggaggaagcuccaaaggaacuucuaaucauuaaauuuccuuaauuaaguguaaaaaguaguuacuuccaauuaauaauguugguuauaagcauggaaaauucaucauaguugcccaauuuuucuucaagaugaaaaccaaacuaaaacagaugauuuuuauagaucagaauacagcaacacaaaacuguccuugagaggccaaaaacuccaacaguuauagauuaaguauugucaaugucuauguuaaucaaaaaucuuuaugacuuguuaucucacaacuuaggguccucccggagagcgugguggcccagguccugcaggacccagaggaguagcuggagaaccuggccgagauggaaccccuggagguccagggauacggguaaggagacacauuuguuugacuaaugcuguaaacugguaagaagaaagacaauacaaauaaugagaggcuaaagacaacuucacaagaugauaccuuucaaaagucucaaaguaaacaaaccaaauuccuuauuuaaaaaaaacaaacaaauaaacaaccaugggucaagacagauuaaggaagagaauaaaacuaaauauuugacuaggaucaguuuuuaagcagaaaauagggaguacauuugcaaggauacauauaaacacguaaaucucaaaguuguacauguuaacuauguuguacuuuuacauuuuaagucacaugacugcuauacuucucauuuaggguaugcccggaaguccagguggaccaggcaaugauggaaaaccaggaccuccuguauguacaauuaugaugucuuguuuuacuaacccaguaaaaaaaaaugaaaugcauacauuggauagauuugaguguguguauauguauguguauuauaauuagauuauuuguucaucaaguccugauuauggcaaguguuuuucuuacuagggaagucaaggagaaaguggucgcccuggucccccuggcccaucuggucccagaggucagccuggugucauggguuucccugguccuaaaggaaaugauguaaguucuauaauuacuuucuucaauaaauauuugacagauugauggccuuugaccucuauaugaaaaugcaaaaucaccuaauaccuagccuaucauuuaaacaugaaagaaugugugacaauugagcagcauguaugaauagagacaaauauauaguuggcaauggguguauguauguguguguguguggcuuugcauguguagcaggaucaaaaaaugggguuuggacuuuuauuagugaauuacuuuuugaguaucuaaacccuugcuuuuuucuuuagggugccccuggcaagaauggagaacgggguggcccuggaggaccuggccuuccaguauguagcuuugguuuauuucuggcuuucuaaucauuucagccaucuucagccucaauacuuccuuguuauauguguuaauucuguuucccugacugucacuuuuguaggguccugcuggaaagaauggggagacuggaccucagggucccccaggaccuacuguaaguuuucauauaauuaagauagagguaggguagagauauaacaaagucaauaauuuagaauguauguuaucucuaccacugugccauaauauuucaccaagcaguuacuagacuuucuuauuuuauuaucaaguuaaauguuggcauuaauuauauguuguauuaaugugcuugaauaucuucuauagaucaagauuucccuacucuuaacauuuuugccuuuuaaaguaagcaauaggccuacugagagguggacuauagacuaacuaggaaugacaauuuuacaauggaguguauaauugugcuucugaaccuagggcccagcuggugacaagggagauucuggacccccugguccacaaggauuacaaguaagaguuuguucuucaaauguuauuaguuuuuaacagacaauuccauauuuccuuuuuguaccuauuuuuauuacauaaauauacgucaaaauuuugugagcaggcuacauguucaucugaaacuuaauuuuuaaguuuuucuuccauccugaaauauagcauuaauaguaguuuucuucuauugguauucuagaaugcacauauucauuuauuaaaaaugaguugaacucaaagaguucuauaugcacauacuuuucucuauuauagugaaaacuccacauagcuaaauuaaucuaucuuuaucucuuaguucaucuguauauauauagaaaacaaaaaauauagaugugagcacagguuucuaauauguaacuauccucuaucugucacugguuaaugaaugaggcaaacauuuuguaccuuaaaauuaugaaaauuacgucauuaacuaccuggaaaauacauuuauauauaaaaagcuuucacauagcuguguuugaagugaucacacacaauguaauuuuguugauuuguagggcauaccugguaccggugguccuccaggagaaaaugggaaaccaggugaaccaguaaguugaaucuuauuuuaaagaggcuaugccagugccuggcaaauacagaagugggugcuuauagucaucuauuggauggaauacagggccccuaauggaggagcuagagaaaguacccaaagaacugaaggggucugaaacccuauagguggagcaacaauaucaacuaaccaguacccccagagcucaugucucuagcugcauauguagcaaaagauggccuagucggccaucauugggaagaguggccccuugguuuugaaaacuuuauaugccccaauacaggggaacaucagggccaugaagugggaguggguugguaggggagcagggcaggggaggguacaggggacuuuugggauagcacuugaaauguaaaugaagaaaauaucuaauaaaaaaauuggaaaaacauagcaacuaagugaaaaauaucaaaauucauuuaucuauuauuagcuuuguauguucuaauagcuaaguuuuuauuguguagaucaaucgguacagugauugcuagcaugcaugaaacacuuggugaggccucuagcacaguauaaaccaaaugucggccugucuucucagucucuuuggggaggaaggcagcagcauuaucggaaguucaagaucacccuuggcugaaugugucugaggugcaugagacccugucacagaaauaacaaccaagcaaacaugaguuacucauaaugccacuuacaaaacguuuauauuuuauauaaaagaacagaauuaagaugcauagcuucauaauuuaaacaauugcacaauauagaggcaugacagacgucaauguuguuuauaccugugcagugcauacugacaaaugcuuaccauacauaauguugaccuccuaggguccaaagggugaagucggugcuccuggagcuccuggaggcaagguaauuucuuuaccuuuuuaccauguuauggagcaacuugauuagagaaaaaauuuuaaguacauugaacuaaaggguucuuugcuuagaaaaauuagauucccaauguuuaguacauccauguaagcaaacggcaugcacuuccagugcauuaauuuugcuccauuugaauauucuaacauuacaaagcaccacagacugugccaucaaggggaaagacaggugauguauggcuucccuacagagaacucuccugguggcagaagcacaaacuuuaucucucugaauaauaacaguaauuacuuuaaagacaugucuaguuuaaccaggagaaauacacauuucauuuugcuaggcuuuuuacaagauuccuguucucaaacaauaaauuaaaguuuuauacucauaaaauuugcaaaacuauuaaaauuucuaacuucaaaaccuuauuagacauaaucaaaacuacauaauuuccagugcuuuucuuuucugacaaugugcuucuaauauggacauuauauuuccaaugauagggugauucuggugcaccuggagaacgugggccuccuggaacagcaggaaucccuggugcuagagguggagcuggacccccuggcccugagggaggaaagguaacuguaguugcugauucccguaaauauuagagaaugcacuucaauugcuuucuugucauuugccauguauuucuucauugcagggcccugcuggucccccuggcccuccuggugcuucugguucuccuggucugcaagggaugccaggggaaagaggagguccuggaaguccuggcccaaagggugaaaaggugcuuauagcugcauauguaucaaaagauggccuagucggccaucacuggaaagagaggcccauuggacacgcaaacuuuauaugccccaguacaggggaacgccagggccaaaaaagggggaguggguggguaggggauuggggguggguggguaugggggacuuuugguauagcacuggaaauguaaaugagcuaaauaccuaauaaaaaauggaaaaaaaaacacaccuucuagauuaaaggaaauucccaucacuagaaacuauuuucaaaauuauuguuaucauuuuaaaugaauuuugacauagaguccuauaacaacuaucaaucaaaauaucagcucuaaccccagcaaauccugaggauugcuauguuagacuggggauguuguuaucugaugaugcuugcuuuugauucgcagggugaaccagguggugcaggugcugacggaguuccaggaaaggaugggccaagggugaguauucacaucagugagaaaugagcccugauuauaugcaauauguuguagacccuuccucagcuuucacuguuucauaaaaugagaccauauguuaccacauucugaacauuaaacaguacugaucacuucccuacuuaaauucuuagcuucuaucuaccacuccgugauaguucuacagugaccuaaguaugauaaaagcaaggaauggauaccauaauguaucaagaaauccaaaguaauuaauaucguuaagaaauacaguuuuaaaaauauguuaccauaagguauuuuaucacauccuauuuaucuucucuaauuaugguuuaaaaaaagaauguaucaaugaaaucacuuaauucaauuaccuucuucaaucauacacacagaauagugaacuuacuaaacucucauacuuauacacagcaaugaacaaaucauuugagccaagagagagcaaaaaucuacccacuuuagugguaaauaaaugucccuauacucugauuaauacaagaaauuauguuuauuuuuucaaaacuaaagacacuucuuccugcaggguccugcuggcccuauuggucccccuggcccagcuggucagccuggagauaagguaacaaaacuacuggaaacaaaaaucaaucuuugcuuuaauagacauagaacaguaacaauaucauuugaucuuuucucagggugaaggugguuccccuggacuuccagguauagcuggaccucgagguggcccuguaaguauuaaaggcauuuucaucauacucucaacacaaaacaguccauagcuuuagcaacuuugccccugguauucugaucuucauguuuaaagcucuauguuuaaaauauaugagaugcaagaauauauuuuaaaauguuaaaguccucaugagauuauuuacgauaccuuauuaacugaaaaacucuggggaaaguacauaauuugaaaaacaguauauauuucuaaaugagcaucucuuaaacuuuaccaaaagcuuauccaaaucaaaaauccuuugccccuaaaaagauuuggcaaucaagauaaagcuacagaaaguguauuuguuuaaucaauguguuaguagauauuuuacccuucugccaaauguuaaauacuuuauacuugcaauauuuaaguguauuaaauauuugcacuuugaugauauauuccuuggaaguuauaucucaguucagagacagaagaaaucaacaguugcagugcuguuccuuucuuauguugauaagaaguaaaaaagacuuuuagauacagagacacauaaugccuguggagaaggccuucacugugacuaauaauauaccuuccuucagggugagagaggugaacauggcccuccaggaccugcuggcuucccgggugcuccuguaaguauggacuucuaagaauguauaucacaaugcuuauuuuaucaaauuacugaaaacuagcaaauaaaaauguuacccugguuccaguauuucuucagccacuuuaccauucgaaauuacuuuaucccuuuuuuaagcagcucaaacaccaauccuucuuugugcaacaucaugaugcucauuuucaaauucaagggaagauccuucuccuuuuccuccuccuccuccuccuccuccuccuccuccuccuccuccuccuccuuauucuccuucuuuugccacaguauuuugauugguuuugcuuuggcauaucuucuaagagccuccuaucccuauuugauggcaacaacuucccagcuuaaaaaaaaaaaaguucuacguuuuaaagagaaacaaugauaagucaagcauguugugaaggaacuugacucacagauggucacuguugcuguguucagggacagaauggugaaccaggugcuaaaggagaaagaggugccccuggagagaaaggugaaggaggcccuccaggaccugcaggacccacuggcaguucuggaccugcuguaagucuuauuguuaaaccauuguguaagacauuuugguuuauuacuaaguuaauauuucauguaagauuuuuguguuaugggaggagaauauaaucuucauaggaauauaguccuuaauucuaauuuucuuuucuguaauuuggauaugaucauaggugagcuaauuuaaucucuucagggagcauuacugguuuuccagugauuaaugauuuucucaaauguuuauuuuauuacuuuacucaauauuccuuuccuuucauuuguguuuaggguccgccugguccucaggguguaaagggugaacgugguaguccuggugguccuguaaguaugaauucucuuagcuaucauucuaugacuguuauugaacauaguuauugauuccaaucuaagugaagaccagauaaugacaagaaaacaacagagagaauacgauagucaggguuuaguuuuguuuuguuuuguuuggggggggggggugguuugguuugguuugguaguuguguguaaauuuaaagagaguuggcaaauccuaaauaacuucaagauagaauucaauuccuggaacauuccuuaccuucauauuuauguguuuacagaguuuuguuuuagucuugaacuaauugguucauugacauuucacaggguacugcuggcuuucccggugggcguggucuuccugguccuccuggcaauaauguaagcucucuccaguuuuuuuuuuuuuucaauauaacuuacagaaagacuagaauaagaaaauauuuugauaccuaccaaauuuggcaucuaccaaaucccaccuaaaaucuaaaauaaauaaaaggcaaggaaagcaaaaagacccuuuucugccauguuaaaauuuaaauuauuugcaggguaauccagggcccccaggacccaguggugcuccuggcaaggacggcccuccagguccugcaggcaacagugguucuccuggcaacccuggaauagcuggaccaaaaggugaugcuggacagccuggagagaaggggccaccuggugcucaggguccuccggugagagcuauugcuguuuuguugguagacugcauauucugauaacaaacauaauaagggagcuaggauucuguagccauaggcugauucuuucguaucuauuacaacaggguuccccaggcccacuuggaauugcagggcuaacuggagcacgaggucuugcuggaccaccaggcaugccagguccacgggguagcccuggaccucaggguaucaagguaagcauagucaccuugcaucugauguuugcuuuacuacagagguauagagauuucuucacuguaucagauauaaaaagguuucugaucaagguauaaauuaucaaagaucuuaccuucuugacacucuuagguuugcaaaaacaaaacuuucauuaagucuucccagaacacaccggcaagggacguaguaaacaagcuuugcauauauacacaagcaagccaacaucacagaaaaacaauguugcuuucucaaacaucacuguuaggaaacuugugagcauucuucaguugguucacuauaacuaggaagggagaaacuuuuucaucucauaaauguaugauacauuaauugauguaaauuacccaucucuugaagucaaaacuauugguuugccuucacugauauuaccagaacaugauagugcuuaguaucuggaauguccauucaaaaaagaaguuaacauaauuccacucacaccauauuucauagcauaacauuuuaugcaccuuuuucaaaauauuucagaaaauaguagcaggaaauuuaacaguaauuaacauaucuaggaaguuucuaauaaauucugauucuaagggucacugagaugauaguuuaucauuauuuuucuugcuguacucacaagcuucuguucuucacaaucaacugugcucugauuaagaaagcauuuuacuauucugaaucccugagacacuagaaaaauccaaaacccuugcuccccauuuuucuguuaugaaaggcuuaguuucaagaaaaguaaacaucaauagaaacugacuaaaucacccuccaaucugguaauaccucauuaguuggaaucacaaagugaaauguauucuguuucuuuguuugcagggugaaaguggaaaaccaggagccaguggccauaauggggaacgugguccuccuggaccccaaggucuuccuggucagccugguacagcuggugaaccuggaagggauguaaguagcaauucaggaauaguguucaaccagucagcaaauacuccaguuguuugguuuauuuuuaaaauuacaguuauuagauuguguuugcuaguguguauaacuaugagcacauaagaacuauggugcacauauggaggucagaggacagcuuucaagaguaaguuuuucccuuucacccuuuagcaaccaggauauugaacucaauucaucagguuuaguuggaauaaucucuagccccugaaacaucucuccagucugaaauucaaguauuaguuaaagaaagguccacuaaaccuuaauauuugcgauuuaaauaaaauguguccauguagcagaguucuucuucccucucugauaaucaaucuuuuuguaaguuaggcuaauauguucuaugaccaagaacauuucccaaaauauucaguaauaaagagaacguaaccacaaaauaauuuagaaaauuaguuaauaggcaaaauuacaagauucaauuuuauauaaaaauguucauuauucauucaugauuauucuuaauuuuucaauuaacauucuguauuaaaauauauuugaacagugugcucugggauuuuugagagguauauuuagcauggaaauauuaaaugaaguuuaguuuuagauuuucauaacaaauuuagauuucccacuucuaaaaaaauuauuuauuagcuguucuuaaaaaccauuuuaggcuuucuuuuuauuagcacuccccucauauuuauucaugaaacuuuaggaaaauagaaauauccuccaaagaaucauggcucuuuaaagaguuaaaccacauuguaaauaugugcuauuucuuuucaccagaagcaacuucggcuuccacuaggacagaggggcagcaagggcgugggaauaucagaggggagaaaaguuuacuaaaauauccucuguucaaaacugccauaauggugugugacacuuuguauacaaacuauaaauuaucuuuaaaaggguaaaaggcucucuuuuaacucucuuuuaaacagggaaacccuggaucagauggucagccaggucgagauggaucuccugguggcaagguauaacaaauucauguagaguagacauguguaauuaaauucaauggccuucaugcuuauguaagauccaugaauuuguuccagggugaucguggugaaaaugguucuccuggugccccaggcgcuccuggucauccaggcccaccuggcccuguugguccaucuggaaagaguggugacagaggagaaacugugaguucuaauacaaugcuucguucgauauaugauauaugcucucauccgucaaaaagaggcugaggcgggacaaugggaugguccucuugccaucaugauauaucugugcugauuuccauugguauuaauugggcagcuuucuguuugcugugggaaugaugucagaauuuacagaacucuagcuuccaauaacaguauguguacuaugaucccacugcaaugaaguuagcauuuaaaaaaaaaacaauuuucauuuuugaaaaaauuucagaauuguuuauuuuauuuaauuuuuaaauuaacuuaauuuuuaauuaaucuuuuauacgguauguuucuccucccccauuccucucacaucuuccuguccuccuuacacaauuaacguuuuaaaauggaguugaaucagugacaagauaugguucacacugcaguuguucaauugcuugcuugcauucuagggcccugcugguccuucuggugcuccaggcccugcuggagcucgaggugcuccgguaaguauuagacauuuguccugauguguuuuuaaacucauuuuagauuauaagaaacacccugcugcuuuaugaaaucucuagaaaguaauuagaaugacagauauguaacuauggagaaaauauaaacuuucauuugaugauacagaaaaaaaucaguaucuaaaaguucuaugcagguagugauaugagaauuacaauuaucaauccaaaguuaaagcagaaacaaucuuugugauuacguuugugaagucucuuuugauagggauuucuuccuaagauacuauauuuauuacaauaaaucuaauagaaugcuauaaaauauucauuaauaaauuaauaauauccuauagguuauaauauauuuacuauaagcuuaauuuuaaucuuucaauaugacuguauaagaaugacucuaauuaaaaauguauuuuuaaaggguccccaagguccacgaggugacaaaggugaaacuggugaacguggcucuaauggcaucaaaggacaucgaggauucccuggcaauccagguccuccagguucuccuguaagugcaucaucugauguuagaaauucuccuuuacugcauaccuuaugagacagacuggagagaugagacaugaauucaagggcauauuugaaguaguaguuuaacaugaaacaaugaaugaaagaauuagaaauguuuguuucauuggguccugcagaauuugcgaacaguuccuucccuaagcccugaaguccuucacuggucucuauccccuuuuugcuuuccagggugcugcuggucaccagggugcaauugguaguccaggaccugcaggucccagaguaagugucauaaaaauacauugaaaggugaacauuucaaaauguuuacacagcaggaauauauuuucugcauuauaacaccaucauguucauuucuuaagggaccaguuggaccacauggaccuccuggaaaagauggaacaagugggcauccagguccuauuggaccaccagguccuagaggaaacagaggugaaagaggaucugagguaaaaaugcauauacauacacaauuuaauuugcuaugauacaaugugucaccaacauuucauucuuuguaaacuagacaguauagucacuuacuuuagaaagugaaagcuaauuuaaugcauucuugauugcauuaaggugguuugugucagaauaacauggauauauauauauauauauauauauauauauauauauauauaugccuuucugagugacauaucaauaaaauaacacauacucuacuaaccaaacaaauuaugccaugcuggucucacaucagagaacucacagauaucauuuuguuucuguagauguuuuacugauucaaugaccuauaaaacucuguauugcuacugauaaaaucauggcuaaugccuucugacugcacaguguugggauaaauguaacaacaaaccauugcaucgacaaauauacauguaacaaaugaaaaaccaauaagucacaagcauauuuugagccccaaagaugaagucccuauuuuauuccuuuucaugccaauauugugccuucuggcuuacaucucuacacagaggaaaugaugaaguuucugcucaauacuuacuccuauguaauagaauaacauauuuauauguaacaaaucauauuugacacacauugacaaucaaaauauuuuuuaauuaaacuaauugucacaacauauguggauugauugcuuaugguucauuuuuauacauaagugacauguuuauuuaguggaggcccaagaaaaacauuucuauguucuauauguuuacuuaucuagggcucgccaggccacccuggacagccaggacccccuggacccccuggugccccuggucccugcuguggugguggugcugcugccauugcuggaguuggaggugaaaagucugguggcuuuucacccuauuauggagacgauccaauggauuucaagaucaacacugaagagauuaugucuucacucaagucuguuaauggacaaauagagagucuuauaagcccugaugguucucgaaaaaacccugcucggaacugcagagaccuaaaauucugccaccccgaacucaagagugguacguucgaguuuucaucuuucaugcuguacacuuacugaaaaaucagccuauauuagaauuugaccaagaaaauuauuccaauggaaaauauuuugaagcuccuguacuaucaaaacauuguuaauugaguugaaaaugcuugauaguaaggaggaaaaaacaauguuugaaggagcauugaagguauaauguaaguaacugcaaaauagcucaaauauaagaaacuuuaucccgaaaaaccaaaaaaaaaaaaaaaaaaagaaauauuauggaugguucuauagaaauuuuaacacaaauauuucuaaauaccaaaccagaaugauuuaagugagcaaguagcauauaucauccuauucccgugguuagauaagcauaauuuuacuauuuuuauuauuauauuacauauuuaaagaauucauuuuaaugaacuaaucauuaaauuucaaauuuuuuucuuaaaucacuccuguuuuuaucuacugugacauguuuaauuuuauuuuucauuaccaagauauauuuauuauauaaaguuagucuuaauauuuucaaauuuuaaaauacuauuuaaaauuacuuuaaguuuuuaaauaucuugagagagaccgcuacuuuuacucagacuaucuucugggcauuaauuaaaauaagaaauaaguacaaauuaaguuaaaauaugccauaaauauggacaauaguguuaucuuugaaauaaaagaugauauuuagacaaauaaaacacaccaaucugugcaucaucagucaaugguaacacuguauuuuucuauuuccaugcuuuuauggugcauacuagcuuuuuacuucagaaauaucaaccaguugugcuacauacuucaaauugauacaguaguacuccaugcacugaaccaaguaacaagcaaaucuucugguucagccuccacuucuaaauuuuauaacuaauucacauuaucucuuuggugacauuucaggagaauacuggguugauccuaaccaaggcugcaagauggaugcuauaaaaguauucuguaacauggaaacuggggaaacaugcauaaaugccagccccaugacugucccacguaagcacugguggacagauucuggugcagagaagaaacauguuugguuuggagaaucuaugaauggugguuuucagguaagaaaagauauaaccuuuaaacugagcuaugccuauuacguaacacccuuuuccuuuuacuuguuuaugguuacugaguagaacaccccaaacacuugugugauuaaacaauuauuauuccuauaaaagacuaaacgauacaaggucaguugcauguaaacaccuuucuuuaacuuucuagggcaucuaccuaugcacacaauaaaagaucauauaauguacaugaacaaguguuauaacacagugucagugcuaaugguguaugaaugaaucacuuacuccagguuucagucccaagcuuagauguacuauuuuucuuuaauaguucagcuauggcccuccugaucuuccugaagaugucguugaugugcagcuggcauuccucagacuucuuuccagccgggccucccagaacauuacauaccacugcaaaaacaguauugccuauauggaucaggccaguggcaauguaaagaagucucugaagcugaugggaucaaaugaaggcgaauucaaggcugaaggaaacagcaaauucacuuacacaguucuagaggauggcuguacuguaaguaccaauaucuucagauaggauggcaaauaaacucagaauuuauuguuuaaucauccaagcuguuuugagaagcagaaauaaaacuauuagaagaaauaaaacuaaaagcugcuuggguggggaauuauauaauaucuacuuauuuguuauagaaaauguuaaauauuucaaaaauugaauagaccuuaacuucuagauggaaaacaguugaaaugaaaaugaaugaaauuuaaacucauaaaaauaacuuugauaacugggauauugacuauaaauuacacauacuauuaauuauauaaggucugugagauauaacuauugcuuuaaaauguaaagucuaacugaagauuuauucuuuuuucucauaauucauuaauauuagccacuccuguuaggggugacucaacuauuuccuuguaaguuaacuauagugccacagccuuaaccggauccaggcuugugaaugagcuagccuguggccaucucccuucuggguuaacuuuugagucuugccaggcuuugauuaacaaucuuauuuaucaauugagaauauuaaaacuuaaauacagaagguuucauaugucuagaaguuuacauguauaguaacugcuuugugagaucagaagacaguuuuagaaugugaucaguuaaggaaaacauguagguaauaauacugucauaacuuuuucuuacacaacuuuuucucuuuugaauagaaacacacuggggaauggagcaagacagucuuugaauaucaaacacgcaaggcaaugagacuacccaucauagauaucgcacccuaugacauuggggguccugaucaagaauuugguguggacauuggcccuguuugcuuuuuauaagccaaacucucugaaaccccagcaaaacaaaaaccacauccauguguucaucuuguuuuaaucuuaucaaccagugcaagugaccaacuaaauuccaguuauuuauuuccaaacuuuuggaaaaagcauaauuugacaaaaaaagaauacaauuuuuugcuguuucaaccacccaauacaggucaaaugcuuuuguuuuauuuuuuuaccaauuccaacuucaaaaugucucaauggugcuauaauaaauaaacgucaacacuuuuaugauaacacuguguuacauucuuugaacucuagcccaucugcagagcaacggucauacucauucaccagcauagaauaucuuuauuuccaaaacaggaaagaacaaaauuagacauguccuccucccuauguuaacuaccucaacuggucagaacagauagcuucugagaccugaagacuauacaaucauguaaaacuugacaaaacuuaugaauuucauugguuagccauguagagcguuaacuagaauuaaaaaaaacuagacuauagagcaggaauuugaaggaguacuuucaguucacaauugucuucaucauagguauaaaugcuuuuaaaggugcuucucuucugcuguugcuggugaacuugcaaguaucuggaagggcuuuaaagacacauguuaaggugcuaauguauuuucacauuuagaacuccagaucaaaauugguaccuucauucaagccauaaaugcaaaguaucuauauuugucuucugccagaaauauugacuggcaugccacaggaucuucucuucuuuuauucuauaaaaauaaacaacgaaaaacaaguuugguuuuuuuuuuuucucacaauaacacagagaauguuuuaaacuuuuucuuuuguaagcuuguauguaguuguugaucuuuuuuuccuuccagucauauaauaaaauaucauaaugaaacauucccaguuuugucgcuucucacagauuuaacaauggcacgucuaccugaacuucaguaauuuucuagaaagaaucuaauuguguaguucagugaaacaauuaaaaauauggcauaucauauuuucagaauaaagauaugugcccuaauuaauucuguauauuuuacaucauaguuaguagagaccuugacauuauuucaaacaaaggacaucagaauugaggaaaccaguuucuggaaaugaucacagagaggacuaguguauccuugaaaugcaaauaagaaagaagauccuggggaaauuaucgggaagacuaaguaccagcaaaacauaaacacuagauuccuucaucugaauguagaauuuaauuuuuuuuggagaauaauagauauagauuauaggggcuaugaguggggugauaccguggcuauuuuuaucaguagguauaaaauaaaaaauaauuggaguaaauucaaauaucuguuggugacuguaauuaauaauaacauacucuuaagauuauuuuucauuuuuggugcccaaucucaaaaugaaccaauaaucauuaauuuuuugaaacaggucuugcuaaguuucauuccuugucaagucucuugagcuuauugugcagguuaacggcuccugcaccauccuccugggaagauugguuauaguccuggcuaucauauucaacaaaugauagacuucauuaugaaacuuccauaguuuaauauauuuugcucauuuccauuuucaguuugaaaugcuuugcugaguaauauagaguggguaauauucaaauuaugaagccaaauauacaaaucaauucuguuguuucuuuugguaacuaagacaguaauagcaauacacaaagagaguccaacugagcagucagcaaggcaacauguagugcuaggagugcaguccaggguaguccuugcugagcaggcacaaggccccagguucaauccuagcuacaaaacagaaaggaauaguaaggaaaccaaauacuuuggacaaucaauauacucuucuaagaaauaucuaauaauccugccagucaagcauuaaccuagaaacaaccuugugugaacuaccuuuuauuuuaucauucagauauuuuuaguucaugcauuuauguuacaaugcauuuguauauauuauuuauauauuaauuauguaugaauaacaaguuuagaaauaaggaauaaauaagugcaaacugagaagaugacuuaaauaagauuaugagaauuauucuguuaaguuaggaaaagcauaucaaauauauucuaccuccuauaucuguaacacaauauauuauggagcuuuaauacaucuugggcuauauaaaauaauugcucaguuuaauacauaaacucuguuuauguaacaguuacugaguaucuaaauuauaucauccugcaaugcauuuacaauugaauauaacuuacuucagcuuggaaaacuggaagacauuugccuucccagaaauuuaucucacugaaugggaugaucugaauuugaaaaaucagauauacaugccuauaacuguaugccuaaauaugccuucacugcuuucaaauuauuacuaaagcaaauacauuagacuuaugcuuuuacauuuuggaggucaaaaucuuaaacuggauugauugaacuauagagcacaauccuuuugcaggcuucagggguuccucugguucauuuguccaugugauucuuucaguuuuaaaaccacacacaguacuugguugaguccuucucacauuguaggccucugauguuguccccuucugcucuucucugucauguauaaacaccuuuaggagaucuuaggcccagccagaugauccaggacaaugacuuuucaaaacaugguaguauuucuuuuguucuuagaagucaaaauggccacaaggucaguucucuucauaucucauucccacuacugauuggaguguccagaguuauagcuagagucaggucuaagaacacuucaaggguaaaaauaaaaauguuagucucagaaagcuuauaaacaaagaauaaacagauuuaauuaauuuauacugccuaaaauuugaagaaaaaaaauguguaccaguucuggaaaauaagacaaaguuucaugcauuuugagugaaaaauuaccaauacaugaacauagcagcaggaaguucuaggagcauuucuuaacaugguuauuuaaguaaacccccagaucucagauaugcugaaaccaaccaaauuucagaaaucugaaauuuugugacaggcaaauaauauaauucugaaauguuagaagacaggaaugcuggcauagguagcaucugguagauccaaucauuuucuaacagaugucauuuucuauaauaguuuuaguccuguugcugugaaaaaauacuagacaaaagcaaccuaaagaaggguuuggaggauggaaguucaagagauaccagccauaguuuguccaucucaagaagcagagaauuuugagugcuugggcucagcuagcuuucuacuuuuuauucuguucccaggaacccagcccauggaauaacccugcucauuucaggaugugucuuaucagcucaguuuagauuaucuagauaauacuucacagccauucucagaaagcauaauaaucuggauaaucugucauggaaugucaagaaucuuaucuccuaggaaauuauuggucuugucaaauuguaaucaauucucuuguuuugaugauguuauagaauauccacuauuauugagccaaguggagguuguggccauuccucucaggaagauaaggaauuugaaucuaacagaugcuauuaacaguuacagaguagugcuuagaaugguuugaugggauaauauugcaugaggcagaguuuaugauuuagucuauugugauaaucugugcgaaggaugauggugaccucuaucaaaggggucacaguggauggguugaaaguaguuguguuuugaaugcauuuugauacauagccaaccggaguugcuaacaaaucggguaagugauuuaagacaaagaggaaugugguguaaaucgaggcauuuggugugaauaacuaaagauaaggguugcaagaagacacacaucuuuaaucccaacaugcaacagacucagacaggagaaugcuguggaguuaaagauagcauaggcuacauagucagacccuguuucaaacuacaaugaauuaauuaauuaaaaaaggguugccaaaaauaauuaaaguacauuaaucaaggaguucaacuuugcuaauagaguacacuaugauuuagauaccuaucauugauaccaggaaguaauugagaccaucaaucuauugaaucuaaaaggagaaaauauauacaagaccuacaaacuaucacaaugauccaaaggcaguaaaggaaagucaagagcauggaagggacaagugacaguggaguggaauagaugauaaacaaacaaugcuugcucuucacauuuuggaacuaugauauauuaaaacucggaaaauucaugaggcuccagcuacaagucauauaacaacaagcaaacaauugaauuccauggagcagccagcaaguugggcauagacuucuagccaugcugcuuuugugagcuuucuuacaugcugcagcgagcaguguggugauacuguugcuuuugggccauccaugcacaugucaguaaucuuaaaugauguuuuuguaugugauuuuaauacaaccauuggcucuucaagugggauuucaguaaaaucuuucuuuggucugauauauauaauuuauuuacauuucagaugguauccccuuuccugguuuccacuccagaaaccugauaucccauccucccuccccacuccuucucugagggugcucacccuucuacccacccacuucaacucugugcacuggcauuccccuacacuggagcaacaagccuucccaggaccaagggcuucuccucccauugaagucugauaaggccauccucugcuacuuauguagcuggagccaugggucccuccauguguacucuuugguuggugguuuaguuccugggagcucugggggguuuugguugguugauauuguuauucuuucuauggauuacaaaccucuucagcuccuucaguccuuucucuagcuacuccauuggggacccuuugcucagguccagugguuggcugugagcaucuccuuucuauuugccagguucuagcauagucucagaagacagcuauaucaggauucugucagcaagcacuucuuggcauccacaauagagucuagguuuggugucuguauaugggauggauccccaggugggucagucucuggauggucuuuucuuuaaugcuccacacuuucaguauuuccucccaugaguauuuuguucccccuucuaagaaggacugaagcauccacacuuuggucuuccuucuugagauucacauggucugugaauuguaucuuggguauuucgagcuuucaggcuaauauccacuuauucucaguaccuccuuuuagaugaauaaauaucuguucaugucucuaccaaaaaagucauauaaugcaaucaaugcacaaagugguguugacagacccaaagacauguuagguaagagccauugcauggauaacaucaugggcaacugagauuccucuaccugaagauaguaaguguaugaugggagauuguaauuuuguuguuauauuggcaguuguaugcuccauaugaugguuagugagacacaaauacaaggauuauccuuuggaaaguaaaaugucuucaggggaacucuaaaaccuguuuuucuuuuauuuaauuuuauuuuuuuacaugguauuggguggcauuuuuuccuugaugaauaaaucugucaaacaaauauaagaaugcaccucaaaugacuuauauugaguacaaugaaaauaguuccugagaaguacauguauauuugacuguaugcagaccaugaaggcugcugagucgccugaguuauggauaauaagaccaaaaacugaggcucagcugucuauaccguaagaacuuuccacaaaggggaggaauuacaauggaaaagagaccugcauccaugucugauuugacaggaaaaaauaaaaggauagcgggaugaaauggagauguuugcuuguuguuccucauaguuggcaaggaaaaagaagaccuaugagauaugugcuuccucuaauuuaaaaccuugaaaccuaggccaauagugggaagagaggaauguagacagccuuuaagacuccacuaaguucugcacuuuaauacaaaagaaauggaaaucauaguugaaaagacacacagaaaccuaaccuaugcccccagcauaagaaauaucugauaauuacaaacgaaucagcaugcauagugcuugacuuuuaaacaaggaauaacacaaguccucacagccuggcucaugggacugugacucguggagggagauaggaucagucugcuugcucuuuaagugugugcuaugacuucacauuccucuuugaagcaaaggcugcauaaccugagaugaaacuagggaagucagucucugaugaauggacucauagaagccagcagggacacuugcuugucaucugagaucuuuaugaauaucagaaccugggauacaauagaggaaagacauagauuauugaggagauaggucaugccagaugcaacaauguuuuacaguccagugagcuaaauaagacuagagacuuaaaaaaaacuugauccagguggaccucuggaccagaauguggcuuuaaaggcuuuuuuaggccccauaauaagaugugaucuuuaugaguagaagaggcucuguguucuaaaugauuuagcuuagcauguaaauuugguucuuggcauaauucauagcaaaauuauaguuauaaaguugcaacgaaauuauuuuaugguugggggacaccacaacaugaagagcuguguuaaagugucauugacauuagaaagguugagaaccacugacuuggaaggcgauuugaccuaagcucaucuuuuaauaucacacacuggggauucagaaugaguuucaaagggaacaaagcauaaaaacagcaauauuuaugauggaagaaagacaaaggacaauuuacaggaaaagaugucacaacccucagagcaaggaaugcagcacauuucuucaaggacuuauucugagaaagagucaaaaagcauagagacauaugcugugaaauaggaugaacaagagaauagucaacugaagucaugucuucaacagccaugugggcgaggucuccuuaaaagaaacauuaagugcaaaguugcuccacucuaggcuuucucacagccuccuacguggcacuuagacacgaaagugauucauuuggaaggguggcugaacaugaugaaaugugugacuaauuggagaauaguaggucaagggguagcuaagaacauguggaaaguauccuuguacagauggccgaugaaaucagcugucucaaaaacaaugaccucagagaacagaacauacaguuauggggcaagauacuuaugaaaggauaaugugggcaaagcuggguugagacuucagaguuuaacuuaaaaauaggaagauuuaauuuugaaaacugacagaggcuauagggacaaaaaggaaaugaaacaggaggcagauaccauugcuguuaugauaaaacaaaugagucugguuuucaaauuuucucuugaauuugcuuucacuagagccagaaaagucucucugaagucaagaccauagcuguucuucagagccuuccagggucaacaucacacaaagaaaccuguaagaggacucacagugcucuggaccucuggauucucuugacccuuagagcuucaauucugaauacagauguuuccaauucacguuacauuuuuuuuccacauuaaacuaacaauuguagucau

SEQ ID NO: 149 - RNA, 129092 nt, Mus musculus
ugggugugugucuggggaaggguuggggaggguggaucagacuccuucuaauaggcuuucuuuaaaaaaagaagaaaagaaaacacacacacacucaaacagaaggagaaauaaaaguuugucucuguugagaagcuuccucugugcuuaaaaucuacaagaagcacugaaaacucaagucgcagaggcgcgcgcucugauuugguuguuuaccaucaaucagacgguugcuuggcagacacuggaugguuaugagccugaacaagcugaaaggggcaggaaaagaaguggaggcagcauucuuccuauuuaaagcugcaccgcuugaaaaaaguuuucgcagacugugccggaccuggugcugaaacagacugaggcagcgcggggacuggugcugaaaaagagcccccagcggaauucauggugcuacagugaccucaguaucuacucuucgaucccaggaggacccacaugucucauauuuagacaugauggcaaacugggugggagcaagaccucuccucauucuuucuguuuuauuaggguacugugucucaauaaaagcccaggaacaagagaauggugaguuugccuuuugcuuugcuuaugguguuuauggcuugguuugggaacuagauggaauguuaagcuucaggaagaggauaaagagaagacucugguuugaaguuugagaagggggcucuaggauuuguagcuuggcucuggagacuaggcacauuugcaaauccggagcuucugugcgugcccuggcaaaaagugggcuucugacauccuguaagagccaggauaucaccagucuuuuuuuuuuuuuuuugccggaauguaagagugggacguuuaaaagaaaacaagagugcuuaaaacggagccccggaggcacuuuuaguuagaggucuguccugugggcaggcgcuuuccaagcagggaaagccgcugcagcagaagcugggcaggguggagucuuuccugugugaacuucagcagcuucaugaaagucuuuguuuagaaaaaccucuccagcaggcaaauccgauaguucggaauuuccuuugucuuugcucuuuauccuccccuccuaaaguuuucaucucugaucuuaaaaucggguuugccuacagagagggagucaaguuuauuucuccaugacagacucugauagaaaccagauuucuuaaauuucugugcuuucccacccuacugacuugauuaucaggacagcaugguuccuggguggauggaugaaggcaggaaauucuacuuggaacagaguauuaagaaggacuuuccccuuagacccuuccuuucucccuuucuucuucucuucccccguuccuucuauuuucuuuucuuuuaaggcauaucuugcuugguuacuguuuuguuuuguuuccccuaugugauuuacauauguuagugcugggauguauuguuaagcaaaauggcguggcugcuauagaauaaaacuuaaaaauaaaauaaaaugggccucguugauauuaacguuaacuuuugaagguugaagugucagaaacagauacauucucauuguaagaggccagcauagaucugaaucucuguuagcaucacacucaagcuuccaaaacuuagcaaugugcuaaucgugucuguaacugucuuucuccuguguauauccagccaucuguacgaauauguuuucugccuuucugauuuuuuuuucucuaaaaauauuuagaaacuguguuuagcaacuguaaguuguagaaaucccaagguucuggagauaaaauucaagucugucagcagccccauagagggagcacuuuucuaaaaucuuaaaacuuuaaaaucaguuucuaugcuucauaacgugaggaaacuuaugaagggugaaacuugcguuuccucauaaugucaugaaaagucugugcuguucgcaaacgcaaagaacaaagaaguuaggaaagaggagagcacauagcagcguuaagauagaagcaaaaugucugaguaucaaugaaucuguccacuccccuccccuaccagaagacuaacucuaaaauaucuauacagacuuuauucucaauuuauguuaaaaugaugugcuuaauuuuuguaauguacaaaaguaaucgaacauguguguaaaugaaagauguaagauguucaaaagucuuagaagguaggucaugugcuaaaacucuugucuaagucauugcauuuauucuguaggucuuacugagaaaugagggguuuacuguucucuaagauuaauuuucauacauuaagaauagguggcuugguucagaaagucuuugggccaacccuccuuuuuuuccuuagugucauuaaauagcagagaaauucaaaccucaaaccaaagauuuuugccaagaaaguaaauucucucagauuuuacaaauauuaauucaaauagauguaaugaaaauuaauagcauaaaccugaauguaugaguaaggaaaauauugaugacucaguaaucuaguauauccacagcuuacauuucccaugauacuguguggacacuucuuauacuucauuuacccgauuauaauauagccaaaaauuuuugaacuugcgaaagagucauugugggaaauguucuauauuaaggaaaagucuaaggcuuauaugucaagaauauacaauuuucaaaucauugcuaaaucuagcauggguugugguauuuccuuuguauuccauuuaauacacguugcagaaauaugacacuguguguaaguauguacuuauaagcuuagccuuuuccuucgucggccugaugggaacacacguggaugcuaagauagaguaaguaaagauuuagacauuucuggauaaaauacaaugaccuuucacuaaagucuaacaauugauuuggauuuuaaaagauuguuaguaacuaaaaagaaagaguuugggaguuaggcucacauuaguugaaaguauaauguagucagaaucagacccaacaugauaaaaacagcuuuucaagaccucucucucucucucucccucugauguguauuguguagggaggccuuggaauguccuaaauuuguuuguuuguuucuuuuuuuuucuuuucuuuucuuuuuuuuuucuuuuuugguuuuuugagacagaguuucucuguauaacccuggcuguccuggaacucauucuguagaacuggcuggcucgaacucagaaauuugccugccucugccucccaaguacugggauuaaaggcauguggcaccacacccagcugcccacaucuguuucuuguaaaagaaaaaugcuagacuauuuacaguaaaaauuuauuuccaaaucaaacuguaacaucuagggagcuaugcacauuuuuguuacuaauuuaggcauacucaaucuuugggaaugaucuuuguuaugaaucaauuuuauucaauaccccaugagugauggagagagaaaguuuagaaggagauaugcaugaacugugcacuucaguuuuuucagaagccaggcauguaacacaagaagugauacaauagcuuuguguauuagcaguuugaugggacuuguagaaaacugaagacacaaacauggccacuuuaaacuuuccaaauuaacaaucaucuaaaaguauugcauaagccaaauucauuaugucuaagggccaaaucuggcucauggacuacaaauaaucaauacccauguugcagcccuauacugauauuuggucccaagccaacuacuaacuaggaagagaaaaugugcacacaggauuuuuaauauuguggugucuuacauuuuuaugaugcuauauuugugauuuaucuuguaagaauauaaauaggaaucauucgauuaugacauucagaaguauuuagauaacagcauuagauacuuuguacuuagcaucauuucaagggaggcacagagaaacagagaaugaauauauauaguuuaagauauuuacguucauagauuguucuacacuuacuacuaucgaaaugauuuuauuuuagagggcuucauauauuagagcacaguuucaacaaaggagauuauaacagaaccuuguuuucuuacucaaaagaggcucucaaguagaguaaagagcugguauauugaaacugguuggggacucaaacuuuaauucucuucauucuuuuaucccuaguggauggucuucgaaugcacaguccuuaguggcugcugggugauccagcuauugcauguaguuucuuuggcauccagauaaagaaugaaaaagcugggauucugcauuuuuuaacuggaaccuuuuaugucuucaaaacauuuaaacuuauuuauguuugccuggaauuuaaucauauggccacaaaaggugcaagaauuagcaggagaauguagaauuuuagguggaccauaugguaagaugcucaacuauggaauacacaagaaagaauugcuucaguggacaaaacgcuugagugacacacuggauaguguucauuuccgugaagaaugcaaaacuaagaauaugucagaaauauauacuaaacaacauuguagcaucauaacaucucucugaaaauacucucucucucucucucucucucucugcaugagaaguuagggaauucauuauacugaccagugcaauaugugcucccccuugguuuaggauuccauaaaaggucaccuggagaucuuguucuugauauggcuuccagguuuuauccuuuuaaauauaucuaggaaacguggauauggucugagaaucagaccuuuguaggugaccuuuguucacacuagugaagcacuauguuaugcuuuugacuacccuucuuuuaauauugacggagaucacaugucuucuauaugcacuaaaaagugaaugcuaggacuuugguuucauagugacucauuuuacuuauccagcagacugaaguuuguaaguaaaccacuacaauuuugacauuugaggaaaagauaaucccaaagccaaaccuucucauagcauuaggugaauaaaucugcuauacagaggacacauguaauucaaauguauguucaggcaaaugugaguucauuuuucauucuucuuccuuucuucacacauuuaacacugcaccucaagccuggguggauuacagugaucaccccaaacauucacuuaguucaaggugcaagaugaaacagaaggagcaggcuuugugcugagaaggugugaugagaaggcuggaaucugcugaucugaggugacaguaugaaauaauuuuaaccauacaguuugcuccaugucgaaggguaaaucaugugucauuggccuuaugaaacuuauguaagguuuggaucugaagauauuuuaaccuaauguuuaucaauucuaagaucacaacacugaggaguguuauguuuauauaugagagauacaguaaugauaaaagggaaagauuauaguaguuauuaauuuaucauauaaauuuggguagauuuuacaaggauuuuaaaaaccaaauuuauauuagaggugauuaauauucuuuuauucaccauucuuugugauuuauuucugcagaccuagauaugaaaugaaauacuaucaauuuacugaaauuuugaauuucuuuggacuuuuccccaugaguguguauaugaucauauguauacuuggguguggguacacauguguauggaggccauaaauugacauuagguaucuucuucaacugcuucucaaucucacuuuaaaauuuauucuuaauguguauacaugcauguuuguuaguguauguguuugcaugauguaugucuaugucacauguacacgacaugauuagagaacaauuuuguggggucauuugucuccuuccauuuuugauguggauucaggagaucacuuucagauagauaggauuuaccaaaugaguucuuggccuuugauuuuauuuuuuauuuuuaagagauuauccauuuguuuuuauuuuguguaucugaauauuuucccugcuguauauguauaucuggugcucucagaaguuaggccaucagauuuggaaguggagguacagguguuugugagcugccacauggacgcugcaaaccaaaccuggguccucugcaagagugccaagggcuuuuguuuucugagcccucuguccagucuccaguccccucagcuuugcgaacaaggcaggauaguucccugguugucuagaaugauggccauuaugccucuugugucugauuuucuugugcuaggagugcaaugcaacuuuuuauguauguacuguuuauccuaauucaagcucccauguuugcauagcgaacacauuaccagcugagccauuuccauaguacccgaucauuccuauaacuaaaaauauugcacuaaaaguuaaauuaaucugaaugauacugacaggauuuuuaccuuuaaacgucuuucgaugucaacucuccuuuccaugucucaugcgcaugggaagcaguccuuccagcugugacuuuaagaugcaacuuuauggacauuuuuaucuugccuuaauuuuuauaaauaaacuguacuucacaugaaauuaaugugaauucaucuucuaaauuuauucaauagggaaaaauacagugaagcaauacuuucuucuuaucuaacuuugccuucuagggauaaaucauaccaaugauauuaauuaguacaaaucauucaugcaauuuuauccuuucaacauuuugguauaauauuuaaacugaaauguuuauuuuuuuuucaaaucuuaggucuaagaaaggagagugucacaguuuucucucucuugucuuuuauuuuccuaaagaauuggcuucaguuuucagaugggagcaaacauacacuugguuguagcccucguugucauucaugucagccuuacugucauucaugucacuuuuuacgagucagcaccuucuugcuggccccuccaccgugugugauaacuguguucuguacguugcugcaguuuugcaaccauccaagucuuuuccauugucacaaagaaugcucggaaauaagacacagcuuugcagucugauuuuggagcucuuaacugaaauguagaaagugaugugaacaugcauuucaaucaugacaaauaaacaucuuaguagcauuucuuuuccuuaacuaaaucuuugaauuuuuuuuugaaguauucaauggauuuguucauauguauuuugcuuguuuucccucuuaaggaaccuuuauuaaucauggccucuucaacuauuccuuguuauugccucuuuaauugguucuuucuuccuagccuaugaacaaguucaaacaccucaugcuuuacuucugaguccagcuuccuucaaggaacaguauucaaguuuucugucuugaccuuuuuccuucuguacucuugauuguagacucuacaauccauuuaaauuacuacaguaagagaaauagcacacaugauaacucaauggcccuuuccucuucaguuaauaaggcuuuucucuuguauuaauaccacugaucacuaaauuuucacaaaugcaguucuaugaauauuuuuccucaccuccuuuacuuucuauucuuguucauucacagguucccucuuaguuucccacgguuccucuuaguuucucaugguuuuccuuuucuauugguucugucaggauauugccuuucuaggucauccaggaagcuuccauacuuucaagaguuuacuuugugucuaauugcuaauuuauaauucuguugcuaauacugauuauuucacaugaacuccagagaauaugucuagcuacugagaaccauuuugaguucaguguauucaauacacaguuagcuaguauaauuugugucuuggagucuuacugcugaauaaacucucccuuucuagcucuuucugaacuuucccugucugauucaacucaguucugguccaaacuucucucuaggccaacuaauuuaaacuagcuucucuugacuucuuacugaauuacucugcuuggccucaaacuaacucugacaauaucuucuaaucuucucgcuucuucucauucucuggauuguuuuaucuucacuugcaaaccugucucuauaaaauuguuccaguaaaacugccucuuuucuuucuguuucucugugcugcucucuuaaauuguauauccuaucucugacucauucugccaaauuguucucugacucaucacuucgucugcccuucaauuagaugucacuuucaaacaugucugcuuccuuuuaugucugcaccuucauuguugacugguaguuugcuguugcuaguuguuauugggugguguugguggguauauguuuaguagugcaaagaaguuagauauccuggcagccaagauuaauuuuuaccaaguuggaguuaaagguguguacuaucagcauaacuguauuccagaaagaucguacuguaauccauggcgugucugaauuccagcaggaucacauaaaccuagaaggucuuuggauaugaucccauuccagaacagccaaacugcuggauuaaaauucuucuauaaauuacccuagaagaacuggcuauuuuccugcauauuucugucuguuaauggcaacaucauugugucauucagucaguaaauuucuagcagucaccaauuuugccauuuauuugcuaaauauuucucauauauauaguucuuauucaccuuuauuauaaguuucuaaguucaugcccucaucauccaucccuggguuacugaaaugucagcuaaauucaucuucuugucucucuuguagcuauuuucuaucagcacauaaauauauacccccuuuugccagugcaauucaacacuaaauguaaaccuguuucuaccuucuaauuuuuccaugagaauucuuaguuucaggaaacgguaaugguaauguuuguuaccuugcacagguucuaaaugugaccaauaucuacaauauuagucacauugauuguuauucuuuuucucacuauaaaaagucacuuauaguuuucaucaccagugcaagcaugcacacaugugcacagauacacacaaaacacacaugcauguauauacacauacaaacaucauacacccaugugcacauacacauaucauacacacacucucucucaauuuuuucuuuuuccaaaucacuacuuuucagagagcagucagaguuuugauuuucucuguaguugauuauagugacaaauuugaaguuuuccuuucuuugaaaacauguuaauauuaugggaauauguuuuugauuuauuccuaggugugggacaugggguugcuucauauugugaagagcaacugacuaugauuugccuagugcuuuaucaggggcaugauuuugccagcuucagauuguuucugaaauggugugacauuuggaauacuuuuaagaggguauauaaauguaggguggguuguugacugguaguuugcuguugcugguuguuauugggugguguugguguguauauguuuaguagugcaaagaaguuagauauccuggcagccaagauuaauuuuuaccaaggaacuuaauguaggaaguagacuaaugauaauguucccuuucuccucuauccccuuuucucuccuaucuaguguuaggagguuauaaggguagaaaaguggugggagaagcgaagaaguuaaaagaacccacaaagucaccaaaguccagcugcaguugaucccaguuuucuccuugcuucuucucucagaacucaacucacuuuucugugcaugagccagauguggagaauuucuucccuugugucuauuuaaccuguuccugcaagauuuuuuuuuuuaauuuuuaauuuuuuuuauuuuagaucuuaaguuuaccucauaguuucccaauuuggcaacuuguucugacuugccuaauauaauccauuaauuacuaauauucuuuuuuaaacuaaugaauguuggaauuauuccucuaacuuucaaggcuaaugagcucauuuccucuauguaaacagcuaugauuguuuuuacuuaaaggauguaaaauccuuucucaugucaauacaguguuucaauugauuagucuauagugauuaagggcuuucauuucucuaaauauucucugaguggccaaauuaauugacugccuuuuaagaauuagaggccauaccacggauucacuucacuucuuuuccucuuaucaacccuuugagucauuuugcacucagucuuucuaagaauguccuacuuucuuuugcuuucauguccuuggggaacuugcuacaauaugauugacacuuuucuguuaaaccaacagguagaugacagcuauuuuuugcauauauauuaguuuaauauuucuguaaauauuugaaaacuacuauuacuauuuauucaguuguaagugaacugaauuuggagucacgguuuucaaauuauaugugcauagucuugggaaauuuaacauuugugauucuuuguuucuuuauacauaaauuuauaguaauauaauucacuccgaauaauuaguagaaugacuagcagguauauauguugccuauuaaguuauuuccuauuaauggcaaauauucguugauaaagaacaaauaaauauuuuuuuucacuccaagagauaaaaaucaaguauaaaaaucaagguauaaguucuaucuaaagauaauaucauuaaugcaaauauuguuaauaagcucacuuagucuauugauagacaaauugugguuuccaucuuuacuugucaccguuuuagugcugagacaagccaggaaagaaaagccuuuugcucaggaagcugcucagugagcuugugccaggaggcugagcacccuccuguuuuacauucuccuuuuccaccaagcauguuucauccauaucccaguggcacucugagccuggaccaacugucuacugcagaguugcuuuucugaaaauaugugagucauaaaagccuuuauugaaaauuggaagcugacuuuccacuccgccuugcuugggguuuacauuuggaaggagaggagcugcuuagagacauggggauugacagggcagcuccaggccuacuaucugcagacaguaguagcugaauauccuuccaaacugcagcaucucuucuuucuccagaggcugcuaauguacuucagucccuucaccaccagggaaguacuauggucgacuaaaaaaacaaaaccaaaagcaaaaccccaacccugacugcuggaugauuaggcgcucuucugguauugccauacuuuucuugcuucuugguuuuacaaauguaaagaaaccaucaagagcaggaugggaacaacaugaugagauuaauucaggaggagagaugcgaauagaauuucacucaaugacaugauacaaugaaauucccuaauccaaucugugauaucucacaugguuguucucuggucaucagcuguaaaauuuacuaugaaauucugaacauguauaguuuauacgcagagcaaauauacuuuauuuuuaggauuuaauauuuuccuuacuuucauuaucuguuauaugcuuauuugcuccugcaguaaaaaauaauauaucaaguucauucauauuaauguuaaaguauuuguaaagccucuucuuucucaauuuuccaggguuuuaucugcaauaagugacaaguuucaauuuaauucagagaauuauauuucucaggcaaauacuaaaaguuuuagucaaaauuuaugaugaaaugcuuggugaguggugggauggauugacuaucaugagaaaauaaaaugcuuucuggccuuggucagagacacuagagacacaaaaucucucuagaaugugaucagaaagucauucuaaugacuauuucaagaaaaauuaaaauacccaaauguaguaaucuuccuuuggaagaauuuguccugaacaaacaaacaaaaacaacaaaaacaaacaaacaaaaaguagaaaaagaaaaaaaaugaggucaaugcaaaaggagcaauggaaaauucuaccaaugagcuuuugucaagccuuaaagcuccugucuuaguuaaguuuccauugcucuguuaagauacuaucaaaaagaacaacuuagaaggaaaugguuucuaggugccaauccaucauugauggaagcaaaggaaugaaggaacacugcuuacugccuuuccugauaguuugcucaguuugcuuccuuauacuacccagaaccacuuucccagggaugguaccacucacuauaugguaggcuguuccucauaagccaagaaaaugugcagacuugaccacagguacucuuauggggcauuuucccaauuauuauucccucauuccagaugugucuaguuuuguaucaaguugaaaaagacacauugucauuauuggaugucuuuuuagguacuucuaaaaaucuuucauaugccuuaaucuuuucuuauuuuuucaauauacuaguuuauuuauucuuugacaaugcuaucauacaauacauuucagucauacccaucuuagucuuuccuucaauuaccugcuucauaaucccccucuaaauucaugcucuucccaguuuaaaaaguauagcucacugaguccaaagauuguuucaauauaugcauaaauguguagcuauccacugaagcauggccagucuacaggguuuacaacucuaaagaaaaacuggcuuuuguucuguagcagccauuaacuguuaguagcuccuuugauaugggcuccuaagccccuccuucauccaugcuagaauguugacuggcuccauuguguaggaaacuaugagucccugaguacagcauccugccaugucugaaagagagguuucuccagucauccacagcuucuggcuuucacaaucuuacagcucaggaugauuucauuauacuucggugagguuuauugaagaaggaaaugauuagaaucauuucaacuuuuuaguauaguaucaaggcaaauugaaauagaauucauuuaagaugaaucaacaaacacacucagguuucacuguggauauuuguguucagauaaauggagggugacaaaaugaaauaaaauuaguacaacauaacaauauuuucaugcaguugacaugcaaaguuugguucauauauuugguaaauaugcaguucccuugggcugccucauguacucacccucuguguauuccuuugguggaauguauguacuagaacagugguuuccaaacuuucuaaugcugugaccuuuuaauauaguuccuuauguuuuagugaccccccccaaccauaacauuauuuuugcugcuacuuuauaacuguaauuuuguuucuguuaugauuuucaauguaaacaucuguguuccaauggucuuaggcaaccccugugaaaaaguucuucagccccuguggucauaacccacagguugagaacuauugcacuuagaaagaagagcaggcccaguucuuaguuaaaaaacaaacaaacaaacaaacaaacaaacaaaaaaacaaagcaaagcuaaauaaaacaaaacaaaacaaaccucaauuuugcuaccacgugguuaaugucuccugagucaaaagcauucaggagucugacauaauaaucacacuugccugcagucucuuaccuguugcuuuaugcagaugccauuuccuuucuuugcugauuucguuuuuguuguuguuuuucagaggggcucucuacauagcccuggcuguccuggaauucacuauguagaccaggcaggccucagacucucagagaucuaccuuugccucccaaggguugggauuaaaggaguguaccacugaauccaaguuugggugccaucuucuuaaccuuuuuaaauuuuacaucaaauuuaaaauucucuauuauagucuaaccuccuaucaggauuuacuuauauuguucuccgcagggaacuauuacauuccacaugcucuccuaguguacagagcaauuguuuuucauguaauaugacuuuuuuauauggcaauuugucuuugagacauuuuccccaaucuucucuggccacuagaaugugcugucaaaguguuugugguaacaacaaaaacaaaaucaaacaaacaaacauaaaucaaaaagccaaaauuuauugucuugauuggacucuugagcucaccucuagaagguaaacuucaguugucauagauguccuauauuugucaacagaauauugccaauuagagcauuacaaccaccucaauucuauuuuaauaaaaagugaaaauucaaaguucuugugguuauagcccuaagguugccagaucagacagacaugccucagguuauuggccuauggcacugggauuugcucccuaaucaacaaagccugcaaugaauuccacaggaguccccagacuucuuuucuuuaugaugugccuucagugccuuccuuuuccugcuguaggugauuaaauauuuuugauuugucuuuucuuccuaaagaaguucaagaacuuaauuaguauuugaacagaaucuuugcuucugugcaguuggcaguguaggaaaaucaggggagaggguuuggagagcauuaaguaaagaagagugcaagcaauuaauuccaaucuaugguugagauaggugagccaaaagacaaaaaaaaaaaaaaaaaaaaaguaccguaguaccguuucaugcuacauuuuucuauuuuuauauccagacucuccccacccacuguucucugugugugaacaaaauauagcuuccugauauaaggugaaaugcauuguaacuauuaccucuuuuuauuuuugccuuaucaggaagcuugccucaaaaccaguuagcucugagguccuguuuggagcuuggcaucucuuuuacuguggguugaaagugacuuggagaaagaagcugacaaaaauccccagcaaucagcugaguguuuacauaaaggcuccaucauuucucaggccugucugucuucugguguauuuuaagacugcuuguacagagagaaacaugcaguuaacaagaugagagcuucaacuaaacaggcuggaacuuucuuucaugaaugaauuguugaaauaauuuaaaugagaagcuucuaacuuaaaacuggaccggacacaggaauucugcauucuaauugcagcucuguccuggguucacuuggugacuuuguggaagugacuagauucucugggccucggaagcuuccuucaaaacaugcggugcaauauuguuaaacaaugagagccuacaaugacagaauauuaauguaaauuuucuucacauaucagacuaaugguauaauaccacagaguauacccugcacauaguuugaucauuggauauaugaugaaaauuuucuguggauaauauauuucuguccauuaaagauagcauuuaaaguuuugauccagauuucugguuauuucuaugcaaauguagcuaugaguuauagcugcuauuuucucccagcaaauaguguacauacuaaagaauuucucuauacuguggcugcaaaacccauucagaacuaaaaagagaagguggagagugaagagggaugaagaggagagaaaaaggaaggugugagagaaggaaggaagggagucauauuuuaacuggcuguggggcuaugggauugccauuuuguucccauuauucuuaauuucguauucuucuucacaauaaugguaauuggaagaugugaaaauguucagucugaauauuuagcucugauucacuguauuguuauuuccuaacaccagaacacuuuagaccguguucuuuugaccgguuuucauuucuguguuuuucucucucauuucuauauucaugaacaaugaaugaacucugaacauucaugcucccacguucugcuggauuuucacucucagauguccuaagcagaaaauaagaccgacaaagcugaggaccaaauuaaauauuuuggauauuuuaauauaucccaauauauugauuucugaauuaacuucauguaguagccauuuacaucauuuuauugacugaauuccuacucaaguauuuuuuuauuugcauacuacuuuuuaaacagaagagccucuugaauauuaaugaaaugaugaguauaaucugcuagguuuugcacuguauuuuugcaccaauauuuuuauauuaagaaguguuuauagugauauuaagauaauauguaaagcaaaggacuaugauuuaacuagaagauaauaaaaucauggcuuagaauuauuuaaucuacacaugauaauacuuucuacuaucacagauauauuguagcauaauuuaccacaaauaauucauuaauauaaugccagucacuucucuuaucuucagguauuacugugaugagucuucggacuacaucaaaucauuacugagccacugucuauaacauuugcaauuaaaauucagcaaauauucauuggauauuuaguauguuaugcuagguuauggagaugccauaguguguauaacaugaacuuauugcccaggaagagaaagagaaauaaagguauagaauagaaauuuuuagaaaauuaaaugccuaccauuuucuauuuaagucagaauguauaauguaugaauaugccauauucuaacuaguuuauaauucucaugauuucauugaugcuaaaaugauuucuucaaacuaggacaugacaaaggaaaugggauaucucgaacaaacacuuggcaaagaucacuucaaauaagaauaccacaaaauauuuaacuccccugaaaaauuagcucacauuuuuaguuuucaucauuacauuccagccucucuuuuacuuuuauguaugacagacacuuugagguagacaauagucuagauuagaauuccauuuagguagacucuguucagucagguugcaaagccacccagcuaucacuucuuuaaacagauagcagagucacaguuaugugauuauuacugaagacauauuaaaaguauucuuauuucuuuuauguauuuuauuuaaauguucuuaaaaugucuuuuagugaauguuuuagauuuuuuuuuucuauauaacuguuuggucuucugguuguaguuaaacucuuagauguauuuuacuggcuuauuuacuuauauaugugcgaguguaucugugagaggaggggguagugucaggguaacuuuaucacucuauuuuuuucuuuuucugagacagagucucucugugaaucuggggcuuguuccccccaaccucaaaauccuuuuauuauuauagcuucccaaauccuagguucacaaaccaucuuuaauucucauuuugagaaaaauauaucguuuaaguguauuacaacauguaccaauaacaaaguauuugggggcuuaaagagauggcucaguggcuaagaucauuuucuguucuaucagucaccaggccagacaguaguacccaugugaaagccacauaucgugcauaggccugaaacuccagcucagaagagcaaggagaaagcaaacauuucuggggcuugcuggcuuuucggcugacuuuaguauaaguacauaauaacacauaauuuaaaaagcaacugauuauaacaaucaccacaugaacaauaguaaagaagaaaaagaaagaaaaauauaauauaauauaauauaguauauuuuaguauggaucuuacuugguguaucauguauaucagaaacaucauuuaagaaaaauuauauauguagaaaauaguuuaaauuuuuuuaggcuagcuauuuucuucaacauagcaugcauuccacaauuagugauuggcaaaaugcagaugcuuagaagugaagucauauuaccaaacauuuaggcuuccauuucuugaguggauuacagguaugcaccaguauaccuagguaaaaaggaauuugaagauucauuuauucaguaacuacucauuuauugaguguaugugguaggcacaaccaugucucucaggauauaguagugaggcaguccaugagcauucagaauuuauguucuaauucuaauauucauuggauaucuauuaucuauaguaauagauagaccugaauuuagaugccauugaggcagagucucucugugaaaaagaggccuauuccaauccuuuuguuauugcagcuaauaucccuaaucucuauaacucauguuuauauugccuccuguagaaaggaaguguagaguuaguugaugaagucaugguggccaacagcuggucucuuucuccuucuccuucccguuccccuuccccuuccccuuccccuccccuucccccuccccuucccccucccccuccccccucccccccuccuccuccucuuccuccuccuccuccuccuccuccuccuccuccuccuccuccuccuccuccuccuccucuucuucuucuucuucuucuucuucuucuucuucuucuucuucucagaggacggccaugugagauggaacugccugacuuguaggccuuggcaauggggaagaaccaugaaucagagaauacauuugaagcuucuagaagcuggaaaaugcaagaaaaagaaugguuuccucauucuuucugaaguaaugccaacuucuugauuuucaauugauaccuauuuggaauuucugacuacacaaacugacuuguuuagcuuacuguuugugguagauuauuauugcaaucaucagagauaacuauagacauauagauauuaaauaaagaaaauauauauguauauuacuuuaaaagaacauuuucacuuaauaaauaucauaaaggauaaaaaaacugggugucuggaaucauggugucuaauauaaucuacugacagacugacaucauuuaaauuuuauaaaaauuaauuacagucucaauuauagcauaacuagaggguccugugcuaguauagacaguagaacauucacaacaugauaauaaugacaaaaaugguuuuggccaguguuguuuugaaugugucacaauuuuacauaggguggaucuauuuuaaagggcaguaugaagaagguaucaggaaugagaaaggcugaguaggcauucaagguauaggagaaaaaugugaaguuaaaaaauagauagauaaaagagauauauuacaaaccuggagagaugacucaguuguuaagaccacuguuugcucuuugaaaggacugggacucaauuuccaucaccugcaugucaugucacaacagucuauaacuccaguuucaagggaucugauacccucguacuaauacacauacaauaaaguuaaagaauuuuuaaaaaagagagacaugugacaaagcacauucuaaacuccucagaguauucuaguaauaugguuacuauuuuguuauaaguaguggcaacuguucauucuuucauuaacuaagcauuuacugacaagcguguuuuguguaaugagauuuuuuuuucugguaaauacauacacaagguucaugauacucacaguuagguacaauuauucucuucuaaaaaucauaguuguuuaggauaguuucagaggccacugguuagauagggagagagcugagguacaauucuauauucuuuuugguauaaugagagaagaaaacuggaaaaauucuucugcgauagaggccugccacuuggggagccccaagauaucucuauagucauuuuauggccauguucagcuccagcaacugcacaggguaucaguagaagcaggucaagugggaguccucaagugcccuggcaaaugagcaaugugccauuaaacuauagguucuguugccuguauugaugaagauuuggucuugagaguguauuauuccugcuauacuuucauucuuauugcaauuugcaguuaaugacaauaacauuuaucuauuaauauuagcgaguauaaagaauagcauuuagauguaguuuucuuccuuaaggaagauugaaggucugugugaguggugugugugugugugugugugugugugugugugugugugugaacuguuuuguucaucauuugccuuaguuuucccuuuuaagauaugacuugguuauacuuaaaacgcacuuauaaaaugucauuauuaauuuuauggaaagugucagagggugcagugaaugacaacuuuucauagccagcgaauauuggaaagucguuacucaaagguacuguggaaucucagaggaucuauaugggaacuauguuuuaaggcaaaugcaucuuacuggugaaagugauggaggaugauuuccagauguucaauugcuuguuuuggcaacugauacagaaaacuaaaacauguugccagaacaaccgaaagugauaugagguagagaucuaagaggaauugggcauacacaaaggaaagugugcagaagccagaagauggagacacaggggaugcaucugagugaagagaacagcaaucagaccuccaguaauuacauggaauaaaagcagggagacauauagguaagcacgaagacaagcucacuacugcuauguacccagauuacuuuccuauacagucucauuaucuuucccauaaccauggcuguuacuaugguaaccagagaaauuaugacuggcuaauaauaccuugucaguuuuaaguuauaaggcagugaaauauacuugauaguagaaccacaaagucuuuaagcucuuuauccuuuauuuacuaccaaaguauacuuuauuaaaugacuuucucuuuaugcauguuucuucuugauguuugguaugguaccacuauugaagggcuguuaaaggaggaaugagaaaaagaggaguguuuucagagaugagucucacccuugaucuggcucguuucaaucaacaucuagaguaaauuauauuuuaaucaaguaguaaaagaagauacauuuucuaaagaucccugaaaauggaagauaauguuagcugagucaaauguuuuaucuuuagucagauugacuuuccuugagauuuuagaagagucccauuucaacuagguacgccauuggguguauauuuguuauuauuuucuaaaaggugagaugcuaaaauaaaaaucaaucuuugauuaaauacuuauguugacuacagugcuucguuuucuccaacauuuugagugugagugugaauuuucaaguggagacaagaaauugcuaccucaaaguagucaaccugugccaaccugcucuagggaaaugagaacuuaccuaacacuaugacuuuugugaaccuuuuuucuuuauuucuaaauuguuuugauuaucccuuuccuuucuacaauguucuccacuuuaauuccuucauaaaauaaagacuuuuuggcaaucuuugugguaacucugguccugggccagaaaaugccagacuccuccaaagagucagccuuuaaggagguuggaacauaaaauaccaauuccuuuacuauuuuuacaagaguugagcaauaaggccaggauaacaggcaagaucccuauagagagcuaguucaggcuaugacugguuaagugaguauguucuacugugcaucuucuuagaagcuuuucaauuguucaugcugaguacuuauucaucguguauugacuuuucuguaaguuuaauuuacuacauuggguguccguauucuuugaucuuuuaauuccucugaagauacaucagaaguacaagacagaagauuuugggaucuugauuuguugucuagaaaucacagaauguugaccuuuccuaucuuaaauuuugaguuagaaacuccaguuuaacuccaucuagcaucagauuauauauauauguguguguguguguguguguguauuucaaugauacacauagaucucagguuauagaucacaaaauauaaagaguaauaauacggucucggauuauguuguaguuugccagaaguggaauuauguguguuggaggaauguaaaucgucacucuucuuaguuauacacuaagcaugaaaauucaacucaggcuguaacuauuugauucuuuuuacugauucaggaauaaaaauuaguucuuuuuauuuuaaagcucuuaaguaagaaaaagagugcuacacuucucucugugaugucacuaacagacucuuagaaccagaagugaaguuugaccugaacucuaugauuauguaaaauuuggggcaagggguaacaaagaggcuuuuaaguacaauaaaccauguguaauuaguggaagaaucuccguuaaaguuaaauuuuaaauaacuaugaacacuaaaauuagaggcugccuuagugguguuuguaguuaaaauauaaagagaagaguuaugaaauaccacccgugguuuuguuuuuugcuuccccuggcaguuugaggaugaacaaagagccguagauaugcugcuauguaaguggugcaucacugagguacagcgucugcccuucuugcuuagauguuaaugcaagcacauuuugguuauuccuuuuggaagguggcuaacugauacaggaucucagaaaggggccagucugcagaugaucuucauuuucacuucuccuuaagcacucuguguuucucgucaugaauaccaaaacaaaacaagaacaaacaaacaaacaaacaaacaacuucaaccaaagcccaacaguuucacuauuaccuuuuuuuuuuuuugugaaaucuguaauauagaccagauuguuucucacaauaaagaacaguucccuuggcauuaaaaauacuaagccauuuguaaaguaccuuaacacucuucaccaaagaaagaagaagucuugugauuauuuuaguuaaaagaaggugcauuuucaaaguauguacaggaaagaauuuuuggaaauccacuguaacaggaagggugaaguuauuguguccauaucgcaggaaauaaaaauaaagugggagggguuauuagucuaucuuaaaauguuuggaaauaugaaugaauaaaauaaggaauaaguggugcuuuucucuaaaacccaggaaguuacuagcaccguguggcuuagaaagaauggguaguucagugcuuuccaugauaauccagugcgcaccguacaaaccacgugauaugaagcuccauguucauacucucuaaugaccauguggcauucucuaggaaagauauucuuaguacuuuaaccugacaacauagagcagaaucccucugggauaaaauauucauuuuugaaaguaacucgcuggucaguuuaucccuauggaugcuguagaaggaauuuuuaagaaauuagauuagguagcuuccuguucuccucugaagccuuguguauuugaauuuaguggccuaguaacugcugauaaaaucucuuauuucauucuaggagagaggccugaguagaauagaucuuucagcaagaagaauaggggaacauuuauuauacacacacaaaagaaaucaguuuucaaagauaauuuuuaaaacaagagugaagaaaucaaaaccugauugaaauugacuuguauuguuaaaaacuaacuacuacccauggggucccuguuauuuaaagguaacuuuuuuuuucaaucuuugaaacuuuaagaagucuguaacauuuauaucuuaaaaauauuuuuucagaaagaaaacauuuucaaauucacuaugucacaaggguucauagaaguguggugugcguauggacugauaugggacaauuaggaagagaaccauuugccuccuguacccagucccuuguugcuacagcauauucucauacaauuuacugccuguuaaaccaucuccauagugcaguuguaaugcagggaggaaaacaaucaccacuguuuaguggacuguuggcagcuuuccuaugaacaugaggacugugggcuccuuaguuugacuccugaagauauacacauuguuuagaaauguuuaucaguuaugagugauggcuaauuuuccauguuaaccucauacauaguuacauacauuaacgcaaaccauaacaacugaggcuacacauaaaauuuuacaaccuuugcauugcacuaaguuggaaauuacaugccauagagcacauacaucauuuuugcaaauacuuguuuaagccccuucuaagaagaguaaauaacaguaaauguuacuguggaguuuucuuuuuuaaaaaucugguuagugagauggcuuauuggguaaaaguguuugcucacaagccugacaacugaacugaguuacauuccugggacauuagauagcauaacuaugcagucccacagaagauuuuuuuuuuacuguaauuuuuuuuuuuuuggauguaguuuucuuuuuuuuuuucauuauuuuuuuaauuaaguauuuucuucauuuacauuuccaaugcuaccccaaaaguuccccaaccccuccccccucccacuucuuggcccuggcauuucccuguacugaggcauauaaaguuugcaagaccaaugggccucucuuuccacugauggccaauuaggucaucugcugauacauaugcagcuagagacacgagcucagggggaaacugguuaguucauauuguuguuccaccaauaggauugcagaccccuuuagcuccuuggguaguuucucuagcuccuccauugggggcccugugauccauccaauagcugacugugagcauccacuucuguguuugcuaggccccggcauagccucgcaagagacagcuauaucaggguccuuucagcaaaaucuugcuagugugugcaauggugucagcguuuggaggcugauuaugggauggauccccggguauggcagucucuagaugguucauccuuuugucucagcuccuuugucucuguaacuccuuccauagguguuuuguuccccauucuaagaagaagcaaaguguccacacuuucgucuucauucuucuuaaguuucauguguuuugcaaauuguaucuuguaucuuggguauucuaacuuucugggcuaauauccauuuaucagugaguacauaucaugugaguucuuuugugauuggguuaccucacucaggaugaugcccuccagguccaaccauuugccuaggaauuucauaaauucauucuuuuuaauagcugaauaguacuccauuguguaaauguaccacauuuucuguauccauuccucuguugagaagcaucucaguucuuuccagcuucuggcuauuauaaauaaggcugcuaugaacauaguggagcauguguccuucuuacugguugggacaucuucuggauauaugcccaggagagguauugcgggauccuccaguaguacuauguccaauuuucugaggaaccgccagacugauuuccagagugguuguacaagcuugcaauuccaccaacaauggaaaaaaaugucuuugggcucacacagacagaaaaggcagguaucagaagaaaugaaaguuggagaacucacuucugauuacauuauuaaagagagucacaguccaguuagagccagagcuggaaauuauaacagcuaguacugguguguuggccucugaaguuucauggcuggcauuuuguuuuaccauggcuguucuuuuuauauucccaguguuacuaaauaaaacagagauguccugaaauaaaaaaaaagaagauuguuuguguguaaaucaaugauuauugaaaacauuguccuaucugugcuucuuacugucauaagaucagguguguuuuuggaguuuagaaaaauaaaugccaccgggcaugguggcgcacgccuuuaagaaaaauaaaugccauuccugagacauacauggaaccaauauccacaagcuauccucugacuucuacauguaugcuccugugcacacacacacauacacacacacacacacacacacacacacacacacacacacacacacacuaaaaaaaaccaaaaaacaaaaaacgaaugaaaguauguucauagcagccuuauuuauaauagccagaagguggaaacaacucagauguccuucaacagaggaauggauacagaaaauguggcacauuuacacgauggaguacuacuaagcuauuaaaaacaaugauuucaugaaauuuacaggcaaauggcuggaauuugaaaauaucacccugagugagguaacauagucacaaaagaacacacaugguauauacucacuaauaaguggauauuagcaaaaaaaaaaaaaaaaagaaagaaagaaaaaaaacucagaauaccgauacaacuuacagaccauaugaaaaucaagaagaaagaagaucacacuaaaguauggaugcuacaguacuacucaguagggggaagagaauaaucucugggaaguauagggagagagggaucugggagggagagaggagggggaggggaaaaagggggccaguucagauauaggauaagauggaggagaaguacagaggaucaggaauuugaaaguugguguuugguuuuuggugaacucaucuauuucuuuauaucuuuauuuaaauguagaaaccuaaccugcaccuuuccauuucccuauguucuuauucuuacauauauguauacauacuauguauauguguuucugcauguguaaucuucacuauaacauuuguauuaaaacuagcaucuuucuugacuaucuucaagaaugacuacaaaauucugagauuauuuuucugggucuuugcaaucauaaugagcuuguuaaauauaugauaauuucuccuacuuauagaaguauauucucuaugagugcaaauaaauugucuauaaggaaguucauuaguccuucuucucccuauuaaggaucaucuaugauauucgucacuucuaacuuuauuuuuauuccccagaggaguuuuaggacugcauggccaaaugcugaaucccucaugaccaguucauccaauagaugugcagagaguauagagaagggagaauucugcuuuuugacccuguccucuuucucccuuuucuucucuguccuuuuauucuuaaucuuauccacaaaauuuuacugagauaucccagagaacuaagaaaggcauuuagcuguauuucaacauaaaacuccaaaauaucacuuugauauuaucugugauuaucuggguaguguugugucuagaguaguuauagcauucaaaaaucuuguaaaucuccauauuugggcuucucuaccugaagaaacacuuuuuuuuucuuggagauuuauuugugucuugacuuaagccagcuuccuauuaaugucaaaacaucuucuaaauacuguagugagugaguaucuaagcagcuuuggucuuauccuuguuguauauacucuuugaaaauacaaauaaaacucuuugaacauacaaauaaacuauaucuaucaggucuuuuaaaaugucuauuuaaguuaauaauucuaagagauuaauuacacacucuuuuccuuuccaggccccugauugccucugagggguuuguuauauuuaguaaauaugauguuuguauauauucuauguagcaguucccaucuaauugaaugaaugcacuuuaauuuuagauuaucagaacauccaaaugauucuuuuuacaaguaggaauaauauugacaauucacguauuuuuaauuuugguuaauuuguuucugagagguuauaugaucagcucauuguucaauaucucacucuuauguucacuaauaauuuuguguauaaacuauacuuucucaaguauuugucuguaucaaguuuuauaaugaauaaaugauauggcuuugguaguuuauguaguauuucuuaaauguauacgaaaacuacauuuuaaguacuuaaguuaucaaauaaauaaauuaagacggaaaaaacaacuaaugauccuuggaauagucuccaaacguauuuauuuauuuauuauuuauuuauuuauuuauuuauuuaauuuuaaacuccagauuuauucucguccugguacacccuccgacuguuccacacaccauaccuccucccugucccccaaaccccugugucuccaugaggauguccccaccucccacccccaccccaccagaccucuaaacuccgcagggccuccagucucuugagguuuaggugcaucuucagggugccauuggauccuuugguuggaucccuuuccucugacauucuuuuuuuuuuauccuuaauuuuuauuguuauacauuauuguaauacacacacacacaaauaagucaaacauucauuaggaaagaugauucauuaggaaagagaccauauacacagacaucgucuuaagggaauaccauuggguuuucuaucauuguaaucuguagggccauaggcagggcugguaaaauuaaaucccaacacaucuucauggucaguggauguugcagcuucaaauaaggaagaguauggauuuuucccuauagagaggagagucuggagcucuuggaggauaauccaagaagaaugggaacagaauggauacaagaagagaaucuacauugcacagugugauucucauugaucuuucagacauauauaaagacaguaaacccuuagauaaguauaucucagugaccuuuucagagacaaggcucuguguagagacuagcaaaacaguugacaacugaaucuugcugacuuugaaauguguuguaacauaguaucacaaauaguuuucuggucugucuaauaucuccuuguuucugacgagucacacucuggacuccuuucuuuccccuucuuuguaagcuuccuguuucauucuuauuucucuucauagucagcuuuucuuacaaacauuuuuaucugaaauuaguuuaauuuauuuauuuuugcaucugucuuguaaaaaggacuuuuucucaucucaaucaugcccacagucuccucucaucuucacauauuaguuuucuuauauggucuaaggaucugugcaaaguguauacuucccauuaaaauagcaaauguacauaguacaaauccuacugaagaaauucuucuacucacuacuuacuacuauuacuacuacuaauuguuaaacuuucugugcaacacaauagauacagauuuuuuauaagaaauaauuaagagauaagguuuuaacaugcuugaacucaugaggucucugauucagugugugaucaaaauaauauguacuagucaauuauuugauuuggaacuccaauuauauaguaguaauaauguggauuuuuauuguacaccuuccacgggcagauagaauaaacauuuuaaauauuuuucauaguugcuucuauucugacacauauuaugaauuauuuuaauuuguuauuuguaagcucucauucucaauuuacaugcgcuugaauacuuuuauuuuguguguguggaguuaaacacaacaucuacauauugguaguucaacugugguggauauuuaacaaauauuuaaggguuaugugaaugaauauauaguuucacuacuacauugaacucuacuacaccuauauuucuauauuuaucacugcuuugaaaacauguaaaaacagagaagaaagguauguaagggauaaauuauuauuaauucuuaaucuaaguaauuucuuacuuauuuuacuuaccucuugaauugauuuacauugauaguugccagauguuuguacgaaugcaaauauucucacauccuaucucauuucauuuauccagagccgaauuauuaaguuuguauauaaccauggacgcacucauaacuuucaccuuuccauacauguagggauugagaaaguagcuugggaucuuggaagaugauucugguuguagaauagggaaauucacguuucuaugagguuccaaacucaaagaagcaccaguucagcuuggauuauuguaauaauagagaauugcgugcuaaugcaccacaggagcugguaaaaucccuuaucuuauuaauuuggcaggacugaggugcucuucuguagaaugcaauuuccucucuaaaggaugugaggcaucuguuccuacucagaaccaaauagagaacgcuucaucugcauucguuacgccacuuagugcucauacucugcuugaagcucuggauacuuuacuacacggacuacuuagugaaucuugaaucucauguuauaacuccaaaguaucauauagcauauacauagaacauauauacaucauacuauauaugcacauaaauuuuuauuugacuuuacucugaguacaauaugacuacaaagaacauauugcagcuacuauuucuuuaugaagguaaaugauaccaagguuacaaagucuaguuuucuaacucaaaauuuagaacaaaaagucuuauuugucuucccuuuccuuuaaaaauacauuugcuuuccugacuagguaaaacuaaucaauuuaccaccauuuguuuaauaaaccaagguucuuaguagagggaguuuauuuuuuuccuuuuaucuguguguuuuacguuugaauugcuaagaaaacucucaagagcuuucauacucucuuuuuagaggccaguguuugugucacagcaguggggguucugcacggggagaaugccuuugagugcccacgcccuguucuacaaccaucugcuuugcagaugauucagacuagcauugauuuuuuuccuccuucaagauuuggaaaacagauuagagucaaaaaucuaccccaguuaugcuuagcaaauucaucgucacaauugcaucaaguuguuuaggaauuucauccuuuagcucuuuguuuauuucaagaauagacacaucacaccuaucaauaucuucugcagaaguuucucuugcugcuguaauguugucauucuuugcuguagccugguuaucucucauuccuuuuuccaaauuagguuuaaaugcugaucuucugugaagggucuucuggaucuuguucauuaccuagaucacuggauucacaccacaucaacauuuacauuggcccaaaugccuugucuuuguguuugcuucucuaaucagacugugauuuuggcuugauaucaggauucuuuuuauuuuguugugcugucccaauacaagguacacaaugggcauucagagccuaucugcugaauuguuacuaagucaaugccauuuaagaagcuuaauuauaauacagaacaugggugccuuuaagcuuuuaaaaaaucugcagucagaaauuuuggaaguagugucauuuucucuuauucuagacaacugggcagacaggaacaccaaaaacaaacaaacaaacuaacaaacaaacaaacuaacuaacuaacuaacuaacaaacacacaaacaauaagcacaccagaacugcauccacuaguggguacagcuucuagcuaggccucauaguacaagaugggaaagaaacucuggagcacuugucagcucucuguagcccuugugaaccucugugaguuuacaaacuuccacauaucacauacccugugcauuaugaaguuagaggccaaacaucugaggguuuuaugucugggagaaagaugugaguaguucuugaugauguggauauauauuuuugaauugacacaagaaaauaaucuuaaugaaaauggauagucuagagaguaggggguaaucaaggcaggggaauaacagauaaagguaugaauauccagagacaaggaaaugaaacagaucucaaggugagaaugaauuuguuauuaagauagaccauguuucagaauaauuacugaggcuuggagaaggugaaaugacugacaugccauuuaggaagacaauuuuaauggcuacauuuaagauaguuauaguaaaauaauaucuguaugucaguggcauuaaucacugaaaaaaauggaagagcaauuaaggcaaaauacacgcaacauaugguugacuuauguaugcuuucaaucugggcaagagugcuuaagaaauuaaagaaaugaaaaaaguaauaauagcuauuacauuucauggauuuuuuaaaaauaauacuuaucauuuuaagauuacuauuucuuaagacacuaaugaguagacugaguuauuaagcuuauaugcaguacauucuuauaaauaaagcaaggacuauuaugacauuagcaauaucuucuuaauauagauuuuauuaauacaauaauuugaugaacucaauuuacaaacuauauuuuuauggcacaaacuaacuucagaauuacccacauuuugaaaucucauggugaggaggggcuacuauagucaaacucugagguaaguuuaaagagcaagaauuauuuuagguuucuacguuauguuuguacauaugauagaaaaaacccauauaaaugaucaaaucugagauuauuucaaauuauguauuaaauggaagucaacuuaaaguauaucuuaaugaaccauguauggcauauacacuuaguccuaccacucaggaggcagagucaggcagauuucugaguucuaggccaauuuaaucuacagaaggagagccaggacagccagggcuacacagaguaaaucugucuugaaaaauaaaauaaaaaagcauaucuucaguaaaaaauuaaaaauacaaaaauaauggcacuaugcgcacacacauacgcacagacacauaugggugcacauaaaauuuuaguuacaguaaaauagugugaaacaugggggaacuaauuuucacagugugaguuugucauaaagguuaagcauuuaucauaaaaauaagaugacuagauaggaguacauuuuuaaacagaaagcauuuugcuauuuuaaugauuuuuuucuuuaaaauuguuuuaaacaagacuaguaacauauaauuuuaucucuucuuugaccauguaauccuuuugaguacauauuuuagugagugagagauccauaaacacuaaugaaucauuccaaucaagcuuuucuuccacuucauaucacuacuagucuggcuauauucucagacgaaugggcucuuuugggccacauaaaaaaugcuuugagaaauggacugacuauucauugaguugguaaaaucaugucacuucaagagcucucaucuccuuaucuguaaaauagaaaacuaauuucuguuucaagugugcaucagaugaguuauguaaagugcacauaugcaacaagacacuaucauuauuaacacuguggacugagaacgucuguuguacacccuuacuuuucuucacauguugcucagauguuuccaacagugacuucacaccaagcuguuuggaaucaugguucauguuacccaucuccccacugugcccguuacagucuuaacuuucccaaaaagcucaaaguaaauguguccuaaaaugaaugcauagagcuaauuuaauaauuuacuuuaaacaaacuaauacugauugucacuaaaauacuuuaaagucccaaacaucaagauguacuuuuggugcacuuaaaguagauugguuuguuuuugagaugggaacuaacuguauaaccuaggcuggucagcaauacaaaaaucuuccugugucuuccuuccaaguucaauguaucacccuccaauagaauauaaauauggaucaaccaacaaggaguauuuguguaguacuuaguaguugaaaaccuuuuuccaugcaguuucuuucauuaccuuuaauguaauggauaaaccgacuauuuuuauuggaagaacugguccuuagacacaugacuuaguucaggucucccuaauggugcaauuuuaauuauaaugaaaaucaugagcugugucuucugaugccugaacaggguucucuuauacaccaagacagaagggggagagggaagcaaucuaaaaacauaagcaaaguaaugaaacuuaacuuucucauuauagugugacauacuuugacuaauuuaaaaauccuuuucucuucugcacugugaguauaccugaauacacaucuacauaaauuuucaggauccuugugguuaauuuaguucaauauguuuaaucacuguuguguuacauguagcuucagccuuccaguguauuaguauguaaagcugaucugagauggaauaaaggacacaagggaauacacccuccaggagagggugcuggacugagaauuauagaaaucagcucaccuuuggggucuuugccaugaguguuguaucuuaaagcaccagaauaauuuuucuauuauauauggauuuuugugguguauucaugaauguuaaaguaauauuauuuuacuaauaccuuuuuauuuauuuauuuuuaauuagguauuuuccucauuuacauuuccaaugcuaucccaaaaguccccacccccuccccccaccccccuacccacccacucccacuuuuuggcccuggcguuccccuguacuggggcauauaaaguuugcauguccaaugggccucucuuuccagugauggccgauuaggccaucuuuugauacauaugcagcuagagucaagagcuccgggguacugguuaguucauaauguucccccuauagggcugcagaucccuuuagcuccuuggguauuuucucuagcuccuccuuugggggcccugugauccauccaguagcugacugugagcauccauuuauguguuugcuaggcccggcguagucucacuagagacagcuauaucuggguccuaucagcacacuuuugcuaguguaugcaauggugucagcguuuggaugcugauuaugggauggaucccuggauauggcagucucuagauggucuauacuuuugaaacuuugaaauuuaucuuuuuuuucuguguuuuuaaauacucggacaauuuugaauguuaaccaauuaaacuuuaaauauacaacccuaauagcuguucauggaaaaaaauacauuucuugaaaauauacccuaaauuagauaacuuaacaugaagucuuuaggcugacauauucuugcacaaagauuugguuuggcuuacaguaaaaguuuccagucccaauuuuuccucuuauaaagauuacauugagacauaaagaacugauguugauaguccauuguaaauaaggaaguuuuauuuacauuucuuuggcauuuaucucaugacauuuuccugucucaguaucccaugcaacaccacauugcacuugaugaaugcauuucucuaggcccccuuugcugggaccauuugcgaaccauucuuuguuuucaugacuuugaaaaacauagaggagauuuaaugaggcauuuuauagaauuuuucucauuugggaugugacuuuuuuucuuuuucauuaauugacugguguucaguauuugugaggaagcuugucauggucaaguauaagugacuggcagugaaauugagaguaaugauaguaaacuugaccaccuaacucauguagugguuauuguuuaucuuuauuuccaucuuccacuuaucuccauucuuagaaagaacucagugugaauacucauacuuaaaagaguggaguuauucucuaucucuuugaaguuggaguaucacacaaauuaccugaaauucuguguagaguugauuauuuauuuuuuucauuauggauucucagauacuuauuuauuucuagaaguguugacuucugugucccacccagucauaguuacgcccuuuuaaauucuguuguaaccccaucauaugaaccucccucucaaauucugauauaacuucaucauacgcacccccuuucaaauuuucccuucuuucugaaguuucaauaugaaccaucuuauguaugucucagccuaguucuaagaucuugcacuucuucaaacuggcuuuacaucuuguugugggaugauauuaaaaacauaaucugugaucugggugugcuugcuuucacaccugcuuagcugucagagcucagagcuauauauauauauauauauauauauauauguauauauauauauauauauauguguguguguauguguguguguguauguguguguauguguguguuuaugaauauauuuucaaaugccuauacauaaguguucauagacacauaacuauuucaaugaacuauacaguucucacaauguugggaguagacacaguaagaaaacuaaacugcauuuccuaugaaaucaccagaggaagcaagccaggacaugcuaacagacaggaaaacuaggcagaauguuagaaaguauauuuugagcaggaggaguggauuguggggauggggagaugggaggaggacuggugagaggaggaacaggaaaauguggucaagaugagagaauaaauaaaaaauaucuaauaagaaagaauauuuugagaguguaccauaagucagauguuuccuccuagucaugggcugaaugugccugccuauguguuuuguuuggcucaaagaaaacuuuguaaacaauuugaauugcaccacugaagucaaacgcaauacucaccuuuagauauucuaggaagugucaugucugggaaaccuuggacuuguauucacuauuuucccauugucuugcacagaucaauagugccaacuuuagugaggaccacaaaaguacuauuuuuccagucugacuacccaugcccacacucaacucaugcucuccugugcacugggagccaacucaggccccagaugcacguguuuugcugcuuuuauuucaauacagaagacagaaaauugucucuugaguccaugacuaaaagauuuggaaaacgagaaaaguaauuucauuuguuuaaugaauauuuucucuauuuaaguaaaaucaaagugugaacucuaucaaaauacuacuugaaauuccaguacaaaauaaauguagcucaguaaaauuugacuucugugcaaauccugauugucaaugacaaucauaaaucugucuuccuaacccuguuucaaaauaaccuaaguaauauaagacaauauaaaaguuagauuuggagagaugaagagauggcuuagagguugcuguucuuggaaaggaucugauuucaguuuucagaaucuugucacgcagcucacagccauauguaacgcaagcuccagagguaacacaacccaauccaacacuucuggccucaaggggcaucugcagucaugugcacauaucuaucuauauaugggcacgcagaccuacauagaauuaaaauaaaucuuuaaaaguuugauuuugaugugguuagauaaauauguuauuauaugauguauauuuuaaaaugcuaaaagauauuucuuauauaaaaauagaauuuuauuuucuuugauaaguuuuuuuuuuauauguugaacuauacugcauucuauaaaaggcuggugauagaugugaguuuauaaaucacauacuuucacuacaucuaacggcucagguuugagguuuugucuguagagucagcuugauuaguucuaaggcuaaggauagaaauuggcagggugcucauggugcauguguugggcccuacggucaguacucaacacugcaaaacaaaccaacaaagccaccaacccaaggaugggccaguuucgcuuuauugaaaaacaauacaaauuaaggaaaagguacuaauuacaaaauaaauauuuaugauauccuaaagauaugaguuauuuuauuuaacaucugaccucugcuuuaucaaauaauaugaaacaauaaaaaucugagccaucaauuggaaaaaugcaaauaaaauccagauugugagcaacugggagugaagcaagcuggcagcucuucgaguguuguuggcugaacugaauuaaacauguuacaagacaaugaacuugaaauauagugaaagaauaaaacagaauuguaauuauuggaauugguugaauuuuaagaguuaaaauaaguguagcauaaaguaaaaauguaauuaaugcaacauuaaaauauguaugucaugucuguacacuuggcuuucuucuuuccuaucuccacauuggugcaaaauuugcuaguauauuucagaauacuugcauguaucucccuguauauguaaaugcacaaacaugaaauuucaucauguuugcuuauauauaguuuuauguacacacaauauuuauaaaagaacaaaauuuauagcugucaauguaugguauuacuauaaaagacaaugucuauacauauuauacacagauauaaaaugauguauuauauucaaauguacauauaccucuuaacuagaccucuuuaacauacacagcuacaaugcuuucauuaaacaauuuugauuaauucucugaaaacuucucaacugcauaaguuuuguuuacucuguucuccccuuuacaauuccauuuccuaugaauagacauaaugcagguuaguuuuuaaaauucaaucaugaauacugauuaaguuaaccaggcauuuccucuacuuucagugcugaggaacuagaacuuaaucaggauucuaccuggguaggucccaaucuagugacauuuuauccuaaugugugucugaccaagacccacccauggaaugaaugucuucaugcauuucucuguuaauuuucaguacuugugaaaaagcucucaacaauaacaucugauuuauauuuggggccucucacauauuuggugagggaauugcuuucagcuacugucaguaagucauuugaugaaugggucuguauuugaggguuaacuauaucuaucaugugaaauacaacuauguuuagcacauuuuaaguucuaaagaaguguuagcuucuaauuuuugguuuuacuccuacaguuaugaucacugccauuuuaaacauagacacuuaaauauaauuauuuuuauuuuaaugucauuuauagaauuaaagaagagaccaauauugagugcucaguuaugaguuauuuuccauuaaccugaagauuucucaagcuuuuggauguggccuuaguauuuacaaggaacaaacaauaggaagaccaagauuaacuguucauaagcaauauuuaagauaucaaggagcaaggcuuaccagaagagccacugccuguuuugugaauggaaguaguauuucuuuuacuggagaggcaguggcuauuucauaaaauauccaacgcccuugagauacuauuacaaaaacccaauugcauguauggcaauuauuuaccauaaaccauaaauuaaaaauuaaaaauugcucaaauaucuaggcuugggaaguaguuucauaagggguugagauaauagugcuugucuauuuaggguagguuuuauuuaguuguuuagucugaauuaaaauuauuggauuuuaaauuggaauuuaaaucaauccuuucuuaucuuaccuaaguguacccacaauuguaaguugaaaggaaaaauggaaauagaaaagagagggaaauucucuaacuugaauugaagacuuauuuuaagcaauauauaaucauuauauucuaucaauccugggguccuggacuauagauacugaaauacuguuuuuagugaaaagaugacuuucugaacuuugcuacuaaugcuucuuugaaugcaugaaucuauagcuucacacaggagauagagauaaaaagguaaaauuggaacuagaagauacuucuuuguaaagcuccaaacagacucucccugauucucucaucuccauucuuuuauccaaagagauauacuuugaaauauuuuuaugauagaauccacuucauuuuccuggaaccugccuuuggcuuguguucuguaacuuucagauuucaggaaggugcucuauguaugauuuaaaaauucauucagugaauguaaguuuacuuauugaagaacaauuaaaauuauagaguacaauagcaucuaggaaauugucaaaauguuauguuuacauugucaauugccauagaggaaauuucagaaacuucaguuauaaauuucuauuguugcuauaaaacugccugguuagagagaggaagagaugcugaguguggaauggacauuaauacauuuauaaauggaaugaauagaauguuaaaaguguccacuuuaugaauccagacaaacuuggucagugugcugauuaauuuuucucaacuucacauaaacucaagucaguuuggaagaaagaaccucaugugaggaauggccuucauccgacuggcccacuggacaugucugucuguggcucauuuucuugauuacugcuugaugugggacccacugugagugguuccacccaugggcuggagguucaggguuauauaagaaagcaagccaguaagcagcuguaccuauagucuuuggcucaguucauguugcuaggcuccugccuugaaugacugcuuuggcuuccuuggaugauggacugucacuaagaaucuuaagaugaaaugaaccuuuucauugcccaguugcuuuugguucguauuuugccacaucaacagaaaaacuaugguugucaguauguaauuucaaccuauuuuucuugauauuuugggaagcuugaggagagucuaucuggcuguauccucaguacacugagauggaggagcugaguucguguacaucucucuaguacuuuguucagaaagcccagcccuccccaccccaccaauucucccaccuucuugccauaaaaaaagaguaauaacucaugcauucaucagggcagaccaaggcaggguguguucuuauaugaaauacaauuucugaacuucuguaucugacacagacacuaggagguaggugaagugucuuuccaucugcuaucucuuuuccucucuuuuuucauagcucauaggaggcuaccuugaagauuugcuguguggauucuuaaccaccuuucuguuaaaguuuaucuuuuaccuaucauaucuggggauucaguuuugcuacuugacauuuuccugcuucgcaaaguaaagacauucaugcaaucacauugcgcaucaccaaucacgagauuccagccuacaguaauugcuaauguuuugugucaauguuuggaggaagucagugcucucuaacauugugucuauuuucuaccaaaguggucucuauccuaauauccaaacacaauccauccuggacuucuuugucucucauuaauuacuuggguauuuccaaaguuguuaucucuaaagcucuuugacacaauccacauugcuuuauuguuuuggcaauuaauuaacuggagaguuagcuucacauaaaauacauuuuuauuccuauuaucuuugauuauuuuacuuucagccuuuguuuuucaauucuauuauuauuuuuaaagaauguuaauuauaugcaguuaaaauuaaaugcacuuauacuguuagaaacuaagauagcuuuuacuuaacauugaaaggcgaagauaaaaucuguuuuucaucuccuuuaaggguauaaaacucauuuucucuaauuaauacaauuuuuaaaguguaugauuacagucaaauccuucccagaauaguuucauaguuucauucuuucuuggauguuaugaaguugucuguaccaaaaugacacuguuuuucuggaauguugaugugguaggaaacuucuacuuaugucucuagaaacuaggccaugauuacauaucauuaaaauagaugugaaauguggcuacucuggcuucuuggggaccaugagguugcuugaucauguguuuguacuucuagcaguuuuucuuucuuuuuuuuuuaaauagacauguuaauauaugauagcuaagaaugaauuucaauggguugcauaacaccaauauuauguaauaaacauuugucauucccugaauuaacucaaggauaaauaauuauuaauuacauuaaaauuauuuuguuuguguuauuuaaguacauuuauugauucauacacagaaucucacucuuuucccucccauuuguuuucccaagucuaagaggcaaauaugguuaggaaaaccuuggaaaucgcuuggaaggaacuuacuucuacuagacaacacuagaguauugauaucugccaacuccuccuuaaugcacauuucuuuagaugugcuacauuuucaucuuuuuagacaaaguaggcauaaucuguguguuuuuuuucugaagcccaauuucaugcacagucaugcucucagucauuccuauacaucaaugauuuauuuaaagauaauaauucuacugauaauauaaugauucuuugacaaauaaauguucuaaguucuuuccucaaauauuuuaaucuuuuuguuuuauauuuauuuuuauuuuauuuuuugacuaagaagguuuuauuaguuuagguuggccucaaaauuauuuuguaucagaugaugaucuugacuucuaauccucaaguuucuaccuuccaaguacugauauuauaggcaaguaucuccaugacaacuuuaugggguaaucauaaaacucaggccgcaugcuugcuaggcaaacacuaccaacugagccauacacucauccccuuccauagauauuagaauaaguuuuuaaaaaccacacaguuaauauaucuucuuuaauuucaaauuuugaaaauaauuuccuaaguucgaaaguccagcaaaccccaauggaauacgaaucugaaaacacagacugggccuagcugacagccuuuuagugcuggcaacuccagcaauguguuuucuauuaggcaguugcuuuuccuuauuaaauucucuaugugaaaugcuuugcuugagauuucucuuuuugaccugugaauucuguccugugaucaaacuuacuaggggaccagagaaguacaugugcuuccugggaggaccuuugcaaccugcauucacuccagaagcccacugaucuggaaaaaaccagauccuucgcagggauaauuuugaaugacauacugagugguccuagugauuaaagggcacuuuuuaauuuaaaaguuuuuuuccccaguuuaaauuaguauuagaauauucaguaugugguagcuauuagccacagacuuugcuauggaaaaugucauuuagaauuuaucucugugucacaacaagccuccaggaaaagcacucagugaggauggucauaccuagguaugacaaucuucuugcuccuccuuuuaaggagcuagagaagguacccaaggagcuaaaggggucugcaacccucaagguguaacaacaauaugaacaaaccaguacccccggagcucaugucucuagcugcauauguagcagaagauggucuagucggcccauuggucuugcaaacuuuauaugccucaguacaggggaacgccagggccaagaagugggagugggugggaggguaugggggacuuuugggauaacauuggaaauguaaaugaagaaaauaccuaauaaaaaaaaagaaaaagaaaaagacaucacugugaggacaacagucacuauucccacauuugcauccaaaguuugagaggagugucuaauaaacagaacuuuccagacucaaagcaaaaauagaacaaguaagagcaaaagguaggaauuaguauuaaaacgacgcuguauguuucugauugagacuuggguuugagaagcaccaaguuaaauucaaggcuaaauuuaaaaugaaauuaaaaaccuucaauuugagagauacacaguauuuaaaaucacaaaacacauauaauuuuuauaggacugauuuucaaugaaauguuugaauuaaggaacuaaaagauuauaaauauauggucuuaaaaauaaccugaaacuuuacaugacuccgaaggguaacaaacagagggaucugccuccccaucccacaugcacaagcaccuacuuuuaaaaauuauaacuggcaaaauauggguuguguugccagaaaucacagaagacucuucauagcuuaaaagccucuuguuaagaugccguguaauuagcuucagaaguuuccaucugugaugauguuaaacacagguguauugcucugggcaaguugcucagguauuuuaacauuaacagcccuaguucguccuacagcagcuuguucaccaucauauauuaacccagaaacagucuucuugcacuggagaaacguaguccucuuauaccacacucuuguugcuuaugcacuugaaauaggaaugcuucagguuuguaauauuguuuaacccugaguugauuccugaguguuuuguagaagaagcaacauucauccaggacacuguuaacacagcccugugugaaucgguuuccaccaccacacugucaugugaccuugucuccuuuguccuagugcacauucugauagguccgucuuaaaaucaacagugacuuacacaagucuacuuacacaagaaugguugagugagaggaggauaugggagacuuugugcuaaauaauaauugcuuguauuugaugaacaugaguggauuuuuccagaccauuuuuauuuuauaacaguucaagguguagugcaacuuuaagggaugguguacugagccuaaguuuaagaugaagaauaagcugaggaccaacauauuuauuuauuuugccaaagguugcacaauauguacuuuuucagagccggagugaaaaguaauggaacaugaaaaauuuagguuucccuaauuauucagucaaaaugaugcugaaauugaucagaguuuucuuuguuuguuuguuuuguuuuguuuuguuuuucgagacaggguuucucuguauagcccgggcuguccuggaacucacuuuguagaccaggcuggccucaaacucagaaaucugccugccucugccuccugagugcugggauuaaaggcaugcugcccucucuccuuucuucauucucuuguucugucuuggcaguguccuacuaucuuugaagaggcauccagauaaaucacaucagaaaucacugucuucaacaucccacaugaauuccucccagggauacuccuuccugcccgcccccacccucuucauaggaucucucuggcucaugacauauuccuuguuguccuagaaaucaccuuuagaccaggcaggccuugaacucacagagauccuccugccucagccacuugagugucaggauuaggggugugcagcauucugcucagucuccaucucucuuccacuaucugacuucuaauauucaaauaaucauguuuagacuuuauagaggacaggcugucauacuauaaaagaacauccauaaucauauuuuuucuauauugcacuuucuuuccaauccugaaaaccagugaaccuauugcaccuaacuuaacaagcacaaggaagaagacaauuguacuuaaccuguguuauuggaguacucuuguuuucaaauuccuuugcaaagccauuagaaaacacugaaacauagcuggaaaaauuuaaaacuaguucaagcuuuaaaaaaaggaaaaggaaauaaagacccaaauauuacauaauuuaaaauuuaaauaguuggugguuuauuuuaaguuguauuuuuucaauacugaauauuuccccuaauuugaaucaacaaaacaaaaacauuaucuggaucguuuaaagaaaaaauuuguuaugaacaagucauuuuugcauaguaaaagcugaguauucugggggaaauucauuuccuuuuccugauaaacuaaucuaaaacagaaaauaguuggaaugcagacacuugcuaaccauauucaugcaaaucuaaagauuuauuuaagacacagacuugacuuuuucaucaauauccuacaggaucucgggaaagcugagggaaauuucaccggauauuaggaugggaacauuggaugguugcauagaccaugugucuggagguggaacccugaccacuaaggguuuagaagugaggagaaagcauagugucacuuccuucccugcaauaccaaucuuaguuucaaauaccaaucuuugcaaccucuccuuucaaaauuucuaaaguuaaccuacuuuguguugauuucuuucaaguuaaugcaugcucuuggucuucuuuccuucauacaagucuauuguccauuuuacugcuuucaguaaugccacauaaaauuuuagacuucacauuucucuucaugcaaauugucuucuuucuaaaacagaagucugguuucuaauaaagugcaagaaugccaaggacauagacuuccaaacaucaacucacuagguuuucauggggcuugagaaaauuauuauuuuuaccaaaauuucccaacaccuuuuuuaugugacugaaaugacuucuuuugguccuacccacauauuuuuccucuuuucaaugccucuuucauggacuucuguuccccuuccaggcagucuuauucauggcgccacauggaauugcuugaauccauuuucccuacuuuuaaaaauuaacuaaauuuggucuuagauaauuuugaacauguaugccaugaauauugaccacucucauuccccaccacacuuauccaugcuuuucccucuacuuaaaucuucuuacaguuagauauauuugcuuuguuuugugauccaguaagauaaacuaaggcugucugugaucaugauuuuggauuuauccauugaauucuggugggcucagcaauagguacagagcuaaagacauugauuccuccuuucucagacucuaucaagggucauuaguucagcaguaaagaggaggagccuagugagaugcuucaccccaccccugcuuccucgauugaugauaguguuguuuagaauguguccagugcagauagcuacaguuggguauuaacagaugguuauaugaaauccaaaagauggcuuuuugcagcccuucacucuaucuaucuauuaugcauuuucugccccucuuuccacauauucuaacauucagaucuuagagaaugugauagaucaguauuuuauauaugaagucauuuaagaagcaacuggauagaacauauuuaauuuaaaaauuuuuuagcaaaauguucuuugaaaauaugauuuaauaagcuuucacuuuuuuucuuaccuaaaaucucuagaguaguauguauaacucuuguaucuucuugcauggauacagucaagcagauggcuaaaaaaaaccccaaguaaucuaugaaaauggguauaaauugauuuucuagggauaaacugaaagugagagccuaguacaaauguuugguaccccucuaaauguucaguguuuacuaaauccuaaauuagaauguguguaguaaauuuaccucuuuuacaaaauagacaucgaauaauacaucuuuuuugaauggaaaaugucauagggagauaauccagaauucagaaucuaaauuugaaaaauggcuauggaauuggacuuggaagaacacauuuauggaguauccuacuauggccaaaacagucauuggcaacagaauuucccucccuguuuuacagugcaccucugcccugguuucuggggaguucugcagaguggugaacuaaagucuucucccgaggcaccucuuguggauccagacugauucagaaacaagugugccauuguuucacccuuagaaaaggaaaaagaggaaagaugguaaagaaaucaaaggcuuugggaaacuaccauguuucuucagauguaucccaggcaguuggcaaacaaaaugagucuguagccaauugcuagcaugagccaggaguaacacuacuuauuacacagcuuggaaauggguuuuuggaaggaaccacuuuggaucaugaaguguuuugaugucucugccauucagccuagguucuuccuaagcauucuaacauccaaguuugcccugguuuuauguuuaaagaauguagguuccuacuauggucuguauaggcaggaacgaauacauugcuuaucuuauauuucuagcaauuggcauaauaauagaugauauagauuuuugagugaaucgcauuaucaacagacauccauuauauuauuuuguuguuuuguuacauggguaaauugucugauuuauaauuugaaaacauuucuauugucaaggguaguaaacaaguaaaacacuuaagaaaagauugagcccacucagaaucuugacuuacucaguuuucgcgcuacacccaagggcuccuaguuugaugugcaguauuggauuuccacucuccucuugccauguguccugaugcucuaagucaaaggcuugaauuauguuccauuaccaaguaagacccugaggauggcugguuaugucauuuccuuuuaagauaacuaacacaauuuaaaguuuuauauuucgucuacuucuagcuuacuugaugucuguuccuaugaaggcauccucaacuccuuuaaaaaugauugaaaguugcuauuguuuuacauucuaggaaagucucauauuaauguugucaagauuuaauuguaguaaagaaaaauguacauaaguaaacucuugccaaaacaguggaugauccuggauacuauguuuuuuuaugcuuagucauuuuuuauuggauauuuuauuuacuuacauuucaaauguuauucccuuucccaaucuccccuccaacccccaccagaaacucccuauuccaucccccuccucuugcuucuuuuaaggugugcccccacccacuggauacuauuuuuaacauuuaaaauauuuaauauuuugaauaagaauagcacccagaagcucuuuuaugugaaugauuggucccugguugguaaugcuauuuaggaaggauuuguaggaguaggugugccuaucacuggggucagggaucugugagguuucaaaggcccacacuauucaguuagucuuuucucucuccuugugcuuauggaccagauguaagcugucagcuacugccugccugcugcuauguuccucaccacaaggacaauagacuuuaacccucuagacccaugagccuuuaacuuaaaggcuuucuuuucuaaguugccuuggucauaguguuuugucacaaaaauauaaggguaacuaaaacaaucuauauagaugcaaaauuaauaauauauauaagggagaugugugaauaugcacaaauauguuucuucaaggauaauugaauaccuuucuguagcuuuugcauauuuugauuauuuguagguagguagcuguaacccuauuuuucuauuucacuggacucaaguuugcucuuauaguacguaauacaguaaaguuuuauggacgagugaauauugaguaaauuauuuaauuguuacuucuguuucagauugaugaauuugcugggaucaauuuagauuucaaggaaaauucauuuacaauacccuuaaaauauuucuucuccaaggucaauguucauguuuuaucucuuuuauacauuaauaaguacagaaauuuaggcauacuuuuacuuuauuaauuuagugauaaguaauuaauuaguaaacaaccuaauuaaucuuuuaguaccagcuuuauuuuauauuccaaauuuaaacaaauauuuauauauucuucuacaacuaucuauugagacaauuuuaaaauuugagaucucaugcauauuugaagaaaauccugggaugugccuuuuguguaccuauuuuucaaagucauacuauuuaaagaaacuugucauaaugauuaaaguaauaauuaaaauaacuaaaaggaauaacaaucauuuauacucuagaacuuuaaaauuguauuaaagcuuaugcauaucaacauugcaucugcaaaagauuuaauuugguuugcauuuauuuacuuguaaagaaaauaucaaauguuccacaaaaugaggucuguuuacaaauacaacuuugggauuucauuuuuuguaguuucccuaucuaaccacaguuuagggggaugucuugaacucaccuuugaugcguacuaaaggaacauggaaagcccccucaacuaguggaaguacaggagagaugcuggcuuugcuuguuagacuucuggucuccuucccugacgucauccauccucuuugucuacucuccauccuccuccuucuucuuguccuauccuuuuuuguucugaagcagaaaaauguccagugaauagcuuugauguguaucuagaaagauauuuauaugagucucuagcuaucacuuugcuguucagcugcuucugagauugaaaauacuguacaucuugaccuuaaacauauaaguuaacuuuuauauaauuguuaauacauaguauaaaggauaagcugggaguaaagacuaagaauuggauuuagacugcugaguaaugauuccagucuuacuuagaguucaaugccuguucuggcagugguuuggaagggagauuuauaguaaaacugaucuuugcaucuuuucuucaaugagauugccugauuuuuauuaguuacaaaauaacaaaacugaagcuuauacagagaagaacauaauuuaguauuuguuuaauuugcuauauaguccaaguauuugaaaaaacuagaaauuuccccauugaaugagagugcuccuugccuagugcccuguucuccugaacccaguucaaaggaaagagaggacaaaaagaaugcuugaaaauuucuuuagaaaguaucuucaaaguguuguaaacuuuuuuguaaugaaauaaaugggaucuuaaggacuuuagacuguucuguugauuguaaaauuaaaaaaaauguucaaaguggguagcaaaauaaauuagaagaaguuaacuacugcaauaucuggauauucuccuuccccuccccccagaucucucucccagcucaaguuggcuuugaacucaguauguaaacgaggauaaccuugaacuucucucuaucuccugccucuaacuccucauuacuuggauuauagguguauaccacauauuuggauuauguggugcugaggacggaacccaggacuuugugaguacuaggcaagcacucuauuuacuaggcuaauccauagccuucaaugaauagguugugucuauagacacuaauuauucuuugauaucaagaaggauaagagaauguuaaauagaauguaaagacagguaaaagaucauaaagaguuaaagugauuuugaaaaucucucuuagauaaaacaucuaauuuuguauccaucugagucucuuauacauaauauuaaaauacuacaaaaucuuugaaguaaguuucguaauaaguaaaaaaaauguauaaaauguccauuuuagauuaaaauauauguacugaaaauguuaauauuauauaggauccucauagucucaauuguuucauauuuuuguaaguauggaccacacuugaaauaaacaaaaaaaaugcuguuucaaugcaaauuaugaaauagcgcaggauuaaaagaaaucaugucugcauucaauauggucuauaucucauuauugggcucgcucuacucuaucucuacuuuuucucuaucucucugucuucauguguauaugugcauguguaguuaacuugcaugaaguauguuaggccuuucuaacuacuguaugaggacaguuuuaccucauucucuguaguauuuuugcagcuauucgugauuuugagcuguguguuguaucucuguguguaaacaaaaguguuguaguuugaauaugcuuggccuaucaaccccugacccauuggucaacuauaaggaggccuuguuggaauagguuugacauuauuggaggaagugugucagugcauagauuaccuuugaggucuacucaugcucugcccaguauggaagagaguguccaccuaguugccuuuggaucaagauguagaacucuggacuccucccgcaccagggcucccugacaaugccaugcuucccaccaugaugguaauggacuaaaccucugaaacugcaagccagucugaauuaaauguuguucuuuagaagacuugcuguggucauggugucucugcacagcaauggaaacccuaauaaagacaaacaguuacaauagauccacaacagccugaaagucauccuuguacacagaauuauggaugagcauugcacauaaguauguguaauuuuagcuccauaacuuggucacaauuauuuauauuuccaaaugacacauggaaagaaaccuaaguaauaccguaaaagagauuguuugcuuuucauuuuuccauuucaaguaaaguaaaaacagcaguuuugcuaguuaacugaaaaccuuuauuuaccauuaaaaacuuuuaauggcaguauuaaaaaaauuacuugugcuaucauuuaucaaggccuuucaguugugggcuacucugaaaguguauaugaguuuuccucuuuguauuuucucagguuucuauaacaucuuuaacauuugucauuguuguuuaagaauauaaaauuaaauuuguucuuagaauaagaauuuagcucagcucaaauacuuuggauguuguagauaaaucuuuugcacuugggacaaaaauacuuuguuguuuuuuuuaaaauuucugaaauuuccgucagugcucauuggauguuucugguucugggcuugcaagguaugagacaguuucaggguagguauauuauagagauaaauggcuuuccucuggcaaauaggagggggagagagaaacuuacaggaaguggccaguggcaagauauauacuucaaugacaacucuuagccacuuuauccagccuagccccauguacuaauaacucauucagcugugaacucaaugcuuuaauccauugauagaguuaguaccuucaugguugaaccauuucugaauagaaaaaguuggggaccauaauuucagcaccacauauccaaacacaacaaaagccuacucuuauucacuuaguucauugacagacagaacagaaaauggaaauuuagacauauauauauauauauauauauauauauauauauauauauauauguguguguguguguguguguguguguguguguguguguauguauauauauguauauauauauguauauauauauauguauauauauauauacauauauauauaguaccuuauuaaauuaaaacaaaguagauuuaaaaacagaugauuaaaaguacccacaaccaauuugauacucacauauguacccaccuacuugaacaagacauugaggcugaguggaaaauacagccaaauccacuuccucugucucugguggcuugagauguuuccaacuucuaaagcucaagaaacaauggccauaacacuauuggcuuuaacaaagcagagccuaaagagaaaaauggauguccuuccuuuucuuugccucuugcugauaggagcuuugaaggggcuuugcuuaaaagaagcucgagaagccauagaucuuaggcuggccaugccuugguaaagacacuggcccagugcagaggugcuugaugcugcuugcuguugcucccuuugugucacaagaggaaaaugaagugaguauagucuuacaaagacguugacaauaagagaagcuuuaaauaaugguaucucagaucuucacaaucccagcacagaauggugugagcugcuggaucaggaaggcaaguguucuaaaaaucaaacuauuaagaacauguuuuuccuuuguauuuggccucauagaugucacacguucuuauaacacucuuucagaaaccaccacauuacccacugccuuucauucaaaauaaggaucugaagugcauuuucucugggaauuuaaguagaggaaaggaaugaaagugacauuuuuucaauacauaugaugacaggcuagguaucuuccuuugacuuaugcccucauccacacuauauauggcaucagaaaaacauuccugagauggacacuauuuugagucucaaggaauuuacugcucaguagaagaucagaacaaacaguugacugaacaagagaggagaaauuauuauagcauaaggauauugcauaauuucuacagagaagaacuucagugaaccauaguuaaaggcucuuagauuauuugcaauuuuuaguuguaaggcauaauaguagcaugaacauggauuuaaaauuauugucuuuagguucagugaagaacuuuaguuauaugauuaggauuguauuucugggucacaaagguuucaauauggaucugucuuucacuucuaaagauuuauuugauucucucucucucucugucucccugccuuucuccaucucucugccucucugucucugugucuuucucuaucuguguguguguguguguguguguguguguguguguguguguguguguguguguacuauguguguggagauaucuuuggaggccagaagauauuguacucccuagagcuguagucacagggcauggugagcuuugugggcuggcaaaucagcugaaguccacugcaagaguggaaagggcuuuaauuccugauaauaucucucuauccuguucccuccuccuguacuuuuuuuuucuuuuugagauaaaguaucaugacauagcacuagcugguuuuaaacuugagauugcuuauguagucauuuguuuuggauauauacuaugccugaagaaauggaaaugugggguguggcccauccuuggcaagcagcacuuuaaaaaacuuaguuucugauuauuuauuguuauuagaagguggguuugcucugccaucuagugauuaagaacuguacuuagacaauuaaguuugaaagcacauagauuuauacgaaaacauaucucugaaaaaauuuuaaagcaacugugcugauuucaaguaaauauguucaaauacaucucuccaucuagaaacccaugccaggacuauggugguaauucauaauggagucagucuccuggggcauuuaguagaagaaaaauaauccuguugcuuggaagauaaaaugugggaaauuauaucacagaaaucagaaaagaauaaaaauacugccagaucgcaaccucuucuagauuuuagggaccucaauaaauuauaaguagaaacaagugcaaguaguacaaaaugacagauuuguaggcuguugagugugugugucugugucucuuuguguuuuauaggacuuaaauuuggauucuagaugcugaguugauuagcagagucuugagggcacuacuggauuucucaauaugucauuugaaaauccauacauuuuuugcauugacacaauaauaaggugaugacauuauuuuuguaacucuauucaacaaacugaucaccauuuuguuuccucuuuugcuuuucauuuaaguaaaugcaauguccaaacagaagggacaauagccacaccauguacagcugccauaucagaacacagaagaaauaaugcaaggugcuguuuuguagccuuccucacuuggcauacaucuuucauucacacaugaacagugagccuucacugagccuucugugauggcaacaaauucuuguaugggcgaggagaaggcauguucagucgugaauguggauuuuucaccuccuggccauuuaaaagcauuccaaguacauguccauauuaucuaaauuuaauuauaaauucucaggagaaaaauaccaauaaugaaucuggguguaaaaucuaaaaccagcuuuuaguguugacauuuaaagaaaaagcaguguagugaccuacuucucugcuccuugagcguaguucacauagucuuaaauugcucuuguuuguguuaacaugggacugaaagggugagucuuuuuuuccaacacucccacuccuuuuuucuuaaggcccaagaacaaguuuauuuggcauccagaaaaaacacuacagauuaauugaaaauuccagcaaucauuaggagaugauguagaacaagacaugccuuuuaaguuaagaauacuuuauuaacgaagacaaaacuauuccaaacaacacagauggaauagugagcugauuuggaaagccuuuugggagccucuguugaaguagcuucugaaguaggauuaagccauuuguugaaaauuuacacaucaccuuguauauauucuugacuuccaaauuuuuuaauuuuauuuaauuuauauugcauauauuauacacaucuaauaauauacuguaucaaagauuaccucauuauaacauauaaguuuaaauugguaguugauagcauguaaguuuuuuaaaaauauaaauuauauagcauaauguacucuauauuaguguauuuaauaacuuauauauuuuauuguuucaguaaauauaacuucaaauauuguauauuagcacuauauauuacaauccauagauauaaacauaugauguuacauagugauauauuuuuaaaaaaccaaacauuuauguguucauuauuugaucaaucagcacauauuugcuaacacccauccccacuaauauguuugaacauuauuuacucccgaccuugaucacucaaauugugagagaaauaguuauuugucuuuacagagaauuucauuuuuaagcaauggguuuaaaaccaguaaauugauaaauacuguuucuuuaaccauaaaauuuaaugaacaaaauauuuuauuuuaaaauuacauuuauucguuaacuaucugugccuguccacguuuguauggaggagauuggcagauagaacuuaaauaugggagucagaagacaacuuuggggucugcucucuuucuucucugugcauucccugggguuaaacacagaucaucuggcuuggcuaagggugacuuuaccuacugagacaccuugcuggcccagcaguuauuuuuaauuuauguaguuaaugcaauucuucaauugauuaugaauacaaguccauguuuauagagauuguauuuuagagauguuuauuuggaaguggaaugcugucuuagggucucuauuccugcacaaacaucaugaccaagaagcaaguuggggaggaaaggguuuauucagcuuacacuuccaugcugcuguucaucaccaaaggaagucaggucuggaacucaagcaggucuggaagcaggagcugaugcagaggccaggagggauguuacuuacuggcuugcuuccccuggcuugcucagccugcucucuuauagaacccaagauuaccaguccagagauggucucacccacaaggggccuuucccccuugaucauuaauugagaaaaugccuuacagcuagaucucauggaggcauuuccucaacugaagcuccuuucucugugguaacuccagcugugucaaguugacacaaaacuagccaguacaauugaccccuugucaacuugacacauaaacacaucacuaguaagccucaacccuuacauucuuauucauccccaaguucuaaauaacuuuaaacaucccacugucuuuacauauucuuaaaauuucaaucucuuuaaaauauccaucucuuuuaaaauccaaagucuuuuuacaauuaaaagucucuuaacuguggacuccacuaaaauaguuucuuccuucaagagggaaaauaucagggcacagucacaaucaaaagcaaaaaucaauguccaaccuuccaaugucugggauccaacucacaaucuucuaggcuccuccaagggcuugggucacuucuccagccaugcccuuuguuacacaugcaucguccucuaggcuccagaugccuguauuccacugcugcugcugcucuuagugguuaucucaugguacuggcaucuccaaaacacugcaugaccccuucaguccugggccuucaauugcaacuguggcugcaccuucaccaauggccuuccauggccucucacagugccgagccucagcugcucugcgugaccccuucaugccuucaaaaccaguaccaccugggugacccuuacauauuaucaagucccgcugcagcaggaguacaaccuuggcuaucucuggaacacagccucuuugugcuuucagaaagcacuucccagaagaugucaccucaaugaugcuggucucuucuuaaucaccgcuaauuucuuagcuccagcuaaccagcaucaauagucccaguaaugccaaguuuuugcuuuaguaguucugguaucuuguuaaucacagcugauucuucagccccagcuaaccagaaccgcagaaucuucacaaucaaaacagcaauggggaaaagccucgaagauauggguacuggggaaaaauuccugaauagaacagcaauggcuugugcuguaagaucaagaaucgauaaaugggaccucauaaaauugcaaagcuucugcaaagcaaaagacacugucaguaagacaaaaaggccaccaacagauugggaaaggaucuuuaccuaucccaaaucggauaggggacuaauauccaauauauauaaagaacucaagaagguggacuccagaaaaucaaauaaccccauuaaaaauggggcucagagcugaacaaagaauucucaccugaggaauaccgaauggcagagaagcaccugaaaaaauguucaacauccuuaaucauuagggaaaugcaaaucaaaacaacacugagauuccacuucaaucuagucagaauggcuaagaccaaaaacucaggugacagcagaugcuggcgaggauguggagaaaggggaacacuccuccauuguuggugggauugcaagcuuguacaaccacucuggaaaucagucuggagguuccucagaaaauuggacauaguacuaccggaggaucccgcaauaccucuccugggcauauauccagaagaugucccaaccgguaagaagaacacaugcuccacuauguucauagcagccuuguuuauaauagccagaagcuggaaagaacccagaugccccucaacagaggaauggauacagaaaaugugguacauuuacacaauggaauacuacucagcuauuaaaaaaaugaauuuaugaaauuccuaggcaaauggauggaccuggaggguaucauucugagugaaguaacccaaucacaaaggaacucgcacaauauguacucacugauaaguggauauuagcccagaaacuuaggauacccaagauauaagauacaacuugccaaacgcaugaaauucaagaagaaugaagaccaaaguguggacacuuuacccuuucuuagaaaugggaacaaaacacccauggaaggaguuacagagacaaaauuuggagcugugacgaaagaauggaccaucuagugauugccauaugcagggauccaucccauaaucaguuuccaaaugcugacaccauugcauacacuagcaagauuuugcugaaaggacccagauauagcucucucuugugagacuaugccggggccuagcaaacacagaaguggaugaucagagucagcuauuggaugggucacacggcccccaguggaggagcuagagaaauuacccaaggagcuaaagggaacugcaacccuauagguggaacaacaauaugaacuaaccaguacccgggagcucuugucucuagcugcauauguaucaaaagauggccuagucggccaucacugcaaagagaggcccauuggacuugcaaacuuuauaugccccaguacaggggaacgccagggucaaaaagggggaguggguggguaggagauuggggggguggguaugggggaccuuugggauagcauugaaaauguaaacgaggaaaauaccuaauaauaaaaaaaaagaaaaaaaagcagcaauggcccugaaaagagucuuuaauuuucccucugaaauuucacaaaccagaccuccaucuucugcacuguucucaacauuaucuuccaagcuccuacacaacaucugacagagcucuuaacaaugaauggaucuucaagcccaaaguuccaaaguccuuccacaguccuccccaaaacauggucagguugucacaggaauacuucacucugcugguaccaauuugucuuagucagggucucuuuuacaguuuaacagaaacuauauagauaugguauccuauauauuuguuugguauggguaauggaaaccuaauccaagagacagaaaaugguuauuucauuuucacuuaauguuuaaaacaauucucugacacccauauuguauucuuucgaaacuucuccaaguauaugagucugcuugaauucuuugcaugggauuuacuuguauaaauucucuaguaaguuuagucauguaggguuuacaugcacuggguuuacauauuccauuuggaaaugcuuaguugcucuuuaucagaucuuauuauguucaaucacucauaacuucgagaauaaaaccuugugagaagcauucuuucacuaaaaagcauacuuuuuucuuuucuuuuugcuucuuccuauaauagggcaaugcgcauuuuauucauuaauccaugaggaacuauucacuauuuuauguacaugcuaaauguaguaaguucaucuguuuuucaucucucuuaaggagauuagucauuucucaucuccuccccuccgcuuuuauuccuucucuucuucccugacuccuucuguguguguuuguuaaagacaaaggcugauguuggguauuuaccacaauugcuuucuaccuguauucugggauaugaucucucacuaaaccauccaccugacuggucuuggcuacaaguauaugugauuacacuuguuuagccauuuacaaggugacaaggcuucauucucagcuugccauacuuguccaauaggaccuuugccagcugagccagauccuagcccugggaguuacuucuaagaacucuuuuaaaccaaaaagauucuuuaucuuaaacauuucccaaauuauacaauuucagauuaucaaccucuuuuuguuuuuauuucagaugaauaugaugaagaaauagccuguacucaacauggacagauguauuuaaauagagacauuuggaaaccuucuccaugucagaucugugucugugacaauggugccauucuuugugacaagauagagugcccagaggugcucaacugugccaauccuauaacacccacuggggagugcuguccggugugcccacaaacuggagguggagauacuaguuuugguaagaauucucaaagcuguuucagaggagaacuaacaacuuaccuuuauuuuccagugauuauugcuuuuagaguuuaacaacucaagugaauaaucauagcaacuaacucagugacuucagagaguaaugauuuugaaaucacugugaaaaguguauauauucauaauuuuaaaguguuccgagcuuccuggaguaaguaaggaaccuuuuuuucucuacuuaggccauuaacacagaaauagacaguaauuuuuugucguaauugucagaagaccuuacuuugaacggucauaucuaauuagagaacaauuugugccuuauggauggcugcuguuauuggguuaugaaaggggccuccaugauaauuaguugacuuucuauuauauuucuuaauguuaaggaaacacagaaaauauauuuauugucuccuuuacaagguucacucuagagaaugcaguaauuauucuuaauauaauuuacuguucuagcaacuucucuuacauugucucaacaaucuaggguaugaguaaugugcaccacacaauagaaggaaauggaaucaauuucuuggagaaaagaauugcaccagcuacuggguuuaaaaauauuuuugcaagaaaaauaucuguguuuaauugauauuauauuucagacuaugcaacaaagauacaggcauauauuaucauucauauauuuuaaugaguuagguaagaccaacauuaagcauuuagguuguuugcuucaguacuuauacuaauaauugucaagacauuaucaaagcuuuauuuuuucaaauuccauugaaaauagcaauacauauaauaaaaauguucaacaguauacacacagaaauauuagacaccaacuuguaucuuuucauuuugguauuauuuagcagaagcugcaucuaaaauaaugacuuuaucauuaaugugugauaaaguuaggucauaauaugauaaaaauaacacacaaaggccauggaagcaauaauuucauagaauuccaggaauaaguacaauuaaucuuguggggauaaacaaauaguccgugagaauagucagcaaguguuagaaagcaaauuauccaacuuccugcaaguugucaguguauggaagcacaacuccuucaaggggaguagugacaaugggcagaaauagauuuauaaaagaaaucaacagagaagagugcuugagaugcauuaaguuuaugagacaaaguacacacuagcaccuguguggccacagauuagguaaaauugcuggggcucaauagaguggcacauguauuuaaucccaagacaagugagguaagaggauaacaaauucaaagucagccugaacuacauucugagcugaaggcuaacaggagcuaaauaccagauaucaaaacuaaauaaaacucauaacaaacugaacuaauagaauauuuaaccaguuauacaacuuuuuucuuuucuuuucuuuucuuuucuuuucuuuucuuuucuuuucuuuucuuuucuuuucuuuccuuuccuuuccuuuccuuuccuuuccuuuccuuuccuuuccuucccuuucauuuccuuuccuuuuccccccucucucucccucucucucuuucuuucuuucuuucuuucuuucuuucuuucuuacuuuccuucucuuucucuuuuugagacaaguuuucauguauaccaagcuggucuuuaacaaauuuagccaagaauagccuugaauuuucuaagugcugggcgcuuucuacauacauaaguuuuacuaaguacuaagcugugccuucagcucaaaaccuaguaaagucacaggugugucuaagaaaaaaggcuuuucagcaggaacgacaugcaaugaauaggaagaaaagcaagucuguguaagaugaacuaggaaguugaacaaugaggcgauaguacagaagagauguagauggcauccaugggaagagaaaaauaauaaauuaaaaucaagaagaauuaaacacauuaaaaaacacaguacacgcagaagauauauguauccuugaagaguucccaaagaagacacuaauguaauggagcagaacaaaucauucaagaaagaaaccaucuuagcacugacaauacuugggcaaacaauuuuguuagaugggcaaguugagcagauauuuggaaauuauaauuuaggcuccugugcauuuuuuuaugacugguaauagauaguagguagccacuugagauaaguauuuguuuaaggcaauaaacauuguaaguuccaaaaccaaacaaacaaguaaaccaacagcagcagcagcagcagcagcaaaaaaccccacuaucacuaccaacuaccaccaaaaaaaccaacauaaaacaaacaaacaaacaaaacccccaacuaaccaaaaagaaaaaaaaaaggguaaaauucucuguuuacaaaaagcaaaacuguguauuuauaaaccuaaggaaauuaagugaagcauugcuauaaagcauuguaguauaaaauuaacuugcagacuugcauagguuugcuguguaaaaaaauuuucccaccugugggaugcuuuuccuccugcuggguugccucauccagccugaauaugagaggaugugccuaguuuuauugcaacuugauaugucauguuugguugauauuccuggaaggcaugucuuuuucagaagggaaacugaggagaagugggucuaagggagaggggagcugggaagagacugggaggagagaaaggaggggaaaccacggucuggguguaauauaugugagaagaguaaauuuuuaaaaaauaaaaauauaaauaaugagaauaagauauacaagaaauaugugauaaaauuauaauagagaagcaaaaguuuaaaaaugucaauguccuauuauauucuugugaugucuacugcagcguugggagcaaaacauuuuucauuugagguaaauuacucagcacauuaaaaauauuacgaacaacauggagcaaucguugaauuauaauucaugauaaaacgccuagugccauauuuuugccaguacuagaaucucugugaauguugugaagaaauuaugacuaugugagacuauuccacuauaugaaugauuucuuuuguuggacuugauucagacaguuuuugagcucugccauacuggggagguguugcagguaauaauaaaaaagucaacccgccaucucuccugccccgcuggucuguauuccugcucuaguaccgguacuggcgggccacaacacuaugucccagcggguccgcucagugcugagcuacucucucccaccuagccgaguucaucucacuuccaugcagugccccacacaccucacgaucagcgauuucaaaaccuacuaccggguagaauuaagacucuugagcuuauaguuaaccaaucagauuuaucuauuaauaauaucacauuuuaccagaugccaauacaauaauuuuagagccaauugaugaugauaaaacuuuaacccaauuauucuaaccuuuagauaacaccacgucagccuccauucugguucucucccuccuucccuucugggaccucucugucuccucaacucccagcuccuccucccuuuuccuguccaauuacaggccugccacugcccuaaugugauuggacagagaaaauccugcaacagggagguaacauguuugugaggaaauauacuauugaaaguguauaugcaggauguuuuucauaguuguuucucaauauuaaugacauuuucuuucuuuuuguagguagaggaagaaaggugaguuuuacuuagcaugauuccuuuuucauaggcaaaauucuuucuuagaauaucuacauggaacugugcucugaacucuauggaaacauagcuuaaauaucaaucauagaugccacccacucauugguauuuaaggaugucacuguaguucuuuuuuucuuuuucuugaaugugacagguuaggaauacaacaguguggcuuugauuagaaaaacaagagugcauaaaaaugaugggaccugucaggaaguuaacucuggcuauaucuagaguguugagugagauaaggucuucugagcauuuccuuugcuuccaaaauucucuguugcucacagauuuggcuucauaguuaggugaaguaauaauauaugugagaaaagaaauuaaguaaauucaaaugcauuccucccgcaauccuugcucuuagaauauauguguugaagucauacuucauuuccccaguugcuuaauggaauauaacauuuuauaauguguuaauugauauuaaugaauuaauaaugauggguucaagaagauaaucaaggaagcaagauaggcagacacaaugauggcauuaaggagaucaaaaaucacagaaagacaaauacugagacagguuaacacuaaauaguauauggggaaauacaccucagagcacacaaucacaaaaccaguauauauacuucaagaguccguaguucuacuauucaaacgaaaagccacugccgucugcuuugcuugcugugccugcacugagggauguagacuggccuggcaguaucuuacaaugcaguucacauuuuccaacucuccccucagagguugaggaaguacacaaguagaacaacugcaccuguuguucagaugaggcaagcauguuuaccuucauuuacucuuggcauuugcuaugaauuccaugaaagggaaacagguggcaagagugguauacaauauuccugaaaacccugucaccuaggaugugugugaaacucaaguacucuccucuggguuucuuuuugugauuugaaucuuuagggagauguuucagcuauguucugucuuuauaucuuccccugacuuuuuugaauuguaaucaauucguugcuauugauguaaugaaaauugaagcaaaacaaaucuuugcucauuuaauaugcuagauuuguuuuuauguccuuuagaugaguagaaauuuuauccacaaauaaugucuggcagaaugccuugaugauugaagauuaacuuuuuguuuccaagguuaacauuucuuagaaaugucaagugauuuccauaggcuaaugugccauguuauuucucuaaauacuuuauauuuucuaauuggcaucuuuucuuuuaaacaaucuuccuagggacaaaaaggagaaccaggauuagugccuguuguaaguauuguauauuuguauguuacauuauauauauauguauauauauauuuauauuacaaacaugacuauaagaguuguauauuauugcuuucucucaaaaagaaaguaauuuuauaaugaaaaaauuuaauauaacacgaauaagauaaaauacaauauuauuugauacaauauucuacauuaaauuuuauagucauaugacugacaguacaaaaucaugauuuuaaaauauuuaauguaucauauguauagauauacugucaguucauauuaguguucuugguuuaauguuccacaauuuuagaagugugcuauacccaauccucauugaaauuucccacuaauacaaaauccuuaggcuguauuuauccuuguacuuaagcagaagguucaccaugguauuauggaauggcuaucauuucaacucacagaucuuauggcaguuuucaucaaaagugcaggaaaagaguacacaguuaauuguuugguauuauacacauuuuuacuuuaccuuuaaauuccauuuuuuuucacaauuuucuugaaaaguaaauacuuccuauaguucccccuuucauguuugauauaucuuagauuccaaauauuugacauuuauuaagccauauaauucuaugagguuauuucauacacaccauuugcauuugagucuucauauaaauugucacuugaagaagauuaguacacagagaauaugcaaucaguucaaagucacacaguuguccugaaggugaaacuuuaggcuuagugcccuugucuucauuguggguguaucagucuccauugcaaauacuacauuccuauguuagagcucaaacuaggugacacuuuaacuccuaaggcagggggaguacaacugguuaagaacaucuacauucuuaaagacuuagcugugcuuauuauuaauuauuauuauuauuauuauuauuauuauuauuauuauuauuauuauuauuauuauucagacuacugaguuuucuaaaucuuuguguaaaacuuugcauuuacaaauguccuucuuccguguuuagguaacagguauacgcggucguccaggaccugcaguaaguauuuuucuccaguauuucuugugaaucuuugagcagaauuucuugagcaucuuuguugacaagguauacauguggaaacagcaggccacagaaaagugcuuggccucccaagauauuuuacuucaaaccauuuucaaauuuagacuuuguauuuugaagcaaugcaugguacacaagggccaguuucauucugaaguugauaaacuuuauuuuuccuuaugcauuaguuuuucugcuggugaaaaggaaaagcaagcuauguuuacauugcuaauauuuuauugacuguguucuuuaaauaacaacauauuuaaagaguguauuuguaugcugacugauuaagagagauuuauuuacuuaaguaauacauugcaauagaauuugagaaguuauauacuagcaugagagauuucuggcuuugcuugaagacuaauuaucuugaacuugggauaucaacagugcuuuaagguaacuaaugaauagugugugcucacauacauaacauuuaaaucucaaaacccaccagaucuuuugagaucgaauacuaacauagcucuaacagacuuauuuuaguccauuguaagccucugcuuuugcacaguguuauugagcaggguauggaaucaagacacauaguuccuacuuuucaggaggcugagacaagaggauucuuagagccaaggaguuucagggcuggucuguaaaacaacuuaauucaaaaucaaauaaaacaaaagcaacaguacuguuuguugaaacaaauaauaauuuugaaauaaaauauuuguaaguagaacagaaauuguggcaauuauaauuugauucauuauaaguagauuauauguguguagguaugcaguaaaaauaauauauuaagucaacuagugaauacaugaagugacauaaaacugacagcagcaggcagaccagugaugacugacccagaacauugugaaccuguuugaaugcacauauuuuaccagacaauugauaauuuaggauccacacuuuuaugcaagucuccacaccugaacucauuuuuauuuguuguuguuguuuguuuguuuguuuuuuuguuuuuuguuuuguuuuugugccuagaucuuaauggccaaugauucacacuaggagaaguaaaaauggugcuuaaaaagacacaauuaguuuuuacccuaauaugcuuacuuacacagcaucuuucuuuaugugucaucuaauucuuuacagaucuucaaacuucacucuuaauucacucugcccuuuuguggguaaaguaaucauacacacagacuuugcuguccagucuuccagugcucuaaauugaaaugugauguuucugugucaauguucuuauaucaauugaauccuuaaaauaucauucguaaauguuuauguucauaauccucauuuaugcucuuaugcucuagggccccccaggaucacaaggaccaagaggggaccgaggcccuaaaggaagaccuguaaguguacaugaaaugagcugauuugcacuuucuaccuuugaggcacuguuaacaauaaauucuacaaaaucuauguucgugaaaugaucuuuuagcuguccaaauucagagcaaauuacugcaugaaaauuauugcccacuguuuacuagagagauaguauaacugaaaucacuuauccuuuauaaagucaaauuaaaaucaauuuaacuuaagaaacaggguuagugaauuguggugagaucgcauguuaucauucauugguaaauaaugagaagaauguguagccaagguaaaacacccgaacucuaugacuuuuaguuagcagugaaauacacaacuggauagaggaaaaagacauuaauuaaugaguaaaauuuacacagaaaauuuauuuacuucuaguguccuuaaaaggcaucuaaacauuucaccaaaaacagaacacuuuuacaauggagcugucaucagggauggaauucauaggccuguaggugaaugacaguucccccaagcaaguuggaaccauuuguggugggaagaaacuacauucucucauucugcugugcauucuccauugcugucccacugaacuacuucacagaauuaauaguuuaaaagcuuuuagcucuucaggugucacuagagaaugaaaaugauaggcagaaggugaauucaauuggguggagucagggugguuacacagaaaacauauuuuaccaauguacuuguacuacacacacacacacacacacacacacaccucuaucuaucugucugucuaucugucuaucuaucuaucuaucuaucuaucuaucuaucuaucuaucuaucuaucuaucaucuaucuacuuaucuaucuagaucuagauauuugaugacacugcccaaugacacauggaaguugcuaugaaaauaaugauugcagauucagaguuucuggcuagaaaacuaugaguuuaaucccuauccccugucccuuuuuuucuuucauagcgagguaguuguuuccucucuuagucccacgggagagaauguugaucagcuauaauucuguguuuggguauaaaaauaaaagcagcuauuuaaaagaguauagagcaacuacuacugcaggugacuucuuucuucuucuucuucuucuucuucuucuucuucuucuucuucuucuucuucuucuuccucuuccucuuccucuuccucuuccucuuccucuuccucuuccucuuccucuucuucuucuucuucuucuucuucuucuucuucuucuccuucucuuccucuuccuucucuuuuuucucuuccucuuccucuuccuccucuccuccuccuccuccuccuccuccuccuccuccuccuccuccuccuccuccuccuccucuuuccaacucuccccaaauauacuucucuguuucuuugagaaaagagcaggcuucccagugauaucaacugaacacagaguaacaaaugcaauaagacuaggcauaaccccucagaccauggcuguauaaugcaaccugguagaagauuuuuccccacaaucagguaaaagagucagaugcucucacucucacuguuaggaguccaauaacaacagaaaaaccccaguuaaacaaccacagcauguaugcagaugccucauuaaggccuugugguugcugcuuuuagauucuuugagccugggcuagagagaugguucagggauuaagagcacugacugcucuuccagagauccugaguucaaaucccagcaacuacauguuggcucacaacuaucuguaauggaaucugauuccuucuuccgguguaucugaagauaacuacagugcacucaucauauuuauaagacaaauaaaaucuuuagauucuuugaacccuugugagcccuguuuaguugauucuguagacucuguucuacugguguccuucaucccucuggcuucuacaaucauuccuaccccccuucuuguaugaauacauuccucugauagucugagcagugguaauauaugugauuuguaguuuuugcugauuaucuugguauaaauaccaucacuaauuucuagcuacaagcauaucacagaauacugauagguagaagauuuugauucauaacacaauccuccuuggauauauuugcuggauugaggucuuuacugucacaauaaggagugguauaaaaauaauuccaguuucuaguacuaucaaacaauacaaaucauuuacaucauguaaugugguuucucaacuuuaacacuauaaaagccuugaaccagauaacuccuuauauguugugggauuguugucaguucuaccuaccagaugccaguagcaacccucauuucucuucuaauuguugcaaauaaaaaugaauugaugcugccaaaucuaggcaaaauuguacuggauugaguaguaguaauuagauagaaacucaugaagccagugaccaccaugauucugucaucaaaagucccugguuuagaguguauuauucaaauugcuucacacucaaagguuuuuagucuagaguacauuauuauccagguuacuucauguugacaaacucgucauuuaucuggagaugaacauucaaucauauguuaaguacaaauugcaugugacaccuaaggagucaccugugcagugaaacaugcaccaauuauugcagcuguaacauuccauaauguacccaugugagugguuacgugugcaggacuuugugcaaucaaacugcuaacccgcaggagguacaaaguucuuguggagugugcagcuuuucuucaugugaacguuuaaaguuugccaccuaguggccauccacaaguacuuuuaugcagagugcugccugagaguauucugggggauggaagaaaaaugaugauacacagaacauuuccuuccccaacacaaaauuuauaugacuaacuuuaauuggaaauaugaaauguauuuuaauguauccccaauuauaguuuauuuuuauuuucaucagcaaaaugucuacauaauguuuuucuuauucucauuaaauuucauuuuguuuuagaaaaauuucauaaauguuuauuaauuuaaaucucaaauugugcuagaccaaaacacaauggauauuuaaaggcgauuccaggagacuagagaagaguccaaaucagacccagcuugguaucugauccaucuuaaccaacgaauacauuagcaguuuagagaguuaaacuaaccagaucucuuuugguucacauaaaaaaauaaauauuuuuuuucuguuuuuuggaacuguuuuuggaguuaacauuuuauuuuauuuuauuuuuuuaagauuuauuuuauuuauuauauguaaguacacuguagcugucuucagacacaccagaagagggcgucagauuucguuacagaugguugugagccaccaugugguugcugggauuugaacucuggaccuucggaagagcaguugggugcucuuacccacugagccaucucaccagccccaacauuuuauuuuuguuaccuuuuuuguauauaauaacaguuaucauuuaauaguuuaauuggggggcagugagaaccaugaauaagcucaaguacuucuccaguguucugguguagagguaaaaggugucuacacacugugugauccaggagccugacucaaaagcuggaaucagcuugcucaugccuaaagaaagagcuuagcgaauugccaguaguuuaggggcaagaaggagguugauuuuuuaaauguagaaauauuuuucaagaaguuuugaauuuucuagacugacuuuucuaccuaaauacaaaggcauaaauggcuuuuuuuuuuuuuuuuuggcccaauacugaaagacauggauucuugaauauagcaaaguaugguuaaccagcugcuucagcuuguuaauauugcugcauuauugguccuaacugugggccaagaagagcuacccucuugacuaagaauuagaagcuuccguuauuuuuuaacagcagcauaccacuuuacuuaaacuccauguuuagugauaaaagugaaauuaucuggugacuaauguguucuucucuuucuuaucggaacuuauuaagacuuuuaagauuaacacacagacacacacacacacacacaugcaugcacacauucacaugucugaugugaaugaugaagcugggagauguagcuuuuucagacuugaggacuuggcuauuucccaagcuguccucagaauguggguuaggaggagggcggggcuuggcagcauggcuuagugaucacuccucugagaacuagacucugcuggaucacagugccuugccucugaauucucguuggucugguugaccacuugggugagaaggaaaauaaaaugugccagacuuaaaguauagaagagugaaaugggcaaauguuauccacaauguuggagaacaaccaugcaccagauauucugcaagucuuguguacuuuggaagaugaaauagaccaaaaaacucuacugaggucuuuuauacuuuuggauaagauaggguggacucggguuaagcaggcucuuucuaguuaacuauaacauguuguaacaagacagacgagugaauuuagaaccuguuuuuaaaauucacauaagcaucaaaaucucaccaaacaaagcucauucuaaaugcugcuaaagugaagugauuuucugauuauucuaagauuucauacaucaaguacaauucuuaccaagacuacauuuccauagcagaagugcuggacuguguugacacugacaguguuuagauugucuguuuguaauuaucaugacugcuaucuaaaacugcuuuuagcuuucuacggacacauuuuaagaugguucuaaugacagcugguuuucuuuucuaggguccucgugguccucagggaauugauggagagccaggugugccuggucagccaggugcuccagggccuccugggcaccccucucacccaggaccugauggcaugagcagggugaguuguguguucugguuaguguaacaacuagguuacaugaaagucauuaauucauucuuauguuauuagacuguaucaguucagagguugauggcuuacuccaaaaccuguauaguaaauguggaccuccuaugaacaacagugaaacugauaaauccaugauagauuguuggaaaaacacaaaguguuauuuucugaaggcuuguaucaaacuauuugcuuuuauuccaaaccuuuggguaucccaucccacgggauucaguuauuugugggugcaagggggaacgcaaaccuggaaggaaaugggaggaagagaaagagaaacaggagaccaagaagaugguaccuaucaaggucucguuuauuaugcugaggugccuuccuuuuaaagcauacaucauggggaauaggggaggggucgagggggaauuuuacaaagaacaaagaagugggcaucugcugacaugggggccgaagucaggcgccaggcagagggcacucugcaucuuaucucuggaacauagauccuccuugacagccuugggugucaggccaggcucaggcguaacucauguccuuggaugucaugggaguucaggaagagauagggaagaggggacuauaauucagcuuuuacagccucagguuccaggaagggaauaggggggaagggggugauaaccagcuccuagcacaaggccauuuggccuguuagggagauugugaagggcucacuuucucaugggauggucucugacauuuggguuuuuuuguuuuuuuguuuguuuguuuuuuucugguugaccaaggcacuguccacacaaugaacuaaagaacauacauuucuguccugcuguuucccagacuacaaaaacacugacaaaaucaauccucugggagaggaugcaugucuaugaugauggaaagagcaggaaguuguacagacucuuggggcagaccuuuuugucaucaugacaaaugcugacaagaaacaguuuaaacaauaaaggauuuguuuuaguucacagugugagaaguuuccauccaugguugcuugcuccauuguuucuaagucucugcuggggcagagcauuauggacuaauguggggagauuaaauacuccccuucucccuggccaggagagaagacaaauaaaggaaaagguuuuggaaaagacauaggucucaagaacaugcccccagugacuaauuuuauucagcuagaccucauuuguguuucuaaaucucucaucaguggauggagucauugaucaggcaauuccauagacaaguuacuucccaacagucuacuuguaaacauuacacugggaacuaagauuuuauuuuuuuuauauuuauuuauuuuugagaugcuccccuaccccuaugaguuucagauuuucauucauucuucuggucaucuggccuucuuuccuguccuuccccacaccugauccugaaaccaccccuauuccccuucccauccucucccucacccagucuccuuccuccaucuucuuccuaugauuauuuuauuaccccuucuaagugacaguuaagcuuccucacuugugacuucuuuccuguuuagcuucuuugggucuguggaguggaguguggguaaccuguauuuuauggcuaauaucuacucauaagucaguacauaccauacauguccauuugugucugggauaccucucucagaaugauauucucaaguuccaccaauuugccuacacaauucaugaugucuuuauuuuuaauagcugaguaguauuccauuguguagauguaccacauuuucuuuauccauucuccaguugagggaaaauuaaguuguuucugguucgggguuauuuugaauaaaguugcuaugaacauaguugagaaagugggggggggcaagauuuuaacacagaccuuuuuuggggggguauguugguggagccacagccaaaccacaacaggauuacaaauauuccuuaaauguuuauauccuacuuuaaucaaauaaaaugcuuuguucugucuacgcaauugaacucuugguggaggcauaugcuacuuaguauaucacauaguacaggucaacuuauggagucugaagauuauuaguauuuuacaacuguucaugcauuugcuucuaauugaagaauggucugcuuauuuuuugaacaauacagauauuuccccacuauaaucuggaaauuaauaaagcugcugaaauauaguugaacaauuuuggccaguuuaauugccagaguaucuuaaaggucauagagaauauuuaaaacuguuuccaauuuuuggaacaagcagaaauugauugaaaugauuaugaaaauuuugucaacuuacauuaaaucguuuuuuagguuauuuuccaugagugaauaaagaacaccauuuacuuaaaauggaaucuggcaucuuuaggauaaauauuuaaaaugcauucuuuaagcuuuguucuguuauuagcaugucccagggaugggaggaagccaaaugaagaucccagaauccauagcugucgacugcguucuugucagacagccguugcuuuuguuuggucccaggcauauacccuauugcagcaguucuuuucugaaccaguauacuuagaaacugcucugggagagaaugguccaucaaaaccgcacacagugaaaaacggcuaauuuuuuuuaugugcuaaauucaaauguuuaaaauaguuguuagaagagucuuguuugaacauggcagaguguguacuauucucacuauuaaaaguauguugaugcacaucuuuuacaguggaaacauugucaacacuuuauuuuauagccuuuuucagcucagauggcugggcuggaugaaaaaucuggacuuggaagucaaguaggacucaugccuggcucugugguaagcaugaaaguuauggauaaaguauuuguugaaagaagcuuaaguuagcuaguuaaaggccaaugagguggcucagcgagugcugccaagacuguuaauuugagaucaaccaccaagaaacauaugauagaagaguauaaaaaccucugacuuccacaugugcaacauggcacacacacacacacacauacacacagaaacacacacacacuuacaagcacauguacacauacccaaacgugcaauuguauacaugcagacagacgcauauaugcacauaugaauacaaacacaaacacauacucacacauaugcacacacuaagacacagaaaggaacaugcacacucacauauacauauauacaagcucacacacauauacacauacacacauauacauauacacaagcauacaagcagacacacacacacacaaacguuauaaauacuaagaaaauuaaaauauuuuaaaacacacuuauuaauaccuuuaauuuacuuagcaaguccugcugugugcaaguuaaaaggcuaguugcgauccauucauacccaugcuaaacauuugugaacaucaguaaacucugucuacauauuucauuuacuacuugaggaaguacaggacauaacuaccaccaucacacaaagacuguuccuucauaaucuaaaaguguauuuauuaucuuuuauugugcugaugagaaacacucacuuggaagaacuuucaaauagauuuccauuuguaugaguucuaauggccuaacaggcuuuggcuacuuuacuccaacaacucugcuuucuggcuaguccucuuuugucucuggucucuugaauuuuccaucuccucagguuacuuuaaaguuggcuauuugaagaauucuaaacugugagaaaaaauuaacacucuucaagucaacucucccaugccuuuugaucauaauucaaaauugcuccauguuaaugaaaucucaaacaauaagaagugaaguuacaccuuguagauucucacucccuuuuucauccuuagggccagcuuuaggacaccucaaacaugauuuguguauuuucuaaacuaucaguggcacuauugacugguuggcucgugauaauuuucugaaauaccaaauuuauauauuuaaaguugaaacuacauauauauucauuccugcaucuuaucaaaauguuauuuauuuuaaguuuuuuuuuacuuaaaauuaagguuuuauuagcauauuuuaauuguacauagaaauggcauuuaaaauauuuaaaaauuuuuauuagauauuuucuuuauuuacauuucaaauguuguccccuuuccucguuuccccuccaaaaaccccuaucacauacccccucccccugaucacaaacccacccacuccugcuucccuguccuggcguucccuuacacuggaucauugagccuuucacaggaccauaggccucuccucccauugauguuuaacaaggccauccucccauggaaggaguuacagagacaaaguuuggagcugagacaaaagaauggaccaucuagagacugccauauccagggauccaucccauaauuagccuucaaacgcugacaccauugcauacacuagcaagauuuugcugaaaggacccugauauagcugucucuugugagacuaugccugggccuagcaaacacagaaguggacgcucacagucagcuauuggauggaucacagggcccacaauggaggagcuagagaaaguacccaaggugcuaaaggggucuacaacgcuauagguggaacaacaauaugaacuaaccaguaccccagagcucuugucucuagcugcauauuuaucaaaagauggccuagucagccaucacuggaaagagagacccauuggucgugcaaacuuuauaugccccaguacaggggaaugccagggccaagaagugggaguggguggguaggggaguggggggauaugggggacuuuuuauuggaaauguaaaugaggaaaauaccuaauaaaaauauuuaaaaaaaaaaaaacaaggccauccucugcuacauaugcagcuguagccaugagucgguuccuccauaugcacucuuuaguuggugguuuagucccugggagcucugggggguacugguugguucauacuguuguuccuccuauggaacugaaaaccccuacaauggcauuuuuuuuugcauguacagaauuuaauaauguucguucuugaauuuuccuuguaugcccuuuucuauuaaccuuucucuuuccaagcagacauucuaccuccauacuuuaaaggucuuuuuucccucaguagcuagcaugccuaaugaauaacuuagaagcuuuuacuugauugaacuugauuuuaguuaaacugauuuugcuuuauaagcuuuggcauuauguuuuguuguccucauacagaauuaaaauuuccugaagucugcauuucucuccuccagguuucuugugcuucgcagcaucauuuaauguguagauaaggaagacuguuuauacuuuuaacauauguugugaaagaaaaaaaauguuucagagaacccaguacccagauaauuuuaaacugacauuggaaauaaccuaacaaagacuguugguuucauaaacuguuaacuuagauuguuauuuaaguuaggccaccguggagcugaagcaucaaacuggcucucuucaauaacuaugugccugccaagauuuuucccuuuuucagaugguuuacuuuguuagaaccacacauuugcacaugugcaggcccuuguccuaaagaaacugggugugcauaggcguggucaucucuccuaugacgcagaggauucacaaugaaauuaucacaacugucacucaaauuuaaucucccagaagagcaaguuugggcgugucauuauggcccucuaguccgucaucacaguccaaguucuaaacacauucaccguuuuaaaaauguaaguuaaggagaugaggagauggcucagcugguaagaguaccugaugucucagaaaucccagguuugauucucaguacuguugugguggcuuacaacuauccauaaguccaguuccaaagggcacaauauucucauauggcauccaaggccaauagacacacauguggugcacaggcaaacauaaaagcaaaacacucauacaccuaaaauaaaauaaacaaaucuaaaaagaauaaauauaaugugacauaaauaugauauaacuuuuucccacuuguuuuuaaggguccuguuggcccaagaggaccucaggguuuacaaggacagcaaguaaguguuuuuauaauuaauuuauaugguauaacauaaauaaaggucacaaauaagccucauguuucaugacuacuuuagacagaacauuaaacuuuagaauucucaccuggaaaggcaucuaccaauuaauccuuaccgauaaagaaggacaugcagcuuucuuuuuucauaguuuauuuuuuaaaguaauguguguguguuucucucucucucucucucucucucucucucucucccucucucucucucucucucucucucucucucucucucucucucucucucucucucucucucuguguguguguguguguguguguagaccagagacugaagucauguauguuauuuguuucuugaggcagucagaugagugguuugcuccagaggugccuuguucccauuucuguuuaccaagcacugggauuacagaauggccacuauaucugcucagauuuuacaugggugguagaggcccacagucuaauccugcccaugccugcagagaaaaugcuuaauccacugagauguccucuagcucucacaguuucuuacuuguccugcauauucaucaucuaauuucuuuauaugacucaccucuaacacuaggaguuauguuaugugucuuugguucuaaaauaacagagcauuauuucauguccuauaaaguucccauaauugauuuuuuuucuaagccucuggcuuuacaauaagauaauaaaaguucacuugaaauuaguauucuuguaaauuaaaaucaaggugguuauucuguggaaucuugcuugaagaauauucuaauacuauguaguuccuuuccacaccuaccaaaugucaguaaaacuaugauguagaacuauuuuacuuuguguaaugauuuaauggguauuagcuaauaauauuucaaaagaaaaaaaucuuuaccucaaucaagguaaucacauugucaugaucaucuguauggacuuuucugaugguaaguacuguugucugagcacccauucugugguagcacuagucuauuuuaacacaaauuuaucuaaacagaccaaugaacuaagucuuaaucuuagucuaauuuuucauaaugaaauuacauuauauucagugucaauaauuuauuaaaauuauguaucugggaagugucagagacaaauaucaauauuguaccuugucaaaaguacagaaauugguauguugcuuuccuuugcuucauuuaucauuuguucucaauuuuaggguggugugggacccgcaggaccuccuggugagccuggcgagccuggaccaaugguaaauacggaauaaguaugucagcccauggcacaugagucuaccuugaugauguauugugagauuauuuguucuccuaggcuuuaguaacuuaacaagaaaugauaauccuggaagcccugugcuguggaugguacuuauguucuguggauuuuaacucagaguaugaauguuguagauaguauugauacuagauuugagcaguucagugguucuguucuugugcaccagaucugagacacacagauaaaauucagaacauuaguaaugguacuugauauuuuuucauugucuuucuaguguuugaauaguauuggaaggaggaaguagauauucuucucagcauuuucuuucuuucuuuuuuuuuuuuuuuuuucuaauuucuuaggguccaauugguucucguggaccagagggcccaccugggaagcccggagaagauguaaguuucuauagcacauugcuuuggagucugaaagaggcuaacagggagcuacaagggucaggagaguauucuguucugauuccuauuucauuuccucauuccuccagcucuuauuaaauccacuuuaaaauguagaacacagguuaagguuuuccaaaauuagaaagaucucauuauuaugagagugcuaaauuauuaaauacuaucucuaugauguccuccaagauuuuuauugauauuuaucuuugaaaacaaacaaaaaaaacuacaacauuuugucuuuuagaaggcugaaaagaugacuuacuuuaaacauggaacacaugcuuauuuuauuuuacuuuuuuacugugcuggaaucaaacuugggggauuuuucaugauagacagggucucuaccuugagcugugccccagcccuuugcauguaaauucugauguucugaaaguguuagaucagaacagguuauuuugcacccaucucuuaucauugauaacuuaaaacacuaggauuaaauguuaccagagauagagcccggguuuugucuuuacaguuugcagcauaacacaaaaacuugcuauagauauaucaucuguaauuugucauguaaucucagagaauaguauuuaaucucucuauaccucucacccccucuuucacauuaagggugaaccuggaagaaaugggaauacaggugaagugggauucucaggaucaccaguaaguaaugguuaucaguauguugccauaaagguuaaagaaagugaaacuuccagcccauuguacacacaugcauuagacauuggguaaaugcaggcacacaagugauauccuguuaugucaaaaugcaaacuguggagggacauuuugccagcauuacaaugaauuccaguucucagaauugcauuggccccagaugaaaaccuuagugccaaaacaauuguaucaugacuauaauacacaugaguacacccaaaacucaaaauuuccacauuuaugaaguauuuuaagaagccaucaaugugaccuauuuacaucaaugugaccugaguuuuguugagcucuaaauauguuuauuguauagcaacucaucuguuugaaauaauaacuugaguuuguugccuuguguguguuuuuaaucaacuggggacuaaacuguggacaggaugcuccuuuggcugcuccccaaguucuaauguguccugaaauccuuuauuaauauccugggcccuaaaaucuuaggaagagaugcacuuauugccaggaugucuaacagcuguuuuauuccuccucaauucacccaagaaacacauaucugugaacugauuccaccagaauucaagaucuagaacacugaacauuccucaaaccugccugucugacucucauauugcuuuguuugguuucuuuuagugugugcuagauuagaauggagaaaauaagagacaaaggaaacaagaauaauccucuauuuugccaacauguguaguuucucuuacccaacagcccccagcuuaauucagcuccucuucauuuuaguuccuauaauuuccuaauguuucuaugcuuauuauaaccacccaguacuccaugacccucuguuuacuuucuggaaagugaugagguucauugcugggauuuuguuuuaaacagaggaauguugaucucuuacugggauuuauagggcucuaaggauuauuuaguuucaauuaugaagacaaacccuccucuuccugcuuucuuuccuuugcuccccuaucagccuggguauaaaugcagacaaaggcaugagguuuagcuacuaggacagagauguccuuuucgaccaauucaggcuggaaacuucggugaccuucugcacucuucauggacucagaguguguauguccauggggaggaaaguacucugccagcacagcacagaugcacacucacugaaacagcaugcaugugugcugugaugacagcccugggucagcagaaugagaaugagucuuuaugaguauuaguacaucuaguucauuuccuucuuauacuaaaguauguaaucacaugggaauuccccccacaccauaaaagcugaaguuaacuauuaucuugaaauaaucaucucaguuauucucacauagacuuggaugaguguacacugaguugcuugcucagggugaagggaaauauacaucagcaagagggaagguacgaguuaaaaagaaaaaaccaaaacacaaaaacaaauaaaaaaaucuuuaagggacuucuugaugugaaagauuuucuauggaagcuugugucaacagaagaauuaguggcaucucaucucuucugagagacgauuaguauacccuuaaaugcccuaguuucaaaacacuaaagaaauauuuacccuucaagaagucacagaaaauauugcucugauauguugcuuauucauucauuugguaaauagugaauaaagacuauaacguguggaauggaaugaccauucugccauauguggaaaugcugagacaagagaaguuccucugaaaagaugggcggaagugaugaguuucugaggcauuaaaacuuuccuccagucaguugccaagcuaaugauuauuuauagcauaaggcuauguguuagggaucuuacugaugauuuaaaauuauaguugaaauuuaacagugguuuguuaguagcaauguguacuaucuggguauagacccuuccaguggcaguaguaaugagaauucaaugcaaaacuaaauucaugcaggcagagaagauguguguguuuuaguuucuggggccuuaacauuaaagaaaaauauaugaaaauccuuaaauauuguuuaaaaguaguuauacaacuagguuuccuuuauggcuguaacucuauucuguguuuuaaugggcuugaguagaagaaaccgaguuaagcagaaauagaaaugaaugaguuaaacacaaagccacccucacauuuccugacuauuuugguggauauuuuagccccucauuuaccuuuaagcagccaucacuucuacaaagcuugucuugaacacuuacuauuuaaaaguuaggauuauauuauacuacucauucuauugcuaauguucagacaacaauaaaaauaaucaaaauccuuggcuuacuacauauaaggaccuuuacucuucuaucacagaugaaacucaauggaaaggagaccccuccauacacuuaucuuugugugucacgugcucacuuccaacaguguguuugucuuucuaguuuucaucacccuaguaacauuuuuauagacaaaauccaguucuuuccuuuauuauguugcuguaaaugauguguccauuuucuaagucauuuuguuuuauuugaccacaaugugccuauguaccuuucucucagggugcucgaggcuucccuggugcuccuggucucccuggcuugaaaggucacagaguaaguugccuuauuuucuguuuuuuauugaguggggcauggggauaauucagucaaacccuuuguaauuccgagugccaauuguccuucagugcuugccauugcgacguucuucugcauuacuaaaaucauaaugcuacccuaaguuuccucugaauuucauaugguucuauaaagcuauacuguguuaaaugaaaugauauggugagugaaaagauucucuggcuuacaaccccagguaauaaauggaugcacuuaguaaaagagacaaacauuguauagugcaaugagugacauaauaaaaauggugauacuagguuaaaaaguauaacaaagaaguuuucuaaacuuaagauaacagauagguaacuauuaaauguacuguucauaaguauaaucuaucaucagucaucugcuauauauguaucuguauuggauauagguauuaucucuuuaucuucucucaaauuaaauaucuaaaaccaaggcaaaucaauuauaaaaaaugguguagucacuuuuugaguaguugaaauuccaagaagaauguguauugcuguauuaucuagcaaguaacaugcauuuaaaaacuuuauauaaaucuauaaucugccuaaggucacuauaauuuuuuauaauauagauuaaauuucuaggaagucauuacauuuuugaugacugauacuuuaagcugauacuauuuguaaaauuuuagaaauauaguaagcaagauuuuacuugugagacuuguuugcaugaggcacuuuauguaaaugugcuuuuuguucuuucuuccuuuaugcuuuuuaaacugaugaaagcuaaaaauauuuaugaauuuauauuguccuuuucagggacacaaaggucuugaaggccccaaaggugaaauuggagcaccuggugcuaagguuugucuaacaccaaacuuaacuuacaguaccaauucaguugcuguggacaccuuuuaaauaaggaauaauauggagaggagauggacuuaaauaaaugaacauccaaguaaauaaaaaguuuccugguugcuuuauucuaugcaaagaccucuagcccuucuuucuucccccaaaugauuuguuuauauaguuagagaagauagcgcagauguaucaggaauucuuaagaggagaacauaauuaugagauauacacauggaaaaauguuuuuaauuuuauuugucaaauuccuaagaaaauaauuuaguuacuuuuaacauuacaaaauuuuauuugggauauauuagacauguaaguucccacugacuagugauuacaaguucaaucuuuuuaaaaucccuaguuuagauuuucuuucuuucuuugacaauuaaaguuucauuuaauucuuaagaaaagauaguaaaauaaacucugaagucuucccuugaaagcacauuuuucaaauguccuuuuugaaacugugccuucaaaaucaugcauguuuagaccagcaguuugguaaugauauuuaaauuucucacccugugauguauccucaccucugcuuuagggugaagcuggccccacugguccaaugggugcuaugggcccucugguaagcaucacauuauuuguuucuuuauuuugcggguuucaauaagaaaauuaucaaauaaaaagacauauguuaacuaguaaaucacucugaaaaguaccugagagaaaagcaaccaaagcaaguuggauguucgaugugaauuuuugcccuuccugaugucacuggucuucuuggcuguuggaugcucuuacuuuccaugcagcaaucaagagugacucuuaucauguguguuauuuugugauuggguuaccucacuuaggaugauauccuccagauccauccauuugucuaagaauuucauuaauccauuguuuuugauagcugcauaguacuccauugugcaaauaccacauuuucuuuuuuauuagauauuuucuucauuuacauuucaaaugcuauccugaaaguccccuaugccccgcccuccugcccuucuccccaacccacccacuccugcuuccuggccuugguauuccccuguacuggggcauaugaccuucgcaagaccaagggacucucuucccauugauggccgacuaggccauccucugcuauauaugcaacuagagacacaguucugggggguacugguuaguucauauuguugccaggcacuggcauagccucacaagaaacagcuauaucaggguccuuuuaucaaaaucuugcuggcauaugcaauagugucuauguuugcuggcugguuaugggauugaucccuggguggggcagucucuggaugguccacccuuuggucucaguuacaaacuuuuucucuguuacuccuuccauggguauuuuguucccuauucuaagaaggaaugaaguauccacacuuuggucuuccuucuugauuuucucguguuuugcaaauuguaucuuggguagucuaaguuucugggcuaauauccacuuaucagugagugaauaucaugugaguucuuuugugauuggguuaccucacucaggaugauauccuccagauccauccauuugccuaggaauuuuauaaauucauuauuuuuaauaguugaguaguacuccauugguaaauguaccacauuuucuguaucuauuccucuguugagggacaucuggguucuuuccagcuucuggcuauuauaaauaaggcugcuaugaacauaacaaaagaacacacaugauaugcacucacugauaaguggauauuagcccagaagcucagaauacuucuuaaaagggggaccaaaauacucauggaaggaguuacagagacaaaguuuagagcagagacugaaggaacgaucauccagagacugccccacuuggggauccaucccauaaacaaccaccaaauccagacacuauggcaguugcaacaagagccugcugacaggagccugauuaguugucuccugaggagcuuugucagugccuggcaaauauacagaaguugcugcucaaaucauccauuggaugaacacaagguccccaaugaaggagcuagagaaaggacccaaggaacugaagggguuugaagcccuauaggaggaacaucaauaugaacuagccaguaaccccagagcuccuuggaacuaaaccaccagucaaagaaaacacaugguggaacuuguggcucuagcuguauauguagcagaggauggccuagucggucaucaaugggaggagaggcccuggguccugugaacguucuaugcuccaguauaggggaaugccaggaccuggaaugagaauggguggauuggggagaggggaagggauaggggauuuucagaggggaaacuaggaaaggggauaacauuugaauuguaaauuaugaaaauaucuaauaaagaaaaaaaaacagaaaaaaauuuaaaaaaugacucuuaucuaucuagcuucuuaaauucagguuaugugaaaucuauuugcaucaggguuuggaucuccuuagauaagcagauguuccuauccaaauucacuccuuucaacauugccuuuuaugguaauuauauuuuuucauaggucucuuauauuuuauuuauauuaugucuauuuuggauaagacagugaacuaaaaccagccuagaacucauauagaugccucaggagacauuuuuucuucccaucuuauguauagggaccaagaggaaugccaggagagaggggaagacuugggccacagggugcuccuguaaguauagaucauguauuuauugagaucuauguuuagcuuuuuuuucaguuauguuuuacuagauaugcuuuguaaaugagggcaaaacaagguauauaacuuaugauggggauacuuuuauuuugaaaugaacaucaaguucaaaauacuagccagcgugccaugacauucugaaagcuaugaagagaauucauagaacauacuuucccucagguucagccaccaucauccuuuuggucuguucagcacugagccuuuccaaauaccugagacagccauuguaggcuuagccucuuccuuuacccuccaugcugccucagcucauuauugaagacaaccacagcaagcaaggauuaccccuccuccauuuaaugccaacaggccacugaggaaaccagaauaaauuggcgaguuuagagucugcugucuuguaacacauuugacaccaguggacuuugggucuuaggucaguuuucuuagacaacagcuugaaugcugugagguguguaugagaaauugaaccggggugcaaucagaauuuauaccaaugaaaaaaaugaauaaaggaagcagacugaaaggaaaagcuggaugguguuccaauuaucacagagaccucugcaaacacccagugaguuaucugccucuguaaacaugaccgaggccagggcagaagaggggaaaaauugauacaauuuugaaggagagcaucaauugcagccaucagcagguguuaucccagcgacucaacggacucugagggggauuugggggaaccccucagaaucaauuugaacuuaguucuuguuugugccucauguguuauuucauuuguuuugcaaaagcucuuguccucagaguuauucuggucaguaaaaggccaagaugcucaaacucucauuguaucuggguuuaccugacacagcaugauacagcuaaguaaagagaauauuuugaucugcuuucuuucuuaagucuugacuauuaauugcuuuuuguuuguuuggcuuuuacugauacaaggauaaauauguuuauugcuacuugaucugcuuuuuagaaacucaugccuuuuuugccauuaguucaguggcuuuuguuaucagucagcccuaauauuuuucuucaaucuuuucacuggaaauugggaaacaaaugaaucaugaaaaaaccaagugaaagacgaaguucucuaucucuuuuuaaauucucccuuuuucuggaaauuagggaaaacggggugcccacgguaugccuggaaaaccuggaccaauggugaguucuguuauuuuucauaauaauuaauuacuuaucuauuuuucauuuguauauuuuuauugcucauuuauuuauucauccauuauuuuauuuguuuuguguagacaugauaaacacaguucuuauuuuugaaacuggauauauuaauuaauauaaacauguaauacuacuauuaaugcuguuguguagagugaauuugaaauauaggaacauagaggaggaugugcuuaaaucuacaauagaugaaggauauaaauaaaagaauuaaaaauuaauaucaguaaaaccucgagucauuaauaucuaaaaaggcaugagcguaauuccaucuauagaaugaguaagugaaaaaaauaugagguaauacuaagaguaaaauugaaucaucagguagguacuaggucacacaauuucaucuacuauguuaaggaaugcuuaaugucuuuccuaucucacauauugagaaaccauucuguagcgcuaagcacagguaugcaugaccagacagcaucaguuguugaaauuuuagauggaugaagacagucaagacagagugugaauaccauuaauuuaauuccagaaaggagcuguaaaauuguaaacuaaaucuauuauauuggcagugaagcccccuuacauauuagugagcuaagaaaggccaauuacucauuguuuuucugguuuaaggaguuugguacaugaugauauuuaacuaaaauuaguguaagucuguguucugauugcaaccauuuuauagagaacuuuugaaucuauauucaucaaguuaaagguaguucucuaauuucaugaacuuauaacgucauucacucuuugccuuauauguaguccuaucauaugucuaucuuucaucauucauuuuccauagguaucuuaagauccuuuaugucauugcauaucugagaaguuaaugagaaaaaggaggauuuucaguggauacaaaucucuauuuauugugccaaggacucuuaaauuauaacucuauaaguuaaacagaaccaaaucuuucuaguagcugagugauauaguuuuucugaucuguaaagcaauugguucauauaugguuuuauaaauuuggauaauuuuuacugauacuuuaguucuauaguagugcuaccuugguuuucaaaacugugucauguuccauuuacaguuaagaugguuauuaauaaaauauaccgaauagaauagauuugugauuacaaggccuguggauauuuuuuuuggaaagaauaaaaguuaauucaagcagcugcacaagauaaauugugcaaauauuacaaaaccucauuaaagugaaguaaaaaggacagagggggauuuagaucacaugggcuaguuuuaaaguuugggauuuuuuuuucuauauucccaaagucaaauagaaauacauuauucaaacuuuuuggccccaaguauuuuucuucccccuguuucccauaaaaaugauauaaaauuuaggaaaaaaaugaguauacucugaaagaauuauauuaaucacaacucauagaauccaaauaugucccaugauuagcucuguaccccuaaagucauaccuuuuaaacugguuuacacugaucccagaaguugucuaugcuuuuccaaacauugaaagucauaaauaacacaugcuagugccuuauccagaugguugugagcugucauguguauacuaggaacuaaacucagaucuucuacaaaagcaccaagugauuuuauuuuuuccugcagcaccaucucuucagacuugguaacucaauucuuaugguugauaucauuugagaacuacuuugggacaguguugaaugauguuuggaauguaaucacauuguucuuuuuuuauguacagauuguuuuuaucuguggaaauacagauuuuuuuccuucaaagaauggaaaaauaacauaauuguauauugauuaaaaagauaugauuacuuuacaauuuuccccacacuuaggguccucuugggauaccuggcucuuccgguuuuccaggaaauccuggaaugaagguaaguuugugacaguacuugaugagugaagggcauuucaguauuugaagagugugggaguuauucuuaacaaggaaagagccuagaguaguaggucuuuaagcaaggaaaaaaaagaagacauggggaaaaaugaaagcuguuguaugaugugccauuaaaggaaaguuacuuaaagcuguguaauuggacucuaaagacagacuuuugaaaugguugcaaagaagaccaucuuugaacagagugaauacucuguucuuggauacaauguggagaguaaucaaaagcagacuguuuuaagcaaugggaaguuaaauuagaucuugccaaaaagggaugcuuugucauaauaugcuggccauuauucugccccucccugcccaagccuuuaaagaugugagcagggaggacacuuggguuuccaugugggaauggauuaaaguauucagugggaauuguauucugagacaauuuguucuuucauguucuuugggagagagucaaaaguacuauaguagcaggacauuaagauuauacuagcuaaaucacaaauucaaaacaccaauucuaaguugagagccacuggauuuaauuuccccuuacugcaguagcaguaaauuucuucaucuugaaaaagagauuuccuuacaagauucacugcuuacauggcccaccagaaacuucucugugccuuaagacagaggugcuuacugacaggagccugauauagcugucuccugagaggcucugccagauccugacaaauacagaggugaaugcucacagccaaccauuggacugaacacuggguccccaaugggguccccaagggagguguuagagaaaggacugaaggaacugaagagguuugcaaucccauaggaagaacaauaauaucaaccaaccagaucccccagagcucccagggacuaaaccuccaaccaaggaguacacauggagugacccaugacuucagccacaaauguagcagacgauggcuuuguugagcaaucaaugggaggagaggcuuuugccccugugaaggcuugaugucccaguguaggggaaugccagggcagagaggcagagaguaagugggugagggaacgccuucauagaagcaggaaaaugggaaggaauaggggguuuuggggagagggaaacagaaaaggggacaacauuugaaaugcaaauaaagaaaauauccaauaaaaauugaaaagaagcaaacaaaaaagauuaaaugugauuuucuguauaaauccuuaauauaaagggggcaggaauccagccaauauacuguagguucaugcuucuuguuaguagcugcacucagauugaauuugaauuuagaaauugaaagaaucugccauuuuaacuauucuuuuaauugugaggaucuuuuugucuaacucuccagguuggaggcuguaaacugaagucuuaaauuauuucagcaacugguuccuacuuucaccgagaaucaauuuguucuuuuaggucucugaucccucugaaaccuauauuccucuucuuccucuucuuccuccuucuucaccuccuuuuucucccucuucuuccuucuccucugucuacccauccuuucucuauucuuguuucucuuacauaacacuuguuauucuucuaacuccaccuucuccccuucuuuuuuucugauacugugguucaaacccaugaccacccacauuuaagcagguauugacuguuauguuacacccagcaaugaaguucaaauuuuauuuauuagauacauguagauacauaaucuugauaaccucucucuccaugcccuaauaaaaauauacaacauucuuuaacacuuuuauugagacuuugcaugcucagacugagugcuggcuaggaaaagaagaaaaagauacuaagucuuggucuaugaaugaucaggaaaagauuugucuuccuucugccuguaguuggacauuaguucaacgucuauagugaguuacacaacuaauuauuugugauauugccuuguacccuugugcauuuggcuguugcauccuucuuaauaaaacuuauguugaaaguuguguaaaucucagaauuuacuucacugucuuuccauucucagucucucaccauacaaucccuggguauuugguuacagcaguuucucuaagaucucaccauaguuucuggcuaucuauguaucaacuuucauauccagucauuugcauuucagugaagaauggaaagauggaaggaauuuaauauguuuuguuaaguauagaguagccucuaaaagcuugcaauuuaaguuuucuuaguucuucugagauuggauacauauagauacauauuacgcaggaugaaauagaggagcuaaacuugaauuccagaaaaauucaggaaaugcuuguggaacaaauuugucucaaaaauugcacagaagagacucauaguaaguuugcuuauaugaaugaaaguuaaguuaauaugguacacuuggcuuugcugucuggaggagcaucuuggagugaggugaaguuuaccacggccuuccacuccauuauuauugcugucauuuuaacauccuuuaguuucuaaaagagaaaguguuguuuauuuguuaagacauucacuuuuuacuuuuauauugccagaagucaccaaguuuauuagccacuucaaaaccauguguuuucuuuuuuuuauuagauauuuucuuuacuuacauuuaaguguuauccccuuuccuaguuuccccacagaaaauccccucuccccucucccuucccacugcuccccaacucacucacucccauucccugccagugccuggcaaauacagaaguagaggcucacagucauccauuggacggagcauaagguccccauugaaggagcuagagaaaguacccagggagcugagggagucugaagccccauaggaggaacaucaauauaaacuaaccaguacccccagagcuccuuguaacuauaccaucaaucauagaaaacacaugguggaacuuguggcucuagcuguguauguugcagaggauggccuagucggucaucaaugggaggagaggcccuugauccugugaaggcucuaugcaccaugaguuuucuauuuuauugaauaaacauuaauuugaaggucaauaaguaagcuuuuaaugagucaaaauauuccauacucugaaacauaauuacauacauauauauauauauuauauauauauguacauaauuacauauguauauauauauauauauauauguauauauauauauauauauauauauauauauauauauauguacauaggaaggaaaaaauguuuugucucuaaaugauagugugaaauuucacauguauuuuuaugaugaguuuaauccauucaaggauguaacaaauuuuagcuauaaaauaguauuggaaaucuucuauuuccuucuguguuucaauccagcuuuaauugugcaguuucugauuggacuucaaauguccagguuuacccugaaaagaaacaagcgcuuaguagcuucaggcacuuagacugauaauggcaaacuccaaaaucaccuuuacaccacaauaccacuguuuuaccucaguuaacauuuucuuuuccauuccuuuagggagaagcagguccuacuggagcccgaggcccugaagguccucaggggcagagaggugaaacugggccaccugguccagcuggcucucagggucuuccuguaagugccugacauaucuaggagcuagcccagaaagaugcuuauuuauuacaauaugagaaaaauguagcuuauuuaauauaaccaauucugaguuauuaacgcucaggaaaagaauguuuuacaugucaauacagccugcuuuuucuaucuuauggaaagguuacucacaaaaguacuguuacaguuauguagucauauaaaaauuuuacauacauacauacauacauacauauauauauauauauauguauauauguguauauacauauauauauauguguguguguguguguguguguguguguguguguaaaauaaaaaugcuaucuuugcaauuuuccugccucuucuuaggugaucugaauacuagauguuucagauguagcuuaauauuucaaaauauguuucauguauguuuuagggugcaguggggacugaugguacaccuggcgccaaaggccccacaguaaguaccagaacuuaugucaggugauuuucaaagggauguaguucuuggccuuagauuucuagugagaucuaugcucaucggcucaucuugucauccuugucauugguagggcucugcaggaaccucuggcccuccuggcuuggcagggcccccugggucuccuggcccucaaggcaguacuggaccucagggaauccgaggacaaucgguaauaucuguuaaauuauggcuuaaauauucucaaauuuuaguguaauugcaucauuuuuaccacuuccccuuccccuuuccuuccuccaaguccuccuguauacccuucuuguucuauuuaaaauuuauggucuccuuuucuguuaauauuguuacauaaauauauauguaugugcaugcugggcuugaggaccaugcuucuaauccuagagcuugggagguggggacaggcacacaggugcccauucacuuccacacaaguccucuuacuccacauccacaugcacacaugcacaaauuuauugcauuuuauuuuaauacuaauucaguauagauucagcagccuacucacuguacuuaauuagaccaggaagaacuggcuaaauuccucgcuucuuuuaacugaugguauuuucuuuuagggugauccaggaguuccagguuucaaaggagaagcugguccaaagggagaaccaguaagccuuaauuauuuuaaugauaaaaauauaaauauugucuagaggaauauugcuuaaaauuuuuauguauuuaaaaagagcucugggauaaaauaauuaacacucuaaauuguuuccugacaucauuagaugaguucccugacuuuuccuuccugaaugacucuuucugagaccuguccuucuguuuuaauaggggccacaugguauucagggucccauugguccaccuggugaagaaggcaaaagagguccucggggugauccaggcacaguugguccuccaggaccaaugggagaaaggguaaacgugaacaauacaaauccuguuugucuccucucuuguacauguguuuuggguaguaguaugacugaaauugcaaguagaaaggaaagaugaagcaagagaugacacagaugccuugcaggguguaguguguuuaucucaauguaaaaagagccaagugucuacguaagguucacucacugauucagcaaauguugacugcugauuaguguaagccagcuugagcuuuaagugcuuggcauacaucagggaacaaggaacuugugguccugaucuucauguggguugugaacaguaaacagugaaacacauuuuaguuagugcccuguacaguauuaacuaacuggugacaguggagaguggggaugggugggaccaaugauaaauuguagauuaguaggagacaugggaguaugagaagauagcagguagguugagucugcaggaaaagaagccugcugggaaacauggcagauagaacaauuuucaucagagagggcaagagagaauuugacaguuuuaaagagucggaaagggugggauaggugggguauaagaaaauggacaugaaggaauaaugcugauuucauguuuuuauagucuuagugaaagccacagucuucuacaagauggaagaacacaucgcuggcacuuugaucacaguacacugugacugugcuucuugucucucuauauuagacuuuuauugauuuauuuuaaaauuaauuuuagaggauuucuuuuaaaagauuugguucacuacucauguuugucaaacguuuaaguaauuuuucuaguaagauuauuuucuuuguguuuaccuuuugcuguguuaacuugaucagagcucugaaaaccugauaauaccagaaauaaaacuuuuuacuagguacaugucccagugauaaacaacaucucaaaacugcauuuugguccauuguagggcgcuccuggcaaucgugguuuuccagggucugaugguuuaccuggaccaaagguaagaucacaccaaagcugacauuuccagauuggggauuugucccuagcccauauauuuuucuccuuuuuuagcauuaggaaguccuggaagauaagugauaauuugaauaauaugagauaucgcuuccagacuuuuccauuucacuccugagaacaaaaaguugucaugcuuuaguuuagauaaaauuuaaaaucuaaaauuuguuccuuauuggagugaggcugaaauuucaaauguuuucuuuccuuaauggugaauaagacaauuuucauacagaauacagguuagaacaaaauauucagugacauuguuuucaaauacaucuuugguauguauuuggaaaauaagaacuuaaccucuuuuugcuuuguuucaauuuugcccuaucugucuuuuuuggagcagggugcucagggagagcgugguccuguagguucuucggggccuaaaggaggccagggagauccaggacguccaggagaaccugggcuuccaggugcucggguaagaagccuaugguuauaugcuauggugacacccaagugcuuccacaguuagaauuguuucauuuccuauuuuuauauuuaguuuguuuuacaacaugaaacuuugauuuaauaguuaugaauggaugcauuauuuuuaaaaugccacuaugcuauuuuugacauuuaaguaaaauguaauaauuuguaaaagacauuuuucaaaggaguauauacaaauaauguugccacuuguuaucagaacauaaucuauuuguaaauuuuuauacuuuuaaauuucauacuaaaauuaacauauuugaucuuugguaaagaaaauucuuauuuaauugaacaaaaugccauuuaaauuuuuauuugaacugugaaauugcccuucuguuuaguuguuuccaauagaauauuguuuuuucuguuuaaagucuuuacuucaauugcuguucaucaacaaauuaacaguugauuuucauugucagggucugacaggaaauccugguguucaagguccugaaggaaaacuugggccuuugguaagaaauuuaaauaauuuuaucacuuugaacauuuucccauagauguguaagucauauuuaguuauccuauggaugauggucaugauuacauguuuuaaguacccacuaguaagaauuucuuaguaucuuuggauuuucaaauugaacaaaauguaaguuaaauucucuugguugaauguuugaaauugagauuacuacagugaaaacguugaaguaauauauuuaaauacuguuaaaauauguuuaauaauauucucuuucccugauuguguuccacuuuuacauguuuagaaauaaauauguugucagcuuauguauuugaaucuuuuuuaaaaauauaguugugaaaugggcauuuuuaaugcuuaagauuauaaaacagaguaaauaaaagcaggaaaggccugcccuuuaauaugagagggcuaguagauggcgacaaugagacuuaugaauggaccaaauuagaacuucuuuucuaaaugcucaaaguacuucagggcuuuguaggaaaauaacaguuagcuuuucucauucacuaagagauaaacauaaggagauuaauguuuauuuaagugacuucuauuguuaggagagacuagccuggccacaauguggguagaguggugcuuagaaauaggucacacucaacuuucuugccugcugucaaaccugcagggugcuccuggggaagauggucggccagguccuccaggcuccauugggaucagaggacagccuggaagcaugggccuuccaggccccaaagguagcagugugaguacaaugaacaacguuuaacagcccaauguaaucagcuguuggaaaccaaaguauauuucuuaaauuaaaugaauuuagaauacuguuuauuuauucuuuagggugaccuuggaaaaccaggagaagcaggaaaugcuggugugccugggcaaaggguaggcauucauuuucugguauugaauaaaaaggauauaaaaucauacaaaaaucugauggccucaccuaaaauguccaugugauccuagggggcuccuggcaaagauggagaaguugguccuucaggcccugugggaccuccgguaugugacuuucuuugaugauauuguucauuuguauuucucauuguuucuccaaaauuacuaguuaaguaauuacugauuaauuacuaaguuucagggaaguggaaugaggaaaaaagagacugaaagucaauuucaguuuuauuuuauuuuauuuuauuuuauuuuauuuuucuaaaguacuguacucuccuuuuugaauaaaaagacugaucuaauuuuaaacuguaaagugguauguagugacaaaggcugcccuaaguucuuuguauaucauaguugaagaaaaauauaacaauuaagaaaaagaguguuugagauauuuauaauguauuuuuuaaaauguauaaaugcagcuuauaccuacauuuugauaauuuaucuuauaaaaauuauuuaagaugccugcuuuugaaaagguaaaaaaaauaauguucaucuuuugauguuacauuuuuauucucagauuuuuaaaaacuguuuaucaaagauauuuucacauacuuagcuuuugugggaucaauuuaauuagccuaucaaauguuaacauugcuuucuugaaucauucuauuuugaaauuaugaaugaauuaugaugaauagaaauaaacauuaauauaaauacaaccuuuuaaauuggauauaggaaauaauacguuuccaauauuucaucuaugguuggcucuaggccuuuuauguuugaacuaaaaccaccaucaccaccaccaacaaaaacaucaucaacaacaaaaucaacaagaaaccaugcuguaauuucuucacuggcuuuuuaaaugaaaauuucucauuuucaagaaguucacuuaauggcauuuggugauuuuuaauacuauuuuauuaucuggcuaauauguaaagugggugguuguaaaaaaugcaaaaugaugaguacacccauuucauggaaacaggaagcagacauaaaugacuggugggauucaugcuuuucuuucuuuuacuuagggccuagcuggggaaagaggagagcagggaccuccaggccccacuggcuuucagguaugcacuaauuuaaguuuucacuuauuuuaugaauugcuuuuaaaaguauuuuuuuguuguuguuguuuuuaauaauacagggaguagccaguugucaaugcucacaccuacacuucuaccaguugggagacugaguugggggugggagcugacucugaauauacagcuagccugugcuaccuauuaaauuccaggcagggcauaucuaugaggagguauguauacaugcacaugauagaauguuagaaugaggcaagguucuuuaauuuucaaaacagacaucguuauuagauaguauagaugguuguauuuaaccaaacauuauuguucaaagauaaggaauguccugucucuaaaaaccaaaccaaaccaaaccaaaccaaaccaaaccaaaccaaaccaaaccaaacccaaaccaaaccaaaccaaaccaaaccaaaccaaaccaaaccaaaccaaaaccacacaaaacaaaacaaaacaccauuucaaacacaaacugguaagaaauucacaauaugagcuggagagauggcucagcuguuaagagcacugacugcucuuccagagguccugaguucaauucccaagaaccauguaguagcucacaaccaucuguaaugggaucugauggcccuuucuggugugucugaagacagcuauaguguacgcauauacauuaauuaauuaauuaguuaauuaauuaauuaauuaaaaaagaaauguacaauauaaaauguaaaauauaaaaugcuuaucugguuuuacugguauauucacuaaaacuucuuguugaauaaaugaucacagaaugcuuccauauaguauauauuauuuaaaggcauaaaauuuaguuuauggaaaccucaggccuuuuuaaauaauaaucuagcauguuuaaacaugugcuagagccauaacagacucuauugaacaugaagaaccuauuauauucuuaucuuaauuuuaagugauauagaugaauaagaaucuugcuuuaaaaauugacaaucuccugugauuuauaauagauugcuuucuuaaaauacuuggacaauauuuuccauaauuuuugauuaaaaugucuaugcacuuucuucugcaugaaaaaauaaugaaguauaaauguaaaguauuugguauugguagcugauuuaaacuuccaguaaaucacuaguuuuacuugucauuauuguuuuagggacuuccuggaccuccagggccaccuggagaagguggaaaggcuggugaucaaguaaguuuuuaaauaauaauaucagaaguauaaauugauggacuacaauaucaucuuuuaagagugaagcuauauguuuuucuguuaagcaauuaaagaacucagauauuaagcaacuuucucaaagucacucagcucauaccaucugaaccugacacacaugcuuccuauguucauaacucuuacuuccuauauucaccacucacuugcaugcuucauguguuuacaacucacacgguuucuguguucauaacucacaugcuucauauguuuacacaucccaugcuuccuauguuauguaucuuaugcuauacaguuuuacuaaaugauucacagucugaaauugauauaaaaauuuugcugguagagcuuugcucuuuuaucuuugauugauuaauauauuuauuaccauuccuuaaacauuugcucaacauucuaugugcuuggcuuuguuaugcaauggaccuccucugccaagcaaacuggucauggguuaugugguucuguauuuacaaaaauaggagagaggggaggcgggcucagagauagagacagagaggauagaggaaaacaguauaauacaugcaugauccaaaugguacagccgggaagguacuauaugcguagaaaucaugguaaaggaagacuuuucagaaguaguaauguauauaaggucuaaaaggauauagauuaccaaguugaaaaaaaugcuucagaaaauggcaauggcaagugcaaaugcuugcugagcauuucuaaggcacugugaaaauacaguguuggaaguguggagcaccgucuaaaguaguagagaugaggcuggaggugugaauuagggaccagauuggagggaauccuaaaucgggcuucauuuguugauucuuagagcagagaaaaacuggcagaauucauuuaagcagggauuucugccgccagauuuggguuuaggaucuaucauguuauaaugagaaugauuuacgucugaagaaaagucugggagaagacuugauaaauuuaucauuuuaaaaauucuuuucucacaauccacuccuccauuuccauuuuagacaagagcaggucuccuagugaucucaacaaaucaugguauacuaagcuacaaaacuaggcacaaacccucauaucaaggcuggauaaggcaaccugguaggaggaaagggucccaagacagggaagaaucagagacacugccacuccuacagugaggagucccacauuaacaccaagcuuauagccacagcaugugggcagagggccuagcacagaccugugcaggauucuuguuuuccacuucaaucucuuugaacuccuaugagcccugcuuaguugauucugugagccauguuucugacguccuugaucccucugauuccuacaauccuugaucccuuucuuccaaugagguucuucaaguuuacuuauucuuuaaauuuuauuuuauguauuuuauucgcuauuuucuuuauuuagauuucaaauauuauccccuuuccugauuuccccuccacaaaaccccuaccucauccccccuccccuguucaccaacccauucauucccacuuccccuacacuggggaaucaagccuucucaggaccaagggccucuccucccauugauguucaacaaggucauccucugcuacauaugcagcuagagccaugggucccuccauguguucucuuugguuggugauuuagucccugggagcucugggguuacugguugauucauauuguuguuccuucuauggggcugcaagcaccuucaucuccuucaauccuuucucuagcuccuccauugggggaccuugugcucagucuaaugguuggcugagagcauucacaucuguauuuaucagguacugucugagccucucaggagauagcuauaucaggcuucugucagcaaggacuuguuggcauccacaauagugucuggguuugguacuaguauauaggauggauccccagguggggcagucucuggauggucuuuccuucagucucugcuccacacuuugucauuguaucuccuuccauggguauuuuguucccccuucuaagaaggacuagaguauccauacuuuugccuuucuucuucuugagccucauuuggucugugaauugugucuuggauauucugaguuucugggcuaauauccacuuaucagugggugcuuaccauguguguacuuugugauuggguuaccucacucaggaugauauuuucuagucccaucuauuugccuaagaauuucauuaauucauuguuuuuaauaguggaaaaguacuccauuguguaaauguacaacauuuucugcauccauuccucuguugaggguucuuuacagcugucaaugcaauccuuaucagcauuccaacucaacucuucauagaguuagaaagaccaauucucaaauucaucuggaauaacaaaacaaaaacaaaaacaaaaacaaaacaacaacaacaacaacaaaaaccucaggauagugaaaacuauucuaaacaaucagcauccuggaccucaagcuguacuacagagcaauagugauaaaaacugcaugguauugguacagugacaggcagguagaucgauggaauagaauugaagacccagaaaugaauucacacaccuauggucacuugaucuuugacaaaggagcuaaaaccauccaguggaaagcauuuucaacaaauggugcugacucaacuggcauguagcaugcagacgaaugcaaauugaugcauucuugucuccuuguucaaagaucaaguccaacuggaucaaggaccuccacauaaaaccagauucucugaaacuaauagaaaaaaaaaaguggagaagagccuugagcacaugggcucaggggaaauuuuccugaacagagcaccaauaacuuuugcucuaagaccaagaauugacaaaugggacugcauaaaauuacaaugcuucuguaagguaaaggauacugucaauaggacaaaauggcaaucaacagguugagaaaagauuuuuaccaauccuacauccgauagagggcuaguguccaauauauacaaagaacuuaaggaguuagacuccagagaaccauguaacccuauuaaaaaugggguacagagcuaaacagagaauucucaacugaggaauaugaaauggcugauaagcaccuaaagaaauguucaacguccuuugucaucauggaaaugcaaaucaaaacaacacugagauuccaccucauaccagucagaauggcuaagaucaaaaacucaggugacagcagaugcuggcaaggauguggagaaagagaaacacucauccacuccugguacuauugcaagcugguacaaccaaucuggaaaucaguuuugcaguuccucagaaaacuggacauaguccuaccugaggacuaaguuauaccacuucugggcauauacucagaagaugcuccaacauguaauaaggacacaugcuccacuauguucauagcagccuuauuuauaauagccagaagcuggaaagaauccagauguuucuccaagauuauuaaaagaaguuuugaggggcuggugagauggcucaguggguaagagcacccgacugcucuuccgaaggucaggaguucaaaucccagcaaccacaugguggcucacaaccauccguaacaagaucugacucccucuucuggagugucugaagacagcuacaguguacuuacauauaauaaauaaauaaaucuuuaaaaaaaaaaguuuugaaauggcaauaccauuauuuugauccuacaauuccuaguggaauauuuuguauauauccuaguuggauauauauaccaauauaucauuuggaauauaugaauaaauuguguucauuuggaauauauguuccagacaugauuuauuuacuaaauuuaauauaacugaaauugauaaguugaaauggcugguucuuaguucuuuuguauguuauucucuuacuauuuaaauacuuucugauaaauuguuuuaaaaaagacacuauaacuguucuauuguccccaaaacauaauauucuauuuuugcaugagaauauccuacacauucucauugcucccaaaaauuaaacauuuaggcauaauauaaauuauugcagaaaauaugauauuucuacacugauaucccucaauuacacuaguauacauauuuuuaauccuuuaauguuuauuuuaaugguacacuacagaaaauguaauguuugauuuggaaauauuuccaauaauacaagaucuagaucaauguuuauauucuccuuuuuugaaaccuguuuaggguguuccuggagagccuggagcaguuggcccauuaggaccucggguagguauuuucuuuuaugugauucauuuuguuuucuacucgguacagaauaagaucaaaccuuuucucuuaaggcaugcuagauuuuaaguauuaaguuauucuacuauuugaaaaaaauaccuuaucuugugaauauagaguaucuuuaauuccaguuaauuuuguagcacuaaauuaggaaaccugcucuauuaauaagauucuaccaguagaaaacauuuuguagaaacauuuuaacuuauuuuagauuaauauugagaugauuucacauccugaugacauuguagggagaaagagggaauccuggagaaagaggagagccagggauaacuggacugccuggggagaaaggcauggcuggaggacauggcccugaugguccaaaggugagugcaguccugauuugggcuuuugaaaacucuagaacuuaacaaaugcuucuggagacauccuaucuugacuuuucaguauaaccugauuaaauuauuucuuaaaaaaauucaguugggugcauguugggcuuuuucuggcaacuagugagugaucuuucuguugugggaaacaacaucugucugggcacaugaccauuguucacauacacuccucucccccacauacacacacucugauacuuguacauuucuuugguaaccucugugaaugaacagagcagggaauggaaaaaucacacuuuacuagcaguucuaacaaacuaugugauccauccauguccuuugccuugccuccacaauuacaguuacugacuaucugaaaugagaggacaugccuaugugcuuuaaugugccauuuuaggauugauagaugacaauguaaucagauugaggaacugaaaugaaauucugcauuugacuaagaugucuuuaacuugaucaagauccacagugauagagcaaagacgaucucaaguugauugugcaauuaacuuggaaccagcuuaaucucacaauuuucccaaggaaauaaugaaauccuucuuuuuucuaaauacaguacuaauaugucugucaugcccaacaaaguggaaagcacucaagccauuguacuuuaaaagauauuuauuuuucuguuuauuugaauuaguauuuaauuuucuauaaagagaggauggguaugcauuauaaaacucacaugagaaacaugcgaggauggaagggauguugacuucgggagggcacaugugacauaaaaguugaaaagaaaccauuggaguugguauagugcgagaagugccaaagggguuugagggcaugaggaggaccaucaaaaacaaaauuauguucaaauuuccacagugaauccuaauaaguuauaugcuaauugcaaauaaaauucaaaguauuaaagagcaguuaaguuagaaaaaagaacaauagagagguucacaugaacaaaaaagagaaguuggaaguauaaaccaaaaacaaaauguaaaucuagguuguuuucaagagaucccacucagacaguuucccuaauacacaaucugaacauuaaucuaaccuccaucuaauugcuaacauucaauuuagagugacucaaauagcaacuucacgggcuuuaauuuaacauucuaauauugucucauuauuuauuuuagggcaacccagguccaacugggaccauuggagacacagggccaccaggucuucagggcaugccaggagaaagaggaauugcaggaacaccuggcccuaagggugaccgaguaaguccugucuuuuauuaacuaaguuuuccagugaaugucuuuagacuaugauaaugauuuccuuaacagcuucuuauuucuaucaaccugaauuauaaguaauuauuuucuuauaaucuacuuuauugguugagaaaaugcauagccagcagcuguuguagucuguaguggguaaagcuaugaaggggacaaguaauaccuuguccuuaugaagcugcagcuggaguauugaaagcacacguaaaugaacaacugguucuuuguuauuuuguauuuucccaggguggcauaggagagaaaggugcugaaggaacagcaggaaaugacggggcaaggguaagagaaaggggaaaggguauuuucuaccaugggcuacgauccuacauuucugcucauuacccuacaaacuugcuguaaguuuuaacaacaauguuauucaugcugucuuauagucaaggcuacuagaaugaugcaauuugagacuggauguagauugacaguggcuacuuauuuuacuuaucuuccauuagauccguagaaaaauguaaaguccuuccugaaggaaugaaaggaaacacacagugcucucccuguaucuauggcacuuagggaauuauguauaauagaucagggcaaauacaaugauuguucuguuuguaguaagugcaauacauugucauuuucuauaaggaaaaaaguaacaacaugccuucuuuguuuuaagaacaccaccccuguacuaauagggaacuuacauuuucuauccauauaaacaacaaagugauuuuacacagcuuagaaaaauuaugagaaaaauauguuuuccauuauauauuuggagaaaaaacuuuuuuucuuaagaacauacaauuaauaagucaauuuuauucuuuauguuuucuuucaaauguaugcauauauacauauacauuuauaacuuuaaugacaaaauaauauugagauaccuaugaagaagaaacagaaaacugacagagaacuuguucauaaagaacugccaacaauccauuugaauguugcgauuaugugcugugaagcuccaggcccugccccagguguuagcucacguuaugaacagcaccaacagcaaugaaccuugacugcaaaugucuauuucaugaacacugaagacguguuuaguguaauugaauuuuaaauaaaagaauuacacuuuguaauaauauuaaaauuugaaaauauugcaaagguaauucuaauuuucaauuuauacccagcauucaaacuagagacuaacaaaacuaaacagauuauagaagcaaggguauauuaacaaaaugcugcuaauuuagacuuaauuugaagacaguuucauauacugagaagagguuuuuuuuuuuuuuuugaaagaggucaaaauauuuuguagagaaaaaucucauugcuagaauaugcaugacauggcaaaaguccugaaaguauagaggggaugucaucuaugauagauaaugacauaauugcuugcaaaagcaaucgugcuauaaaaaaauagcuguuuuguuuucuuauuuaauuaaacaugaacauuucuguacauacuuuuccucaucauacuuauguucuuuuaauuaacagggucuuccaggucccuugggaccuccagguccugcaggcccuacuggagaaaagguaaguuagaagguaucagugugcacaccaaaauaacaaggccuaaauuguugcuguuucucaagacugugguugagguagaccauuuuagagcuugccucacacugucuaccuucagaugugccuaguagucuccaauuguauuuuggauuagguacuuagcuauguaaaaucuacuuuguagggugaaccugguccuagaggcuuaguuggcccuccuggcucccguggcaauccuguaagugaaaaccuuuuuuuguuuuuuauugugagguagaacaccaaaaagauuuaucucuuauugaucuaucuaucaucuauuuaucaucuaucuaucuaucuaucuaucuauccaucuauucaucuaucuaucaccuaccacuuauugauuugucuauguuuauccaucuucuauuaccuaccaaucauuaaucacugucugucuaaacucuagugucauuuuuacaaauugauuuucaaauuuauuuaacuuaaagaauuguaagccucgaaaucuaucaaaucaagacaauuaacuuguuuuccaaguaacugggaaguuucuuugaccuccaacuuauaacuucacuuaagguucuuccucaagcaauguaguugauuucucuauccacaauuaccuauauaaaauguauauuauaugugugaaagcuucaauagaacuugucuccuuuuaggguucucguggugaaaaugguccaacuggagcuguugguuuugcuggaccccagguaaaauuuccaaguauuucuaacuuacaaaucaauacccuucauaguagaguaauaaguuuaaguauuauucaaauauguuuuguuauauauuaacauuuucaaaguuuaaaauauuuuguguauuauucaacaaauuuuaacagguggaacaaaaguugguacuuuuaauauuuuaauuuauguaguuauauuuaugaugaaaauugcugacauaguuugaggauguuucagagaaguuauugcauuuuuucauaccaugcauacacuaauuccacagcaauauucuauaugacuaaauauuauguuauuaguaauuacuaugaaauaauuuguuauaaaucuuaaauauguuuucucacuugcuuuuagggucccgauggacagccuggugucaagggugagccuggagagccaggacagaagggagaugcugggucuccuggaccccaagggcuagcaggaucaccuggcccccaugugaguuaucaaaaauuaaaaaggacauguugauaccagagcacaguauuuaugaugcacagcucaugcauuuggcuuacacuaguggucuuuuguucuucuauuuaggguccacaugguguuccuggacugaaaggcgguagaggaacccaggguccaccugugagucuuuuuuuuuuuuuuuucugggaauugugcacagccaguugcaaauaucuagugugcuccaguuauguaaauguuaacugucauccaaugacauaauaaaauguuauuauauacauaucaacuguauuauagagcaaagugugcuuagcuuaagcuggagaucugggggaaaggaucuuggagaaaaaucaguuuuguuaaucuugaaaacucaagugcuuucuuuauauggagcacaaguauauacuuacuauauauugaaguauaaacacuuuauguaguugauuauacaaaacaccugugugguuuuagcucuacuuuuauauguuuaaaauaaauaaagcuguaacagaaaagcaauguaccucuaccagcuaauccagauucucuagaacauuuaaggcaugagaagaauaaaaaucuucauggucuaaauaaggaauggaauccacagacccacagccucccaugugaaauguaggcuugagcaaaguggagaacuaaccaauguaucuguuguucccagggugcuacaggguuuccugguucugcuggcagaguugggccuccaggcccugcuguaagucuacuuagaucuacaccauuguacauacuugcauguucacccacacacaugugauauguuaauuauuguuuugauuuagucuuucauaacuuuuucucuuugcuaacucuucuggcaaacauaguauaguuuaaucaacacaaauugaaacuuacaaacuaauuaacuuggaggagauuauuugcagguuuuucuaauccaaugucuggcuguucuuccauuugaguacuaaauaccguuuugugugcugauaauaaaucucagaaagcaucucgagacgcuuugaaacuuucuuuaugaaagcaggaaucauaaauauauguguauaucugacugugccugcauauguuuauguaccaagugugcagaagcuuguggaggccagaaacagugcuuaauucucagggacuagaguuaccagcaguugugacuaucacauagguauuagguaucaaaucuaugucaucugcaagagucauaagggcuuuuaacagcuucaccaucauccccugaaaguuucuauaguaaauccuaucauaagcccaguucaaaccuguuaaaaugaaguaacauucuaaucuauaguuagaacagagccuuuaguagguuugaaaauuaauuucagaacuuuuaauaaugagugaucaaaguggucaucugaaaaaaaauggaauuuagggcuuucucaggguauuaauguucagcuaugcuuuguuucuuuugcuuuacuuaaguauccucaugagcaauuaucgaagaagauaagaaacacuccugugagguacugcucucugugcccgagggcaagccuucugaguccauacuuacuugguuucuacuuugcccuccucauugcuuuuuucuguaugauaccagggagcuccaggaccugcagggcccgcaggagaaccugggaaggaaggaccuccuggucuucguggugacccuggcucucaugggcgagugggagauagaggaccagcuggcccaccugguagcccaggagauaaaggggacccaggagaagauggacaaccuguaagugggcaucuguuucacuccaacugaaauauuuauaagaagaaacuuguaauaauaccugcuauaaaacuuaccaaaauauuauucucgaaauauuccuaaaugauuucaucuaaguuuaaauuuuuaauucucugguauaaaaguauaugugcaaaaguacaaaaugguaaaggacaugguuuucuaaaacuaaaccuuuguugaauguuuucuaugugaagacuaaauauuaacauuguuuagaaguguaauccuuuaaauuuucucuuuguucuuuuaaaaggaaaauauugaguuuuuggaauagcucucucuuuuuauuuuuauuagcuagcaaguucuucuccaaguguugaauaaugucacaggcuauguuaaaacugaaaguguucacauucaugcuuggaugaaacgagagguuuuguguggcuguuuuuguuuuuuuucucaugccuccccagauucuauaaggccugaguuaacuauauaguuucuguagguauggauucauccuuuacaguaguaacuaucaucucuuaccacuaggguccagaugguccuccuggucccgcugguaccacugggcaaagaggaauuguuggaaugcccggacaacguggggaacgaggaaugccuggccuuccuggcccagcgguaaguagcuguuuuggucaauguucaucugauauguuauauauauauauauauauauauauauauugcagaaaauauugguuuguuuuacuuaauaaauagguucagucagucuuaagcugacauuaauucuuagcuuuuaaaaaccuuucagucuuaaauguuaaguguuuaacaaacuuuacaaucauaucugcuuaacuaugggucaagagacuuagauaauaaaugcuuggauuuuuggugacucgguauuccuucaaagauaaaacugaugcuugcugcuagagacaugagauuaccuccuggugguuuggcagcaucuuuuaaaauaaauauccuuaaaaaaaaaaaaacagccauacuucacaguaaacaaccaaagaaaagacaugguugaguuaaagucacaucagaagugauugugggugaaguacaauccccuguucuuuuugagugcuugagggucucguauuauuuggaguauggaggaaaguuucacucuauaaaaacucuaaagcaacuagauuuuaccaguugccaaaguuugagggggaaauaguguuuuuauguggaacguggacucccaguaugugaaucuaguagaccauuggguagaaauaugaacaaauuaggaguucaaguuuaucuuagagauaucaaaauugagccaagaauuugaaaguaaaaguuuucaaugaugagucuaaaguacugaucacauuuuuuaaaaaaaugagcagaaaaagcaggaguaauaaagauauguauaucuuugaagugauacagauaacaaaagcauagccacaauugacuacauauguuucaaacacaaaaugcauaccuaaacaggcgauguaggaugauuuuggucucuuugauaugucaugagcaaugugauaagaaguaugaaugucuuuaagcaaucauguuguaggguacuggacaguuacauauauuggaggaaaaauugaagaacuacugaaugaaugggucuuauggaaacugguauucuuuugcaguguuuuaccuacuuguguuuuaauuucaggguacaccaggaaaaguaggaccaacuggugcgacaggagauaaaggucccccuggaccuguaggaccuccagguuccaaugguccuguaggagaaccugggccagaagugagugcuacaguccuuaacaaaaauaccuucauuuuagauguguaugaagguuauaguuauuucauuaucaaauugauguagauauuuagaaaugcauuguacacaugagcuuaagaaagaugucugucauucuguuugaugugcuugcuucccuagagauuugacuaagugauagagaaacaaauuuagugccuuucuacuggcuuuuagaauagcugaagugagcauuuugguugauuuagcuuuuggcaaauuguuuugagggugagaggacacagccauucaccuuuuuccuugcuauuauuucauucuguaaugggauauuuaugaaaauugccaaguuuuauggagauaggauuaaugacacuauuacagcucaugaagaagggaaaggaaguagaggguuauuuuuuuuuuaucacuguaaaguaacauuaugguugucauaucccuuuagucucuuuuuagaggaaauaaggcucuaacaggcaauuugggaagccaaagaauagaauacccucugcucaacagccagugauuuuaaagauacaugaaaacaugaaaguaaagucgggcaagauuugaaacauaaucuuauauaacaugaauauagucauauaguuucaaaaccuuaaaaauauuauuuggauaaacaaagugagaauucaggcaaaaugcaagauaguggcacuguaauugugaucuauuuccaugcaucucuggauuuuuucuuuaaugagaacuagaauuaaacaauaggaguaaauaagaauacaguaaauacauaaguggaugcuuacagucaucuauuggauggaacacaaugaaggagguagagaaaguaccugaggagcugaaggggucuccaggacuaugggagaaacaacaauaugagaaccaguacccccagaacucgugucucuaccugcauauguagcagaggauggccuaguuggccaucaaugggaggagaguccguuggucuugugaagauucuaugccccaguauaggggaaugccagggccaggaaguaggaguagguggguuggggagcagagggaggagggaggcuauaggggauuuucagagaggaaacuaggaaaggaaauagcauuugaaauguaaaugaagaaaacaucuaauaaaaaagggaaaaaaagaacaugguaauuuuacaaucaguugacaauaaaaaagagauuggaguguugacuguuauuuuauaguuuaaagaggagaaaacauguuggucaguuucuggucaacuggcugagaguuuaaaagccuccucaagaagcugugucuaacacuauucuuuuuaggguccggcugguaaugaugguaccccaggacgggauggugcuguuggagaacggguaaguugauuaaaacauuagaaccacauaagcaugaaaucauugugaaucuagcguaauagcaauuuuaauaaaaauacucucuaucuuuauaaccccagugcaacucugauuuuucugauggcaaacaguuuaguaaggucauaacuuuggauaaccuuguacaugaaauaaugucugaaugcaugacaaaguaugauacauguuuuucaaaagcaagaaaccaaauugcuuuuauauuugguguaacauagaagccuuggaugaagaugugaaucgauguucuaaauuucuguaucaguuacacaacugagugauagcuacauuuuucuacucauucucuaaagaaaguaacuuacaaggauauaagcaaugaugcacucuaaacuguaggugugguauuuauuuuuaaauuagcccuguguugagcugauaauuuuccaagguauaauagcagcugagucucuuuuggugauuacacagcuguuaauuaggaaacagaucuggccacuaaaggcaaaccagccucgugauguuaaauuuucugaaucuguuuccaaauacuuaaaugcaaguauuuauaggcuuaauuuuuuuucaggguaagcacacaaaaauguuaucaugcuauuaauagggagauggaaaaguuuggagaaaccugggcuaagacucuccuuaucuaacacagccauagaaauuuucugacaucuggaacauuugccuuugcugguguacucacguaacgcagcaaauauucaaaggucuugauguucacuaccagaaauauuacugcuguaccgugaacuccuacguggacuuuaaauugcuguuucaguuuaaucacaaacuuuaauauacauauggcacaggaaauucccuauaaauuacaauugcaugugugcuuuaaacaaguuacuuuucaaaaucuuuccuucaguuuauugucuguguguucuuuaacuuagaauccaguguucucucuaucugccaaauuaacaagccaaguuagaguuaauauccuucgcaaaauaacauuuggcucuguuuuuuugagucacuaauuguuuccaugcauacuccugccagucugagcuuaccugugcuuccauaucaagauguuauuugcagccccgucacaugggguugucugaguguaaugaggggaggccuauuuuccccuaauuauuccgagugacauaugcaaucugaagacaacuuuguuugcccccaguucguugccuuuugaggguauuauaccauaugaacauugcagcuagcaugguagcugcccuucuucuguaagguaggggaagaaugcuuuuaaaaaggguaguaaguuaacagcacucagaacaaguuuucugagagacucuguauggauuugaaaaauggaugaagugguuuccacugugaaauugcauuguguguuacaaaugggaauacuacucugaagacugcuagucuaggaaauuagacuaucaaauguucaguucuggagacaaacacuccuguccuccaacacucuggacauagggaccagcagaaaucgaggaugaauaaguucuaaagccaggguggaacaguccuaugccugugaauuaaauuuauucacuagugaauaaaaguaaauaauuaaguaaaauaauaaauaaauauguuuaaaaagauauauuuucauauuguaaauaauaugagcaauauugaauauuguuacucuuauagaauaauuauuuaaagaauaauauuauauuuuuugucagggugaccguggagaccccgggccugcuggucuaccaggcucucagggugccccuggaacuccuggcccuguuggugccccuggagaugcaggacaaagaggagagccaguaagaaugucaacuucacauugacaauuacaugacacugauauacuauccuguaacuauauguauaugcauucaguccugauuauauuauuagcugaggacucuaaauagugauagaaaauuaugaauuaaaauauauacuuaguuuuuaaacuaauuugcuuuugaauauggaugugauacugauauauuuucuuuaauuauuuaaacagguugugauuuauaggaacacaccaauauguguuuuauaaauucuauaggaauuuaucugaaucaauguaauuuacuagaacacuaaggugaacuuaauuuggucaaguuaauauuugaaguucacuguaauauguuacuagaguuaguguguucuuaccugaaguacaaacauuuggcaggugucaauguguacaugauauauauaucuauguuuauaucgagauguuccucuuagauuuauauuccuguguauauuuaugcuuuaagauaccaaguuuuaugaaaaauuuucuaggguucucgaggcccuguaggaccaccuggucgagcuggaaagcgugguuuaccuguaaguucuauguuuucugaacaaauaaauuuuucuuaugcaaaauacauaccaaaagggaaaguacacuuaagauucauaaauagcggggggggggguagcuguuaggaaauuacugaucucuaggaggcagagacucugugagaugguaguagcaauauagugugauggugcaguagcuagcagugagggauauuccagaaaguugaaagacagauuuugaaagauuuuauuacaaagcaauaauaugugaaacaguacaguuuaaguguguauuaaaaauuccaagagaauuaaguuugaaacugauauggggaaaaccgagggucuuugagagcaacagcagcuuucuugcuugagauaagcagaagcuagggguucuaaagaggauguguuccugggaaaucaaaggucuccaauccuuucccagccaguggcuuccaacuugguggguauugguuauccugagauacaaacacaccuguucagcccuacuuugcuucucaaugcagucucaguaguccuagcccaucaguuuauuugcauauguaaauuuaucauucuuacaggcagcauggaaaguaaaucuuacuuuaaguuuuaauuuuacagaaacuauuuuaaaauuauaauaaauacaaucauaaggaguagaauugcagcaaauuguagucuuaauguucaugauugucuauucccagggaccacaaggaccucgaggugacaagggugacaauggagacagaggugaccgaggucagaaaggccacagaggguucacuggccugcagggucuuccuggaccuccuguaaguuauuucuuaaauacuguacuuucuugcauaugagaauacauugauauauugacagaaacaucuauggauuagagagguguuuuuguauaucauuuuaacuuuaaaauuaucuugauggauaaucauauaguuagcuaacuauaacuacccauauauaaccuaaaacauuguggaaaagaaauuaugcaaaaagcuacaugccucuuuaccuacacagcugucuuuggucuuagucagauguuaaagaaaucaaugguuuuguuuauagugcuaguauuagugacaucaugcuuuuaaagauaaaaguacagcacaauacagauuuagauguuuuagcaacacuuucauuaaucuuccucuguaggguccaaauggugaacaaggaagugcuggcauuccugguccuuucgguccaagaguaaguaacagaaacuauuaaguuucagaugugcaugacauacuguuccuugaguacaauauuucugguauuucauauuuauucguucauguucucucaguuuggcagaaaauuuaugagucaaacuuagcaaguaauaugaaauagaaauauccugauguauggcauauuuuguuucucaaagucuauuaccuagguuuuauaugugcuucuauucaauuucauauuugugguuuaauuuucacuaaacauaaauucuuugagguuauuggaacugcuuaugaaguagaauagauuuugaaagauagacauuuauuucuuuaauugugauaaagccauagaagcuuauucaaagauaauuuggaaacaaaucauaguagagaaccaauacuugaggcuuuuagaaauuguaaauucauauaaaugcugcuucuuauaaaucauugguguccuaagacuauucagaaaaauauuuagaaaaauaaaaagugagaaagauuaguuacaaaucugcuauauuuaaguacaauguaaauauacauaaagugagaauaauauuaaggaaagugcuaugauuugaugagguuaagugauauauaaguacugguuucaaccauaauaaacacucaacuuacaucauuuccuuuuaaaucaauugaauuuucaaccagguuaacuauuugaugaaacaguugcuacuaaugaaaguuggugaccagccuguuagcauuuuaaaguuauuuugguccuucacccagaauuagugauggacaguucacacacagugaaauuguaaauauaacagaaugcugaaagaugacuuauuaguuauuaagacuagaaucuuagcaaucaggguaauuacuccaucucuauaaugguucuuuuguuagaaagaaauuuugcagucuuucuucuaaaauacauuuuuguguucugacaggguccuccaggaccaguagguccuucaggaaaggaaggaaacccugggccacuuggaccaauuggaccuccuggugugcggggcaguguaggagaagcaggaccagagguaaggucaaaagaguuugcauggaagaugcuguugccaaaauggagucaauccaauggcaacuguggaaccuugccaacaagaguuucaagagacucuuaagccuagaaaccacaacaagguuaucuacuuaaguaauuauuucaagucuuuuaauacaugguauucagagcauauaaaaauaagaguucaagauaccaagcccuugaaccuauauuauaucgagguuaaauaucaaacuauaauuccauucuuaucaaaguuugacaaacauugcauugugugaaauuacaauaaucuuaguuugcuuuccuguuaaaaacucugacaaaaucaaguuaagaaaggguuuauuuacaucauaguucaugauacaguccugcauggcagggaugucaaggcagcaggagcuugaaacaaaaugaagcauaugaguuugaaauuuuucuuccccaaagaugacauuuaagauuuuaauuuucaguguucaauuaaaaaucuaauuguauuuaguauaauuucaaacacuaaaccauguuaguuagucucuguccucagacauucggcgucuaucuacacacagacccacucuguacauuuaaagguugucugaugcuucuuugaucuuauuuaucugaccuuacugucuuaaucuuuguuccuacagugacagugccauugaauaguugaauguuuauuauuuauuacguggcuauagaggcucauucuucuuauagucaagaaaguuucacaguuuuagaacuucuauuugacuugggugguaauugauuuacuuucuuauggcucagugcucuuccucucagauuacuguaggaugugugaaauucggaggaucucccagaaaaaucaauuuucuaucuauccaucuaucuaucaucugucuuucucccugaaaucaguguuuugaggauaagaaagcacagagguugaaacgccuucccugaagccucaguugaguugcagagcuaauauuauuaacauaucagccucugacaccaagggcuuugcauuuuaccugaacugugucucuuuaguuguuacuuggcuucuuugagacucuugagagcuuccucuggaaaugcagaggaauuaauggagagcacucagcuuguaaucuuuuccacuuuuuggggguuugauuugaguggucacauuucaucaguucuccccugaaaacagaagaacaggauacacuuuuaaggcuaugaaaaggauaaugaaaaacuuucuuugaauuuguucaguacagagaauuuuuacauuugucaaaauucacauacauacaaaaaacuuccuauuuuuuuuucuugauuuggacaaaccaacaaguucacuaacgggagucuugcguucauuacccuaauauuugcaugcagacauacagaaacagcucucacacacuagcauccuuuuucugccuucugcccauagcucugguaaagaauucuaguuguaucuugcucaaaauuguuuugaaaagaauguaacucugaaaguucuucacaugaaauacaucauaucuucaaagaagacaucaaagcaaagaguuuggcuuuaagcuuuguuuaucucagagccugucugguagauacuuucccugaaaagcgguucaacaucacuccucauuuugcaauguuaucacuugacaggcuagcccugccuguuuaagaaguaugaaucacacuucuucaggaucgacuuauucuugugccaaguuguaaauguccccacacagcauaguaagcaauuucguaaaacaaaacaaaaugcuauuaaaugucuuuccaauuucuccuuaauuaggguccuccuggugaaccugggccuccuggcccuccaggucccccuggccaucuuacugcugcucuuggugauaucaugggacacuaugaugagaacaugccagauccacuuccagaguuuacggaagaccaggcagcuccagaugacacaaacaaaacagacccugggauccauguuacccugaagucucucaguagucagauugaaaccaugcguagcccugaugguuccaagaaacacccagcccgcacuugugaugauuuaaagcuuugccaucccacaaagcagagcggugaguagacaggggccuguuugaguaaaacauauugauuguguugaguuauucucaacugcuucccaaaauguauuuuuaacuuuauaguuaaugauagaaacaaagauaaauuguugagcaugcucuagagcuuauaguuuugugguugugacaauuaauugaaaagaugauagauagcauauauaauaaaggccacaucauaucaaaaaaacaauuuugaggaaauaguucagacacacacacacacacacacacacacacacacacuacuugcucaugcauaauuaaaaauacuuucuuaccuacauuaucauucagaauuuuaauuagguaaaucauugagaggccaguaaaggacauguuucccuaacugauuugcauauugaaucaauuuauugcacuuuaaugaccugccaaucaauccuuugcuauacugccuggcaggaucaaguauagugaucuuuuauggcaguuuggaaugaaauagugucucuaccuaaguuguaugacaguguucuuaguuugccuucuucaguaauauuaaauuauuuaauuagacccagaaaagggggaucuaagaucauuugaaugaguuuggaaauaccaggguuucaguuaacuuuaaacuuuaacaucaacagagacaacuaagaauguucuaucuaaagaauauacacuuuuuguacuauuuaugucucacaacuucccucccauuuuauauaaaauuuuauuuuugcaguuuauguauaauaauacauguauauguauagaccuauagaaacaaaugugaauaaauacacuugauguauauuuauacaauuauagaucaaacauaaaaggcaaaaucuugguuuaaaaaucacuuggauguuuugagucuuaaguucaugauuuggaaaagugcuuuugaaaagaaguuagcaugaagaagaccccuagugcuuaauaguuacauuucauauauauagaugaauauuucauauauauauaugugugugugugugugugugucuaugugucuacuugcauguauauuuaugugucauauguguguggcugcaugugaacagcagguugacaugagaugucuucuuuaauuacuguacaucuuauaugguaagaugggguuuuuagcugagucuacacuucaucuuuuuagcuagucuagcuaauuggcucacuguagggaucuccuguuuccauuguuccacaugcugggauugcaggggggccacaauacccaccuagccuuuguauaggauaugugugugugugugugugugugugugugugugugugugugugugugugugugucuguuugaguauccuaacucaaguccucaugcuuauguggaaacauuucacuugcugagccuucuucccagucucuuacuaauuauaguuugaauaaaggaugaaaucucuacugauuauuuuagagacucacaaucauauuugagauaaucuucauuuagcacauauuucuaucuuggaaaauaggugaauauuggauugauccuaaccagggaucagcugaagaugcaaucaaaguuuacugcaauauggaaacaggagagacauguauuucagcaaacccagccaguguuccacguaaaaccuggugggccagcaaauccccugacaauaagccugugugguacggucuugacaugaauagaggaucucaggugaauuaacauauuuaccuagaauuauauuuuuaauuguuauuauuuauuauguuuucauauuuauuaaaaugaugcuauuauuguuugacuggauuuaauguauuauguuuacuuuuaagugauaucuucccuuauuacaugucacugacuguggaggacagugggaagggucuugucucaacuccaggaaacguaggucacaauuagaacucauuaaauuacuaagccuugcugggcgugguggugcacgccuuuaauuccagcacuugggaggcagaggcaggcgaauuucugaguucgaggccagccuggucuacaaagugagugccaggacagccagggcuacacagagaaacccugucucgaaaaaaccaaaaaaaaaaaaaaaaaaaaaaaaaaaaaaaaaaaaaaaaaaauuacuaagccuuuuaaaaccuuuugcuacuuuaauguaagggugguaaagcugaccuucgccucacuauuaauguuagugcuuaguguagugucugaaaagauaauaccuauuagcuacauuuuuaaaauaauguaauccuuugaagccugugaaguguuuaagucauuauuuuaauuaggugaaauauaugauaauuuuuuucugaauuccugucuacuuaauauuucuaguacgguccacuugguucaggguuucaucagaucuugguuguccuauuacaaugucauuauuucaucccagccuaccccucugccuccaaccuugcccuagucaacucccagccuaccccucugccuccaaccuugcccuagucaacauauuauggaaguguuauaguucuguauaugauaaguuacaaucuacuaucguuuagugaaaauuuaauuuaacaccuauaaaaagcugaauuuaaauauaaauggcugaagcauaguuuaaccaaaauaaauaugucagaaaucaaaacuagaccauugaaaacaguacucaaagcugaagaugaauagggaagaguuaguuggaaaugaguuuugauacuuguguuguagaaaauaguauuuuugauauguauguaauuauucaguaaaauagauuuauaccuacacuuaauuuauauuuuauucuaauuagugauaauuugaguuguauuuauuaaguauaauauauauauuuuaaaauuauuuaaccuuucuccgggaaauuaaaauaauuuggcuuuucaccucuucuuugaaaucauaaggacacagguacuugugauaguauuugaaaauauuuuccuuuguauagauaaaguagcuuauuauauggguaccaagaaauaucuuuaaaagugauuuaccuauagucuguuagucaucugucgaucuaccuggcauugacucuuugggugauauuaugaaccucuuuaguaugucauguuacauaaauuucuuuuauuucucuaguucacauauggagauuaccagucuccuaacacagcuaucacucagaugaccuuuuugcgucuuuuaucaaaagaagccucgcagaaccuuacuuacaucuguaggaacacuguuggauauauggaugaucaagcuaaaaaccucaagaaagcugugguccuuaaagggucaaacgacuuagaaauaaaaggagaaggaaacaucagauucagauacacaguucuucaagacaccugcucuguaagugccuuuuggacuaugcuuuucuguagcuuccucucuuucuucagcaaggaaaguuucugacucgcuuucaaucauaagcuuuaagagucuacaauagagacucacugauuggcauuucuccuuucugccacacacauugguuuauacuuaccagagcuguacguucacugcuuuugaauuuuaaaaguuuagguggggaacacccucauagaagccgggagggggggaugggauaggugguuucuggaggggaaacugggaaaggguauaacauuugaaauguauauaaauaaaauagcccaugaaaaaagguuacuugcgcacaugcgugggggcggggguguuccuguguaaacuucuuggauauauauacuauuuauccauuguccucuugaauuccagaagcgaaauggaaauguaggcaaaacuaucuuugaauacagaacacagaauguggcccgcuugcccaucauagauguugguccuguggauauuggcaaugcagaccaggaauuuggccuugauauugggccaguuuguuucauguaacagaagcccagacauaucgacaaugagcacuaccaucaaugaccaccacaagaacugugacuguuuaaaguucauccugagacucuugaaguaauggcugguccugcaucagcuuuguacauacgaucugaagugccugaccaccuuauccuucagaauauuuauuuuacuuacaauccucaaguuuaauugacuuaauuuuuucaauauggccguuuagauuaaagcaaccaaugacaaugaccaucuuuacaaaaaguaaacugaucaaaaaauaaauauguuuucaucaauucauuucacuguaaugaauacguugcuuaguauuuaugagaaaauucuucuuccuagcagguagcuuacaugaugggguauguaaagccucagcauguguugauuuugcuuggcugcagucugaaaaguagagaguaaugcccccuguguccucuuauugucagaacaucagugacaaaugaagacccccaugcaugucuuaauauuauacuaacauuauagaaaaaauuaaggugaauauaacacguuuccacugucuuaaaugauaucuuuaaauaacauguaaccauugacuuuuaggaggaaaaaaauccauaaaauugcuucaacuuuacaauuuauuuugcaaaaacugauacaguuagaguuuuuuccucauucaaauuuaaggguaacauuuucuuuuuguuguaaucuuucaauacagauagaaguuauauuugugguuuccuauguaagaagauauuggaugaaauuaaaaaaaauuacccacacaauuuucuaacacacgugcccaguaaugaauguuaagacucucccacagucacagucucauuuuccugaagcauaucauaagaaaugaacaagaaguccagcauuauaaugaucacucaaauaaaaugugaggauuggaauuagaacauucauaagaaaauaugacccaacauuucuuagcaugaccuaccucaucucugcaagcugggauagauuuccuguucuuguuuauuuuuagguguugaaaggugcuaugcuucuguuguuauuccaagacuggagauaggcaggguuaaaaauauuauaacuuuucuuuuaaugauggugcuaaaauuauuucuauaaaauucuuuaaagauaaagauuguuucaucaaugcuauuugugaacacagaacuguuaaacaucccauuugagagauagaucauuauuccugggucuuuuaacuguuccuuuuaugauguauuuagaacauuguguaaugcuugcaagugucuuaaccuaggacacauagguccccuugugucucaagauuuuuuccuuaauugcaguuguuugcuccauuguuguuucuuacuuaaauaaucugggccaucccaaaggacaaggcccacauagaacuuugaucauguaucucugcaaagcaucgaauuaaaugcaugcuucugucaugucagucaucuucaguuuguugaauccuuugaacauauuagguccuuuuaguuuccaggagugaaaacuaagaucuccugguaguuuuuguucacaauuuaguagacgaugcaacaaguaccuaccauuuugucugcacuggcuuaaaaauaaaccuaucuguaacauugccugcaaaggcauguugacaucaaugaagacagucuaugcguuagaaaacucaggcuagugauugguaaagaguaaaggaaaugaaaaauccauuauugaauaaacuaauaauaaaacaugccucaauguguaucaaguaug

SEQ ID NO: 150 - RNA, 2465 nt, Mus musculus
caaaccaggcaaaaccccagcauggagaccuggaaguggacacaagucccacucccuaagcaaggagcauugcaauugacaguuucuggcaaaggggaacucuguuuucuccaacugaguguugcuggauaggcaaccacacuccagggcaggcgccaugcccagaaguaauuggccaacacuccaugguuuuguuuuaaaguuuuguuuuagguuuuugguuuuugguuuuugguuuuguggaggguagggguguuucuuguuucacuuuuuugguuuggguuugguuugguuugguuuggguuuuuuggauuuuugguuugguugguugguugguuugguuucuuguuaucugacucacucuuuuuugauuuucuuuuuauuuguuugcuuuuuggaaaucuugugcaggaaaaaagcauggagcuggguagguaaggagaaucugaagacaguuuggagaaaggaaaaauaucaaaauaauuuuuuaaauguuaaaaugcaguacuuugguacaggcucggcgagauggagacgaugagagacgcagcgugagaagccagagcagcuccaaaccucauugagaccggccgccaaagcccuccacacccacuguauauuuuuggcuauuucagcccugaugaauucagaguuuuuguuguuguuuugguuugguuugguuuuuuugugaucccugcucuucaggugagcuccccccuccauacagugggacucuguauagcauacaggcugaagaugaacugccagaugcguucggcucaugaauaaguuuauuaauaugccccuaccgcccgagccccgccaagcugucggggauaaaauaacuccacccaggagcugccuuugaacccacauacauuuacagacagucaucaagucgagccuaccugaaaagggccgaccggaggacgccaaggaguaccuagguuucauccucaguggacuccaugaggagaugcugagcccgacuaaacuccucucacccacgcaugaguagcacucuguuuccaauuggccugggagccacuugauagaggagcuggaagacaccaguguggucagugaggacgauugcaagcaagugggucccaagaacaagaugucugucgccugacaggcggcggauuucguccagacacaccuaucacuggcauuuucaguguacacccagcagaguuccaaggaguccgccacucuguagucauuuuucucgcugcaguuggauauccuaucugacaagauaugcacaguucaggauggguuggaagguuuaguggcaagagagucuauccaagguuacaccaccaaaaccgagcaggagauuaaagucagccgcagagugauucuagagaagcuucccccaguccucccucgugcuccaccuaaagugcuucgucggugagaacacaggcagaugccagaagcuggucaggaacguugacgacacuguggacuuggagaucagcagagaacggcuuucuccaggcuucaaaaauaaacauuuuaaaugccacagaacguagaggcuguucacagugguuucauggugccagcgcuacaaucggccacuacauuacggacaucuuccagauugggcuuaauggcuggcugugaauugaugaccaaacggucaagguuauuaaucaguaccaguuggugaaguagacugcugacuucuggcuugcacagccuaccuccugcauuaccgccauguggaccugcuguaaccgugcccgugugucugugugugccugcuuccuacaacugccaacucacucacuacccaccucucuaguggcucuguagagagacucucccucugcgccaaugggcuugggagauuccugggggucugcgcagcgcaacucagugagcugccacuucugaagaacugcugguuccugggcggaggcggcgguuuacacugugucccaggcuagucgcauaguagaauaagucccgcaccaacagcucuugcaaauuugugaaaaugaauuuuaucuuuccuuuagaaaauauuuuuuaaauucaucacacuuuccuccuuuacccuucaguuuuugauaaaugacaaaaaugagccaguuaucagaugagguaguucuuacuucaaaaagaaauaaauacaagaaauauauugcagguuccuaacaggaaaugcauuuuaacgauugugagagggaaacccgcugacguagacaccgcgggucagacucaggcuacagaaguggguaauuguaacuucguuaccaugaaaagauuucaaaucucauucaugcuguguacacaugaacagugggcaaaaugauggacugacacuucccagugucugcuguguaaucuccugccacgccucucugaugcccugucccucagguacacagaauaggauuccuaggaguauaaaguugucacucuucaauaaaggucacaaaguugguuua

SEQ ID NO: 151 - RNA, 28493 nt, Mus musculus
ugucgcucaaucacagugacagaaaaggcaacggcuucaguaggagaaaggauguucacuuccgcuucuggcggaaccuuuagaguccgguaaaagaggccgaagagaaaacucucuucuguaucgaauagcuguagcggcaucugguaugauuuaacuuugugcguggcuguugggcuuuacuccuucuacaaggguuuuaauuugacccugcccaaacuaaagauggcggcguaggcguggagccgaccauagagucuccaggcuagagaggcccaggcgggccgcgggcggaagaguagggccaggccagucggccuaugaaggaaguucguaauccggccggugcucggugcuuccugcgccugcgugaagaugguagaagagggaguccgcgugguucgcugcggcggcagccggcugaacuucaggagggccguguucuccguggauuccaaguaugcaguaggcugcgggucaacagggcuccgggcaccgcgggccggggaggggagugcccggcgcggcgcggcccacggucggacugcgaggcuggaguccgcggcgccgcgcagcgcauggaccgacccggagcuccccggagccgcccggcuuugcugcugugucugugugccuugcacccaggacuccaccugcgggaagguuggcgguuacaggggcaggucaggugucuacaagggacuaggagccgcucgguuggaaaauggucacucucuccguaugugcaccggucugaccaugcagacuaauguucacguguggaacguuuuggacuucaaaaucauuaaugauucagccuuuuucccgcagaaaaacaucauaauuaccaggcuccuuuuuuccuuuuuuuuuuuuuugaguuuuacauaaaaacagauguuagaucuguaggagaaagugucuauaugcacacaacuuuuacaauaguggcuuucaguucgcugcuugucagcuggcauuguugcugccacguuguaucaucuagaagagguguguaguagggcuaguuuuucagagcacucugaauguagagauacuuaggcucaguuguuugaaugcuugauccccaagaggagcaauuauuccugaaggauuaggaagcagacccuccuuggaggaggugugccaauggggcaggcuugaaagguucaaaagccuaauccauuaucagcucucugcacagggaugucuccuguacugcuccagcucucucucucuuucucucucucucucucucucucucccucucucucucucucucucucucucucucucucucacacacacacacacacacacacacacacacccaucaugggcuccacugugauggucauggauucuacccucugcaacugugaacugcaaauaguaaauaccccuauuuuagaaagguauuuauaguauuuguggaagguguacucucccgcaauacccugccaguauacuuaccaguauacgggguuuuguugacauuguuuuaugaauuaaagggauaaaauggacauagcggaguugucacaguucugccccuucaaauucauccuuauacucauuuuuacccugcauugaacauugccucaccuugucuguuaaaugagguguuugguccauaucauuuuccaagucugauaggauuuuuuuuuaaagcuuuggucaaugguuugaucuuuaacuagcugagcugacaaaaucaaaacaagaaauuugacuguguagugaggaauagagaagucaguguagauguuugaaagccuaggugcuuuuaagacuuuguuacgucauagugagaaagaugaaaauugcagagggcuacuaucuguuguuauaugcuuuucuauugccauuagaaaauacugggaccaaaggaacuuauaaaacaaaauguuuaauuugagguucacaauugcagagguuagaauccaugaucaucgcaguggagagcaugauuggggccuggggggggugggguggggggagguguggcaggcaugaugcuggagcaguacaggagacaucccuguguagacagcugaaaauggauuaggcuuuugaagccuucaggccugcccccaguggcacaacucuuccaacgagggucugccucuaauccuucaggaaugauugcuccacuuggggccaaaaccuucagacuucugagccuguggggaccauuccauuuuccuuuaaacacccacauuaggcuaagccgagaagguugucuauugguuguucuaugaauggccucccuuauagguacacaguaguauccaaaaggguagguugacuugcuuuguuuuuguuuucacuuaauguugugacgauuggaccuugcacauaccagacaagcacucuaccacugagaccugcuucccagcaccuguuccacccuuugugggcacccacucuuuuguuuauuuucauuggggaggggucucacugaguugcucagguugguuuuaaacuugcuauguaguccagaaagccugugaucuccugccucagcaguucauaagaagguuaaguuaccggccugugucaucaggcccaacuuagagaaauguguuuuacuguuuagucaaaaauaauaauaaaauaaaccucuguuuuguuuguuuguuguuuauuuuuuuguuuuuuaaucuuauuugaggugaguuaaagucaaguuuugcaaaguuaacauaguaugaauaugaaacccaacuguguuaaccacucauggaagcuaagaacuccuuaggaaugguccaggcuacagauuuuuagccucuuaacuaaaguacucaggauccugggucuagucaugaagacuaccaaacacugcaggugcuuugcagugauugcuuucuugagcuuauuacacauagagccaauguaucuuaggcauaccgucaguugugaaccacauucuggcuucaaaggugugcacagauaagcaacccaguaucauugauuuaauaagacaggcuguagcaacccuggucggcauuguauuucuuaggauuaagucaugugcagggugcuuuggcagcacagagaauagucugacuggguucucagugaccugaaccuuccacggugagaaaagugaaauaugguugacacagagcaaaauucuuuucugagcuuuucuuagguaaguucuguuaugaauguaaccacuuugauaaugaaggagcaucagguuuguggggaaaagccacaaccguaagaugauauaggcaaaauuaguacuucaucaauuagaagauggauauguauacaggagugaccuggaccucaccauugagagcacaaccuuuuauucggcauuugugagcugaugucuccaguuagcgagggagaauuggguuguuugaagaauaaugcugugucaucucauagucuuuucugcauuaguagaacaucucauauccucgucucauauccucauaugguugacaacacacacagacacacacacacacacacacacacacacacacacacauauauauauauauacuugaauauacaauucuuuuuuuuuucuuuaaaguuuuaagauuuauuuauuucauguaugugaguauacuguagcugucuucagacacaccagaagagggcaucagaucccauuacagaugguugugagccaccaugugguugcugggaauugaacucaggaccucuggaagagcagucagugcucuuaaccacugggccaucucuccagccugaauauacaauucuuaagcuauuuugaaguguaucugcauguuauuaucuuaauaacaggccauaaaacaauuauacuaucuguauagugugugagacuuagcgcgcucucucucucucuuuuccagguauaucuucugugucucgggagacuuugucaaggucuauagcacgaccacagaagagugugugcacauucugcaugggcacacagaucuggugucuggaauccucgucaaccccagcaaccaucugcaggugccagcuuguaauuguacauguguccauuuuuacuguuagcagaaacaauuggguuaaauuuggaguggguccaucuguagguucuccuauucgggguauuuuuuuucaguuuucugagaguggaaagagguccauagccuagaacuacacugcccaugggauauucugugaaccauuucaacugcaugaugcuaauaguuguuacuugauaaggcaaggcuguuuuuaucuauaugagguucugaaauauaggugauguuaaguggauucuugauuauugguccccauacagcaguggcauugugacuauccaaacaugugcccuuacuuuccaauuuuuaaaaaauucaauguauuucaauauuuugcucuuguuauaaguuuuaacgaguugcuauuuccuguguuagucauagcaacauggaggcuauugcuugguuuuggaaagauugacauugccaccauaacugugccauaaaagacauagggcauaaaauaacacuccuguuuuaucuccuaaguucuccaagaucugcucuuaaaaaucagagucaaauaacucuucuguaugauccaguuauauuuuuuauuccuguauuacauauuuauccuuugcgggcuuuuaaugaaaaaaguguucuuaaguuaaaaucauauuuauuaaguauguguuauaaccuuuguugguagacaaaaaaaacauauauacagauuguauaaguuuucucuuaaagucagaaguaguuuuaaaauauuugauuaauuuuuuugagaauuucauacauuguauuugaucauaugcaucccuuucccccagauccacccuccuuuccagagacaccaacucuauucucuuccccccaccuucucucuuaagagaaaauccaauuagugcugucuauaaggccacauacagaugagcagucuuaucagcagguuggggugagguugcaggauaacaauugugugaaccugagaggucuccauuuugaugauacuuauauuuuuaacuguuuuguuaauccuuauguaugugucuuggauacaauaucuggcuuuauuuucuacuuaagauaauuauuuugcuugagaagauaauguuuuacucaaauucuuuuuauuuuuaauccaugaauucaugacucgguucacaaaaaaugucaaaguggcccuuuuuuucaaauucaaauuauuuauaaaccuuauaaacaaguuauuuucucaacaaaucugugaaaccgaaguaaagcuaaguauuuuuaacagacauaauccuauguguuacuaaggucugugcucaccaagaaugguccacagacuaguguucuaacacugucaagccuuacuguagugauguacagcaaagacugagaguccuggaacucagcaccauggaguugccauagagucucagugugcaagaauuccuucuguguuuguuuaaaguauugguccuuaauggauugaguuuaaacagaggaguguucucgucauuucaggaauuuuuuuuaaugcuuagguaagaugagugcagugacaccagugaaaaggcauuuuggcuuuggauaaacgagagcgaguucuuaagugcucuucacucagcucccuaccuuaucccgcuguggaguagagugucgauucccaccuccuuccuuucuguuuaaaagcugaaacuguuagaucguuuuaauuagaugaguuugcagaaaccacugguugguuuccuuuauuucaaauacuuugggcagaagcuguuucauguuugggggaauauuuauuuguuuuacugugcaaucuaaaucugauacuuuuugaguaccauuuuggggcucauaaagcuuugcauuuaaaucuuaaauagagauauucaacuuuuauaaauuugacuaccucuucaaugccaaccaugagauaaugcacagcaaccaggacacaguccuuucugccuuucacugucacugggucucguugggaugguguuuaaucugucuuguacgguuuuuacccugcagcucuacucuuguuccuuugauggcacaauuaagcugugggacuauguugauggcauucugauaaagguauguguauugcucuuuaguucucuucuguaaagccuaaucguuaagggacuuacugaacaauuugaacuauauaaaaauuucaagauccuaccguaaaaagaagacugauaagcacugagagaagguauuuuacucaccaauaagaaacaacuaguuaggcuaacaggacaggagauaaguaagcaugggcacuguagggguugcuccgugcuggagugucugugugcggcccuggcugcugucccagcauuuucagggagaacugguggagucaaaaguaagcuaggaauugacaugacagaaaaagaaauaccaauuaccaugaggaggugauucauccuauuaauuuuagcaguguaaauuuaaacaaguagagugauuuauuuuuuuccccuugcuaaaauucacauugaguggaguaaugaguacaauuuagacagauuuuuauaugugcagucgaugagaggaaaacaaaaauuacaguacuuuuuuucuauaagaauuuacaucuuugaaauaucuuguuauauuuaaauuauaucauugaacgaucuuguuauguaguccuuaaauuacagugggaaaaaaaucuauauaaccugauauuagauaaaauuauuauagguugcaaucauugaaaagccaggaaaguauaucaaaagauaaaucaucaaauaguguacauggccucuauagacagguacucucuugagguacgaaacaucaguaagaaguccuuaaauugcaccaugaguucuguguucuggaggagcuagauacugcauggagugacucauuaucucuuucagacuuucacuauuggaccuaaacuccacgccuucuuuauuccucuccacgcggaagauuccgucuuccuuacaauaaguaaagaagagccagguacagcauaaugcgcuuaauuuguuuuuugugggacaucaaauggaucuuuacacuuucucaaaauuacaagggucucgacacuaguuucaauaucaagcuggcaguuuuugaauuggcauguaaauugcugucguucguuaugccuucgugaggcuuuuuaguucugaggucuucaguguuuaauugaaaggggggggggcauagugggcucagauuuucuguguuaaauccaggcaaggauuugucuuucugcugaauuuuaauauguuagucuuuuauuuuuuuuuuuucauugggagccuaacuuuuaauggcugagccaccucuccagcccuuaauaauaagcaucacagucccuuuauuuguugaucuugacucauaucaaauaauauagauaaaaggauaaaagcugauauaaagaaccaguaguguagcugaauuguuacucuguuuacuagcaucgaaacuaucacauaucaggauuacaggaauguuuacaacauugucagcaauuacagauaguuuuucuccaucauagaauuugguauaacagaauaccaacaugaaguuacccaaaguaaguuuuuaaugcugggauucaagaggacuacuccuuguaagauacaguuauauuagaauaaagaguucaaagaaccuuuaauauagugacuauagacagcugaacugcccaaaauuuaauccuuuauguacaaauauauacaagcacaugcaaaucuuuaguauuaaaauugcuuucauuuuuuuacucaaugguauaacuguauguacaccaaagaauugcuuuagaaucacauaugguugaauauuaguaacauuugacuuaugugccuauuuuauggccaucugucaguguuauauauaauaagccaucgcuaacuuacauacauggauguacauacaauuauguauguagagucaagaaguccacuccaaaugucuuccuuuaucucuccacuuaauuuuugagacauauucuuucucuucgccuguagucuggugauugagcuaaacuagcagcccccaagucccagggauccuccugucuggacaccuguuguugugcuggcuuuugaaauugcagcaaacucagguuuucaugaguucauggaagcacuaaugagugaucucccuagccacacaauuuagaaagcucucauguggcuucauuccuuuggcugcuuaacucaccaauacuauauucauuuuucagucccauuuuauuuuuauuuauugggauuuuuuuugaaacaguucuuuauaguuuuauaauuguccuauccuggaacucacuguguagaccaggcugacuucaaacucacagagaauuuccuuccucugccucugcuucucccuucaacccuaacccugacccugcugggauuaaagguguguucccacauagacccacuuuaaacugcagcugaguacuuuggaacauaaaacacuccuguguaaguuuucuauuucuacagagagucaggaguauccagcaguuauggauuuagacuccaaucagaugaagaguucaggaacuggaguaauggcucagcaguugagagcacuuguugcccuaccagagggccugugcuuggcucccuucacacaguuuguucaaaguguccuacaguugcagucaugucauauugagugugcauauaacuguuucaaaugacuaaguguauaagcuuuauagaaacuguaagaaaugacuuccucuggccagauauauuucagcuggugucagugaagcugcccaaaucaacaagccaggacguggaagcuagacagcucaccuuuguuuuggauuacauaaauaggucccccaagugcauugccuuuggaaaugagguacguuuguucuguugguuucuguuuauaugugaaaucuauccccugaaaguuucccccucaacacugauguccagugcaguagugcacuuuuguuaguaacuaaaacacugugacauugucuuagcaaacucuccuggauuaugguaugcacaaccauccuuaugucauauauucuguccuuugcucuuuuacaguuuuccccgaaauaacaaugucugguauuugaacuuuuuucuuuccuuguuucauauaaagcacuggcauuguuccacuuuaggcuguguuguguaucuuuagaaaauaugggcuauguaucuauagugagaauuucccaucauaggaaauucagguaucacagaaaauauggguaaagaaaauguugucucaccaaugacaauauuuaaaggcucuuauagacuuuuucuugaucacauugaagacaacaguucccaaaagaaguagaaucagaaauauugucaucuuuuuccucuuuucaacuuaauauuguagcacauaggaauauuaacauauuuuugacauauacuuuguggcauuuguaccauuauuuugcuaccuguuaaugccuuauuaaagucaaaugccaccaggaggccuauugcauagccuugggguuuuuccagucauuguaucauucuuuaggacaggguuaguuccucaaaguagagaagauggguggcuucaucacugucauugucauacucggucuuacugauuaccacagugggucaaaucauaguuagaauccaccucgccuccaccauaauuacuaauggugucaagaugaggagcaaaguuaaauucccugggccuggaaagacagagcaugauagcaaauugcuaaguguaggaguaaugauuguuucccauagcccugaaacaagcugauacccaguuaaccagccagucaccagaauuguggaggauuuauucagcuggaugccgcucaccagugagaagaaaguaacaauacaccuaaugguguagguagauuucagaagaauguguugagcuacaguuagaauguacagacugaaauaagcuaugaugauaaaguggcaguugcuggugugacuggggcguugaggagugacuaaauagggagugugcauucuggggugaaggaaauguuucuaggucuagauuuuggcagcaguuauauagauacagucaaacauggcaugguauuguguguaugccuaauggggaaauauguaaaccacuacacuuaaauauauaguuguagaauuuaggauuuaauucuaaagguaaaauuagcaagucauuuuguaguaauacaaucuugaggggguuuuuuguuuuuuuuaauguuaccuucugcuuaaaccaccagggagaauacguugcugcaguccgggacuuuuacuuaucuguuuauuuuuucaaaaagaaaaaaacaugcaaguaagaauucccuuuuauuggcuuugcuguauuuacuggagaacuuguuacaguguuguccaaaccuggugucuucuuucaaaaaguggaccauccuguagaaguucacacauuuuaauacaugagguagggcaggggcaccuuaacuagagagucuucucuauccccaaaccucauacauacaauacaaucaaaugugugcuugguguaauaaaugaauuuagauugaaaaagcuuggccuggugauucucauugacuauagcaaccaaucuaggcauuaggauacuggggcuuuguuccaguuuguuuucuauugcaauguuaagauaucaugaccaaaagcagcuuggggagaaagggguuuauuuggcuaacaucucaauuucaucgucugucauaaagggaaguuagaguaggaacucagggcaggacauaaaacagaggccaugaguguugcuugcucucuaugccuccucacucaggugcuuuuguauaacucccagacccagcuaacugcccagaaauaacaucacucuagugggcuaggcccuuccacgucaaucucagucaaaaagugccccacacucuugacaacaggucagucuggagccauugucccuguaagguuucuucuucccaggugacccuagauuggaugaaguucacaaaaaucaccagcaugaacuuaaaaaacauuucacccauuucauccaucauugacuucaaaauaauagguuuaaauggagaugauaucuuacugaguuuugaaggaugaauaacaugcauauuuagacgagcugagaauuguauaaucaaucucuuagacacugucauuuucgcagcuacacuucugagauuagcauuguuuuguuuaugauauacaagaauccucacuucuucaggaguggaauaucaaccaaccuagacauagcaaauggauuuauccuucugaauuugucccauuaggacacauaaagucagucguuucuguucgaauuuacuaagcauggccauaagcuuaauacuaaaauuuugguucagagagaaauuuucuguccaccagccaggaaaagguacuaaaaggacuaucuucuuuacuuaaaucagagugcauuggcaaguucuugugguaagaccugggucacaugaagcuuauacuguacauuuguaaauguuuaccaaacagaauaaccaagggaaaguuguuguuugucuuguuccuaguuuuacuuuaccaucaacaaaaaacaagaagaaugcaaagaacaaguucacauguguagccugccacccgaaggaagauugcauugcaucuggucacauggacggcaaaauccgccuuuggucagucaacuccagaaaaccugggaucacguguauauauacugcuucacacucauccucaggguagcacuaucucugggcccaaagaaagaguguggcccaucacugcucugcugccaccuucccuuuccuggcauugggcuccuccaucacacugccauguaggauugcuaaccuuaaguuucugaagagagagaagcacuccaugucacuggaaucauuuuauugaagagaaccuuguuccuugccuuuuaacuaaaacaggaaacugagacagugcugacuaucuagugggugguacagugagugcccugauaacuuuacuuauagaaguucaucuggaggguuggggauuuagcucagugguagagugcuugccuagcaagcacaaggcccuggguucgguccucagcucuggaaaaaaaaaaaaaaaaaagacaaaauaacaaucaaauaaagauugugcuuuuaaaaaaaaaaaaaaagaaguucaucugguuaccaagaacaaacuauuuuuaaauauugaugccaaaacacuugggacugguuuauugcauuuagcaugccauuguuucccauuugguaccugaaguuaagaguuuguuuucuaaucuuaaggggaugucuccaucaaauaaccucucaggggggcucuuuucuguuuguuuguuuguuuguuuuguccaauucugauguguuaguuucuauuuuaucguacuauauuuuacuuuauuacugucucagaagccuguuuuugaaucggacagaaagggaauaggucggaauggagcugggaguggagggagaagaaacuaucaucaggaucuacgacaugagggaaaacgucuuaaagagcauuguguuuucuccgacaggaggaacuuucacagugaucagaaguacacauacacauguuugcauuggcaccacgacaugguuauggauuuggcguucacaguaacaggugagugcuucuuuucuuuucuuuucuuuucuuuucuuuucuuuucuuuuuuuauauauagaacaugauuugaauauuuucagcuguuaauagucaacagacagaauaauuauuuuuaagauauauuucauugguaugucucccuuucuauuucugauuuuauuaauuuggauucuaucgagugcucucugguuagucuggcuaaggguuuuuaucuaucuuguuaauuuucucaaagaaccagcuccugguuuuguuggguuuuuuguuuguuuguuuguuuguucauuuauauauauuguauaguucuuuuuguuucuaauuguuugauuucagcauugaguuugauuaguuccugccaucuacucuucuugggugcauugguuucuuuuuguucuacagcguucagguaugcugucaaacugcuaguguaagcucucuccaguuucuuuuuggaggcacucacagcuaugaguuuuccucuuaccacugcuuucauugugacccauaaguuuuaguaugcuaugucuucauuuucauuaaauucuagaaaaccuuuacuaauacuuuuuuucuuccuugaccaaguuaucauugaguagagcauuguucagcuuccacauauauguguguugguuuugguuuugguuuuuguugguauuuaagaccagccuuagucugugauaaucugauagagugcauggaaauacuucagucuucuuguaucuguugaggccuguuuugugauuauauggucaauauugaagaagguaccaugggguguugaaaagaagguauauucuuuugauuuaggaugaaauguucuacagauagcuguuaaauccauuugguccauaacuucuguuaguuucacugugccucugcuuaguuucuguuuccaugauuuguccauugcugagaaugggguguuggaagucucccacuauugugugggauacaaugugugcuuugagcuuuaguaaaguuucuuuuaugaauguggaugcccuugcauuuggagcauagauauucagaauugagaguucaucuugguggauuuuuccuuugaccaguaugaaauguccuuccuuauccuuuuugauaacuuuugguugguugaaagucgauuuuauucgauauuagaauggcuacaccagcuuguuucuugggaccauuugcuuggaaaauuguuuuccaaccuuuuacucugagguagugucuaucuuugucacugaggugcauuuccuguaugcagcaaaaugcuggguccuguuuacauuuccagucuauuauucugugucuuuuuauuagggaauugaguccacugauguuaagagauauuaaggaacagugauuguuacuuccuauuauuuuuguuguuagagguggaauuaucuuuguguagauauauuguuuagguuuguugaaagauuauucuaggguguaguuucccuccucuuauuggcguucuccaucuguuauccuuuguagggcuagauuuauggaaagauauuguguaaauuugguuuugucuuggaauaucuuguuuucucagucaauaguaauuaaaaguuuugcuggguauaguagccugggcuggcauuuguguuuucuuagggucuguauggcaucuucccaggaucuucuggcuuucauaggcucuggugggaaggcugguguaauuuugauaggucugccuuuauauguaacuugauguuuuucccuuacugcuuugaauauucuucuuuguuuuguccauuugguguuuuaauuauuaugugaugggaggaauuuuuuuuucuggucacaucuauuuggaguucuguaggcuuuuuauauguucaugggcaucucuuuagguuagggaaguuuucuucuauaauuuuguugaagauauuuacugacccuuuaaguuggaaaucuuugcucucuucuauaccuauuauccuuagguuugggcuucucauuguguccuggauuucuuggaugguuuagguuaggagcuuuuugcauuuugcauuuucuuugaguguugugucauuguuucuauggaaucuucugcaccugagauucucucuucuaucucuuguauucuguuggugauguuugcaucugugacuccugauccuuuuucuggguuaucuaacuccaggguugucucccuuugugauuucuuuauuguuucuauuucuauuuuuagauauugaaugguacucauuuuauuugccucuuugauuuccugcaauucuuuaagggauuuuuguguuuccuuuuuaaaggcuucuagcuguuaccuguguucuccuguauuucuuuaaaggaguuauuuauauccuucuuaauguccucuaucaccaucaugagaagugauuuuagaucugaauauugcuuuucccauguggugguauauccaggagauuugggaucugaugaugcuaaguaucuuugguuucuguugcuuauguucuuucgcuugccucccaccaucugauuaucuaccugcucucacuauaucugacuggagccuguccuuccugugauccugauuguguuagaacuccucagaguucagcugucucugugauccugggauucuagaauccugugauccugagauccugggugugucagagcugccucugggauccugagauccugguaugaccaaacuccuaggauccugggauccuguaauccugggcauguuaaaucgccugggaguguuaaggaagauaaugccuucaaaggaagacaggaaagugauuugucuuucucucguucuuccuggacacuuaauuggacagaucuucauuagcccuguguguucuggaugcuuguagguauacuugggguuaggucuuagagccgaggaaguagaaaguagauucagccuaaugaagcuuuggauuuguggaacagugccuggugucugcaagagugugaccuaagauugagacaauagagaaagaagaggauuugacucuacuauggcuauuuauuuaccuucuuuacccucucuucucucaccuccaaaaaaaauacugugcuuuuaggaugcugguguauguauauuuaucuguauguuucacauaguaucuuuguucucuccuaaucuagucuacgcuuccucuucauucuuuucuauacuguggccucugcccaucucauggcaaggaaugaccauaagcauuuaauaauauacauuacuaaauccuaucaucucuucccagagcugcugacacuggaguguuguaaauaguccuuuguuauuuggacugaucacagcuaguugauauuacugagcccaaguuuuggugugugauggaaauaaguuacuuucugcaguauucuaguuucauuucacuugaauguacaccagagugagcuugcuaagugcaguguagacauuguuucuauaaugacugugucuaagaaugccuggucagagucugacuggaguggggcacugccucauuuuggauguuuauguggauuucucuaauaguuacuaauguggagaauuuuucauacacauguugauuauuuuauuuuuguuuuucugggaaaugucuauuaagguugcuuuuuguucauucuuuaauuguauuauuuauuuaucuuuuauuuauuuauuuuaaaauaucauuuaauguauauaaguacacuguagcugucuucagacacaccagaagagggcaucagaucacauuacagauggcugugagccacuauguggcugcugggaauugaacucaggaccucaggaagaacagucagugcuuuuaaccacugagccaucucuccagcccuauuuaugcuuuugaauuaguugaguucuuuauauuuuguaaauauuaaucccuuaucagauuugugauuaacaaauauuuuauguauaggucuucuuugcuugguuuccucuguugcacaauaggguagcuauaacuauugcuauugaaaauauaaaagaagauuuucauuauuucaucacaagaaauagauaaauacuuaaggugguaguuguucaaguuaugauuugaguguuacacuauauauguauguaagcaucauauuguacucuaugugugugcacagcuaugucaauuaaaaguaaacuaaaccuuaaagauaauaaauaaaacuaguuaaaaaugauacgaagacacuuuuguaaguuccagagaaaucacuuaaguacuaaauauauuugucuuuuuauaugugugguuuuguuuuguuuuucuucaaacucugcuguuuuuuauuuccuuggcugcaaaggcaccagucugcugaguggcgggcgggagugugugcuuguggaguggcgagauggaucagagaagaacaaagaguuucuuccucgauuaggaucuucuauugagcacaucucugucucaccugcaggagauuuguucuguacuucucacucugauaacaguaagucuaaauuucucauugugaggagguguuacaguuagucaccagcuucugaaugggaaauaaagagaccuaaaacuaguugaaaauaguagaaauuuaauguguagcuuuuucuuuaccucagaugcuaacagaucuaucauuuucaaaauuauuuuuaugaaaacaaagcuaaauguguauauuuacugcugugccaguuauauuuuuagagccuuuuaaaauggaagguggguuuuaagugggccuucccacuuucauaaguaaugacauuuucacacaaaugcugugagcucuuuggcuggaaggaaugcugcagccugugaugaagccugggugcuugcuguucuccccauccuucucuucccauuucuccucgccuagcuuacguguacauuaacaauguucaugaguacagucuauaaagcauagacuaggcggggcugcagagagcucagagauuaauagauguacuacucuugcaaagaacccuucucaguuccuagcaccuacaucaggcagcucacaaccacccauaacuccaguuuugggaaccuagcaacuacuugcacucucaugcacauacauauucauacacacagacagacaugaacacauaauuugaaagaaaauauuagugacuuuaacagaaacuuacauccccauuuucauuguccaacuaacuuguaaacuauaguuuugauuuucuaguaacacugauuuaguugaacuuacuggauuguauuguguuguggcacauuaaguaacauaaagaucugauccuugcuaccuuaauauucugaccuauucauguuuaauuauuuuccucccuguuuuaacagagauaacaguuauucaccgaaaucuugaugcaucggcaguaauucaaggccuaguuaaagguacuauagacuccaguggauaggagacccugcaucugacucguggcugcugcucuucacccacugucucucgcuucuuuugcagauaggaguauaucuacugguuugaugguugacccaagaaccaaagcuuuaguuuugaauggaaagccuggucaccugcaguuuuauucucuccagggugauaagcaguuauacaauguaagauuuuaauccauaaacuaagcuuuaaaacaagugaaaguucuuuauagugcuacugagcuuguaugguuucuuuggaagcuccuaauacuugaacauuuguacuugaacacagcugauaaugucugagauuacuuuaaugcaguugauguuagccacacaugugcucugagucacaaugauaaaggaaugagcauguguggauugacaagacaaaucugggacuguugugugauaaacugucuaacaugcaaacauuaaagcuuaguguagauuaaacaagaauacuucaguguucuugcaauaaaaugcaaucccuuuucuugugcccugcauugcucuuaacuagucaaacccuccccaucgccccacccccacauuuacuaaaagggcucuuacuacacuuaauaugguugggcaucucuaaucucaaaauccaaucuuuuuuauuuguuuggguuuuuggagacaggguuucucuguguagcccugacuguccuggaacucacucuguagaccaggcugaccuugaacuuggagauccgccugccuuugugcgccuuuaaucccagcacucgggaggcagaggcaggcggauuucugaguucgaggccagccuggucuacagagugaguucccaggacagccagggcuauacagagaaacccugucucaaaaaaaaaaaaaaaaaaagcacaccuccaccaccuagccaaaauccaaagucucaaaugcucccagaucuaaaaauugugagcaucucccugacaccacagaaggaaaaucccaugucugacuucaugugaagacaucauagcacagcgcuaaaacuauuagauaaaaucacccaugggcuggcuauguguguguacacuuggauccuagacccagaauaugucguacauuuuugcaaacauugucaauaucaaaagaaaucugagacauuuuggaucuguagcuuuucauaaugagggcuccucaaucaauaguaaccacuuuauuuucuuaccaaacacaaggaaacccauuuuaagggauuaagggaucagucauaaauagaaagcuaguuuucuuggaccauugcuuaucucuuuguuuuuauuuuuugcucuuugaaguaauagaugauuuagcccugagguuuuuuuauaaagcuuuucuuagagaaaauaugacuggaaguaaaagauacuuguauuaauaacacuuuggaccuuuuuaaaccuugucagcuagauaucauacagcaagaguacaucaaugaugagggucuaacccaaacugaacuaacaaaggcugccuuuggcugcucugggacuugguuggcaacaguugaacaacgccaagaaaaugaaaaugagcuggagcugcaaaugaaacuguggaacuauagcaagaaaacccaaggguaauccuauuguguggccaccucauuugaguuucuauuucauaguuaaaacuauauuucuguuguugcauuuugacaaauacagaaauggggcuugugguaucauucuaauaauaaagcuuuauuuuagcuuucuguuuugagaaagcauugaugcaauguaggucaugccaugucaucacauaaaagaugaaacaggagaaagaauuguaaccccacaacauagcacauuucaaggcaaauccagaauuagaauccaaaugugcccugguucuuccaccacuguuagggagaguauagacaugugucucguguucuggcaaauagcccacugcuuucuuaaagaacuguuuaucgagucuuugugccagguuuuuguuuuguuuugauuuugaggcagggacucucugucuagcccuggcuauucuggaacuugcuaucuagaucaggcugguuuaaacucagauuugccugucuaugccucccaaaugcugggauucauggcaugcaccuggcuugauaaauuucuagagaacauuguaacguaagguauugcaggauauuugaucucacuguuaaucccaagauuguguuauucacugaaaaaaacuguuucuaguuguagugugacucagccuuagcacacaccuuuaaguccuucuggccggaauacaaacaggcucuuaguacacacuuugaaucccaagcagugaagguaauguuaguauguagaagaaagcauccauguuugcacgugauaggauaugcugaccucgaaagagaagagagaaggaaggagaggaaagauguaggaggcaguuuuacugggacaguuguacagagacaggcuugcagagagaacaagcuagacacaggugaagacagaccagccagagaacgagaagccaaaagauuagaacagauugcuaaaguuaguuugaggccaagcugaacaaaacgucagaggccgaaaaagaagccagauugagucagucaucuuggagaggaguuugaaccagaacagcugaguugaaccagccagccagauggaguucagaaagaacuaggaagggugagcuuaaccuaccaguacaugucagaggcugguaacauucuaggccuaggaagaggcuagaagcuucuaugacuaggccuagguuagcagacuaaggcaguacgacaauuguaucaggugaacaaaacauacauucucacugagucuuugccccacaguuuacagaugagaaaagagacccagaacuaagugauugcuacugguccucucucuuauuacaugcucuuaacauagaaacacugugcuguucuuauacuauaaggacauagcaagcauuguugaugaagggacaguuugaauggaucauuuuuauuucaugcuuucacaauauauagggagccauucuuaccacagccauucuuuuucgcuguuuuucuuuugucuguuuuagaagaagccagaccucuaaguucuguguauuuauccuacagaaucuaguacaguaggccuucagcuaugauuugauuucuauuuauuuuucccagugagcuggccacuauauauaaugcucuguguuugagucacaccggaugauguuagaacuggucuugagacuguuagaguauggaaauuuguccuuugggguaauaauccaucaguugcccauuuugaagauauugccugauauugcagaguguuagcauaccauagcuuuucugagaauuugugguuuucuuucaacuagguuuguucuuaacacaaagaucgccaugccacaugaugaccacaucacagcucucuguuucaauaaugcagaaagcuaugaaaaacccauccuggucacagcuagcagagauggccacuucaaaguguggauauuaacagaugacucugacauauacaguaaguucacucagauuguguugaaaaauuacaguuuuaagagugauauuguccgggugugguggcgcacgccuuuaaucccagcacucgggaggcagaggcaggcggauuucugaguuugaggucagccuggucuacaaagugaguuccaggauagccaggacuauacagagaaaauacaaacaaacaaacaaacaaaaacaauaaaaaagaagugauauauuuauauugacauuuaugucuuuuuugagaagguguuuucuguuuugguuaauucuauaaacuguugcuuaauuucagcaacuauuuuucauguuaaauuuuuacauaucuuuccaccagaaucugugcuuugggcaaguagaugggcguuuugugucuguuucaugcagcauaaaggguuccugccacuaggugucucucucuuucuccuccacuagagggagcucaaggucuccaggaaggggaaaaauaccugucaguagguuacacuguuuacuuagaacaguuguggggaaucugggauuuuguuauguuuuguuuucuuuguuuaaccuucugcuuauaaccugccucuuaacauuauuucauauuuaugccauuuuuguuaugguuucuuuuuccacagaaaaagccauugcuuggacuugugacuuuguggguaguuaccacaaguaucaagcaaccaauuguuguuucucugaagaugguuccuuacuggcaguuaguuuugaggaaauaguuacaauaugggacucacaaacaugggaacuaaaauguacauuuugccaacgagcugggaaaauaagguagguaaauuaguuuguauugcuaccaauguauguauguauuuuuaauuuaaaaagccuuuaagcuucaguaauaauguauguuuuccccaaagagguaaucaauaguuuucuggggaauaaggguaaaacguuaaucaaaauguugagaagcuguaacccgugaguucaugaguaguuuauaagcauuucuuacacuaggauucacauugaacuuuuguacgcagcuuucuucgggauaguaaacacuuucaugaggguauuguguaaaaacuaagauaugcuagccaugguugauccugaccugccagucuuuaugcauucccuuaaaaauacaauguaauacucaaacuaauacguuugguucccagaccugaggacaaaauaauaggcgacuaauuccgucucauuuuaaauauauaagguuuuguuaaguggcaugaaguucauaaauucuucuuuguggcauggauuguuacgugaucgaguuggucauagcaucacaccuguuuuccuaaagaagugcaaauaccuacauaaccccuuucuauuggcuuagcaucuuuuccauugcuguaagaacuagaaacacaaaaagaauaaaacuaugccugcuuauaagucuguauugaguagaacuaaacgcaguggucuaagccugcaguucuuugucgcuaaguguacuagagcugccugcugcucaucuuuuaugugauuuuggccuaggcaccuuugcuuuggaagacugacaugcucaaaguaucuccucggcacuacugacaauggcauucucugcuguuggaaucugcucaguuguucaaguaagcccgugcgggugggaugcugcagcuagacuuugaccguuuaggaaacaaggacccuguuuucauaucuuuacccguacaauauauaauuuuuuacuuggccaaaagugaauucaaggaagagcucuguugauuguaugcaggaucccagacuguguaauauuugaaaauagucugucacaguauuccugaaaaaugaggcuuugagagcauuuuacucauguggacagggggaagguaugauguuauuuccuaaugaaugugaugguagucucugucacccacgucuaguaagaacagaaaagcaucagccaugagucugaaugagccuaacuuuaaugcaguggguggaaggaauacugaaguucauuuugcaguucugcguccugaugcacacuucacugaccccuccacaggcaaugucaguguguaucuauuguuauugaaaucauagacccuuccauacaagcagagcgcugagcugucccagggaagauaaagaacacuugauguaaagacuuccucuucucagcagugugucgcucuucccacaguacaguggagugcaaaguugaauguuagaguuauggaacccgacccuuacucagaccauguugcugcaguggcucagucuucagcgggcuccgaucguaaguacugaacgcucucugauagcgugcagcuuguugccuagguuuucuuuuuacucuuuuuaguauaagcugagacauagucgcuuugagucaggaauucaaaugcagcuguuugucuggggccugcucauccucucuuacccaacaccuguaauauauacacucacacguauugcuaggacuacucuaguauagcccugacuuucccacaagccuguucccucucgggcuucagaaucuccccugcugguuagcuggacuuccucugcuucugagacaaugucugcaucucuuucuugguacuucagacaaaagauuuguauaguauucugcugucucuuaaacagauacccuggucccuggaacagaaacuuuucguuuucagauuuuaguccucguuccuaaccuguuuggugcauacuaggcacucaguggauaccugucccacagcagucuacgcagggccauugacucugugggcugggaaccauauuagugugaucugccagccugaggcuagaauauuccucugcagguaaaaugacaucuaucuguuuuuccccuuuaguguuuguauuuaaaccuagcgagccaaggccauuguauauucagaagaaugucuccagagaggaaguccaguggggaguguuugucccacgagaugucccagaaucauucacgucagaaacgcaccaguggcugaacagaucucaguuuuacuuccuaacgaagucacagguaacugucucccaccaaacggguggccuguuuauagaaauaguuuuagaacguuuguuuuagguagaacucuuucguuagagguuuauuucccaaaagaaaugguccaauaaguguccgugcaucaguauuaagaaugugauugcgguagcacugucccccacaccuuaaagcuuuguggucacagaagggacucuuuguguugacuuuaauucaguuagcauuuuccccuaaguuuaccauuugguuugcuguugaagaaacuuaacuagugucuuuuauuuuguuacuggguuuuacauuuuucucagaacauggucuuguaacucccacagaaccuuucaaagaaauuuaaaucuuuucuuugagcagauguauauaucaaaauggacacuuuaagacauuguauaaucuuauuucauuugcaccuccuaauguauauuuuguuccaugaauugaucugucuuuuuagagcuuauuaacauucaguacaaagucuccagaagagaaacucacaccaacaagcaaacagguaggccuauuuuauucauuuaugauacaugcuauguuguuuuucuaaagaaaaauagcuuuuagaauccaucugugacaaacgugucucagugaguucuaagaaggaauuguuaagugcgucccuggaaccgcugcucugcuccucccucacguuuagagaauaagaagcauauauagucucguguuuuaaagacuuagccaauuggccugccacgucuaguuugugggauguaauuggcuaaauaaucaguuguagaugggguagggugguacaugccagaguaaaugugcuuagcuuauauuuaaaugagaucccaacccacucuguccacuaaggaucuuggauuuuguugucugaauuauuuucuggaaccagccagcccuccaucaacacugaggggcaacacuagaucaucauuauagaaacaucuuguaauugugguuagaguuuuauuuacuagcuugaaauucauaucuccaagaacguguuuagauuauggauucuggauuuaguuaucuguugaauuuauugaaguucuggaaugcugaaaguuuguauugccuuaacauagaaaugcauucauagccaggcaguccacauacuuucuuuuugugaucaacuuuuucccucaugaaguuaauuacugcugccuuuuuuucuauuagcuggguguuuuguuguguuuuguuuuacuauuuaauucuucuccagacuuuauccaaauuauuggggggggggggguuuccagaaacauauguauucuuucaagucaugaaaacuuuucagacccauggcugacuucauucuggacuaauuauucugugaaucugcuaacagugcucauccuagagccugugcucggcauucugggauucuuuucaccgcugugacacuaggucccauagacuugcuuucuuugcucacguacguacuuuggugaaaccuguucuauucaaacauggcuuaucaccuugcugaacuuagggccuugcaguuuuggaaguauucucuguucgcuccuacuuguugauuaguuggguauaaauguaaacugaaaaccguuucucggcacuuugaggugcuggacaaagauuauguagcuucugacguucuucaucuuugaccauuuaccacagcuugcauaaugucuuuugaaaacucauugaauuuacucacauuuuuuguuaguaaucagcuauaugccaggaacuguuauagacaacugggauauguuaacaaagcagccuugucuguuaaaaauggguuuuuuuaaagauuuuauuuauuauucuauguaaguacacuguagcugucuucacacacuccagaaaagggagucagaucucguuacggauggcugugagccaccaugugguugcugggacuugagaacucuggaccuucggaagagcagucgggugcucuuacccacugagccaucucaccagcccuaaaaauguuuuuauagaagauacagauguuaaacaacaaccaauaagucaguaaaauauguaguacauuuuagaaaaugaaauauagcaggguuggagacaggaaaggugagugaggugugucuugggacuuuuaauggggagucaagguaggcauuacuaaguagcuccagcuuugcucucaugcagugugcagaucccaggagagcuuugaauagguaacugacucagaagguauuuauuccaucucccacacagccaaaauugcccucccuggcuuuuaguuuuguuuucuuguuuguuuggguuuuuuguuuuuaaaaagaauucugcuuagucccauccuuguacuguauuucaguuuuugccuauuuugugggcaguuuugucauguguaucaacaacacacacaacaccccuugcuuuugucuuagaauauuguuuucuugacucuacuaagguuuuauucuuuaaccugcugcauccuuccagguugucgcugugugaccuugccccaguucuuugccaguaugagcauauggccucugaaaacacguuccuguaaucuuuauaaucccuagcaaggaaggcaugguucucucauuagugucuuuggcuagcuuucccauguagaaaguggggcacugggcaucaguugcuuugucuauggccugagaguaacaucaugugauuucaagcuuuucaccagagucauuuuauaguucagugacccuuaaccuguucagucaaagaauuuccaucuuuuuauugaaauaauuuccucuucucuuacauccauacagcugcuggcagaagaaaguuugccaacgaccccauuuucuuucauauugggaaaacacaggcaacagcagggugcaaaguuaacagaaacuucagagaaugaacugguacaacuccccuuaacagagaacauaccugcaauuacugaggugagugaucaguacugcagauccugggagacagaacagauacagugauucgucuuauguccacacgaguaaggaaccuuagugggcugaugcucuccuguaccugggugaggagaugggaccacacagugcaggaaacuggaaguacuauuuacuuugguuugguuuuucuucggggaagccuguuguguuuggcugaccauuuagaauaaaagauauuaggaggugaagccacagugugccagagggugaucuuucuaacaaacugacuuuucugugugccuauagcuucuucacaccccagcccauguccugccaucagcuucuuucuugugcucucuguuuguaaacucgcugcugcugucuaaagagacuaaaagguaagaauucuaggugguuugucuucugaguuguuugggagugucaucuaccauauuuguaucuuaccuuugaaauguagcuaaugacauaagauuauuacaugcaacacuugugaagagcugaggaagagauguguguacugcuuaaaguuguaguuccacauuuuuuuaaguucauuugcuuuuuuuaaggccugugcuccauaagggcauuuaucacaguguuuucaguugaguuguucugucuauauauuauuucaacaugggugucuuuaauuaaaaagaccuaauuuggauauaucuaaugguauuuauguucuguuauugucaaagugcugaagagguuccugaugauguagauauggagggaaacaaagaaagugaugauucagaugaagaguaugaucuuacugaaaaagacaaggaaacaaauaacaacacggacuugggagaagaugcuauacaucagcugucaaaaucugaagagaaggagcugagaaaguucagaaaaguagauuauagcuggcuaacugcucuguaguaggccauggcugugccaugacaaagagacauguuguacuuaauguuuacugucuguuaauacuccaaaaauuuuuauaaaguuauuuuauucuuaagacaaaauauuaaagccuuguguuuau

SEQ ID NO: 152 - RNA, 644 nt, Mus musculus
auuuuauaaccauaauauuugccacuuuuugcauugguauuauucuuuuuuuuuuuuugagggcaaagagagcaaauuuuauuuggugaaggcaaacaucauccaaaagaaaccaaaugggcaaggugcugugacaggggagccucuggagccacacagaaaucacacugggcaaggaacagacucgggauacagaauguccucagccauucagcaccauccggacaagcucuucauaguugaugcaaccauugcuguccucaugccccgccacuagcaucucuacuucuuccuuugucaucuucucgcccagugugacuaggacaugacggauuucagcacccaugacggugccauuuccuuccuugucaaacacacgaaggccuucaacauaauccucguagguucccugguccuuguucuuggccacggucugcagcaugggcaggaagugcucaaaguccagcaccuucacauucaucucaucacucuugggguuccccaggaccuugagcaccucggcguugguaggguucuggcccagggcccgcaucacauccccacacuggcuguacaggaucuugccaucaccuguucggucaaacagcuugauuacugccggaaaagguccagcagagcucauc

SEQ ID NO: 153 - RNA, 644 nt, Mus musculus
gaugagcucugcuggaccuuuuccggcaguaaucaagcuguuugaccgaacaggugauggcaagauccuguacagccaguguggggaugugaugcgggcccugggccagaacccuaccaacgccgaggugcucaagguccuggggaaccccaagagugaugagaugaaugugaaggugcuggacuuugagcacuuccugcccaugcugcagaccguggccaagaacaaggaccagggaaccuacgaggauuauguugaaggccuucguguguuugacaaggaaggaaauggcaccgucaugggugcugaaauccgucauguccuagucacacugggcgagaagaugacaaaggaagaaguagagaugcuaguggcggggcaugaggacagcaaugguugcaucaacuaugaagagcuuguccggauggugcugaauggcugaggacauucuguaucccgagucuguuccuugcccagugugauuucuguguggcuccagaggcuccccugucacagcaccuugcccauuugguuucuuuuggaugauguuugccuucaccaaauaaaauuugcucucuuugcccucaaaaaaaaaaaaagaauaauaccaaugcaaaaaguggcaaauauuaugguuauaaaau

SEQ ID NO: 154 - RNA, 761 nt, Mus musculus
uaucaaggguauagauuccccaaaucaaugagcaagggggugggccaauccgucagccaggacccagauggugacagcauucacaaacauaagaccacccacgacuacaggacucuacaauagaagcaccgaucagugccauuauucacauuguaaggauaaaacaucacaagccaaaaggcuccauugggaaugugguacccacagggaugcgggauuugaaacuccaaugcuuugugaccuaugucaaugccuccccucccgucuucugcuuccuuggcaagcuaucuccgcagauguuaggugcccacaacacuggggucaugggcugauuccggaaguguggaaucggagcagugguacaggaaacgauuuccccagcagcuauagcagaugagaaagagggcugccaggaaaaccaaggcacauauugugcaagguuuacguuccaggaggaagcugagcagguagaagcccaugaacauggaguggcugaaccacagagcgggguugaggggcuuggggaugaggaggacgggcagcagacauuggaggcaauacaugaucucuacugggcagggccuucaccaaggcugccagguaccgcugcaggaacugaccuaaugggagucagcaggcauagguggcugcccuucguuuucuucgacucucucuccaggagcugagccacuuugcucucuggcugucagccgggaucaccaaggcugcagggauccugcgagccugccauggcacugccg

SEQ ID NO: 155 - RNA, 761 nt, Mus musculus
cggcagugccauggcaggcucgcaggaucccugcagccuuggugaucccggcugacagccagagagcaaaguggcucagcuccuggagagagagucgaagaaaacgaagggcagccaccuaugccugcugacucccauuaggucaguuccugcagcgguaccuggcagccuuggugaaggcccugcccaguagagaucauguauugccuccaaugucugcugcccguccuccucauccccaagccccucaaccccgcucugugguucagccacuccauguucaugggcuucuaccugcucagcuuccuccuggaacguaaaccuugcacaauaugugccuugguuuuccuggcagcccucuuucucaucugcuauagcugcuggggaaaucguuuccuguaccacugcuccgauuccacacuuccggaaucagcccaugaccccaguguugugggcaccuaacaucugcggagauagcuugccaaggaagcagaagacgggaggggaggcauugacauaggucacaaagcauuggaguuucaaaucccgcaucccuguggguaccacauucccaauggagccuuuuggcuugugauguuuuauccuuacaaugugaauaauggcacugaucggugcuucuauuguagaguccuguagucguggguggucuuauguuugugaaugcugucaccaucuggguccuggcugacggauuggcccacccccuugcucauugauuuggggaaucuauacccuugaua

SEQ ID NO: 156 - RNA, 446 nt, Mus musculus
gauggagaggggcagggacaggaacaggaaggaggaggaagaggaggaggagggagagauggaggaggaggaggaggaggaggaggagggggaagaagaagaagaagaagaagaagaagaagaagaagaagaagaagaggaagaggaagaggaagaggaagaggaagaggaagaggaagaggaagaggaagaggaagaaaagaaagaaagaaagaaggaaagaaagaaagaaagaaagaaagaaagaaagaaagaaagaaagaaagaaagaaagaaagaaagaaagaaagaaagaaaaagaaaaaagcccaaaaugaucccauggugcuuucaugcuuuuaauguguacuaccugaggucaaauccuaaaggagaauuauauuucauaauguucaaugaacacaguuauugucuguuucauucuguuugugaauccauacguuaaa

SEQ ID NO: 157 - RNA, 13463 nt, Mus musculus
aaacuuugaaauaaacuucuaacauuuauugauggcuaguaggaacuuuaguuucauaugguuuuaagaagcauaacagaaauuucuagacaagugacuauuuugaauuuuuaugguauuucgugagugugaggcauuugcuaaaagccacaaagugcaccuaaaauagggcauuucguuguauauaaauuuacccugaaacuugaaaauuccaaugaacagccauguuggaauauucaagaaaaaucuacuguuugaaaugguuccagauggauugacugauagauggaaaguuggaugcuaauacaaaauuuaaaugaacacaggugucuguaaaguucaauauuuuucaaaaacuguugaaaacauuauucaaggcuguaguuauaagcaaauugcucuacaccugcaaauacacaucaugauaucuaaguaggaaugccuucuaguguaccugcugccuauccucugacccacugaccuuguccucuagcccaaacguuugcccacaagaggucccucuucggcuacacuuucauagacagauugaggccccucuugggcaaaggagaaaaaagcugugauccauuugacuaguuggucagagcuuuguaaugaaagccaacccuauguacugucacagcagaucagcaacauacaugcuuuucugcaccaagaaaauguacaaaaacuuguaauuagaaguuuucaauuggaguugggcacgguaguucuugccuugucuguguccggaagaucaacagcucaagcccagcccacacuacauguaacucaccuccaauauuuuuuuaaacucauaaauuucuuguuauucaauuaccuuuuucugaauuaucuccaagugguauggagaaaugacaguauucaucuuauuucugaucguuauaaaggguuuaauauuuguugagccuugaacauggacgugcuuuguauacacuggcucagauuccucaaauagugcuuuauccucugauagacucacagccaugaagcuaguacaauaacagauacaggacucaaaucaagaucuuuccagcucaaaauuguuuucacuuuacauucuuacauuugaguuaugauaugcaaaguucauauaacuacaaaaauagcaacagucauuuggcauuuaaaaaaaaaaaaaccugaugaaauaguuccuaagaacuucauguucuacuucauuuucaccaaaaccccauuuuuagcaaguuuucacuaacacugacaguauuaguacagguuagggagaagacucaagagcaccugcugcucuuacagaaagccugcguucaauucccagcacccaaauggcggcucacaaauaucucaacuccaguugcaagguauaugcugcccuuuucugaccuccacagucaccaggaacacauaugguacacaucuaaacauucagguaaaaguccauuuuuuuuaaaucuugaaaaaacaaucuuggcagucuucauaaggagauuucccaauuuccuaugaucauuucuuaaugucaucuauuuccuucauaaaucaaaucaaauuuauccuguuggguaauggacuuucuccaccuuaaacuggcuaaaccagauucagccacagaaacuacacaguaauuaccaguagauggcccuagugcugacuuuuguccaaauaguccagcaacuugaagucuuagugcuaaauauuucaaacucaugugggaacugugccuaaggugggauugaaaucugaagaugugugcugugugcauucaguaacgucaaugcuuccaaccccacuuugacauuucaucuuuuucauugagcugacagaagacacaaacauccacuuccugggcuaagccacagaacauaauggucaggguggaaaagauacaaucucggcuuuaccuuuuuuuaaacuauuugaaaauuauucuuuguaugggguacacuguagcugaagguaucaaaccccauuacagaugguugugagcccccaugugauugcugggaauugaacucgggacuucuggaagaguagucagcacucuuaacagcugagccaucucuccagccccagcuuugcucuucuaauuucugugauucuacuuuaaccuaauucaaaauuuccagcacuccuauguagaggggcuaauuauuucuacucagaaacacuugcuucaguuacucugugcuuuggacauucuucuaguacauuuuccacugcucaacacaauuuaguacauucuagauuuacgggaaaggaacagagaauucgaaaauaaccuccuuguaaaagagagacagcaagaacaguagacaaagcucuccagaguguuugaugcaaguucuaaguucccuuccagauaagaguggcaauccacccuucugaaaagcuucauguaugggacuuaaaaccagauuuucaagauuacuccaucguuugugaacaagcuguccuagcuuggauccagauguuuuuaaucuuagaaggcauagaaucuuuaauuucuagcuugaaacaguccgcuuuuuaaaauaugccuauagcccuucaguaugggugugucaauaaaucugccgaacuaggcuacuacagaacaacaaagaacugucacccacuuccuaauguuugggguauaucauaaaguguuggauucuauacuuuuacucuucaaauggcuaaaagaccuacugguugaaauguuauauugaacaccucacaaagguaaaaacuaggucuuaguaguacuuuugggccuaauguuaguguggaaaaaugcuuauuaguaacuuaauggacuugaucuugagucugauuuguguuuucagaaauauuaagucuuugugcauaacaaaacuuggcauaauuuggcuaaagcuuucugauccaaauucuaguauauucccaauaaagcaaaccucaaggcaucuagcaaacuuaaauauaccuagaaaacaaucuucuagcuucuuccuugggauauaauaauacaucagugauagugcauuuccaaaggucacaauuagguguuaagagaaacaugccugaaguguuaaucauuacaaccaugagauguggggcuguuuaaucacucccacuuguaaucaaugucuaggguuucagcacacaaggaucucaucaugcccaaguaucucucuguaucuaccacuuucauuggguaagagaaagagaacuaaguaucaggcuuuaaacaaagagaggcaagaccucagugaggucagagcuagcuuggcacaugccuguuugggaaaguguuuccagugcuuuucacagucaucagaaccucacgagucacacacaaccuaaauuggcuucaagcaaacagccauuaugcucacuagcauaccuaauaggggaagcauuucagcaacuccacugacuguaaagaacacucgggauguaaucucaaguuuaaaaaaauaaaaaaggagugaguuaaccuucaaacuauccuuuaaaaauuaaucacucuucauguuuaacacaguuccuaagacuacuaagaaaaagcaaaacagaguugguaaaguaagggaaacuauacuucugugauggcucagggguuaagagcaguagccguucuuccagagguccugaguucaaucccagcaaccacauaguggcucauaaccaucuaugagaucuggugcccucuucuaacacacaagcauacauacacacagacuacuguauacauaguaaauacaugaaacuuuuuuuuucuuuaaaaguacuucugcaaggcaaacuucagccuuugggcauuuagacuuuacauuuuacuuucuauccuguggcaacucccugugaaccuggccagaaaaauaagggacaaggcuagucugaucauguguuuguucuaauccagaacugugccuagaaacaguaauggggacccaauccuagaagugcauuucuauauuauguuuuguguuucacugggucuuauugaaauuugucaucguugauaacugaagacaccagagaggaggaagguugacacuuuuuucaguaacuucuugaugagugguauccaagcagacuggaaaggcaauuauucauuacuguuuggauuucacuugcuuugguuuuagaaguuuuccuuaagaaaaaagaaacuuguuaauacagaacagguaaaauuacugagacaaguaucaguuguaaguaaaauccuaggcuauuuuuugauuaaaucccaguaucucaaagcucggcauuuccucuauuaacauuuugaucacaccacaagauuugacugaucauucaccagaaguuauugucauuaccuagucaaaguccuaaauccacaaagguuuaccacuuguuucccucaucacaacuugccuagcagcaucauagguaugaaaacgaagucagaacugagggcccacugagauauaccucaccauauuaaaaucuaucaaaguucaaauccuuucuuuagaaucaccuuuuaacaccauauuguaccacaaauaaaaguucuguuacuccuauaucuuaaauuuuuaagauuaguuugucauuuauuuuuauucaaaacaucuauaaucacaaaacacaagcuaucuuaacccuuaacuuuuuugaaacauucagaaauguaaacaaaaaaucauaaggccaaauuagcuauaauuauuaauauaugaacaaugacaaaugucaaagcccuguaccuauaaaccaaauuccuugugacuucucaaaaugcuaugauaaucuccacacagagccuaaugcagugcuuacugaaaaucuguuaaaaugaauuagaucaaaaucugacacaaauuauauucaaaugcuauacaaguugaacagaaacuuacuuauuuuacaauaugagguaaggagaaaugacagguacagaguuagggagcagucaagcugaagaugaauacaacuucaguaaaauggacugggcucuccauguuuacugaaaguaaaaauaaguagguagauaugucaucauuacagcaaguuuuacucaagagacaauauuuaaggagagacaaauacuaacaaugaaaaaaauuaccaaucacccacuguaagugauguuccaucacacaaaucccaccucaacagaaguauaaucacuucuugagccauuuaacuuuugcuaguaaggcuaugugacuuguucaaaaacuuuaaacacacacauuccuggaagaaaggaaaugccuacuucuacccgacuacuugcaacugguagucacauggcuauaugaauuuaauuugauuuguauuugcuauaguaacuaccaugaguauuuuuuuaaaaauaaucagauuagccuuguguggugcuacacaacuuuaaucccagcuccaggaagagagaggcaggucaaucuauaguucagagacccaccugauauauauauauauauaacaaguuccaaccaaccagggcugcacagagaaagacccugccucaaaaauacaacuaguaucaaugagaccacuguccaauaaagguguuauagcucucuucaaucccuccaauuacacuucaauauuuaacaugguaacuucaaaaauaaagcauucagggacucaguuguaaauuuuucuucaauguaaacuucaauguuugcaacaaauguuaagagcaucaucuuaaaccguuuucuucuaaaaauuacuuguuauauuacauauuuuauuccauaauucugaugaagaauuugguuaucuggucaauaaacaagaguuuaggaugauucugauucugucugugaaaaaauccuuauggcaggcagacacucuagggagucaagccauuccuagaucaggaauacucaaaaauguugacaaugcuguccaaguuucuggcuuggggugguuauugcuucagguggcaauauucaaguuuaagacaaguuccauuaaacauuaugacaaacauuacaaaguuuaugcagaagccagacucacagaggcuauauauaagcuggugucuuaaguaacucacccucgaaacagggacagguuuucaagugauacccaguaaguucuugcucaaaaaauaaauguuccugcuuucagaguuccuauucuucaauaggauguaacugagcaguguaacaguuuuuucaguaaaaaccaaccacucuuuucaacaaaccaaaaauauaaaaggaaacccguaagagacaaaguuuucacaguuaagaauaaauaaaagugcacuaaguguucaaguaggucauguaguuuaaaaacuacaugugucucuuuggcuuagaucaucuuuuaaaggcucuccucggaucucuggcguuacuuauugugguccugacuguuugacuacuagguguuccugguagcuguggacugauaggucccggaccauugcuucugccauauggaagaugauauccccuagauucagggccagucugaucaccauuuccuaagaacacaaaaaaucauuuucagaauugguccauauuaugcuacagacacacaaucauuaaaguucauccacacacuaugaauauuuacaaaucccaggaaaaaccagcacuuuuauucuauaacgcaaacaugugagcucugggcuggacaaguguauuaacaaauacacuacuugguacugaaugaauagaagagagaaaaacaaucugagccuuaagauuaagaauaaaguauaaaaacaaacacaccaaaaaaaaaauuaauugcagagaaauguuugaauacugguguuugacucaaauacaauuaauguuucaauguaaucaagcuauuggcaggcagguuuuccauaaugugagcugaucaaauaagccuucggcuacccaaaucaacuccgauuacagcaagauacaucucaaaagacauauccuagguuacuuaaagacaaaagacuuuuuggugcuccaagaucgcuggugaggggucuggggaagacaggcugcccuguuuaaaacggcagcuaacuaagaacauguagaagguuaagguauucacugacgccuacucuauggcaccauuugucuggauaguggugugccaaaacaaccaauaauucugcacacauacauuauacauaaccauuacaccauagacauugguuaacuaaaaaaaaaagaucucaucagacggucacuaaaauuagucugguuacuaaucaguguucagcauaauagguuccaguguuuaaauaagaaagugcucaauauaccggcauguacaaguaucuucuaucucccccaaaaucuuuuauuugugcauacuuguuuacuaggaguuucucuuuaacacuaaauuauacauuaagagauuuuuuuuuauuuauguuucucauauaaugucuccaugucuuacccacugguccaaauguauuggugcucaguuuauccuucuguucauuuuguaccuaaaagacaaaaguagcacauuuauaaaguaaaauauauauauuuuuuuuuuuaauuucaagaguuuuaaaaaugauuaucaauaauauuuaaagguuuguccaaauccauucaauguuaaaguauucagaaaucuuucucaagucugguauaguguuuauuauacucaguacugccugauauuugcuucaguuugcaaaguaucuaaacagcaugugucacaaauuauguauguacucacagaauguaauaaaagcaacuuuaaagauuucuuuuuugauagggucucauguaccucaaguaggccucaaacuuguauguaacccaggaugaccuugaauuucuuauccuauuuccaaccuccugagaaacuacuucccacgugccccacuauguuugucuuuggcaguacuugguagcugagccuagagcuuuaugcaugcuagacaagcagccaucaguucggcuacauccccagugcucaagaauaccuuauaauucuuuucauuucacugugaacaucagacgcuuacccuacugacagaacuaugguccagagucaacuuaacccuaucauaaaacuacaccaaucacaaaaguauaacauauuuuuagauuaauuaccccucuauucugcuguccucuauaaucuggguuuggcucacugaaauuuggcacuucugaauacaccauacaaaaucugaaagaaaauaaaggacaaauuaaaugaucucugaaccuuuuugcauaaucuccuuacaagaauaaaaaccuuaagugucaaaaaaucuccuuaacaguagcauguuaacuaauuaacuuguaaaauuuccaaaauaacuagaucccaaacaaaauagcaccaaucuacuugauucuuucaucgaaucccucuuuugcccaaucacugugaaucugcaaagauaagcaucaaagguaaagaauucucaaugauuaagaaagauauugggcuaggacuucuuauaggcuaagagcacaacuugauauccuguucacauauaagaacauucauagcucuucuauucuaaaaagaacuagauccaguuugggaaagucuuaaauugacccugacaaagaacacagccaugaggaaaugaguaauuuccugugguucuucacuuaccugaccuccguuauuguagaaucucuguauccaugacuaucuagccagauccuacaauucugccccaaagaccuucauaacacauuacucuaaagagcauuacauuuguacuuacagcaggagucccaacaaucaccuuccugaugagggugaagugguaacccaaauucugauguuuaaucagacuacacuuuuucccuuucauauuaaccaagacacaauucaucucucucucuccucuccucuccuccccucccuuccuccuccuccuucuucuuccucucucccucucucucucccucucccucucucucucucucucucucucucucucucucucucucucucucucgcucucuucucaguucuauuugugacuucucuuuuuaaauauccuccaaucuaaugggcacuaagauauaccuaagcaucagcaaccaaaaagucuagacuaacaaucugaaucauuaugggugaaacacagauagcuaagccagcauggagaccaaagcaccuuuacacucccauauguuccugcaggucggggaggaagucauuaauuaccagguggcauacacuagcuguggcugcuugaacuguacauagaauaggacaaacagaaggcuucaacugucacuguugaaaguccauuuaacucuaauacaaauucauccauagagacaaugaauauuuaagcuauagauugaaacccaucucuagauucuauuuuaguaaaucaagagcguguacuucgaaugacaccugaaaaacacauuuuucuaaaguuaaacaggaccccacuggggcuggucuaaacacaggucugcuaggaaaagcuuaccuucucaaagggagcagaccugauaguguuuaaaacaguuaccuaccuauggcauaaagccaagucuccaaaggcaaaauuaguggcuuauauauaguucauacuuaccaauuauuuuguagacauuauuugaaauuuaauuaaacaaaaugcacuuuaauacuuacucuccaauuuuuugaaguucaccaccucuuccaguauaaagugucaggcauccuuuccacauugaugcauaccuagagggaauguauacuuuuauacaugggccuacucaccaugucaagucaaauacagucacuguaacuguaacucuaauaagaaauuauacaaagaaaauucuacugccacauuaagacaucaucauagcugucucuugugaggcuaugccagugccuggcaaacacagaaguggaugcucacagucagcuauugaauggaucacagggcccccaagggaggagccagagaaaguaaccaaggagcugaagggcucugcaacccuauaggaggaacaacaauaugaaccaaccaguacccccaaaagcucgugucucaagcugcauauguagcagaagauggccuagucgggcaucauugggaagagaggccccuugguauuucaaacauuauaugccccaguacaggggaacaccagggccaagaaguggaaguggguggguaggagagcagggcaggggggaggguauaggggacuuuugggauagcauuugaaaucuaaaugaagaaaauaucuaauaaaaaauuggaaaaagaaaaaaaaagacauaaucaucuaaauaacaacccuaggaaaaaaauuuuuuuuuuacugcuagagauggaucucaggccuugaacauacuaggcaagcacucugucacuaaguuauauuccuagaacuugauuuuaaaccugauuuuuaggcaucucccuaaacugcccagguugguugcucuguagccaaguagcccccaaccuugccaucuuccugucucagccucaggaggaacuggaaugcauaguuugauaaaaucuugaccaggcaugguaacacacauuuugaaucccagaacugagaaaacugaaacaugaaaucaaauuugagcuuauguacaaggagaaugaguggaaagaaguaguguucugguaaaguacauauuuauuguuauuucuagaugauuaaugacuuuaucagcaguuaacaaaagauggguuuuuuuuuagugaagaauugguuugauugguuaacuaaaguucaccuuaaaauuacuuuaaaacagacuauuucaacagaagaaauaucuguaaggggcucaacaguuaagaauaccgaacugcucuuucagagguccugaguucaauucccagcaccacaugguggcucacgaccaucugaauugggauucgaugccaucaucugguaugucugaagacagcuacagugugcucacauauauaaaauaaacuuuaaaaacuuuaaagaaaaaaaaaaacaucuguaaaauucucuccauuacaguuagaagaacguacauguuuucuacucucugaagacuggcauggguauuaacaccugugugaagcuugguuaaggaggagaggagccuaggaaggggacaaaagacacacucaaagaaauagaauucaaaguguauucuaaggaggagcuucuaauaguaaaaauucaguauuuguauugccuuucagccacaagguacauaaagccaacacaccagcauugucuguguuacugacauggccaaggaugauauaacaguacuaugucuacuucugcagacagcaguucucaagcuccucaaaguuuggcacuuucuaaagcagcuauaaaaaagauagaccacuaaucuucuugcccugcugguuuccccaaauuuugcaacuuuuaauaucaacagaaugaaaccaauuguuuagugugagcaauuuuaaaugugaaugacaucauuaaaucuagauuagcagaaucagaccaaagucuggcuuuuucaauguuucuuuguacaacuaccaagguggguaacuucauuaaaacauauauuaugauuaguauuaguauuguaguucuccccauaaccuccaaaagaagugauuuuugggggggaaaagacauggacguuaaaaagauguaauuuagugucacaaugacucaaugucugagaauaagaugccuaaauucugacucucacuuccugcuuugaugauaccuuaccucacuuccugaaaauguuguaaggccugugagauaggaucaaagaacuccugcccaaagacucaauacuucuaccauucucuuagcucagcagcaauugucaacuauuuuucugauggcuaccaauaaaauuauuacaauucucccaaucacagaagcuuccauauucuacuuuuaagauucuuuccugaacuuuucuuaaggccaacauuugguaagauuuucaagucuaugaaaaaaaguauuccaacuccauaaccaacuaaauacucugaaugaaucaaagauuaacuucugccacuguguauuauuuuggguuuugugaaacucugaucuuacagaugaaaucauuuucaagaaugaguauuccagauauucauucauguccauaucacaacgaugaguauugaguacaaaaaaagguaccaaaaaaggaaagggguggaagacauuauacuucauacacgaacugauuaaaaaggaaauguguccaacugguguggcacacagaacugauuuccagguauaucucugugaguucgaggacagacuagucuauagaauuguuccaggacaaccagggcuacacagaaaaacccagucuccaagaaaggguggaaaggguaaugugaucuuuuaucagccucacugauaaaugcucacugacuuccacacgguauucucaaaaauaaaauuaaccuuuaaaauuggaggggaguuaaaucccuaccuaaaacaaauuagcugugaaggugagcugcucccagugagguccacuaaaacagcucccuucuugaaguggcccauggaagagccaaacaacuucagaaccccgaagucggccaaacccacaccuaccccaauuuaugcacaccuacccucuggucaaccgaauaauauccccugucuguaugagcccuccgaucucaucccacacagaaauagugaugcuucccguucuaucagcuacuuugcaggaucucacuucauggccgucuuugguuuuggucacucguccugugaagauuuaaaaaucaaaaaggggagaaggaaagguguguuagauaaggaguucauucgagggagcucuuucacccuccucuggcucgcuacgugacugacuucuguccccggguaggauucugggccaggagcacguggggucgcgggcggggaagagguccgagcucucgaggguguggggcgggcugcggaccucacuuaccuaucuccaggacaauaaagacgacauuuaaguuuuucaguccggccuuaaugucuuuuauaaaaaguggagggucguugaccccgugcauacugaggcaggugcggcuacgcuucagagacccacuaggcaaggcuucccacccucggggaggggcaggggcagagccggggagcaaccuggggcaagauuggcgaccggggucaggaagcgguaauucaggggccggguaaaccagcccuagaggcacggagccaaaagaaaauaaaaauggaaaagggaggggaaaaagacucucacaaguucaaaaaaaacaaaaaaccaaaaaacaaaaccgaagacgcacuccgcacccugagcccgcucccaagugggcggcgagcaaaccagcgugcgcacugccgccuccgcuaagggaaaagggaucaggagacggcccugcccgagucccgcugucccucacacaacacacgcacacgcgcgcgcccccuccgucccaggcucagggaagguacgugacagcaaaacggcaaggcuguucaccaaccgcgcagcccgcgucccaagcagcaacuggcgaacgcucccucaggccggcuuua

SEQ ID NO: 158 - RNA, 758 nt, Mus musculus
cuuucgucuggcggcagccaucaggugagcaaagaugggugcauacaaauacauccaggagcuauggaggaagaagcaguccgacgugaugcgcuuucuucugaggguccgcugcuggcaauaccgccagcucucugcacugcacagggcucccugccccacccagccugauaaagcucgaagacuaggguacaaggcuaagcaaggcuaugucauuuacaggauucguguccgccgugguggucguaaacgcccaguuccuaagggugcaacuuaccgcaagccuguccaccaugguguuaaccugcugaaacuugcccgaagccuucagucuguugcugaggagagagcugggcgccauuguggggcuuugaaaguccugaauuccuacuggguuggugaagauuccacauacaaauauuuugagguuauccucauugaucuguuccauaaagcuaucagaagaaauccugacacccagaggaucaccaaaccaguccacaaacacagagagaugcgugggcugacaucugcuggccgaaagagccguggccuuggaaagggccacaaguuccaucacacuauuggugguucccgcagugaagccuggagaaggcgcaauauucuccaaggagaaggaaggaaggaagaaagaaagagagucccagaauuguuucugccgcucagaaaacuugagucugacauuaagaguagauuguuuuuuauauuauuguaccauuuuguugcugagaaauaaa

SEQ ID NO: 159 - RNA, 29064 nt, Mus musculus
ccucaaucccagcaacacccacgcgcccugcacaauauggcuggagcaggcagcaacggagagaccuuggcuacccggauggagguaacggcugggguuugggagaacggagcaggauguuaaggauggguuagaaauaucccgagagaaaggucuuaaauuacucacuccuccucuaggguucauuguccuaagcuggagaaauggaagacuuuuaaaugucauuuucccagagcacuguugguaucaaaauguguuuauaauggucgggucgucauggugcuuacacccacauggaggccuacuggaggugaggccuacgggucgcuuuuguacaaauacuuugccagagcagaagccaggagugguguaaucaagucuauggcauuuuaggauauuuacacaguuaaaaguguuggguccaauuuagaugaacaagucuuuguuuuccuugauuauuuaaagcccucaaccccacccccugcuuguuuuugguuucucuguguagcuuggcuguccuggaacuuucucuguauaccaggcucuggcuucaaacucauucaccugcucagccucccucgcacugggauuaaaggagugcacugccaccacccgguuuccuugauuguuuaguugugauuuuauauaaacuuuguggcuuagguugcagucacuggaacccauaccucuacagcaaacguuucucacuaaaaguguaaagaaaauguuuugcccuguuuauuuucaucauauguuugcaagaucucuccagucucauaaaagguggaggaggggagugagcgcccuuaaaaucagguuagggcuuacucauagaaaguagguuaacuugacaguuccaacugcaaaagaaaaugcuagugagacacaaacaaaacacugguggcauacugguuggagcucagcuacagaacauuugcuuagcaugaacaaaugaucaagucucuggacuugguucccagcaugaccauccccuugaaaaaaaggaauuagauauccaaggaaagacaguauccaugaagucauagccaccaauaaggcuuugugauguuacccagucagcuguacacauaaaacaaaagugcagaugauucacuugagugcacacaaauuacauuacacaccauuucuccucuugacgcuauuauuagugacacgaagaaagguauuaaaagaaaauaguaacuuuuacugcagagccaaaugaaaauacuugagauugucaacagcuuucuacguucauuagcacagauaaugaaaaguuaauuuuaaguuggagcugggcuaccagaccuguauguaaccccaguuacucaagaggaugaggcaagauugaaaauucaaggucuuugcaaauuagcaagacucuugucucaaaaaauuugaaacagugguaggaagcuagugauacagcucaaugguaggacacuuaccuagugaggguuagacccuggacggguucccacuacacugaacuagugugcguaugugcgugcguguguguacuucaaaaccuucacuauucagaaaugcuaaggaaccagccuccaaccuggacucuuagaaaaccacucuaagguucuuuucuguuuacuugauuuggcuuuuuccuggaacuuuaaaauguaucaauaccuaucaaaauugggcucauuacgugaugggauuguuaggcauauauccagaguuucagacuggggggauaggguggguguaggaccaauaugucauuuaugacaacuucccagguauugcuggagcuccugguggaaaugcuauagguggagaggcacuacccaugucuguggacacagauucccuuagacucucaagucaauuucuuuagccuuuccuuuugguuucugauacauucuaucucauauccauuaaaaaacaaaacaaaacaaaaccuggaggcuuuuuauuccugcuaaauuuugauugaaauccacuauuucaaucaaaauuuaaaguagggguuagacaaucucacaacuaugcugugauagaugaugaucugcuaagcucugacagauguaaacugucacaaggaaagccauccuauaccccacuuuuuaaagcauguuuaauuuuaagcugaauuuguacuagaagucuucuggaagccaaccuaaacgccauagcuauucuuuaaguagaccaguucuuuaauaauaaggaacuugaacgugcaaguauaauuuuguggguaccauuuauauaaagaugcuuaauaccaauaacuggcaauccaauuaaucauuaaagcuagacuuaccugauuuuuaaaguacuuucuguuagauauuuuaauuguuuucuaauuuagaucauagagaugaaugacaaguuaagaaacaggcaagaaauugugaauggacugaacauauuuuuggaagaaaaugguauguuugcuuaagugaauuuacauuucuuuaaaacuuaagaacauguuauuuuuaaaagaacuguucuguuuuuaaccugcuuucgauucaucuacagauagugaauucccguuguuuaaaaaucaaaaccaccccagggcuguaacugccaaagugaccucaagucgccauagcaaauuuaugucucuacauagacaucaacacacauuuguaagguguuuaugaccuacuuuaaaguucuuuucaccuuuuccuuguauuucgacuuagcuuucuuggucauauaaagaaauuauaguauuauagguuauacacuuuaucacauaccuagagaugauaaacaagauuuuuuucucuuuauaaacagcuuucugucugucucugucuccuucucugccucccucucccucuuucuuucucuucccugccccacaaagucuauguaacccaagcuagaccacaauccugcuucagcaucccaggggcuaggugagauucccaauaugcucuccuuaacacaugcacauaacuuuuauauuaucugagauucuauuggaucagucucauuucgucuccauccccugucuacuuucuccuuaaaaacaaacaaaaugcauagugcuccacccucggugcuaaaagccaacuuuccuaaguuuuuggagaugacaauuugccucucaaacauaaaugcacacauaaaucacugagcauguucuugcugagaucugggguagggugugauuguacauacucugcugagugcccacauuagugcugcuguuguuauugagaguuuacacuugguauaauuaggugugcauaauggaguauuaaguucuugauauagagcauagaugcauugaaauacaaauauauacugaaaguuaaauaguuuuacaauugccgacccaugagcuaccugauuuaucucuucaauuuaaucucucugaaugucauuuugggugggauguuaauacaauuagaaagacauuaauauuacugugcaugaaggaucuuuuagucuuuuccuaaugugaaauauuuuaguuauacuucuuaaauuaccuuucaugaaacagccaaaguagguguuuuuucuauuuaaccuguauaugguggugaguuuauaucaauguauuucuuuuuauccucaacuaaagucuugaaauucacuaaacucauugaauaggcgguggacauuuucuuaucaaguugagaucuguuuccucucagauuguguuaucuagucuugcuuuccuuaugucuauaucugacauuacauuuuauuuauguaacccuucuucuauuuauaguuuuccucugugccuacuuauuauuauauaacauccuauaauauguuauauuaugaucuaucaguaucauuauuacaacauuagcauuguuaacuuacauaauguacuaauaagaccauacuguggagauaguauguagaaaaauauacccauguaacaucauaagacauauauagcauauuguaauauguuaauauuuuauguguaaaauaaccuuuuagugggagaauuuuaagugucuaaaauugccucucauacuucauuucaaaugugcucagaguguggcucauacuucaccuguuauguguaagagccugauuagaucuccaacagcaaaaaacgaugauuaugaugauaauuucagaugucaaaaauauuuaugcuuuuccuguauuuaagaauuuaaagacauauuuaaacauccucuugaccaagaaguaccaauugacauuuagggaauuuagacuaaaaugcaaaguauuaaguacuaaauauuaagauauuucaauacugaauucaggucaauuggaagaauaaaaugaaugaaagagaaauaaacuuugaaagaaaaggcggcuugaauacuauuuuuuuaaaaaauauauguaguaguaguuugaugccagccuggucuauguagugaauuccagggcagcccuggcuaaguagagaggcuuugucucaaaacuaaaaaaacaaaaagcaaacaaaaaaacagugacauaguuggaaauccucagauucaacagcaaaggcaaaagagauaacaaaauacagaaaaaaagaaaguugagaaucugagugggaaaaugggaguuuuagaaaaagagaggguggagggaaaccuguuuagagucgaguugccagaaguuuucuuuuuucuuuuucccauugcaucucacagcauucugcacuagaucuucaccuggugucagacacucuuggucaaauucacucaugaccaauucugucauggcuguguccucauacaggugcuuugcacaaaguuugugacuuuaccucugucucccgcuugacagacacccagccagaaggcagucuauggauacucaugugugggugauggcccucugucugccucucuccccuucagugccucucuagcuccccgugcccugugggaagacagucacaggaaguaggauugcagacucauugggaacugaaugaguagacuugggugugaagccaaagcuuucuacuuccgcagcagggagugccaugguugccgcaugaacugacucagccuggggugggaggucugcuaaaacuccucuuguuacuguacauacuucagcgaucucauguuuguuauauccuuucaacauagaagaagaagccuauuuagaagaacuggaagaagaauccgacauguuugagguauaaaccuauuucuaaacuggaauucuauuaaaguuuuuaaaaaccucuccauuuucuuguucugacaccugcccaguaacauguguuaaugacauuaggguugcagugacauucuguuauacuuggaugcuugguguuuauauaaauuugcccugauucugauacuugucugaacaaaguguauauuuuguuaucauccucugugccacugcuuuuucuuguuguacuuuuuuuuuuuuuuuuuuuuuuuggauuucauauggauccagauauuuugagaucuucuguuucuuuucuccuggucuauagcuauacuuuccauucauuugauuaagguuaagggucaaaguagaaccaaucagacagacgugaucucugucaguacaaaucauacuaagaugcuaucuaucuuaaaagagaaaacaugcaugagugugcaugagaguugaguuuuuaaaggaauuggcuugucagcuuaccuucuaaugccuggguuucgugaaaguugcagauguguuauuacuccuugggaagaagguccuuccugccuugugcugcugacugucuuucacacuaugcgucucuuuucucugaaggaggaagaaacugaagcucugaaugaagaugguuccaaagaagcacacaauaagucagugagauacauaccuuucugcaaaaucuguaacuuuuuaucaaauauauaacacaauaguuccuggcauuccagagucagugauaagagucugcugcaauugggccucagagguggacagccuuggggcucacuuucagucuuauccauuccuagcuaugccucuguggagauaauauuugcuucccaguguauaaagaagauaugagaugaaaggcagaggcuagaagaaugcucaacacaugcugcucaaugacaguucacaccuucucucucgguucaucuuguuuucaggggacguuuacauugaaaaagcaaagcauuaucguuuuuagauguggagucugccauuguacaccuaaguguaacauucguuuaguuucgggaacguuauucauguuguguugcaggauuguguuccagcuucagaguuagauauaagaauguugagaauggggcuggucagauggcucagcgguuaagagcaccgacugcucuuccaaagguccuaaguucaaaucccggcaaccacaugguggcucacaaccauccguaacaaaaucugaugcucucuucuggaguguuugaagacagcuacaguguacuuacauauaauaaguaaauaaauauauauauauaaaaaaaagaauguucagaaugcguuacaguugauguuaaaucaaugggagaccuguaugugguuaaaaagguguauauacacacacacauauauauaauucuauaaggugggcuuuuggauauguauauuucaauggaauuauaaucuucaaguaaaauagaccccccccaaauaaaacauuuuaaagguuuuuuuuuuaaagaauuucaaacauuggauaaaauguucuuaccuuuuucuccucaaauucuucucaucccaguccagcuuuggaacacacugcugcagcauucgaugacauaguuuuuuaauuuuuuaaaauagaucugaagacugucacuagcauucacugucuugcugauaguucuuaauuguaauagaaaauuuucuuauggucuguaaguccuugagcuucugugcgccuuuuagccucauuuccagcacuuuccccccccccccuccuguacuugaaucuuggcacacuaauuuucucuaaguuuucucucuucuuucccaugucucuuuuuagacuaugguagauagcuaggcaagaacuuguaacucuggaggcgguugacaauggauccaggccuccuggucaguuuugggccccaccuuccaacauguaguccuuuccucucugucguucuguguuuuccuuguagauacuggcccaagccuucacugcuuuuuccuugcacccuggcuucccccauccauccccucauacccuccaucccccauccauccccucauccccuccaucccccauccauccccucacccccuccauccccucacacccccauccauccccucacccccuccauccccauccauucccucauacccuccaucccccauccauucccucauccccuccaucccccauccauccccucauccccuccauccccauccauccccauccauccccucauccccuccacccccauccauucccucauacccuccaucccgucauccccucaacaucccauccauccccucauacccuccauccccuuaugcccuccauccccauccauucccucauacccuccaucccccauccauccccucauacccuccaucccccauccauccccuuauccccuccauccccauccauucccucauacccuccaucccccauccauccccucauccccuccauccccauccauccccauccauccccucauccccuccacccccauccauucccucauacccuccaucccgucauccccuccacccccauccauccccucauacccuccauccccucauacccuccauccccucauacccuccaucccccauccauccccucauccccuccauccccauccauccucaugcauccccucauccccuccauccccuccaucccccauccauccccauccauucccucauacccuccacccccauccauccccucauacccuccauccccccuccauccccucauccccuccacccccauccauccccucacccccuccauccccauccauccccuccauccccauccauccccucauccccuccaucccccauccauccccauccauucccucauccccucccucauacccuccauccccccuccauccccucauacccuccaucccccauccauccccucauacccuccauccccauccauccccucauccccuccauccccaucauccccauccaucccuucauacccuccaucccccauccauccccucauacccuccaucccccaucuauccccuuaucccuuccacccccauccauccccucauccccuccauccuccauccauccccucauccccuccaucccccauccauccccucauccccuccaucccccauccauccccucaucccauccaucccccauccauccccucauccccucauccccuccaucccccauccauccccucaucccauccaucccccauccauccccucauccccuucaucccccauccauccccuuauccccuccaucuccauccauccccucauccccucacccccuccauccccucauccccuccacccccauccauccccucaccuccuccauccccauccauccccuccauccccauccauucccucauaccguccauuccccauccauccccucauacccuccauccccauccaucccgucauccccuccauccccauccauccccaucccauccccucauacccuccaucaccauccaucccgucauccccuccauccccauccauccccauccauccccucauacccuccaucaccauccaucccccauccauccccucauacccuccauccccauccaucccuucauacccuccauccagcuucuugcuaacuuuugcugcacagugugcagcuuucuugguuccaaacucaaaaagauguuuuuccuuucuuuccuccgacucccuucuccugacauccaccaagaugcacagcuugccuguccuguuuuuaucucaaguuuuaauaaaaaaaaggacuuugugcuuccuaucuguucuuucuaaguucuuuuauuaauuacaauaagaacccagaagggaaccccaauuucccugguacuuuccccuaccuaauuuugcuuguuguauacuaacuuaagcccaaagccagccagcagauuuuuacuccacuagacucagaauucauauucauucuuggaaauuccuaaggacuuucuggacaaucuggacaccuguuugguauguuuuuauagaaucuugaacauacuuuaucauuccuacugucuaauuuaauuuugcaucauucuauuacacauuuauuuacauauaguuccccuaaacauauuuauuuccucaucacuuguuucuaccaucuaaaauaucuagauuugcaguaaugucaauauuuguuaaguguaauguaauauguaaaauaauuuuauguaucuucuuguucacugaaugcugaugcccccugcaaggaaauggcaauuuuggauuauuuccuuauaugccacacagcauccuggcauauucaagucacuaaauaacauuuuccuuaucuguuuauucauuucacaaauaauuacuugguuuugcuguuauguuccaggagccauuauagguuuuagcaaauauaacucaaaacccaucccaaaguccuggcccuuacagauuuuauguucuuuggugaauggauguauugauuaguuaacuaguauaaauugccuaaacccucaggaaaauuuauuuacaaaacaguuucucuucuuuaugucauuugcuuacaauacucaaaauguuaaucugaauuguuauuauucuaaaugucaucugaauuaacguuacuugucuuuuuuuauaguguaagaacaucucauaaaguaucccucaggaguauugcaucaaugacagaugaagagguuaggcuuaauuaaguaauuugucaaacguuaggaacuuggagguagaaagcuuaaaauguuguuaauuaccacuaaaauauucuuucagaaauacuagaaaugugagaaauuucauggccuccucacguguguguguguguguguguguguguguguguguauacauauauauauauauuucuaaauaacauuuuaugugucaggagagcagccucucccucuaucuuuccaucacucucuguuuauauauuuauauauguacauacauaugcacacauacauggauguguacaucacucuaguuaugagugcuuucguccacgugugacugcuggcaagucuucugaacuucauuauuauguaugaaguauuguagacauacagaaaauucaaggcauccgugcucaacacaaagguguagcugguauucuguauuaucuuuaaacucaaggauagccuguacuuagccugugagcuuaucagaacugcacucucaggaccauacugaccacccauguuacugaauccuaaacuacauuugcacaaaaucuguuccuugcagguuuuccuuuuaaaaagggggaaaaaaugcauugcuuaccacuucccucuccuucgaauuuuacuccacugccucccacugugccuuggguuaacagcuguccucagcugacauaaaauauaccuuccagaguauauuuuuuacucuuauguuuuaauuaacucaaagcaagucaggaaacaucccuagccacaggaaaaaaaaauguauccacuuuaauuuauuuauuuacaguucuggugauugaaccaggccuugugcaugcuagggaagcaaugugucaccaaacuaaaucucuacccauuguucauauuguuguuauguagguauauauguguguguguauauguguguaugcauauuuuucuuuucuuuuuuuuuggagggggggugggguuugauaggguuucucuguauaguccuggcuguccugguacuuacuuuguagaccaggcuguccuggaacucagaaauccgccugccucugccucccgagugcugggaucaaaggcgugcaccaccacgccuggcuauauuuuucuuuuuauuuuucuuuuuuaauuaauuauuuuuuuacacuccauauuuuauucccccuauccacccacccuuugacuguuacacaucccaugccuccuccacacccccugucuccauaaugauguccucaccccccccccaugccaccugugaugguuuguauauucuuggaucagugaauggcaccauuuggagguguggccuuguuggaauaggugugaccugguuggaguaggugugucacugugggugugggcuuaagauccucacccuaguugccuagaagucagucuucuacuagcagccuuuggaugaagacauagaacucucagcucugccugugccaugccugccuggauacugccaugcucccacuuugaugauaauggacugaaccucugaaccuguaagcuagccccaguuaaauauuguuuuuuauaagacuugccuuggucauggugucuguucacagcaguaaaacccuaacuaauacaccaccugaccucuaaacucccugaguccuccaaucuuuugaggguuaggugcaucaucucugaauaaacacagacccggcaguccucuaccauacguguguugggggccucauaucagcugguguaugcugccuguuuggugcuccagugcuuggcagaucucagggguccagauuaauugagauugcugguccuccuacaggaucacccuucuccucagcuucuuucagccuucccuaauucaaccacauggaucagcagaaucuguccauuaguuggaugcaaauaucugcaucuaacucuuugagcugcuuguugugucuucuggagugcggucaugcuaggucccuuuuugugaacacuccauagccucaguaauagugucaggccuugggacugccccuugaacuggaucccacuuggagccugucacuggaccuucuauuccucaggcuccucucaauuuccaucccuuuagaucuuucagacaggaacaauuaugggucacaguugugacuguaggguggcaacuugauguccugucuuccugcuggaggugggcucuauaaguucccucccccuacugucgggcauuucaucuaaggucccucccuuugaguccugagagucucucaucucucaggucucuggugcauucuggagggucaccccaagcucauaucuccugaggcugccuguuuccauucuuucugcuggcccucagggcuucaguccuuuuuccucacucaguaucagaucagguucuucccucccccauucucucuuccaccaccacucccucucuccccacuugugauugcuuucuucucccucccaagugggacugagagguccucacuuggccauuucaguaucuugaccuuuuucaguucuguggacuguauuuggguauucuguacuuuuguuuuaggcagggguguuacauccacuuauuagugagggcauacuaugcauauccuuuugcgucugaguuaccucacucaggaugauauuuucuaguuccaucuauuugccugcaaaauucaggauguccucauucuuaauagcuaaguaguauuccauuguguaaaugaaccacauuuucuguauccauucuucuguugugggacaucuguguuguuuccagcuucuggcuaucaugaauaauugccacuaggaacauagugaaacacaugccccugaggcaugguggggcaucuuuuggguauauucccaagagugguauagcuaggucuucagguagaucuauuuccaauuuucugaggaaccuccagauugauuuccagagcgauuguaccaguuugcaauccuaccagcaauggaggaguguuccucuuucuccacauccucuucaacauuuguugucaccugagguuuugcucuuagccauucugauugcuguaagguggaaucucaagguccuuuggauuuacauuucucugaccccuaaggacuuugaacauuucuuuagaugcuucucagccauuugagaguuuucaguugugaaacuaguuuaguucuauaccccaauuuuugauucaguuguuuggguuuuuuggugguuagcuucuugaguucuuuauguauuuuggauauuaguccucucuuggauguaguguuagugaaguuuuuuuuuuuccccaaucuguagguugcugauuugucuuauugacaaaggccuuacagaagcuuuccaguuucaugaggucccauuuaucauuucuugaucuuagagcaugagcuauuggaguucuguuuaggaaacuuuucucugugccuaugaguucaaggaucuuucccauuuucucgucuauuagauucaguguaccugguuuuuuguugagguuuuugauccacuuggacuugagcuuugugcaaggugacacauauggguccauuuucauuuuucuacauacagacagccaguuagaccagcaccauuuauugaagaugcuuucuuuuuuuuuuccaucguauauuuuuggcuucuuugucaaagaucaacugucuguaagugugugguuuuauuucugggucuucaauucuauuccauugaucaacgugucugucucuguaccaauaauuuacaguucuuaucuccauugcucuguaguaaagcuugaggucagggaugguaauucccccagcuguucuuuuauuguuaagaacugcuuucacuauucuggguuuuuuugccuuuccagaugaauuugagaauuguucuuuccaugucuuugaagaauuguuugggauuuugauggugauugcauugaaucuauagauugccuuuggcaggauggccauuuuuacuauguuaauucugccaaucuaugagcaugggaguucucuccauuuucugagaucauugucgaucucuuucuugagagacuugaaguuauuaucauacgggucuuucacuuguuugguuagaguuacuccaagauauuuuauauuauuuguagcuauugugaagggaguuguuccccuaauuucuuucucagccuggguaucauuuguauaaaggaaggcuacugauuuauuugaguuaauuuuauauucagccccuuugaugaaguuguuuaucagcuguaggaguucucugguagaauuuuugggggucccauauauaugcuaucaugccaucuccaaauagugauaccuuuauuucuucuuugccaauuuguauccccuugaucacuuuuuguugucuuauuguucuaucuagcgcuuugaguacuauauugauuagauaugggaagaguggguauccuugucuuguccccaauuucagugguauugcuucaaguaugucuccauuuaauuugauauuagcuguugguuugcugcauauugccuuuauuauauuuagguauaggccuugaacuccugaucucuucaauacuuuuaauaugaagggguguuguauuuugucagaugcuuuuuucugcaucuaaggagaugaucaugugauuuuuuuuucuaugaguuuuauauaguagauugcguugauggauuuuuguacauucaaccaaccuugcauuccugggauuaagccuacuugauuguggugaaugaugguuuugauguguuguuaguguaagaugucuccaguuucuuuaccagggcacuuagugcuauggacuuucuuuuuagcacugcuuucauugugucccauaaguuuggauaugaugugucaagauuuccauuaaauucuagaaagucuuaauuucuuuauuuuuccccugaccaaguuaucauucaauaguuuuuuaguuucuacauguauaugggcuuucuauuguuuuugcuguuauugaagcuuagccuuaggccauggugaucugauaagaugcauuucaaucuuauaucgguugagguuuguuuugggaccaauuauaugauugauuuuggagaagguaccaugaggugcugagaagaagguauauucuuuuguuuuagggugaaauguucuguagauauguuuaaaauccauuuuuucauaaccucuauuaauuucauuguaucucuguuuagauucuguuucaaugaccugcccauuggugagaguggguguugaagucucacacuauuauugugugggguucaguguguauuuugagcuuuaguaaacuuucuuuuacaaaugugguugcucuugcuuugcggcauagauuuucagaauugagacuuucucuugguagauuuucaccuugaugaauaggaugugcccuucaucaugcuugacaauuuuugguugaaagucuauuuuacuggauauugggauggcaacuauugcuuguuuuauggaaucauugcuuagaagaccuauuuccauccuuuuacucugagaaagucucugucuguguuuuugagguauguuucucagaugcaacaagaugcuagaucugguuugcauauccaguuuguuagcuuaugucuuuuuauaggugaguugagucaauuaauauucagagauauuaaagagaggugacgguugguuccugauauguuuguuuuuguaggaggcuuuaugugcucgugguucuuuccuuuuggcuuuguuguuuaucauuuuuuucuucuuaccuuuuauuuggccuuuauauagauuucuuggaaaauauuagcucauguuuccuagaccacugcauugaaauaacugucaucuuaugggauaauaaaaggguuuguagcacucucucuuuguugauauaugauaucguugagguucuuugaaaaugcauucaaccucauuuauguaauaacuuugaaauauuguauucuaugauuugaaugaguaugugaguaugugugugagugaguguauauguguaugaguguaugugaguguguguguauguuuauaugagugugcaugugugagugugagugugaguauaugugugagaguguaugugcaaguauauguacacauauaccuuuauuuaaacugcugucuuuuuagccuucuucuguguuggauuucccuuucauguggaauucccuuuugcacaucacccucuuugccucuuccuuuauaaucugcuauccugaaaucauuaucuaaauuucccugucaccuuaacacuuuccacuuuaaguuaacucaacacuuaacuuaaacugaaugucuuuauucagauuauuuagauauucagauuaauuuaaggagguuuaaauuuuuuauauauuuauauauuuauaaauagauauuuguuuauauauugcuauauauaugcagaaaaacuuaaaagcaaaaaaaggaaagcaccaucaaaauuccuacccuuacacaauuucuuuauaacuggacauuuuucugugagccugaaugauacucauaaauuagcauuguaucaaauauucuuuggcuuuuaaguaaguguagauuagagucaauauuuaaucauagccuuucauuauauagauuugauauaacuuaauagcauuaaguugcuucuuuguaaaauggagauaacaaacucguaaguuuauugaaaauauuaaauaccaauauuaaaauguaaauaugaagaaaugcaucaaacauuuaacaccaugguaaaccaauggcauuuaucaguaaaugaguucuuacuguuaacugcuuuacaauuaacauuggucaguuaauauaucuguuuuuagaaccaugguuucuauaguuuuugcuacccaauaguuuuaaagaucugauagacagucguuuuuaaccuuccuagugcugugacccuuugaugcagauccucauuuuguguuggaaacccccaaccauaaaauuauuuucaucacuacuucauaacuguaauuuugcuacuauuaugaaucauaauuuuugaaaguagagguuugcagaaggaguugugacccacagguucagaaccacugugguagggcaagguuuuaucauuucuauuucuguaauacccacgaaguauauuugucuuuauguuugaaauuuucauguguccuugguuauuuuucuggcuaaguuauauaguuaugugaagccaggcauuggucuugauuaucccaucuguuauuuuauccugagaguuguuauuggagacagucucuaguuugaguuuguuuauuuuuguuuuguuuuguuuuguuuuuguuuuguuuuguuuuugcuucuacugucaucauuucuuaaacuuauucaauauuuuauuuauauauuuucagagauuuaauaugagaauuaagaaguuugguauuacaaguaaagaauucagaaaaucaccaguggcuucuugguaauuccugcuuuuuuaaaaaacuaaaaggccuugaauuuuuuuaaaugcacaauuucaaauauugguuaucuguugcacaauuagaaauuucucauacaaccuuucucuuuauuuucccuuaaagcuuuggacugccucugucaacugguauguucugccacuguuuggaguauugcaugagugccaaaugagcaugugugaagcaucaguacgucuguaaugauaagucucccaaccggcucugcucuaggccagccagagcagauccaugagcaaagcaucaggguacaacucggcucuuuuauuuuucacuauugaauuuuuuguuugaauugagcuacuaggaaguacaggguucuuuauuuaaucacauaucuuggugcauauauucuguauguucauuguuaaaaugcaauaaauaaaaauaaauauaaauaauuacuuaaaagaugaugaacaagcuaaggagaaagauuuuaauuaguuauuaugagauaagcaagaaaggaauuaauguaaauuaauaggauagauauuagagaaauuaggaaagaacaauguaaaguuugcauaagcuccuagacuccaaacuguauauuuuaaaauuguuugauuuaaaagguauaaagacuuuaaguauuauauguuauuagguuuaauuuuuuaaauuauagaauaauuaacuuauaauaaaagaaacauggaauauauuaauacuauuguuuuauauuguacacuuuugcuuucaaugauaccuuuauuaugagguuaaagcaagaagaucuuuuaacuuuucuuaguuuuuauaauuauaauuucagaacuauaugauuacaauauuucucccuuuccuucccucccuucaaaccuuggucuuucuuucagauuucugaccucuuuuuuucauuaauuguuauuuuaugcauauaugcauauauguacauaguccuaaauguaaccugcuaagucuguguguuacuuguaugugugguuuuucagaccugauaguuugcuauuggagaaccaguuguaugcucuucccugaauaagaucgugucuuccacucucagcauuccuugguugccuguaguucuuagaguaggaaagcggccuggggcuccauucccaugucagcaugucugcuguuccugucuuggucaacccauacuuggacagucauguugaugagacuuuaugggcuucugaaaguacuaggagacacacucucagaguaaacucccugauccauccuuccuuccucccucgcucccucucucccucccucccucccucccuuccuuccuccauuuuuuccuuccuucuuuucuuuauuuauuuauucauuuauuuucuuucuucaacugcacuuuuggcaucucugucaacuguuaacuggcugaacucacauguacucaauucgguucuucaauuuuguuccauugaucuguuauuuugugcgaagauuauguugcuuuuauuauuguggcucugcuguaauauuucuuaaaaucuggaaugauaaucccucaagcguuguucuuuuugcuuaggaauuuuuuuauuuuauuuauuauuauuauuauuauuauuauuggcuaucugaggucuuuugcaguuccauuugaauuuuaagauaguuuuuuccuauuuuugugaaaagggauauuuguuuugauugggauuauguugaacggguaaguagauuuuggcagaauggccauuuucacaauauuaagucuacuaacccauggccauggaaugucuucucauuuuucuagggucugucuguaucucuucagauguuuauaguuuuccuuaggaauucuucacuuccuugauuuuuuucuuugaggcuauagugacuagagguauguucauuauuuccugcucugaauguuugauguucauguauaguuaggcuguugguuugugaagauuguuucuguauucuaccacacugcuaaaucuguuuaccauuucuagacuuuuuugccagaauuuuuaggaucucuaagauauaguaguaucauguuaucuacagauggggauaauuugacuucuuuccguauuuguaucccuuuaauuuccuucucuugcuuuauugcuccugcuauuucuuugagcaugguguggaaagggaauagauguagugggccucccugucccauuuuuuauuucagugggaucacgucaagcuuuucuccauuuagaauaauguugguuuuuccuguuguuguuguuguuguuguuguuguuguuguuguuguuuuucgagacaggguuucucuguguagcucuggcuguccuggaacucacucuguagaccaugcuggccuugaacucagaaauccaccugccucugccucccaagugcugggaucaaaggcgugcaccaccaccgcccggcugguuuucguguauauagauucuuuuauuuuugaaguaugcucccucuagaccauuuuaggacuuuuaucaugaaaguacauuggauuuugucaaagucuuuuucugcaucuuuugagaugaucaugugauuuuugccuuaaaguccauuuaugaggcuuauuauauuuauugacuuaaauuuguggaacuaucaugaauaaagccaacuuagucaugguauguuugaugugugucucuauucuguuugcaaaugucuuaagagccuauguucaucagggauuuuugcucuuaaccgcugagccaucucaccagccccuccccaaauuuucugaguugcaucuuuaagccauuuuccuugcguucuuucugauuuuuauuuaauggauacuggguucuagucucuguuccucugcaugaguaguuucucuagcccuggaucgaaaacacuuguuuguaaauacuucuucuuguucuucuuguucuuguucuuuuuuuuuuuuuuuuuuaaagauuuauuuauuuaucauauguaaguacacuguagcugucuucagacacacuagaagagggcaucagaucucauuacggaugguugugagccaccaugugguugcugggauccgaacuucggaccuucggaagagcagucgggugcuuuuacccacugagccaucucaccagccccuuguucuuguucuuuuucuuguucuuguuguuguuguuguuguuguuguucuucuucuucuucuucuucuucuucuucuucuucuuccucuucuucuucuucuucuucuucuucuccuccuccuccuccuccuccuccuccuccuccuccuccuccuccuccuucuucuucuucuucuucuucuucauguauuaguuauuuuauuuauuuacauuuccaguguuaucccccuuuccaguuuccucuccacaaaccccccauccuuccacccuccccccugcuucuaugagggagcucucccacccacccaugccugacucaccucccuagcauuccccuaugcuggggcaucaagccuucacaggaccaaaggcauccccucucauugaugccagacaaggccauccucugcuacaugcagcuggagccaugggucccucuauguguauucuuugguuagugguuucugauuuuuuuuuuaaggcacauuagagcuaaacauuuucuuuaugagauucuuuucaguguguuccagagguuucauuauguugguuuuuuauuuaguuucagggaauuuuuuacuucuuuauuguuuucuuccauaacccauucuucacucaguaaugcauuguugaucuccaucaguaccuguauuuacuagaggcuuauuugcugucaguuuuauguuuuucugcauuguugucagauaggauacaggagugauuucaaucuuauaaucuuggucuguuuuagaaaauauucugugugcugcuaaguagaaugugcuuucuuuguuguuuggacagacuauuguggagagagauaucuguuaagucucuuugauguaggaugucaacuaauucugaaauuucucuguuuauuuuuguguggaugacaugucuauuauaauagugggcuauugaaaucaucugcuacuaaugaagugauauuaaugucuuuaugucccauacauaccuuuuuaugaaauugugcucaccagaguuaggugcauauauguuuaggauaguaaugucuucuugguuaacugcuucuuuaauuagaaugaaguaucccucuuuaucuuuuuuaccccucuuuaucucuuuugucagauauuaggauagcacugccuguuugcuucugguuccauuugauugaggaacuuuugcuuaugcuuucaguguaagguggugccuaucuucugaguuaagacuuguuucuuguauacaacagcuucuugauccauucucugucugucuuuugguuggaguauugcaaucauuuuuauuugcagcuauuauugacaugugaacguuaauugcaaucauuguguuauugauuuuugguguuguuuauauuguuaauuguguuuuguguuuuaauaauuauggcuuuguauuucuuuccacaguuucucugcuguguucauuccucuuuucaguuugaaauauugucccuguauuuucucuagguuucauuuauuccauauaauuuuugaggcucuuuauauauugaaauguuuuucuuucuccuucaguaauggcagauacuuuugguagguagaguuucauaaucuuuuaggacaugaaguuuauuguuguaggcuuuucuuccuuucaguauacccauugagaagucagcuguuauucuuuuuuuuuccauuuuuuauuagguauuuagcucauuuacauuuccaaugcuauaccaaaagucccccauacccacccacucccacuccccuacccacccacucccccuuuuuggcccuggcguuccccuguacuggggcauauaaaguuugcaaguccaaugggccucucuuugcagugauggcccacuaggccaucuuuuaauacauaugcagcuagagacaagagcuccggguacugcuuaguucauauuguuguuccaccuauaggguugcaguucccuuuaguuccuugggugcuuucucuaguuccuccauugggggcccugugguccauucaauagcugacugugagccuccacuucuauguuugcuaggcccuggcauagucucacaagagacagcuauaucuggguccuuucagcaaaaucuugcuaguguaugcaauggugucagcguuuggaagcugaucauuugauggaucucuggauauggcaaucacuagaugguccauccuuucgucacacuuccaaauuuugucucuguaacuccuuccauggguguuuuguuuccuauucuaagaaggggcaaaguguccacacuuuggucuucauucucucaaguuuaauguguuuagcaaauuguaucuuauaucuuggguauccuaaguuucugggcuaauauccacuuaucagugaguacauauugugagaguuccuuuguuauuggguuaccucacucaggaugaugcccuccagguccauccauuugccuaggaauuucauaaauucauucuuuuuaaugaguaguacuccauuguguaaauguaccacauuuucuauauccauuccucuguugaggggcaucuggguucuuuccagcuucuggcuauuauaaauaaggcugcuaugaacauaguggagcauguguccuucuuaccgguugggacaucuucuggauauaugcccagaagagguauugcuggaucuuccgguaguacuauguccaauuuucugaggaaccucaaaccccuaaccauuaaaguuagagauagauauagauauuuucuucauuuacauuucaaaugcuauccccaagggccccuaugcccucccccuacccugcuccccaacccacccacucccacauccuggcccuggcauuacccuguacuggggcauaugaucuucgcaauaacaaggaccucuccugccauugauggccaacuaggccauccucugcuacauaugcaacuagagacacagcucugggggguacugguuaguucauauuguuguuccuccuauaggguagcagaccccuuuagcuccuugcguacuuucucuagcuccuucauuaggggcccuguguuccauccaauaaauaacugugagcauccacuucuguauuugccagguacuggcaauagccucacaagagagagcuaugucaggguccugucaguaaaaucuuucuggcauauucaguagugucuggguuuggugauuguauaugggauggauccccagguggggcagucucuggaugucuuuccuuccaucucagcccaguuuuuaaugagugcuucacuucacuaggguuuaggucuguuuagauuguaaauauuaucuugaauuaacuacucacaguuuuauauaucagaaaaaaauaugcacuccuguuggauuuuccaauuuguuggaguacagcauuuuaaaauauauucuuaagauuuucuacauuuucuuggugucuguuuugucaccacuuuuggucucuaauuuuguuuauguggaucuucuucugccuuuuaguuaauuuggcuaaggacuugucagucuuacugauuuucucaaagaaccagcucuuuguuucauuaauccuuuguauguuuuuguuuucucucucucucucucucucucucucucucucucucucucuugcucucuugcucucucgcucucucucucucuagcuucaacccugaguuugacuauuucuugccaucuacuaauuugugccauuauuucuucuuuuuguucuagagcuuuuaggugggccauuaaguaacaaauauaugaucuuucuauuuuuaaacauguagguauuuaguacuaugaaauugccucuuauauaccuccuucauugaaucucaugagugugguagacaccaaacuacacagcuuucccaugcacuuguugcccacuauaguagucuauuuuaaagugccaaaacugaacuauauuuguguaaaaaacuacaugucuacuucuuuccauguuuauguuuuugaugauuaguuuaugucauuuuauguuuuauacacauuaacaaauuauuguaacuauagauuuucauguuuuuuguuuuaagguuugugaauuuuuguauuuuaggcaaagaaaaugcugauaugguaagccauaauauuuaauguacaaaaauuugaauuauuuuuauuaaugaguauuacuguguuuucucuaugccuuuuaugaauagcuguugauuucacagugauauguuuacauuagaaaaauaugacuuuuuuaaguuuuaaaaaugauuuguguagggaagauuaaaaauaauaaaaauuuauauuuuguuucauuuauaguuagauuaacuuucuguauuuaaaauuuucuauauuauauauucugaauagaaccuuauaaaauaaauauuauuaaaucaguaauuuaucacuugaaauugaugagucaaguaauuuaccuuuguaauuauagaaauugacaacuaaauuaaauuauaagaguuaaauuaacuuauaugaauuaacuaaauuuauacacauggaagugaaaaaaagcuaaauuuacauaaaauuauuuuaugguuuuagcaucuucuuucuaaaaggaaaccuuuggguacaggaugcaugcuuuugaaaguuauguaacaguaacuaaagauaaaaguugagccuuguaucacaaugaaguucugucauuucuuugcauuuuuuucuuuuuuguuuuuggcuauuggucccauaauagcauaaaguucuuugugucauuaagugugcacauuuuguauuuugauauauguucaugaauaugugcauauguucauguguguguaaugaugugcaugcauguguaaggcuugcaugugaggccagaggucaauuucaguucuuucuuaauugcuuucuacacuaguauuuuucucuaauuauugacaauuguucuugaaauauuaccuuuuguuuaaccuuugacugaggaaauuacuccuucauugucugcuaaaccagcaguaacuuucucugaaagacauaccaggcaagauaauacugaugccccucuagaccuauaaucagacuuaugguaaaacaggcuacucgaggaucaguaaaaaggguaguccaugaggagguguguuauacuaguaaagagcuuuaugauuuugcuaauccauucaaacagaagucugggagauauguguggaaauugauuuuagggugaaggaucauggugguaggaacauaagacugggucauacugaguuuauugguauaggcuuuuugaguggagauccuuuguuuaauauggcaucucacacagguuuaaaaaaaaaaaggugucaaaaguuuguuuaaauggcuagcuaaaacauuugucaaaagaugaccuguuuaaaagugguuggaaacaccagauaucccuuagcuuauugaugaagggauuuuuuaaggcccagguugcaaggacugaguaggcacaguguguacaagguaauccuauugguaagguccagagacacacccuucucuuauccuacaagucacaaaauggugagggugcaccagcacauuugaagagauuugucgucacucuuuuucuugugccaggccuuaugguuggaugaauuaaauuaaauggguuggaguccugagguagccaaggccagguggcaccacugaauugccaaaagcaagguuaucucaguuauuguaaugggcaguguagacaaaacgauguucauaauggcccaaccuauaauggucaguacaggcaaagugaauucuauagugccauggaugaaccuuugguacuagcuaauaaauccuuguguuugcagacaugaaauagauaaaaagccuacugauuuuuuccuuucaucuguauaaacagaaaaauugucaaacaaaugaaagaaagucuacacuggaucauggaaagggggaaucuuggcuuaugaaucaaguuccagacuuaagccaguuugcagacccagaaucccuugagugaaggugucuuaguuaagguggccauugcugugaagagauaccaugaccaagacaaaucuuauaaagacaacucuuauauauuuaacuaggaugguuuacaguuucagagguuuaguccauuaucaucauaauggcaugaagcauggcagcauccaggcagacauugugcuggagaaggaccugagaguucuacaucuucaucugaaugcugcagaaggagaaacugugcaccacccugaacauagcuugagcauauauaugagaccucaagcccaccuauacaaugacaaacuuccucuaacaaggcaacaccuacuccaagcccccccccaauauugccacuuccugugggucaaauauuaaaacacaggagucuacgggggucauacuauucaaaccaccacaaaagggauggccagguuccccugagguaaggaccuugauaaaauaccugaauuuuuuuauuagauauuuucuuuauuuacauuucaaauguuauccccuuuccuaguuuucccucugaaaguccccuaucccccuucucucccccucccccuucccccugcuccccaacccacccacucccauuccugguccuggcauuccccuauacuggggcauagaaccuucacaggaccaagggccucuccucccacugaugaccgacuaggccauccucuucuacauaugcagcuagagccacaaguuccaccauguguuuucuuugauuggugguauaguuccaaggagcucugaggguacugguuaguucauauugauguuccuccuaugggacuucaguccccuucagcuuccuggguauuucucugguuccuucauuggggaccuuaugcuccccaauggaugacugugagcauccacuucuauauuccuuucuuuuucuauuuguguggccuuguuggaggaagugugccacuguggccaggcuuugagaccuuccuccuaaccaugucagucuucuccuaauggccuucagaugaagauguagaacucucagcuccucuuguaucacgucugucaggauccugccauguuccugccuugaugauaauggacugaaacucugaagaucuaagcuagcccuaggcaguuucaaaagaaccaacucaucuuucauuaauauuuuauuguuuuuaaaaggcuauuuuauuaauuucugcccuaaucuuaguuauuucuuccaugugauaacuuuugacuugauuuguuuuucuagugccuugagguacaccauuacauucuuaccuugcuaucugugacuucuguaacgcaggcaguuuccgcuauaaacugcccucucaacauggcucucauuauauuuauuagcuuuuuauuuguuuucauuaauuuucauacaauucuaggaauuguuuuauucuuguuuucuucaaugaaccuuucuuccuucacuagugugaguguaucauugaaucucugaguucauacuucuugguuuuaucuuagaacacaggaaguuguuucugcuuccuuugcucacugaggcuuucuuuauguccuacuucugaaguuugagugugccuuaugucauuugauaugacauuuuggcuccaagaacccaggugcagggugagcagugcugaaugaaaauccagagggagggagcaaagaggaauggaacagagguucauaaccagcuacauggagccacugcgaagcuuaaaaauacccagggagcugaaggggacugaaaccccauaggaggaaaaucaauaugaacuaaccaguaaccccagagcuccuuggaacuaaaccaccaaucaaagaaaacacaugguggaacuugugacucuagcuguauauguagcagauggccuaguuggucaucaaugggaggagagacccuugguccugugaagguucuaugccccaguauaggggaaugccaggaacaggaaugggaguggguagguuggagagaagguguaggggggaggggggaguggauagggaauuuucagaggguuaacuaggaaaggggauaauauuugaaauguacauaacaaaaauaucuaauaaaaaagaaaaagaaagaaagaaugcuagucaggaaaaaguauagcagggaaggauccugucugcuuucaagguaucuaguagauuugaagggaaccuugaauagaagcugcaucugguggugaaggaaaaguggaagaaaucuauauuuguagagacaggcuggcuggcugauuagaauuucuguacuguggaaacgcuggaauauugcagguccagagacuaauucucuuaucuuggacuaagcucuggcucuguagagaaacacauuccuugcaaacaacucucuccugccaugucggaacuaacaucuugugacaauagauaaaaagagaccuuuuaguacuuauuaacuuuauuauauuuuauuuauauuuuauauaauuaugcauaaguaaaacuaaagacugcauuuuuugcucaugucagcauggacauaauuaucacggacccuauaaaugucuugucacacuuuuuuuuaauaaccuaacaucaucaaugucuuaacuguaggaaaagaagagaaggcgccuggaacguuuuggacucucaugauucacuucugcaucuucucuccagguuugcuauguaaagagaagaucccaguuccacauaucaucucauuaucaucaguucuuuaauuuuuccacugacauugguuuauacugauaaugucacugcuguaauuuauaaauaaaaacagacauucauaucuacuauauacuaga

SEQ ID NO: 160 - RNA, 29721 nt, Mus musculus
agucugugucgaaguacagugucccagacgcggcugcacuuuucaaaccucaacuguaagaagcgucggucagcgucugugcggucgccgccgggagucgccucacaggggccuggcugacggcgaccagccguuguggggaagagugcgaggugagcccguguagccguggcccggucggagggagggcagaacccgcgacggcgcggagcugcggcggagcggucggugugggggcgcggggacccugcggcgagcccgaaggccagagccggcgucccugagcgcggccaugcccgauagccuccgcggcgucucgacgugguccuccggguggcuccggggcucgcgugcugugggcgcgggacgccuucacgucggggcggguggacgcguccggccagcagccugggagaaacuuugcggucaucgcgugggccgcugucagucccggcguggggagccacagcuguuuccgugacuuuuuggcuuuaaagcagugggaauucuucuguacuugugacccauccucagacuagacagccacaucauggccacggucuggaucuuuaucccgacucggccuuaccgugggaaaagcgcuuaauuuggcuucacucucgggauauagaugaguggagacaaaguugaaagaaacuucacggccggccggcugguggcuaguggccguggcugugcugggacuagagaagcgcuggcuucagcuugcaaguuggaauuaagaaauacuucugaaagccuaggaauuucaaccauaaucauuagcuugcagugugacauucacugaggguuuggcugacgucauguuuacauacaugguaccgauaacaccgaaccucgccggcagguuugauaccguguggacuuuuuaaguguucaagacugggagagaggcugugccuugagcagcaaggucugcagagguaacgaggcaaguggaggcauauguaacauggaauuuagaacuccaggagcacaguuuuauuauggagagauauaaacuccuuucucauugguacagucuucacagugagaugcccagaaaugguuuucaacaacuucauaaaaauugaaucacagugccuuaaaauuguguauauuaaaaaacacuaguccauggaaaucgugaccaaauuuuagaccugucuuuucaccuaaucuuuuugauauuaauuuaauuuuuugguaguuuuaauauuucaaguaauugguuuuuuugagauacacauacauuuuagauaauuuucuggaaugaagguuuacuauuaaaguaaauuuacuuacaugacaguaugcuuaaguuagagaaguaauauuucugugauuucaaaauuuuuuguauguggauagauugguaauaguuuuucuuggauuuuuuuuuuuuuuuuuuuuuaaaguaagaauuuaguuucaggagauggcucugcugggaaagguucuugacaccaacucaaauguccuuauccccagggccuacaugguagaaagagaaaaccuacacuuacagcuuguccucugaccucuaaacuugcauguaauaaaauauuaagaaaaaaauuacauuuugguuaagguagaaguggcauuuuaguagaaacuucauaaaucaacagucuaccauuuauaucuaaauuaaugucuauagacaauguaggcauuuaauggcagacacuucuaauuucauuuuucaguguguauugacagugaacaguuugucauugggguuaagugaacguauaaccauguuuucauugguuuguuuuguagcugcuugacaauuauaaggaagaauuucugugucaaaaucucccaguuuuuuagagacucaguuuaaaacuaaauuuucucaagauaugauauauuauaaugcuuauuuccugugucuaaaauucuuaccuccugcaucuugacauuuacucuacacuugagucuugcuugccaguuuuaaaggcuuuuugucuuuugagacagggucucacuuuauagacuuagcuggcuuugaacucaagagaucugccuggcucugccuuccaaguucugaaauuaaaggcccgcacuaucagcucaauuuugauuauuugucuacuuauauggcacuguuggggacugaaccuaugccuugugcaugcaaguugguacucugccaaaagagcuauauaugcaacuacacauaguuuauauuaucuauaccagacuauuuugaaaaggauguguuuuugaacugaguucaagacagagaaauauucuuuuuaauuaucuugugcauguaaaugaaccccuuuuuugaauuuauauuuauacaugauauauuuugauugaucacuuugcuuuuuccaacuagugcaaaagaggauguacuuuaagcauugagaaauuuuaauuguaaaaugguaguuguuuuuuuaacccuuuaagaauuagauuccaguuuacauuguaacaguuacugaacaaacauuauuucagagguguuauuaguaaaggguacgguaauuuauuuuacaacagaaauccaauuuuccaucugaugagugaugagcccgccauuauuuccgguuuucaacaucuucucacccuacuucacaauuacaggaucuauuucuuuuucugaagguggguggggauggcaucaggccuuacugucuuggcccagugucaggcugagguuccuugccugggacguaaccccgcuguaaucuauacucuagugguuggacuagagucaguuggcuucccauuguaauuuucagggaauuaaauuacuggauuuugcuugcuguucaguguuuaaaaacaaacauaacaguacagugcugugaguagaguacauagaacauagaaaucgucugucaacacuaaugcugucuuccagucccuggccaacuaaaacacauccuugaacgaacagaaaguucuuauuucuucuagaugcuagauaaguaaaccuucaguuuaucuguuuccuagacacagcucagucuuguuggugcccaugugguauagagaaguugcuuggcugccauagucauucacauuuacuucaugaaggucuauggauaggacaaguauguggcuuucaggauguucuuagcuaacauaagcauuuacaugaaaacaaguggucgccuagucuggaacaguuagagcagacuaaaugguuuuuguuuuuuguuuuuguuuuuuguuuuuaaaucuuacauuauaauaggugauaaaauaauuuuauuugauuucugaguuauguggcuuccuuguuuugaaaaagaaguucuguacgagcaguuuuaaauauuuuguauuuaaccaacuacuaaaguaagcagagacuguuuugaaggcuccgauacugcaauuucaagaugagucucaguuccgcguaaucccuuuggauguaccuuaucauuuauagcauuuuguucaaacaguuuuuaauucuuaccagguaccccauucggaguugcuuaaacucaaguaaaagguuauuguccuuugacagaaaauaugauugcacucuaauguuaaauuuucagguaaauugguauguccagaguucucguguuugaagcauaaagaaaagacauuuaagucaaccuguggguuugaggcaaggcuuccuggggcagagcaugaauacaaaguagccauuuaaggaaagguagaaaggauguuucaggcagagaggcaaagcacagaaguggagguaaaacaugagacugacuuguggcaggaaaugaagcugguguguacucagcuucuggggucuuuguguaccaugcuacaaaggauuuuaagguuuaguuucuggggcuagcaaaggaaucaaagcagacaacuuacuucuaaaugcuuucuguauugcauucuguaauuucuauuuuauaagccuucucauuugauaaccucgaaacgaauaacuuuugaauggcacugcuagagauuuagaaagaugcuuauuuaguuagugaucauacuugcgcucuccauucaaagguacagaucaaauguaagaugucguucucuuccuuccuuuauugauccguaucugaauucuuauuguaauaauaggaauuaaugaaaaaauuggaaaagguauggcauauacuaguguaagauugaaaucuuguuucuucuaucaugcauuuaugccuucuaucagugugucuauaauuguuuacaaacccaaauucauuaaguuucuuaagauauuuuuauugguauaaucugauaaaauaugaagcaauuucaaauuaaguaagauacauuuguaauuugugaauuuagaauaagguauauucuuuagaauugguuauaacuaugaauuauagaagagaagaucggcagauuguuuauuagaagcaagagaauuaguaguaauuuuaaggcauacaaggagagacagagaacugacuguuagcccucauguauacccauguaucguaaaugacaggcaacccguuuguaaagacuuugguggacagaggugacauuugggcuccauuauauagaaaauugaccagaggaggagaauugagaaaauaccuagacugacaauucauuuacguguaguaaauagauaaaggcaaacaacaaagcuguauggauccuuaaauagcaucugaugcagguauauuagcagcagguagaugugccuaagguuaguuuucuugaaaugucuucuuuuaaggcaaaguuuguauuuggagaugcagagccauaaugaaaugaguuguaacaucaaaacucauuuuuguguuuaaauauauuugaaaaauuugcaauuucuuaacauuguuuuuggauacaucuauugucauacaaauaccugugguauauucauccauaauaauagccaucaguucauaugaguguuagagaauuuguuaggguaugacguuaauacaugcuaacaccccaaggaaagcccucuaaugagcugauaaauaacuggauuagacuaucauuaugcauuucacuaacuuuuuuuuuuuuaaaaaaaaguuccuuuucucuccauauaacuaaauaacaggcuuugccaaacuuaauucuaauuaauauaccuguauaucacacuuuagacucuuuuggaaggucccaguacaaaucugggcuuuucucaacauucacuacauacauacauacauacauucauauauagauacauacauaguuauucuuugaaaauuucacacaugcaugcaauguaucuuaaucauauucacugccuacucucucccucugucuuuucuuagaagucuaucacauuucccuccuaacuucuugcccuuguuuauuuaaccacacagaguccacauagugcugcucauauguacuacuuuucuauguaacuguaaacaauguacugauuuuaacaguauauagccugaaguuguacauggucucugcaugagaucugaccuacauaacauacugcuacuacauacugcaaagaaaauuuugaggccuugaaaaaaucuaaccaaugauggcucuugaacuucaggcaaaguaaauucugcaaaguaacguauauagacugacaccuuugcucuugcaaagaaaaagagguugcauuuuucuggccacauauucacagccauuuccuaucauaaggaagacuuuauuagucauuuuauuguauauucauauuaguuagguuuaaaguauuuagccuuaggagaugacaugacagcaaucacagcuguuuuuauugauuauugaaguauaauguuuuaaguuuagauaagcuaauaauaagaaauucuaauuaccauaaucucacuggggaugacuacugcuaauauuuugcugcaauuuuccaaucuucuguugacuuuuauagucuacccucugauuuaucauauugcuuauaagcuuuuaugucuuuacuuucauauuuaaugaguuaaucuuugaaagugcaacuuucuugaguaugcuaauauguuggauuuuagaguuuauacacucaacagguucuuggaguguuuuuaaauguauaaaucauacuuaauuaaacauaaauauuugaugccaaaaaggaucauauugccucuugaaaauugagaguagaaaaugcuuauuuauaaaauguuuacuaguuccaguuucucugagaggcaaacauccuagcaccuaaaaucuauaugaagaaaaauuuaagacucaugaacuugucucuaaucaauuacaguguucuuuguugaugaaaacuguugggaagauagcccaguuguaucagugauuaggccugucccuucuauuuguagaaaugagaauagugcaaguguaaucauaaguguagguacuaaauucuaaaauccaaaggugcagaagaggcuuugccuagcugacugaauguaggaaucgauauucauauugauuuuucagacaauacuauaugacauauuaaaaauguuauuuaauaauuuuaguaacagugucuucagaacuaagaagguaugaaaaguuaacggaccacagggugaugcuauaggccuauaauccuagcgcucgcucgggagauaaggauuauaacgaguucaaggucagucuggauuacacaguucuaggacugaacugcauacugagacccuuaaaaaaugcagacagcuauugaaaauguuuggcuauuuuuugccaauguuuucacaugucuuucauguguuuuuaugucucucuuuucuuauaagaacaccagucauaguggauuagcgcccuaccuuaauggucuguuuuuaacuuagucaccaccuuaaaagcccuuaucugaaaaagaaguuacauugugagguacuggguuuaauauuucaccuaacagauagaaggaagauguaguuuggccuauaauaguagcuguuaggauuugaauauauuuuguccuccagacuuguguugcauucccauuuugaggugcuuugcuauguaguccuggcagaccucguaugcauucuguauuucaggcuggccucacacucuuagcaguccugccuuacgucuucagauugcuuuagcuuucuggaucuuggaauuuauagguguaugugccaccacauccagccuuugugagcuguuaagagcgugaggaccucaagucugugguuuaagccacuaggaagugauuaggauuaaguaagguucuuagguuagaaucccuguguugaugaagcauccuaguggcuuuaugaaaggaugguaaggaaccagacaugugcacagucuccuugucucuugucaugugauaauugugauauucuccagcaagaaggccaccaucauuugaggcuccuuguccuuguccuuccagaacugugagccaaaauaagcacauuuucuuuauuaauagccuacuuuggggauuucaauauaguaacagaaaccagacugauacaguagggaacuuaaaacucuguauauggucuccuggcuguaaugaauguaaauggaauucacacccaggggcauuucagcucaauucuuucccccaccucccagcauugguauucucagacuccaagagauguauccccagcuaccuagagaaguguuugccucaggaccaaagguuauauagaaauaauuuacaaauuugaaaacuaaacaaaauauaggacagaaaacacugccuguuuccuaaguagaagauacuaguuggcaauugaauguggcaaaguuuuaaaaaacaaacaaacaaaaaacaguuguucucagcaggaggugaggagggugauguagcaacagcaacagacacuagagggguauuaugggagaguccuagcagaauaacuccugaucuuucauagauagacguggcugagagucuaccauaauuacacagauuugguuaauaucaaauaguaauuugauacuaaaaguaccaaaaguuucagacuaugaacuucagauauggauuugacucuggguugguaauuuauuuaugaucagucauugacccagcaaaauagaguuuucaguacuggguugugccaaggguagaacuguuaaggucuaggggggugguucuagauuuaguuuuggaaaguagccaauccaugagcaaguucuguuucuugauuuaugugggacagaaauauaaugcacaaaaugugaauuugcuaccaaguuuguggacauguuaaguuaaaacaaauauucauuacauuacuauauuaaauuccacaggugaguggaagccauggauuuaaagaauagcaauucacagucaauacuaaugauaccuccuuccaccugcaucauaaccauuucucacuauuuuuauagcaguuucuuuuuaaaugaagucaguagcugugcuuaguuaccauucaauuuaugucuaugugugcuucuggcguuuuccgcuugugaauagaauaagcuccugaaaucagcauaucuauguuguucuaucuuaauacuauauuuggagcuguguaaguaaugcacauccugccugagauaaugucucuguuuuucaguuacauuuaaguuccaucuucucucuuccugucucuucuuuuaacuagguaaaagucugccuagagaagcaggucuggcagucaucaacaugucucggaggagauucgauugccgaagugucucaggcuugcuaacuacaaccccucaaacgccgauuaaaacagagaauuuuaauaauuucuauacucuuaccccaaaagaacuugggagguaaggaaacuuugauaucuuugauaugugugcuggcuaaauucaguguuuuauuuguuauaaaacuuagaacuguuaucagugauuagaaagaaaagcuuucaucucuauuuucuuagcugaacagaaaauuaaaucuguggaggaguucauaucaaauaucccaccuagcuccagaucucauuucuuuuugcuucugugucugugaaugggaagggacagcucaggcugccaaguccucaucugggcucugccauugauuaccugugugacuucaguuaaauuacaacaccucucacugccaucugaaaaagagauaaggauaauuguauuuauuuguguagauuuuuuaggguuaaauuacuuaauauuuguaaagggcuaauacaguguuauauguuuugguucaauacauuuugauuuuuccauuccuagcuacugugucugucuaaaauagaaagagauacuuccuuacuccauauguacauacccucauaaauuaagaauauuuaacucauaucuaauaucacaguuuuauauuacaaagaauuggucuucuguauuaguagaagccugucuaaauucuuggcuuaaucaaguaugcacuucuuauggccaagcgugcccuugacauugaguacuacaguaacuuuuuaguauguacuaggaaaccugugccaagucacucaucuguugugugucuucuuagguuuaaaguaagcaugguuaugaagaguuagaucauauuguuuuuuguguacguguguuuguauggagguaaauguuuggcuuaugcuacagugguuuacaaaguguuuucuauugauggguagacaaaaaaccagucugaucucaguguggaaucucaaguugccuggacuaggaaagguaauucuuugcuugugucuuuuauguuuuagguagaggcaaguccuggccuuucuccuuuuuucagauguuucauaaagccccuuuuucauaacauagagaugagaccaucucacagacauagaauauuuugcuucuugcucuacuaaucucuccuucauaaauagacaugguuuccuuuugguagcuacauucaguauauacuugaccgucuuucaaauauuuaaacaaagcuggacaucauuaguuucccuaaguauguaucguguggcacacuauccagacggacuuccuuuguucaauuucccucuucugggacacuuucugcuuuugauuguuucuguuaaaacgaagggccuaguauuagacacaguauuguucacagucuuacuuugugagaagacugcugaagccauuagaugcccgugugucuccuuccacauuuuguuccucucucuuuccuccuugucccccuuucuucuuauccauuuuuauuacuagggaugcccggucugugucauauagcaucauauuauucugacuaagcuaguuacuugagcuuccuuugcucuggaucaaaauuugugaucagugauccucuuaguugaguauuaucuccuuuuacuuaguugagaagauagacuaaauauguucaaguugccuuuuauuguaaaacaacuggaaauugcucugaacagauacuuagacaaagacuugagcauucuuaccuguuuuucuagguuacuauuuggaugaguaacuuuauuagguuaacuucaaaauaauaggcaucgaggcuaaagagagcuuuuucccuuuaacuuuguagaggacuugcguggggucacuguuaacuuuacacugucugcaggugaagggauggcauaaggaaccagccugagcuggacuaaguuugcuuuuaaagcaaaagcucguuauagguuaugguuaaaacaaaagucagauuccuagugucccagaaucagauagcuucauggaagagacuuaaaucacaucuuuaaauugcuuugggcuagugacucaugugauaaauauuguuauauuuaauuuucagcguuggcaauuaaaaauucuaauuuuuaaagccuuccauaaaucuuaaaaaucugucaagcucuuaaccagacuuagugagcuuguuugaugaagugaaguugggguucauucuuuucuuuccucuaggagguuugcauauuuuguaauuuagaaacauaauucuagcauauagaaaacuacaaguuaucuguccauaccagccguguuuaaaaauuaauuuuaaauguccuuuaagcaacacaaagggaaauauauaacguaagucuaaguucauuuuucacuaaacugcauuguuccuguuuuuuaccauguuggguaaguuuuuuccaccccucccccagcugaggcaaaguuucaucggccuugugguuagaagggggaggcagauucagaaauaaaacgucagcuuccuuuguggcuuacccuccccaucccuugguguuuuauuguguguuuuagaaugccguggguaacagcuagaccuuuuucauugcugggaaaucuagucagccuugcccuuuauguuauuauuaagguuuuacauucucuugacggcuucucuucaguuugguauaggaacauaguuuaaagauuacuguuagacgucuuaaacuacaacuggcaucuaaggauagaaaguagguacuuguucuuuucgccuaaagccucugauaauaaugguaaaauauuuaucuugcuucacaguauuuauaugaauauaugcauaugaaauuguauaaguauguugauguaacuuucucaaauguuuaaaaaugcaaaugugagccaggcagugguggugcacaccuuuauuuagucccagcacucuggaggcagaggcaacuguggaucucugagugggaggccagcuugguccagaauggccagggcuacagucccaaaaaaccaaagaaagaagaagaugaugaagaagaggaggaggagaaguggggagggggagacagaagaggaagaagaggaggaggaagaagaggaggaggaagaagggggaggaggaguaggaagaagaggaggagcaaauguggauuuaaaaacagcacaaugugugguguuacaguagauauucagacucuagcauuugcucagaaacauuucaggugauauuaaguguuaguuagcuaaguauagauuuuuuuaauagauuugauuaauuagauuagacacguucccuguccucauagaguguucccuuagcagugaacacugucaaaagaaccaucacccaugacauuugcgcaacuuuguccugagcucaugaauguaagaguaguuuaagagagucuuaggaagccgaaauagugagguaaaaauagaugaaacuuguuaaucuugcuacuuguuuuugaagcaauucuaguucauagauaccuucagguaacuggagaguagugacgucaucacaacuguaaaugcccugucuuucagauauguaauguccuugguuuccuagcuugguuccuaaauuuuacaaggugaggguuuuucuaaaaccucaacucccuuuucuguuuuagacaaguuuuugcuucuguaucuaaguaagacuugguaauuguuaaacuuaauaaacaaauccauuuuaaggggagaaauuguuccauaguugugagacaagaaagcuagaaauucuuggcacugaacaguaaaggaucagguuuguauaggcaguuuauuucauugagguauguaggcuucauauuauagacuguauacuuuauuuuuaauuauuagcuacauguuuuagauugacacugauuuuugagguauuuggaaaauaaugaggaggaaacuguuguucugguucuugugaguaacaaauaaaaugcaggcaagcaauuucuucuccuaacucccacacaggggguuaaaccacuuagguuaaaugguugacccugcuaucagcugaccaucuauguuuagaaguauauuuuugagaguagcugcagcaauggaguuaaaauaccaguuucuggagauuuacuuguacccaaguuaguaccagaaacuagaaugugguuuauucuuaguuauuaaauugggaucuuuuagaguagagccuagcagguuuaugauaggcuucaaucugaaaacccucugggauugaauguaaaccucccugucuaaggucauguugccucuuuuuggagugugcaaaucaauaguuuguuaguucuuagacuaaucuuagguucagaauagcuuuauaucuuugaaaaacuaaaugcuuauaauaauaauauaugcauauaccaggagaaauaaucuuugugcuuuuaaguuuggguaagaugcuaaguacuucuauuaaagagauaaaaacauauauaauuuccuaaaaugacagaugugacauuaccggguguuuuuauaccaaacuguugaucauccuuaauuucuuacaugaucccaaaauacauuugaauacccuccauaggauccauaucccuuguguaucuguuagaggcauaguguuguuaggcacaugauauuaucagguacacugaaauguauuauacugauaguaaaaacaauaguuuauucugcuaugauaauugccuacacuuacacaguaacauuguagacuuaauaaaagagcacauaguauuugugucagcuuguacaaaaaagaaaauuuccuaauggcacagauacgugaaagacuucaccuuaaguuggaguuaugaaguuucccuauucuuucuuucuagaggaaaauuugcugugguuagacaauguauaucaaaaucaacuggacaagaguaugcugccaaaucccugaaaaagaggagaagagggcaggauugccgggcggaaauucugcaugagauagcugugcuggagcuggccaggucuuguccccacgugauuaaucugcaugaggucuacgaaaaugcaacggaaaucauuuugguguuagaauaguaaguaugugcuucauacauuuaagguguuuauuguaauugguggaauacgaugcagaaugucagaugacaacaguaugacaacauugacuauugauaaaauauuagagagacauaguuuauauuuguacauuuuuuuuccaaggcuaaauauguagccucaaacaucuaggccaaaauucauuuacagcaggcaacaaacauagucaacccaacaauuugggaauauaguugcaauaauuuaauuccauauuaauaguuuauaacuugaggguuuugucuagaaauaaucuaauaacaaauaaaauagaagccauguuuuauguuuugcuaaucuguuuaguaaaacauguccaaagaaaugaugcaagaagagggcuuguaaaagaugucuacuacauuguuaugccauuuauaguacauaggauuuaaaaagcaaugucagcaacuguagccaaaagaaaaaaauccgucugguuagugaacaauugcaaacacuaaagcacucaguaauggaugaaguguuaugagugucagacuguuaagauccccauggcuggcuaaccaaguucagcaucaaauacacuuacuaguuuuugaagauggacaauauaugaaagagaauaguaaauuaauacugaguucaccaccuguuuugauaggcuuuaguaaaguaaaucuacuucagcacaaacuaaaaaaggaaaguacuguuuuagagaaaauaaugcuacaaacuagaggaauucuuuuuaccagucaauguauacaaugcaucgcccuuugaaugugacaguguauuuguccuauuuuacuuuauuuguauguguauauauguacauggagugugagugaugcacguuuggugugugugugguaugcacaagcaugugcaagcauguggaacucagagauagauuuuaggugucuucucaauugaucuucaucuuauacauugagacuggguggguccuugaguaaaccuggagugugcccuuucugccagucugguuggccugcuugcuccuuagaugcucugucgcuaucuccuaugcauuaggguuguaggcaggccaccacaccugcuuugugaucagaaccugggccucaugcuuucugaguucccaccccaucuccugugagcuucguuuuaggauucauauuguaaggaaguagagauuuguucauauggguuuuuuuuuaagucaauuguuuuauguaagaaaauagauuugacuaaaauaauuugugaaugaaaauuauuuuuuaaaaagauuuauuuauuuauuuaauguauaugaguacauugcagcuaucuucagacacaucaaaagaggacaucagaucccauuacagaccguugugagccacuaugugguugcuaggaauugaacucaggaccucuggaagagcagucaguacucuuaaccucugagccaucgcucuagcccggaaaugaugauuuuuaaaagguuaaacugacauguaguuuacugaacaaugaguaguauauacauuucucagaacaagauacauaaaaguauauucuagaagcuucagaguaaauuagcauagcaggaaauacuaggauacuaccaaugccauuucauuuuucaugcauuuuaugaugauuuuugucaaaaguucuucagcugccuuugcucuaguucuuuuccuauaaauuaugggaaaagcauaaacauuagaaaaacagcuaauaaaauacuagguauagagaugaauacaagacauugacuguguuaauaaaauccuguuuggagaucgucugaagagcuacaacaaaauuccuuagaaucaugauguauuuuaugcauaggucauguucacaaucugaaaauggaucuaggaacccuauccaacaaauuuaauaggacugacugugaucuaaauaccucucucuggcugagauagaacuagcccucagcaaguguagugguagauuaguguauuuaaucucuuaaaguaacuuuaagacuaaagguaauugcuaggauuggggcucaagcgugucugucacuuucuggauggcaguguuacacugggcauucucauuuaauccuaacaauuuggccagacagauuuugaaucuaggaauacuugaaaaaauaauccgguugacacguguauauucuucacuucaguucaucaguugacauuugaugucuuugcugaaccauuugaagauuguauaugcaauuucuguuuugcauccugcaggauuuguucuaaggagugagguguucuacacaaccaacauaaguaucagacguaaagucagcauacaugaagucgaaucauccaauagcccacauguaaauuucuuuacugucuccauauuuuuuuuuuuugagacaggguuucucuguguagcccuagcuguucuggaacucacccuguagaccagguuggccuggaacucagagagcuaccugccucugccucucagccucugagguuaaggcaugugcuaccacugcccgacaucaucagcugguugugaaaauuuggagaugaguauaucuucaauauaaaggaacaacccuuuguaguuaauaacaaaucugaguggucaccuaguaaaugcccuucucuuugacagauucccuccagaaauuucuguaaccauugacauacuugcacaaauuagcagcuacagugaauagcagaaaaugauucuuucuaauuccauuauuuauucuacauuuauugaacugguguucuucugauaaaaguguuuuucuuuuuucucccauuuuacuaucacuuuguauucaugguuuuguuaaacuguugaauagaauuaauuaaaaacaaccuauuaugaucaaauuaguagacccuaaucauuuuuuccauuauguuucuuucaugccaaauuugucccgaauuuaucaaagguuaaaauuugucaaguagguuuuaaagcuccaaucuguauccuucugauguuguugaauuaguguuugcagacuuccuggcucugcacaccaaggucuccaugaaucuucccuggcugaaccugguuagccggcucuacaugacacucugguuucaguggggugguaucugucaguucugcuuaaaccugcuaauacuacaccuggcagcaagcaacacguuuucccuagccccuuuuucuuuccuuccuuccuccuccucucucuuucuuucuuucuuucuuucuuucuuucuuucuuucuuucuuucuuucuuucuuucuuucuuucuuucuuccuuccuuccuuccuuccuuccuuccuuccuuccuuucuuucuuucuuucuuucuuucuuuuuuccuucuuccuucuuauucuuucuucuuccuucuucuuucuucuucuuuucuuugcuauucuuuuaagccaaaguauggcccacuaugacauuuagucagagucagagauacagaggaaggucaaauccguuugcuucuguuuauauucaggguugggauuucaucuuauaaaacucuuuaaaaauauuuuuuaauuacaaaacaagguuugcauaauuuagaacucaaagacacauaaaaaguuuggugugugugugugucuguguguguguguuauagaaauugaacccagacccuaguucauuauaagcauauaagcauacaugcuguaucacugccauauccauagacccauauauggcuaaauuccaaagaacuccauuguauggcuuuuuuuuuaauuauuuuuuuuuuauucagccuaugauacaaagguggagcuucagggcaaauuuuuggauguuauugcgagcucacagaauaaauguguccaacuauauauaguaucugaaucuguuuugaguuacugcguuugcuagcuuuguaaauaccuguaaacuuuauuuaguaauuaauauuucuaggaguuuugauaguucuauuguguuuuuguauuuuccuguuuugccucaauuuaaacuuuuuuaaagucaaauuauuuacuuuuauaaauuaaacugaaguccuuguaaucaccuuguacaaagaucuuuuauuuuuaucaaaauauauagcccacauaaaaguauuucauuccaauuauagcauaaccgugacuauuuuagcccuuucuuugacuauuugaauaaauaaauguuacuuucuagaaggugguaugguugcaucuuuuuauaaauugaggagagauguugagacuagucuagucacugucacucugugaugugaagaccuuguuccugcuaagugauuuggagacauaugcaggaauuaaggaaaacaccuaaaaauccaaucaaagagaauguguuuucuaaauaggcauaugaaguuuuuaauaaugcugaauuuugagcaaacuaaaauuaauuauggcuuacacucuuuagcuuuuugaagacuauauagcaaaagcuucccuugaaacagaauagcuuggaaggggaacuugccuauaauuaacaaguggcaacuuugccuuuguaagauacccuuuuuuguuaggaaauuacaaaguucuuucgauuaaauaugucauuguagaagacauuuuaaaaguccaugugauagcuaauuuaacagcagccagaaugaauucuugauuucugugacacaacugugagcauccuggugaccugugucuugcuuuguaugauuuucucaguucaugguguauucuauaccuuguaaagugccuagcaaacaaguuucugaaaaccuagcgugucaucuuuucauuucuuacuuucuuagaauuguauucgcaguauuauaauaguggcaccauugcaggaauauaguaggccaaucuauuuuugagugggauuuuuaguuacaguaaacgguuuuaacuaaaaagggaggggugaagguauauugccagccuacacuauggacuuccacuccuucuucaagacacaccagggaaggaugugggagguaaacacugaugcacagauaaaguggccaguauauuaaauauucaugaagauaaauuuauuucuuuuucagauugcacguuuccuaucuugccuuccuaugccugauuuuguagucuacuaauauaaaugcaauaacuacuaauauaaauacaacaguggugugaaauuucugauacuuagacugccuuaucaugauaccucaagucagauaauaaaguuaguuucaugaauuuucauguuuugaaugaguggaauaggauugaagugaaguguaugucauuggugccuucagacauguuccuuaccagcugauaguguuuccuauguugucaugaaacagugccagcagcaaauccuucccuuggaacgcugcguacagauuaaucagugacagcuuacagcugcauuggugcuuggaacauucaacuuggaacugaaguuugagagcacugaauccuauuuacaacauguuucuuagucuugacagacagagaugguauaccugacauuuacauggcugugugguuuucacuuaauagguauacaguauuuaaagguuauuuuuagguaaaugauuuuaaaagguuccauuuuaauuuucuuucagugcugcggguggagaaauuuucaaccuguguuuaccugaguuagccgaaaugguaucugaaaaugauguuaucagacucauuaaacaaauccuugaaggaguucauuaucuacaucagaauaacauuguucaccuugauuuaaagguauguuaaugugauuuaaacuaacacaacauuaguguuccuucuguguucuuggagguucagugcuagggugcuguugauacaagcaaguuguguugugguccucuagacuacagugggugcccucugcugugugagcuguguuaacugugaguugugugugagcugugagcuuuguauugcagacaggaaaagcugcaugugggauaagcuugaguuaaaacccaucauccuuauacuaguuccugcuccccccuacuccuagaggccgacccagaccuuuccuagcaccgccucccuuugaagagauuggugcugauggcugucuaaugugcucucuuugcuccuuauugcucugcuccagaucucacucaucuucucuaaagcgugauggccuuugucuugugcagauuagucagaggccuuacccuaguccccagaaccacucgaugcuuucugguaaugcuguucuuucuugucuuucuccacaacuacucacagacuuuaaagucugaaggaaccugucuuguguuuauuaaacaauggccuccacucugccuauagaguuugucuguaugagccuuuggguuccuuugccacuuucauaacauaauuccaaaaucacugcaugccauagcccaggcuuaucucugauuuccaaaucuuuucccaacugugguuucaauuugaauccauuugaaaguucuguaaauacuuuaaaauguacaauguccagcugucucuucuaucccuuaggaaaacaaccaaaaccgaaaccaaacacacaaaaagccagcaacaacaaaaaaccagcaccaucugcauuugucccucguggagaggaaggaaaauuuuccaguccagccuccccacuggcucuucuguaaugacauaaaugggaaaggggcaacagaguagguagcugggugauuaucaaugaccagcaaauuuuuggucuuuguccugaucaaggcaaagugacucauacagcacuugaaguagggguagccuguaaaccugguuuuuaauaccauaaccaugaagcuggcaacagaggugacuugucucuucuaguagucucuugucacccaguuaagacuguuaggauuuuuugugcacagacuuugagcagcacuucuacacuuacagugggcucugauaggacuuugucauagucugcaccugcaacaagaaagucaaaucauaugucucuaggagacaguggaggauacauacaucuuaaugucuaagcuauaaaccuugggacagucaggcccagcucaucuagagccaucacaugauucagaaucacuuucuacucuggaugggauauguaugcuaauucuuucaugcuuacucugcuaucagucaggccuuuuuaauuuccuauaagacuuggcuugagcaucaucucuacugcaaagacuucaugugcuuggcucucucucucucucucucucucucucucucucucuguguguguguguguguguguauguguacacgugugcuugccacuucaacuuuucauggacagaauuugguacaucuuaaaaacuaaaaguccgugucugugaauuuccucaucaugaaauauguacucuuccuaauugggaguucaguggauauugggauaaaguaucuaagaaacguguaaguucuaagcaacagguucuacucaauuuaucuuuaaucuaggauaauaggauaaguacccuccuucauugucuauugcucaucaccuuuuaugugcuuuauuuagccacagaauauacuuuugagcaguauauacccacucggggacauaaaaauuguagauuuuggaaugucucgaaaaauugggaaugcaagugagcuucgggaaaucaugggaacaccugaauacuuagguaagaauuccaucuuauuuuuuauaucauuuugaauucuuuaacaguauguuuuaugauagagguauagcucaugagguagagugcuugcuuagugccaaaaauaaaccggaaagcccucaccuauuuuagauuacacaauaccaggacucacuugauucagaaguugaaugcauucaaauuuguuuaugacucauuagaugaguuauagugaaaucaggaauauguaagcauuuggaacaacucacaggacaugggcuaaguauaaacguauguacguguuuauacuggcuuuguauguaaggagaagaggaaagcauaagagggaaaucaguagcaaauugguaaaagauagcgaugagagaaacagagccaagcaguccgagagccucugaggucgcugcaauggcucuuacaucugcuucugucugcuccuggccagagcgagcuguguacagugcagccuuugguuucacaggggccgcucaguguuugucgcuguuguuuucaaaugugaggguuucuaauaggacuguuaagaggcuucugggcaaaaagauaccagaaaagaugaugagauaaucuaggaugauguacuaaauuaacaaauuugauuauucauacaacaaacucuuaagaugugugaaaagcauauaagcaucaaauauuuugagauagcuaucuuuuuuuuuuuuaccuucuguuauuguucagaugaauauuuccauugaaaagauaauggcaaacagaacaggucucaugagcuaggcaguuauaucccagaaaugaaaaucgcuaacucuugaaugcuaauauggcuauaguguccuguacuacagaguuauaguuaauaauaacauaguucacaaaaauauacaaaaaggucauguguagcuugggaacacugaacauauauaauucaaagguaugaaucaugagaauguuagaggugagaaaguucuuuuuggagagaugaaaacauguuaagaacaugaucuguuuuacccuuaagagauaagcuuacaugaagccaacaagauaauauaaguuaguaaaaagcaauaaaacuauacuuguaaagauugugcuccugccuuuucauuucuuccuaacacuuuuccugaggucaucugggaugcacuggcucuccuacugcagagccucaagcuccucuaggacagcacuggcuugguccacugcccacuucuucaugagauuuucaaauauuaaauaugucuuaaugucuaauuucaaaguaauuaaaacccuacuaaaucucuacugaguuuauauuacucugccuuuuaugacaaaucaaguucuuucuaauuuaaugugaggugauaaucauguuuuaaaguuugccuaugcugagccuuaauuuucucuuucagcuccagaaauccucaacuaugaucccauuaccacagcaacagauaugugguaagacuacuggugaccuaaguaaccauuuuucaaaauugaauaauauauacuuagguuauagaaaacagcuuuaauauuuuuauggauucuuugugaauuucacaucacuuaccccugucucacucaucuccacauccccucaucucuacccaucguccuuauaaccuccuccccuaaaauaaaacacauacauacaaacagacaaacaaagcauagaaaacaucucauugugggagcuguagugugucacagugugucccacaguagaucccucugucugcauauauguucauugcaaugagucauuggucugguuugaggucucuggcuuccaacaauauuggauccucacugcgacaccucuugguuaucuuguuguugcccugugucauggaaauccugcaguguugggacagcaggacugacccuuucaggcuuuccagccauucacagaugauacagauuuuggggugggccaauucagauagcugacuuggcuagcccacugacucuccuaaggcuuucuuucaaaaauuuuauucaaaagauaccauugaagaauuuuuaccuacuucucaguaagcucuugagccagagacauagaaauagaaacucccucccauugaucaucucaguugaguaagagugaaccagccuguaucagugacacacacucuguagucaaguaaauugcucaggaagcuaggaugacacaucagucaaaacaugaggcccugccuaacuaugccagucuagaagaguuaaguauuugcugaacagaaugaggucagaagcacacagaugcuuaaguuuuuaaggguucaccuguagggaauaaugggguuugcagccaucucagagagaccuucacagggggcagcacagguauuggcacuggaacuucuguugagaccaacugacuucguaguccaagugaagaguuuagccuuauugucuuugaagcuaauggguuuguaguggcacaaaaggucugauggcuaaguccacguguaaagcauacugugcugauuuguucugguuccuggccgccuugcucuugacauauuuacagcuuugagaaguucuacccagccagcuuugugcuuugucagacuuguagccuuuuucacagaacccuggcucucauggggcagaccaacaagugucuguacugaaggcuguagauaaaaugauauuuucaauggauuauguuuaaguuauauguaacauaucuguggacucccuguucucuuggugaggcaaauguaacacaacuauuuuuguuucugugguacaguaaucucuagaagucauuuuaaguauuuuuuaaacuuugccagacuuguggacuauuaauuguacugccuauaaauacuguuaaauugaugcauuuuaaguuuccuucucccuccuuuguuuuucaggaauauuggcauaauagcguauauguuguuaacucauacaucaccauuuguaggagaagauaaucaagaaacauaucugaauauuucucaagugaauguagauuauucagaagaaauguuuucaucaguuucacagcuggccacagacuucauccagagccuucuaguaaagaacccagaguaagcaauggccuuauuuaaauuauuaaauuauuaauuaaauuauuacaaaccaaauaaugugugccugcuaaagacgcauucuacccaaaaugucacuuauggcucuuuuauccuguguuuggaaacuguugcgagauucucaggaaguugaagggaacuacuaggaaagcagguggggcuauggggaagcagcggggagggugucucaguaacaaagccuauuaugugcauguauagaauuauuucagugaaaccuauuuaaaaaauuaaaaaaugacaguaaaagaaaauuacuguuaaagucacaagaaagguacauuuuaagguuauauaaaauuauacauugauaaaacguaaauaaaguugauauaaaaguccauuaaauagcaaauauguaucuauaagcaaaaaaaaaaaaaaaaagccauaacuuacaacaggaaguuuagaaugaagguaagauuugaaguaaauguuuucucaaccaacugcuaauccauggcuuacuacaaugggaugucagugugaaugauuucuaguuaaauuggucuguuacauaacaggcagaauuuacugaacaccagaucuuaaaggaauaaauguauacucaugaguggcuucauuuuauauguaaaaauguucaaacuuugauugcuuaaaaaaagcagacauccuggaaguagagagucucuuucacccuggcaugcacuaaacaugcagugcaucguagaauuaacggaagagaguacuggacccucgcuccagacccuugauuauuggcaguuuugaggcaauaaaagcacagcucuuguuuaagaagcccuagagcugcagccugcaggccaguggucucacuuucuagacuucucguuugacagaugcucuccuagaggacucaguuucuuuaccugcaagauaaaaaaauagguuucuaaauauuuuauuggauuacuuuaauuccagacaacucuuucaagguauauauuaggcauaaauacuuauuuuauauagaguaauaugguuucuguuuauaagccauuuuuguuuucuuaaauagucuuugccuauguucuaaauuuucuauaauaaacacaguacuacuuuaauuauaaaaaaaaacuauauacagaaacaaaagauuagaaauaucuaucuaccaagugauuacuguuuaaucuuugaauuuauaaauguuuuuccuucuuuugaauagcagaaaguaaucuuaaaauucaaaguauuggcuaaauaucauugaagacuaccuuuucaagauuuuuuuuuuuuuuugguuuuucaagacaggguuucucuguauagcccuggcuguccuggaacucacuuuguagaccaggauggccucgaacucagaaauccgccugccucugccucccgagugcugggauuaaaggugugcgucaccacgccuggcuccuuuucaggauuuaaguugcaguuuuaaagcauaaaugcugaaaaauuaguuaucgauuuauaguuccuccaaagguuuuccaaauugaaagaauuugaaaauaaugcaagucuuuauucuauaauacaggaaucuaaaaaucuagagcagcuagacaggcagucauugucauuggcuaguguuuuccaaguuguacuuccaagaagguaucuaugggaauaguuauuuuuucugucucaccuuacucagcauggauucuaugggcugagggugaagccaaaugguagaguuuccuucacuugugugaagcccuaggaucgaucccuagcacugaaaacuaguucguauaacaaagauuaaggaagaaaagucaaaauuuaaaagguacauccugaauacuauaaaaacuuaauuauuuucuauaaucuucuagaagguccugguauuuuuguauauuagagguaauuaggaggagaccuaaaacaauguuucaaaauaaaaaaauaaguuuauacuuuggagauggucaacuaauuaccuagaaagccuuuccuuaguguucauuaauuaggucauuguuuauaacaucaagauuuuggaagcaccaauagguaucugcuuagacagauugugguauacgaggauggaagagugauaaaauaccuuuaauucuguauucauguaaaaagguaauuaagguguauuaucuacuuugagcuaccaccucaccaaucagagcugcuaucaucaagaaaucagauagcccauguuggaaaggauguagggauagaggaauccuuauuugcugcuugugagagugcaaauuaauauuguggaagucaacuuguagguuuuuuaaauucaaaauuaaauaguauaugacucggcuaugucuuagcuggacauaggcccaaaggaacucuauauccuaccauagaaauauuuguguaucugugauuacugguguuuuauuuauaguagaaaggaaauagaaccaauagaaauguuuaucaauaggugaaugguuaaugaaagugugguacauaugcagaaugaaauauuauucaguuguaaagaaaaaucaugaaauuugcaggaaaaugggugaacuuagaaaguagaacauugagugaggugccucaaacuaaagggaaagacccauauguucugccucauaugcagaucuuagauuauaauauauacauguauguauauaugugcagagcucaaaguguauguauggucuaacaucuagaaaggagagcaagaaagggugcuacugaguggugaggaaggguggaaugcaggcuaaagacaugagucaugaaagaggacauaagguuaacugucuaucuaguuucaacccugucacaguuuucucuuuccuuuccaugugugucugugcacaugugauggauaagugcauaaaaauguagcugacagugaaaguguaaacccuagaugaagccccaugacuucagcaugccauucuaacuaugcagagagaugaguaguuugugacugggcaaauguuuguuagaauggcuacuuaaucuaccugcaugaugucuuuauuugugaacucauuacaauaauuagaagcaugugaaauagcccugccguauacauaagcauuuaauaaguuagcuguaucucucauucugcuugggcuuuacuguacgugcugucuucaugcugauuuuuaaguguucuuggaagacaugcucagcuuaccuugagcacucaccuuuccuucucugcuuucugccaaaggaaaagaccaacagcagaauccugccuaucccacucauggcugcagcagugggacuuuggaagcuuguuucauccugaggaaacuucaggcuccucucaaauucaggaucugacucucagguccucugaagagaagaccuccaaguccuccuguaaugggagcuguggagcccgggaggacaaggagaacaucccugaagauggcagcuuaguuucuaaaagauuucgauucgaugacuccuugcccagcccccaugaacuuguuccagauuuguucuguuagcauuuuucucugugacucaucuggacugacucggaaauuugaaaucucuggugugagauuguguuuguagcuucauauauuauguuuauauuauaaaugcacuucugcuuagaagaacuuaaggaacaguuuaaaugcuaggcuucuguuggcuagcauaucauuucuuguccugaaauuguuuugcagaggaaaauauuuaaguauaugacaaaaaauguaaauuguguuuaagagaacacaugcaacugaaagaacucaaguucagucagacuuauaaaauggguuauauuaugguuaguaaaaguugaaaaaaaaugaaaacaggaauuuaguagguucuaagguaagcccuauaccauaacucuauuacagagaaucuguuuggggaaaugcugucaaggguaaaccacaacauauacugcuuuauaaauacuccagagagaguuuauaguugaaaguauuucccaguuaccaauaauagcuugaaacuguaagauuuucuuugugugccaugugcucggugagaggacacagucaaccagagcaggguugauccaggcuguuucucugcaaaccgagucaaaacucgacaucauuuccagcucauguauuuuguacgugcaucauauaucagaucuaauaagaucuggaagauggauaugcaaauaagaggccuuugucuucuagaaugauuagaguagaggagaauuggauaguacagaauaugcucuaguuucagucagacauauucauaaagggaaauguuaaguucuggcagcugacuuaguguuggaugucuccuaagucucaggauagaagcccaucauuagagcauaggcacuucaggaauucuugugugaaauucuagugagugaggaggugugacaugcagcuaucuuugggcuccuuuuguguguguucugcuggacacaacacaugggaguguucaguguuguccguggucaauaucuauguucaguccugaugggaggggccuagggacugcuuuggagauuucccacugguguccauuuuaaggucuguaauaaugucauguuaagauaacagaucucauaaauaugcuacucuaucagacuccguugccaaaacaaauuaaaagccuguguauugaaguggguguuagucuaacaaccuguaaauucuugaaauuguuacuaaaauuccaaauucuuuagauaacuuuaaacuauuuaaauugagcauugcugucuuuguuugauuaaagguugaguuccuuuauaucuguuauuuuuaaaggaaaaguuguuugccuuuuguauaugugugugcauauguguauguguacagguauauguauauauguauugauagauaaaauacagccuuuaaacaacuucauguuagauauucuuuccuuguguauuauguucaacucaggugccaaaagagcccucuuaucugaauaauaaguaugcccauacauucuuuaagaaguagucuguugguccaagaagccaaacacuaaagaugcuaaauuuaacucuuguguuucugaaauugagaagcuguugguaaauuauuacuuguauacuuuccaucaguguuaauucagguaaugucauuagucugucauuaggaaaugugguuacuuucccaaacagugauauuuuauuguaaaacuuuaaaaaguauuaugccacucaccaaaaguaagcauuugaaaauuuaauuuuaagucauuuguuuaaaaccacuuuuuauugucuauauauauacauuuuuucccccugaggaauccugagauaguuuguguguuccccuucguuaauuggcuaccagguuguaaacucccauaccuuuccuugggacauugcuuauuguaaaagaguagcuagugguugcacacaauaaaaaagcagucuuuccauaaaagcaaauuuacaaauuucccauguugaaguguggcaauaaaugucuucugagagaguuaaucugaag

SEQ ID NO: 161 - RNA, 42340 nt, Mus musculus
auacuaugacuuuagaugugauaaguuuuauuuaucuggugguacuugaugcucacagggcaccauacaacaaauauuaaaaauacaauauaaaaaaaaauaaaaucaaacagccaaagaaauaucaauuccaucagagggcaaugcccagagaaaaaaaaaaccaaagcccagagaaaaacccaccccucuguccccuuaagaacaugaauuccuccugccuaaguuucaccuuaagaaacaucaaagugcuaaagaaaaggucuuaguugagaaguguuaaaacgugacauagcaucuuucacaaggguuuaucccaaaaugcuuuccuuauucaauaagagcauuucacaauccaaacaucuuugaguaucuauuuugguccuaaucuugagauugcagccuucagcauuuuuuccccuuauccauucucagauuaccuccaucaggaaaaugucacuuaagggguaagcagucuccugugagcuguaguucuacugcaaaauuuaauuuuuaaauaaaaagcaagaaguuaaacaaacuuaaguauuuuaauuaauaauacaauaaaauguucccaagugguuuaaagucaaauuuuaacuuugagaaauauacucaauucaagauuguaauuaccaaggguuauuugaaaucaacuauacaaaacauuuaaaagugcuuagguauggcuaggaauuuucuaagaacagggaaaugguuuacuacacaaugauagucagaccacauacaaagaacaagaauccgugcguccugcauggggacgguuaaugcucaguauccauucugagaaagcagagcagaagcugucucuaaucuaaucugaucuuccaccagagucuuccuuguuaacagucagaagcacaagcugccuagcacuccugacagucugagggugguagagucacaugccagucacacugauggcagaauuuauuuccuuuuagaguccacacaaguacagagggagacaaaacagugauggcuagaaaaguuuuaaaaacaagaaauuuggggcauaaaauuaaaaaacaauaaacaacaacaaaaaaaagcugauucauuaguugacccaaaacauuaaaauagccccuuaaugcuuguucuucauaaacugaacggcauuuuggcuuaugcucacacuuaagccaauacaguaucugacugcuacauacaagcuaagcaaaucuaggcaucucugcaucuuccauugcacagcacccugguaccuaaggaucugcgcccacccuuccguuacaugaaaggccggaucaugugcaccuucgaagccccuucuucaacagacaguggcuagcauucaacagguguucaauagcugcuuauaaauaaacugauuagaggcaucacacaaaagcccaaagacuguccuacuauauaauuauuucuuagauagccucacucccaacaggaaauacacuauucuaaguuacagacagcuucuccacuuuauaagcacaggccaaaguuggacaagaaguaaaauauauccuucaugucugcucauaaagcauuuugagaaaucaaggugaaaggugcuauguaaguacaaaauaauacuuaagacagcucagucagagugcuacuuuucuauggugcuggaacuguuaugcuacacugaggggaggggcaccccaagcuacucuucauuaccaacaaaacaaugggcuuuugacaaacaggccaucacuauauaguuugcgugcugcuguguuccauaauaaacuaggugacaaaagaugaaauuaauccacuuauucuacacaaaccaguacuuuaccaaaguuuugcauuuuacaagucauauucaaaaaacacacacaaauuagcauuuuguacacgaauguuuauuucucaauuaaacauucccuuuaaacacaaggaaugaauucuaaaucuucauaaagaugaauaaaaaaugauaucccuccaguauaguguguauaagcacuguccuuggucacuacugccauuuacuguuuaacaucaaaaaaacaaaaguuauuuaaaaaucaugcuacuggauuucuaucccuccacuaugaccagcucuacacugaucggcaauguuuuacaaguuuauaucaucagauugaagcagguuuaaggugugaaacagcuguauuagacacaaaguuacaagauauagucaaguucguaacgaauauagguguucuuaucgucauuguagauucguggguaaugugcuaugagagcauccugggagccaauguagauggaguuguaaauuuuccaauauacgucucugacuuuccgagcuggguggaacagacccuagaauaaauaaaagguagaguuacuucuaucuucaaggggaaaauaaauaaauaaacaaacuuuaauacacuauuagcuauaaauaugaugcaugguggcacacacauuuaaauccuagcacuuagaaacagaagcaaguggaucuaucuacuucaaugcuggccuggucuacauaguaaguuccaggccagccaaggcucaaaaaauaaaauaaaacaaaaguacuuacuuugaagagggaaggaaaaaaagucuggaaacugaguaacaaaauugugguggguaaauacaaaaucuaaccuaauuuaaucuaaucuguaucucaauacagaacugucuuccacaugguaauuagggaaugacugacuucaacauauuuaaguaauuuuuugagcaauccccgcauuuaauaaaaaaaaaguaaaaacccacauuuaaccuaccuguaagcaauacugcaacauucugcaugguccaauagcaacccucaggcccuccagagcucccauaacugccuggauuacauggggagaugucucaaacacauuaggccacacauaguucaguaagugauucagagaauccucacagccaaauccguaaacaccaagugacaugugcugcaccacugcacucgcugucugucugugaacaaggucccuguaauaauggaagggaaaagucucuuuaaaucagucccauuuuuauauucacuuguacaugcggaacuaauuacucucaggagucaaucucauuuuaaauucuguaaccuuaaauauuugauaguuaagucacaagucaaaaugaaauuuguucucaaacugguaugauuucauucaaaaauucaauuuaagagaaaaaucuacuagguuuuuaaaccugcacaaauaagaauuuuuaucucuagcagcaucugaauuuguauccaggacauaucaaucuauuauucauauacugagugcaaccaaaauaguguucauacuuucugccaaaauauuaacaaccccucaaaggcauuaggaaaaaaaucugaacacuauaauuugcuaucuaacuuauuuaaugauaaaguuucaauguuucacagcugaagaaguauucuuuuuaguaauuuucaaguuacuaccucaacuugcacacuuucuaaaaauuucuuuagaauugaaaacaaucucuaaagcacaguauuuuuaaaauaaauauagaagcaacaaauauuaugaacuucaaaauuuuaugaacuucaaaauauuaugaacuugaaaaccuuucuaaaacaguugagaucucaauaaagaaugaauagaaaauuauucuggugauuaaauuuacaugaaaauuacaaaaagauuugacaggagucuaaauuuucuauaaauaaauuugauauauuaacugaguauaugagauucaaauauauuuugcaguauaauauucaagaaccuuuuuuuucuuaugaauaacagcccccacaacagaaaguuugccaaauuuucaauucuacuaucacuuuuauuuguagucaguaugugaagagacaagucauguuuucuuuucacaaaauuccauccauucagaacaaaacuuuuaaccucaagucccaccucucaacaguuguaauguucaggaauuccucacuaagaagcagucuaagggagaagcaaggugauuuacugcuauuuuguuuggucccagaaagguagccuuuucagacugacuccauaacuuacaucugcacuuccuaguaccucacuaaaucuguuuauaaaaugaccuuuaugaaggucccugaguaacuggcuauaccagggacugaaucuauauaugggcuucuugcaugacagaaaugugcuuuaccacugaauuacaaccccccaccuaacucucaaaauguuguugugagacagggcaggugcacagguuggcguggaaaguuucaaucccccagcaucagcuuccacaguaguugagauuacaggcuacauuguggcuaguuuagguaacacuuuaagcuguacacuaaagcaaccagcuaaaaacuuaagcagcacugaaacuacuuauacuuccuuuguaaucuugguagguacaauuaauuucuggaccucaaucuagagauaaaauguaagacuaucagguaacacaaaaguaguauuaaacuaauaauagcuaacaucugaacacuggagggagggcugcagaggaaagacuaugacucuggcaagcuaucuucaucuucaauauaagguuaagauuaaaaaaccucagaugugcugagaauaaagaucguuuguagaacacuggcuuaacauguauguauggagcccuggaguuacacacagugcuaacuaaauccaggcauuuagugguaccugucuacaguccugaaacucuggagguagagggaugagaaaugaagucuaaggucauguucagcuacauaguaaguucaaagccacccugggugaccugagacccugucucaaaaacaaaacuauuggcuucucugccauacuaauucauguucaccuuuuuuucccuaauuguuuuaaaaaacaguaaauccauuauuguauuucaaaaucuacuuagcuuaacacauacgaaaagauuaacaagaauagggaaccugggagagaaaaccuggguaccuaacuauaacaaauauaagguaagaaauuauacuuaugugaaauaaucacaguaauauuucuucuuuaacaauacaacauuuaaaguaaucuuaguaaacucuacacugacgcauaauuguccauaauuuuucugcauuuccuuuagucacuugccuguccauuaacgcauccucaaguaaaggcgucacagcauagauguagucuuuccccauuucgccgauauacucaaacaagaaggagagugauuuuaacacuccauuuugcacauuaaguucaggaacucuguauucauucauuaaggcaggcaguacugugaagggggagcauguuucagcaacaauggcuauggcuacagucguacaaacccuguucugccuuuccugaacuuugagguuguuuaaaaguguagccaauacaucaugagggcuaaaaagaaagaagaaacacaucagcauguuaucauacuuaggaaauuugcucucagagacuacaaaaccugcaagcgaauggauaaaacacacuacuuucuuaucacuaaaggaugucauuacaacuuccaaaaauaaaaaaggcuaaagaggaaaaaagguuuaaaaaaaaaaaagcuucaggggagggcgaccccauaggaagaccagcagucucaaucccugggagcuacaagagacugagccaccaaccagacagcauacacuagcuggucggaggccccacuuggcacguauauagcagaggucugcccucggugagaagaugggccuaauccucaagagacuugaggcuccaggcaagggggaugccuauuuagggggcaggaggagagcaccgucuuagaggcaaggggaaagaggagugggaugaggaacuacggggacaaugacuggaauguaaauaaagaaaaaaacaucaacaacaacaaaacaggaaaacagggaaaaaagcuucacacaaauagauucaucuuaauguuaauucagguagacucuuuuuacucuuuaaauuuuuugaaauauaaaggaauuugacuggucuaaauggccucaagagccaugcagccuuauaaauguaaaacuaucccaaaacucuggacuacuagcauauacaaucuguuccucaucuuccccauuagcccacucccaugguuuccuuaagcagggucacccuaccuagcucuggcugccccacacccagcuuuuacauacuccuuugcuaacaguuagagacaauagggcuaaucaauuuugcacuguaucuauuugcagcauuuuuuggaaaucacaccaccacugaaacaguucuauucuacuccugagaaaugaaaagggauguuuaccuauccugaagggaaugcuaccuaacucaucagacuuuugcauguuuuuggaaauuauuuccauucuaguuuccuuuuugcuucugugauaaaaauaaucuagccagaagaaaugugggaaagaaguguuuauuucagcuucuuuuuuuaaaaagagacuuaauuuauuuaaauucaaauaaugaauaagugcucuaucugcauguacaccugugugccaaaaaagggcaucagaucccauuacagaugguugugaaucaccauuugguugcugaggaugaacucagaaccucuauuaagagcagacaguguucuuaaccacugagccaucucuucagcccacauuuuagcuucuauauccaggucauagucuaucacugaggguugaagucagggcagagagccaaacagaaauugaagcacaaaucaugcaggcauguugcuuacuggcucacgcucaacuugcuuuccuauauagcccaagaccauguacuauccacaagaaucaauuaucaaggcaacgucucacacacauggucacaggcccaucugaucugugcaauuccuugucucccuaaggugacucugggcuguguccagcuuccagcugaagcuaauuagaacauuggaaaacacacacugauagucucauuuucuaccuuaacugcuuuucucggccuaguucugaugaagaagcaaauaaccacaaaugaauucauaaagcaaaugagaaugugaaucguucuuggaacaaugcaguuuuuaaaccacggaauauaagauaugaauuauaagccggguagugguggcacaugucuuuaaucccagcacuugggaggcagaggcagguggauuucugaguucaaggccagccuggucuacagagugaguuccagaacagccagggcuauacagagacacccuguccugaaaaauaaacaaacaaaaaaagauacaaauuauauacaaauauucaauuaccaguacccacauggcaaauguguggcaccuguuacaaugaacauaaaaaacaagaaaaaaaaauuaagaaaaaaaaaagaagggcuggaugcauagaucagagaauaagagcaugcagcagcucuuccagaggcccuggguaugauuuucagcacccacauggcaauuaucaaccaucucuaauuccaaauuccaauagaucuaauacuuucuucugguuccuaaggguacaggcacacaaguggcauacaaacauauaugcagccaaagcauuuauauacauaaaaauuagaaacaacaaaaaagauuaaguacguuuaauaaaaaaaaauccuaauguuaagaauguuauacaugcacauaaauguaguuugaucaaauccaucccuccuucucuccuuucuaaugugucuccucucucucccuuccuccaucauccuccccaacuuuauguuguuuuuauuaaauccaccgaguuaagucugcucaguaguaaagagcacuagcugcuuuuccagagggcccagguuugacuccaccauucacuugauggcucacaaccauccauaccuuuaguucuagggcauccaacaccuucuucugagcgccaauggcagcagguaugcacagguguacacacaugcauauauaugcaugcaaaacauucaacaaacauaaaauaaauaaaucuuuaaaaagaaauuaaacccacuaaguccagauagugcuaguaguaugugcguggguguagacguuuacugaaguauguacagacuuucaggggccacaucucuuaaaacugaaucucuggagaagucaccaauugccaauagcuacccagauagagugagacuucaagaaucccucucccacccaugcagcuaguuuggcugacuugaucucguccuugcagucaugacugaugugaguucaugugugcaauugcaaugucguguccaaacaguguucuucugcugcagaugccuacuaccucugacuuuuacaaucuuuacauccccucuuccaaaaugaucaccaaaucuugagaauaagggguauaauguaauugcccacuauuauguuuaauggacaugauaaacugcacccuaacuuuuuccucuuuauacccauaaaucagugcacuucucgaccuuaucagagguugagaaccuucacuuauuuuuguacguaugaguguugucugcauguguucacugucugcaccggggaucagauccccuggcacuggaguuuauagucauagguugugugagccaaguggaggccgagaucaaaccuggcuccucugcaacaaugggcagggcucuuuccugcugagucaccuuucuggccgcagagaagcuucauuuuguuaagagcaauuaaaaccaaggcccacaaucugacaaugugaggagaguaaaagacuguagaauacucauuccuuaauguuuuaagcaauauuccagccaggcauaaugguacauguucuuaauauguuuuugaucucagcacugggaaggcagaaauaggcagaucuaugaguuugaggccagccugguuacauaccaaguuccaggacagccaagaaugcauggauagacucccaucucaaaaaacaaacaaaaaaaagcaauauucuaaaauaggaccaacaaaaacuugaaugugccucuaaaaauaccuauacuuugcuagggaaaauuuuaaagccuucugaguuaaacaaaaauauaagaaaauauucuuaaggucacugguuaaauaaaaugcuuuuucuucaaaugauuaacuauacuaugccuccaaagauaugucuacaugaaaguacuuuccaacacaauggguuuauuauaaccuacucacccaauagccuuugcgauauaaccaaauguauugacgguagcucuucgaauagcuuuuuugugagcuuuuaagagcucuaaaagcucaaagcaaauccucauccauucucuugcagauacauauucagcuccccuaaauuaaaaaaaaaaaaugcaauuaaaugaauuaacauuuuguuaaugcauuuugauguuuuguuuugcuuuguuuuuguaguguuggggaugaagcccagggcccaugaaugccaaauaaggguucuacuacucuaaugagcauuuagagagugaaugugcauauucaauucugaaaucguuauuaauccaucuuaaauauuaaaugaaaacuauuaucacccuuuuaaaaagccugacuuguuaagugaugcugugcagcuuuaaucccugauuuaaauucaaagccaaccuggucuguacagugaauuccuggccauccaaggauaccgucagaccuugucucaaaagaaaagaaaauaacaaaaagaaagaaagcaagccugacuugguuuuaaaauuauacugcgggggcuggugagaugucucagugguuaagagcaccgacugcucuucugaagguccugaguucaaaucccagcaaccacaugguggcucacaaccauccguaaugagaucugacgcccucuucuggagugucugaagacagcuacaguguacuuacauauaauaaauaaauaaauauuuuaaaaaauuauacugcuaagucaggcagugguggcacauuuaaucacagcacucaggagggaggcagaggcagguggcucucuguuuaaagacagccuggucuacagagugaguuccaggacagccagagauacagaaaaaccccgugcagggugccagggugagggggagaggaagacacccacacaaaacaaaacacuauaccacuauuuccuauuaccacucaaagugaaaucuugcuuaaucuaaaaagaaauacugccuauacuugaacuaaaauacaaacgagaauuguugcuauguaaucuguuuaccugucagcaaugcguccaacaagaucaauacaauucucuuguacuuuuucaugucuguucuuuaaaaugggggugagucuaggcaggagaucuuuaauugguggugucaucuuaugcauaccuauuugacagaaaucaaggaacuauuaaaaccugaacugcaacuuuucuuuuuucuuuuuacaguacaguaaaaauaaguuauaagcuaccaguggauaguggauaaagaccccagauucuaauuacaauuuuuuaaaacuauuaacagcuccuuguuacauuuagaaaucaaagaaaucagugaagggauuuuuaaaacaaaaacaaaaaaaaaaaagaggguuaugcaguaacaaaaagauuuuauuugcuuuugaaauguuauuaguacacugacauuuaaauauggggacagccuauguuguggccaaacacaacaauauaagccaaagcuaggucagaucaaaucaguacgggucccuauaacugaaaaacaaaucagaccucuagucuccaugaaauuaccuaugaagagagaaaaagagacagcuagcaagggcucuugaucuaacuagaauuacuagaagcucugauucuccacugcuuuucucauguuugucagauuaaccauaugguuuacaacucuggcaaaccagagaaucacaaguggcuaaaagacuguuggcaagucauuaucuguacauaucugagcuaaaagaguauucugcuaaagcucuaaacugcucuauacuacuuacuccuuuccccaaaaugggaagaacagugauuaccaacagccagguccuaugaacucucagccuuuucuaacccuuucacaguccuaaaggaguuacuuucaacacuguuuaaauacaaugagauuuugaacccaggaauccuuuuguuugcuucaucauaauuccuugaaaaagagugaccauaccugagauuguuguguuuuuaacuuauagauaaaagacgugauagucuuuuuuuuuaaccaagucaucuucuuugaacucauaguauaaaaaaaauaaauaaauaaaucucaaccagucaaaauaccuuaccauagaaaggaaauuucuaaaacuaaauuacaccuugaggguugcuccuuccucuuacagaagaugcuagauuauuuuucagcugauacacuaguucuauuagagcccucucuuccauuaacucaaaacauuuugggcuguuacuauuucuguacuuuaaauuucuguacuaaauuucuccuuuuuaacauuuuuaaguaaaauauaaauagauaauaguaagggagauugguuacaucugacaauccuaaagugcuccagaaaagaagauuaaaaaaaaaaaaaacaaacuccuaaauacaacuuuacaucuugcuuucaaaauacaaagaaaauuaaaaggccaaauucucacaugaccagcaaauuccauaccuauuacguuuacaauagccuucagugcuccaagaaugcugcccaauacuucaggguacucuucacccaaauauucauacagcaccacacccaagugccccaucaguuuuuccuaaauaaaaggaauguuaaaaauguuacuuuuuccauuaagauaccuguuuuaaaaaauauacaucugguagaauagauuaccucuugacaagucuucauaacaacagcaguucgagaaaucaagucagcugcuuguugccuaacuuuugcugauuuguuauuuaaacgccauaaaacuguaccacagaucugaggcaaguaugguuugacucguuugccaagagcauuaacuacugugccaaagccauucaacauuacugaauccuaaaagagaaaaguuaaguuauauuuagaaaaacaaaaacaaaucacuaaaaauauauaauuuaguuuugacugaaaguucauuguucaauaauauucaaucuuuccaaccacccaaacaucccauuuguuuuuaaaccaaaaaaucugagguaaaaaaacauguuaaacugaggacaacuggucacuaaaaugucuuuuaagggauaucugcuugggcuggagagauggcuuagcaguuuaagagcacugacuacucuuccaaagguccugaguucaaaucccagcaaccacaugguggcucacaaucacccguaaugagaucugauguccucuucugguguaucugaagccagcuacaguguacuuauguauaauaauaaauaaaucuuugggccauagcaagcagggcugauccaguucccagcaacgagaggauggcucacaaccaucuguacagacacaguguacuuauauacauaaaauaaauaaauaaaucuuuuaaaaaauauauaaaagggauaucugcuuuuaagaguagguuuucaaaaaauaagaaauaaaaguagguuuucuacauaaaugaaagucaauggcaauaaaaguagguuuucuacauaaaugaaagucaauggcaauaugccacaauaaucaaguuugugacaggccagggugauggcucggcugguaaagugccugcuuccaagccucaugcccaugccccaggagacaaguggugauaggagacaacugauccccaaaaucuccuucuaauuuucacccacacauaugcacacaaaauaaaauuuaaaagcaaggaagaaggugguuggcuacccuuaccucuguagucuguucuuggaaagcauagagaauaccaucaaucaguuguuccucaaguuuauggucaauaucugcugcgccuagauuacccauaauuuucucaauuguuuccaucaccauuuuccuguacugcucagcuucauccuucagaucaucaacaauccuagauaugaucucugcugcaccuacuuuguuugccaacuccacaguuguaucaacuaacugaaagacaaaaacaaaacucuuuaaaucuauuacuuuuccaaggaaauaaaacauacuaaacuuuaauugugagagcaccuagauauggaucguucaaauuccaugccagucuggauggacaaggcccaaggcagcccaaaacuuaagauccuaucuccaaaacaaaaacaauucuaaguaaaacuauacuuagguuucagcuagcuaaagcuucaauuuaccagacaaaaccaucagcucauagcuuaguacuguugagcugggaggcugaggcagaaagaccaagauuuugagaccagcuucagcuacaaaguaaaauuuugucucaaaagaaaagaaacaaacagggcuguagggaagacucaaaagguaaaaggcacuucccaacaaaucugauaaccugaguuuaaucuccaugauccaucuggaagagggaacucuugccugcugcucucuucacacaugcaugcccugaggcacauauacagaccaaguaaguaaguguaauuuaaacacaauacauaugcauauauacauacacacagggccugggcuagaaaacuggggauaguggugggguuccuuccagaagacccaaauucaauucccaggacccacaugguggcucauaacugcaauuccaauacaagaucugauggccuggccccuugcaggcaugacacacaccaaauauagugcacagauacauguccaagcaaaauacuaauacacauaaaaaauaaacauuuaaguuuuaaauacacuaguuaaugggaauuucacauuaaauguaugcuuuuaaaagaaaagggggggggggcuggugagaugguucagugguuaagagcgucgacugcucuuccgaaggucccgaguucaaaucccagcaaccacaugguggcucacaaccauccauaacgaaaucugaugcccucuucuggagugucugaagacagcuacaguguacuuacauuaaauaaauaaauaaaaugaauaaauaaaucuggagguaggggaggggaggggaggggaggggaaaaaaaaaaaaagacacccaaaaagaggccagguguggcugagcacaccuuuaauuccaggacauagaagauggcagcagcagcagauggagcaguuugaggucugcagagugauuucuaggcuacuuagugagacccuaucucagacagacagaccaaacagaaagaauggacuuuaaaaauuccaucucuugucacaguaaaguacauacaaguauaaauuuuaagacagucaaagcaaauuauagcauguaauaugcauucuaaguagguaaagaauuagucaaaaagauuuaugagaaucaaaguuuagcaauaaaaggucaccugucgguaauuucuucuauccaaagccauucuguguugccaaaaguguuuaaagaaagguggaagaaucucuguuuuaauguaguuugcuucuacaccaucaguuccacaacacuguuucaccaccuauaagguuaauaaaaaagaaauauauauaucaaaugcagcacuggcaaaacacaaaacaauccaacacaguuaugaguagguaccaauaccuaauuuucguaaugcaauccaaauuuuagcaauguaucuaaccauguauccaagcuguaauaacuuuuacaguacaaaaauagguuugauuuguuuuuaauguuauaaagaucucucugaacuuccuaaaacaugcacauacccacaaacugagcaacuaauuacuuaccuucaaaacaauuuucuucauuucuucaucaggagacugaaauucucgaaugaggauuaacaucacuucucuaguauaguaguuggcauauucugcauccauaagaggaauaagauacccaauagccuucaagaaagcagccagacccuauuuaaaaauauauacguuaguaaauuaaguuucgguuaucuuacuagcaacaaaaacugaucuaaugagcgauucaccuuuccucuguguuggcggauacccuuccauaggggcuugagcacagaaucaaaagacucaauaccauaaggaguugcugccucagccaaagcagcaauggccagagcacugaugguccgaacuuucugcugcucauccacgagaccuauacaaucagacaugguuaugaguagguacccacaccuaauuuucauaauacaauccaaauuuuagcaauguaucuaaccauguauccaaacugcaauaauuuuuuuauaguacauaaaauuuaggcaaugguaauuuguuaacagaaaauauuacaaaccccauuucaaaauuugcgugagaagucuuucauuuaauuacacauacaccucuccccaucaggacagcugaucuauaaaagauacaccacuuaccauguucaaugauuucaaccaaacuucugagauguggcaagauagcacagcccaugagaauggcuaucuguuguacaaucuuaauaccagugugccucgcuugccaagacuucuugcuuuugcacacagcuuuuaagaaaggcaauaaagaagggaugcccagggcagaggcuacgacagcaaaagcucuagcuguuguguuucggacauauucauccauguuaucuauaucaggucucaugguagaaaucauaguagccagaccagcagccuaaagagaaaagugacaacagccacuuaaguuaguaccauuaauccucaacccaucaaaagacaaacuuccuuuucuaggaauuuaaugugaauaccuuugccaaauuagaaauaaucucucggccuuccacucuagcauaguaaucuucaucaaucaacaguggcucgauaaccacaagaaucugaaagaauuaaaaaaaaaaaaaaaaaaaaaaaagaggaauuacauacauuuccacaucaauuuaucaaagacauuuguuaauuaagggauagguuaaacaauuuuaauucccuggcaguaauugcacauuccuucaagggcagccuggacuaaguuccaggucagccagggcuacauauacacacaaaggaaaguaacaacuuccagauuccacacaguggaaaaauagaaccagaaaaauaaaaguuaaaccauuaaacacuacuucgagaacaaaccaaccuugugcacauacggccgcaccaagucaucaaguuuauacaauauucuaucaauaacuuucacaaguaaaugucgcucuugauccucaaguguaggggacaucaacagaggaagaaucugguuaaacagugguccagcuccaaauucucgagcuuuaucaguaaucugacguaaggcagccugaggaaaaucagagaaaugagaaaaguuauuuuuuuaugagcaaacauuccaaaguggcaauuugcaccaggaauaauauacuguauacuuuuauagacaauuuacauaaaguagucugaauuuguuucugucgaaauuguuuugauauucaaacucuuaucuaaguucaacauuagcaacucauuuuaaaagggcaauucauuuaguggcaggugagggcuuagagguaacggugcauauaccaccaagccuaauaaugacucuauugcaacucugagauccagacaacaaaaggagagaaccaacuuccaaaagcuguccucugaacuccauguuuauccuggagcaugaccuaccuguccacuugcacacauauccuugcaccaugcaugcacacaugcauguguguaacaaauaaauagaugagcauaaaagaaaaaaggguaacuuaagagggcuagcaagacuccuuccucaguggguaaaagguacuggcaggucaccaagccugaugaucaacugaguuuaauccucacaacccagacagcagaaggaaagaacugauccugcaaguuauccugaccuuccacuugugcuccaugugcacaugcccauaaauaagaugguuuuuaaaaaaaaaaaagaaaaaaaggauaauuugauaauuuaguagagcuuuggagccaugugccauaugccuuaguucugcuugaacaaccuucuauguucaagucauauuugaugcuaauauaggaagucauauuauauuccacaaaauaccucuagguuuuaaacacuuuaaagcugucaaggagaaaaagaauuuagccuucucauauccuuaucagaacaaaaauccuuugauuagaagaauuaaauucauugagccgggagcauaagacuguaaucccaagcagcuaguccagaauaagaggauccaaagcucaagcccugccugaacaagcuuauggccaagcuaagcaacuuaucagaaaccauauacaaaguuaacagaaccaaggcagaagagugucaugucuuauucugcuaacuccaucacuuagguaacuagguuucaaaaagacuugcuauuggucuaaauccagccugggcuacgaguuucagggcagucugggauaguucaagaaccuaucucauucauaaccaacaaauauaaugaauauaacaaaucaaaaaccuagaacuaggaaucagaugugauacacaacuucaauguuuauuaaaggggauacauuaucuuuaaucugagcacuugggaacaaggggcagguggaucucuguagguucuaggccaccuggucuaccuauuauauauaguaaauuacaaaacaaguaggacuauguagagacccugucuaaaaaaauaaaaagccaggaaguagcagugcacaccuuuaaucccagcacuugggaggcagaggcaggcagaucucugugaauuugaggccagccuggucuacagaguaccaggacagccagggcuacccugucuugauagaaaaauaaauagaacuuaccuuucucauuggagguguaccauucuuaauuuuuaaaagcaacuucauuauuuuucuuucuuuuuguucuucuggacuaaguguugauucaucuacaucaaccuacaauaaaauuucaaaauagaucaaauuuaugauuuguaacucccaaacaaagagcaauacuuuaguuuugcuaucaccacuuaccaauaguuuaucaaaguacugaaugucaucagguuuuaaaaauggaagauucccagauggcuggucauugacacuuuucauaguucugucuucaguuugcauguggaaaccagucauaccacccaaagguguaggaguugcugucagcuuucgagcuggaguucgaauaggaacauaaccagcuggagggggaaguaccuaagagaguuauaaacauguuaguauaacgcccuuggcuucauauacucuuaagacaacagaaugaguagcaucugcacuuaagagauuuuacaauguauuagcuagcaaguuuaccugaagaaaauauaucccacuaugcaauguuaccuaaaaguuaagauuauuauagaaaauauuauuugcuaauuaaaauuuaaguggaaaagaagaaaauauaugaagcacucuuuaaaagauucucaucaccuuaacaugcuugaaauaucauguugucaagccaacaugucaaacuaacaaaacuggaaaauuuaaaacccgauucagugauuuccuaaaagacacuguuagaaauucuacaauuacucauuucagcggaaaugaauauaugguuuauguaauagauuaaaaagaucaugcauauuaccauuuacauaaagaccuaaauacuauaaaacauuuuuuaagauuaaacucuacagauuugacuuaaauacaugagaguaaaauuaaaguaucugucaagacacuuggaaagaaacaccaaauuaaacccauugcaaaaaagaaagucuuaaaaauaugaguuuaaagcuguaagauucuuuuuguuguuguugcuaauuacacuuucuuguuaggucaauaaagacuaacacagguccucuccaaacauccuuaguugucauaucuaaaaaugucaaugauagauauuucaguccaugggcagcauggacuauugacuaaaaaagaauuuauucgcugagucuuacaguaugucaaacacauugcugucacucuacauuuaggaccuaaagguguauuuaagauuuuaauuaguaaacucacaaaagaacaaauguuccuccuauugguauuaaggaacccaaggacuauaauugagaaauauauuuauuagauuguccacauacaaaauauuacaaggaggcuauaggugguuugguuuuuaaaguuuugcugauuaauagugguuaaucaaauccuugcccuccugggcaaauacucuagcacuaagcaauacgacaugugcaucuaaagcaaauaaucuaauacuagcuuaagugcaacggggguagcacacaaaucagcacauuguuuugacaaagucaacagaaaggcucucuaaaggccauuccuuguaagccugaggucuugauccggacucuagcuaucaucacagacagcucuuugccaacaaguaguuccaugauaauagguacuuaguucaaaauaaacuucaauaaacccaaacuacagaguaagguccuguuguaaaauaaaacaaaaaauaaauuucaaauuauugauaaaacauucuuugugucaccaucaaucuaugucauuuagagacaaaguuuuauugaacuaacaaauaaaaccggcauguuaucugagcucagucccacaaaacuaauuuagagguucucuaagcacugucuguggaccuccagaagcccuuaagaugccucacagaaagaguaauaaaugccaguagcgguagcauacccuucaagacucuaugccuuuaaagucaccuggucugucuguaccuugaacugcaggccagccaugguuacauagugagacacugucucaaaaaguaaugagcuuuuguuguuuucucaaagcagauauuagaaaaauggcuccgugauuuaaagcacuugcaccucaaaaugagaucccagugcucacagcugccuauaauucuacuggaagguuauacucgcuucugcagaaaccugcacguauucaugcauauaauuaaaaauaaaauaguguuuuuagacaguuuuuaauuguguauauaugugugccugaauauaacuuuguacacuugaagacagagccuggaaggccagcacaagaccucagguuuccaagagaucauugcugcucuuuaaaggcaauacauguucuuaaccacugagccauuucuccagcccccaaaauaaaaguuucugcugggagggguuugaggcagaguaucuuuuuguagcccuggauggccuaaaacuuguuaucuggaccaaacugaccucaaacucaagagauccgccuacuucugacucccaccaaucauuaggauugccaaaguaauaaaagcuccauguuacuuauuucaucucuauuacuuuuucaaacugaaaugcacuuacuaauaccuaaaaauaugaaauuaguaaauuucagaaaggccaaugcuaauuuaccaggcaacuuuuuuaacuaaauauuuaaaacucauauccucaauacaacauagucaucauauauucacugcuaguaccuuauauccuucugggaacauagcaucuaauucuucaucagaaagugggcgguuucguucaucaauuucucucucccaccgccacgccugaagcuguucaggugucaugcucauuaugugaccuaccaaaaaagcaaaauuguuaaugaccaacaguguaagacuuaggcccuucagauacaaaauaguuaacaucaguccguaucagaguuguuuuuacauugcaaaugcaaaucaaggcaguuauauauuuauauuuacauucuuaauagaaaagcuagcauuaguggaacccagaaaaaaaaaaaaaaaaacagcaaaaaaaauuaaaauagcuguaagagaaagaaugaugaaaaaaauuuguaccuggagucgggguagccauguucauggcuggugugccaauugguguuuuuccuggagucagaacaggagugcuuccacccauuugacucgccggcguuucaucccaacgagacuuucuuuuacuugcuccaggaguugguguuucaccaauagagucuccaccucgaucuguucgaggagucucagcccauccacuuccaugcccaggaguaucuugaaagacaaaggaucaguaaaaccacacuauuaacacucuuaaaaugcugcuuccccuacaugcaauucgauuaaguucaaaaggaguauauuucuaaaacaagauccaguuaaaguuuugcccaguauuuguuuccuuuucacugacuacaaagccacagauaugaacuaaugagaaacagaaaaacaaaacuuucuucauccacaccucacuguucaucuugagccauguuccagcuauuuucacuauauagcaaacacuagauuuaggcaaauuucugagagagauauaaaauauagccuggcagaagccagaaaguaaugggagaaaggaaaaucuguaucuaaagaaugcaguauguuuggaucacugaaaaaaacauagaagugaauagcagucaaagucauaacugugcaacucuggaaauauucuuaaagccacuaaauugugcacauuaaaaaugguuaaaacgggugcauuuaaacacacacacacacacacacagcguacucacaggaggcugaggaaagaaagaaggcuaauaguauccacaacaauuuuuuuuaaguuuaaaaaaaaaaaagauucuuccuaaaaccuucagccucuucaaaagaggggaaauuaauugaguacaauauuaccuaaguuuuuuaaauuuuaauuuaaacaaaguugaaguguguugccuuucuuuacuguguauguuggggagcacaugccaugauacacauguggagguuagagguuaccuguggagcuggugucuccuucuaccaugugggucccagggaucauacccugguccuccaguuugguugguggcaagagccuuuaccucugagccacgucaccaguccaaagucgaaagguuauuaagaaagguucuaacagauuucagcuuggguacugagacaaacaguacaagaaaaacaaguuuuauaaacuugguagguuuaggcacauccacaucagcugguuauuuauagaaaucuauauuuauacuaggaaauaaggaccucagucugaagacaaaaugcuggagucaacaccucauccacacacucaucuacacugcacuaaaguaccuaccucuuucuguuuugggggucucaucccaucuguuuuuacgagcacuggaaguugcaccaccauggcccgggguugcauggccuggugugucgccucgcccaggaguagcagcucccgcagguguaugacucgguguagggucccauauuuuugagccugggguugcgccagguguuucacuuccuuuugcacgacccggugucucaucccaucuuaaagaugggguaugcccaggggucuguacaaagcaaaggaauuuuguuucacauaccuauacaccuuagagauauaacuacaaauuuucuauugcacaaaaaaaaaaacaaaacaauaaauguaucuuucaguggaaguuagauaucauuuugcuuacugauuugcaaaugcuuaugaugaaaacaaauuuacagcuuucauuuggaacugaacaauguaaaaagcacuagauuaaaacacaaggcuagagauggcucaacaguuaagagcacuggcugcucuuccaaaggacccuguucaauuccuagcacccacacagugacuuacaacuaucuguaacugcaauuccaugagagucaauacccuaauacagacauaaaugcagaugaaaaaaaugcaaauuaaaauaaauagaauuuuaaagauacacaaaacauucuggguuauaaaccuuugugaauauauauguguugguaauuugccaugagcugcuuaagcuuguaaaagauaacucugaaagagaaauaauccccauuuuagacccaagcauguuugucucaaacuauuuccaaaacacauauccuggcucaggcugacucccuuuuacaagggaagaagacagaagaauagcaaaagagcccaaaaauaaaacacuguucuugaaaacaguuaaaucgucuauuauuugccccaugauaaaaaugucuggcuauaggacuggagagauggcucagaaguuaagagcacugucuguucuuccagagguccugaguucaacucccagcaaccacaugguggcucacaaccaacugaaaugggagcugaugcccucuucuggccugcaggcauacaugcaggcagaacacuguauacauaauaaauaaauaaauaaauaaauaaauaaauaaauaaauaaauaaauaaauaaaucuuuaaaaaaaaaaaucuggcugcagcaggaaagagaaggcaguuccgccaugagaagacccuccccuccccuccccuccccuccccucuucucucucucucucucucucucucucucucucuguuuuucgagacaggguuucucuguauagcccucccuggcuguccuggaacucacucuauagaccaggcuggccucgaaucagaaauccaccugccucuaccuccggagugcugggauuaagggcaugcgccaccacgcccggcuuuuuuauuuguuuauuauauguacaauguagugugucuucagauacuccagaagagagcaucagauuucguuacagaugguugugagcuaccacaugguugcugggauuugaacucaggaccuuuggaagagcagucggcgcucuuaaccacuggccaucuuaacagccccaccuuuguucucuuaaccaggcuacuccagcggucuccgugcuugauucuaugaaacccugauucaaugaaguuuuauuuaucugcuguaccuaucaaucuauuauuugccaugguucuuuaacuccucucuuuuuuuuugacuucucuuuuaaaaaaaaaauuauaaaaaaaauuguaaauugagaaaaauaaaucaaaauaaccagaauaaccaggccuaaaaagucuacaaagcucacuaaacuucuauaugguuagaacagccauuuggaauggaagcuguguagcuuucuuuuacucuuauaugauauauacuuaauaagcucauugaaaacuaaaagcaaagcuacuguaauaaucuccagaugauacaagguacccugaaauauacacugaguuuaaacucugaguuuagaaaauucauguaauuuugucuaucuacaacuccaaugcaagacuuucagcucugaaauuagugcauccccaaacuggaucccugagacauuagaaccucuggggaagaaggaauccacauguauuauaauaaauacuuuaaagaaauauguuaugagccagagaaaagugcaucucugugaguucaaagucaaucugguugacuugaguuucaggcaacccagagccacguaguaaaacccaaucuuaaugaagaaaaaaaaaagucgggcgugguagcacacaccuuuaaucccagcuacaaaaaaaaaagaaaaaaaagaaaaaagauuauuuauuuguaugccuguguuugaguacacacgucacugagcaagcguggagaucagagacuaacccaugggagugcacugucucucucuaccacaugaaucuuguaucuggaacucacacuaucaagcuuugcagcaagcucagagggaagaaagauuagaaguggauuugaguaauuuauccaagaauguaaaagagcucugaauauccagugucuuggugguggcagggcuuggggaggugggguaagucauccugagacaagauaacccagaaacucauaauccucccucacucucaccacacucagcuaauaaggauuuuuauucgugaugggaaaacaaaaaugauucuggauagagguauguggauuucugaguucaaggauagccuggaauuucaggauaaccaaggcuacacagggaaacccugucucaaaacuguaacaacaacaaaaaccucuggauuagguaaguaaugaaugaaaaugaauuauucacaaacuuaauuugcccuuccuaugcaaaaaaaaaaaaaaaaaaaaaaaaaggugguaauaugaaucuuacugccaugcauccuauuuuuuccauaaaugagcaaaaaagaaagguaggucuaaguccuaauuacuuuccuagaaacacauucuuuccuagaaggcuuaguaguuaagaccauuuaacugcucucgcauagaaccugaguucaguuccuaccacucacucacaguaauagcucacaacaaccucuaacuccaauuccaauggaucugacaauuacuccuaaguagcugcacacaugugauguacauucagacaaacaccuaauaaaaguaaaucuuguaagaaaaauaaacuuuucuaucuaauuacaaacaaacagcuaggcagcuuugaguagagcaaauuuauuguggcuuuaaauauuuaacucugagccgggugugguggcgcacaccuuuaaucccagcacucggugggcagaggcagguagauuucugaguucgaggacagccuaugagaagaaggcugccaagcugaaggagaaguaugagaaggaaauuguugccuagagagcuaaaggaaaaccugaugcagcaaaaaaggggguggucaaggcugaaaagagcaagaaaaaaggaggaggaggaggaggaagaggaggaggaggaggaggaggaggaggaagaggaggaggaggaggaagaagaagaagaagaagaagaagaagaagaagaagaagaagaagaagaagaagaaaaaaaaaaguugguuguagcacaguuucuuuuucuugucuguaaagcauuuaggcugggcggugguggcacacaccuuuaauccuagcacuugggaggcagagacaggcagauuucugaguucgaggccagccuggucuacagagugaguuccaggacagccaggacuauacagagaaacccugucucgaaaaaccaaaaaaaaaaaaaaaaaaaaaaaaccaaaaaccaaaccaaaacaaaaaaagcauuuaacccccccuguacacaacucgcuccuuuuaaagaaaaaaaaauuguaauguaaggcuguguaagauuuguuuuuaaaccguacaaugucuuuuuuuuguauaauuaacacacuacugaaugugauagcccuguccuggugguauuuucaauagccacuaaccuugccugguacagucugaggguuguaaauuggcauggaaauuuaaagcagguucuuguuggugcagaguacaaauuaguuauauauggggacaguaguuugguggcugcuuuguugacauucugaaugcuucuaaguaaauacaauuuuuuuuauuaauaaaaaaaaguuccaggcuggccagggccacaaagcaaaacaugccuccaagaaaaaaauaaauaaaauaaaauaaaauaaaagacacaaauaaaauuaaacuaaaaaagaacguuccauuccucaacauacggacuggacuaugucucaaagccuuauuaagguauugagguuguaagcccuaaugugaccgauuuuggaggcuggggacauucaagguuagaugaaacggaagaagauugagggaaaaguuaugagaaaacagugacaaaguauucuccccagacaacaauccugcuaccacuucauccucuacuucaaaccuccauuauugagaaauaauggauauaaaguuaagccauccaguaaauaguaacuuguuuuacaagcccaaauaugaacacaguccauagagaaaaauaugaaaauagcaauaaaaaaauaaaagauuaccucugccugaucccaacucgauagcuuuuugggaguggcaccaggagucuggucagcggucugaucccagcgccguuuucguuuugagggaggcugggaugcugcugcuccauugacgacuuuuaguucuccagcuuuagcuuuuucugcuaguuguugccuaauuucucucugaaaaacauuucaaacagcaaaucauuugauuagauggaggaaacucaaguagcuaugcuuaccgagcaugcuuaagcuccuagucaauccccagcaccagaaauagaaaaaauuucuuuaguuaaguuuuaauucuacuagcauaaucauuucuuuucaaugcgcuauuuaguauuccauucacagcaggauggguggcgauggcgcacgccuuuaaucccagcacugggaggcagaggcagaggcagaggcaggaggacagccaggacuauaacaaaacugucuccaaaacaauggggggaaaaaaacaaaaaaacacucgagcuggagagauggcucagagguuaagagcacugucugcuuuuccauaggcccuugaguuuaauucccagcaaucacaugguggcucacaacaaucuguaaugagauauggugccaucuucuggccugcaggcauacaugcgggcagaacguuguauacauacuaaaauaaaucuuuaaaaaaaaaacucauucuguuccuagugauaucauuccuuaucuuuaauauuguguguguuugugugucuguguguguacacacagcauuagcuuucuuucuaaacaguacacaugcaacagccuauguuuugaagcuagggaaagucuuauugaaaaauaaaaucucuagucagugagacuagugaaguuagucuuguaaucgcccuaaucaguaaguaaauauccacuuagcagagaacugaaaaauaugcaacugaaaguuuuuaagacucaagacacaaaaauaagccaggugcaguagcacaugccuaugauccauagacuaggcagguauauugguuugaauucaaguccaaccaaugcgugaguucuagcccagucaggaauacauagcaagacucuuuucucaaaaauagaaaagaacuagaaacaugaaaacaaaacuuagugucauaauaaaugcauuuaauucacccuuucauuuuaaaaugagguuccagaucccuuuaaaucgccuagcaaacccuacuuuuauuguuaauauugcuacaggaaccacgggaaucucagugauguauaccugucauuccuuaacacucaggagacugagguaggagcgucagccuaugacuaugaggcuacagagucauuucuagguuagccugggcuacaggaagacccuacuucauucaaacaacaauaaaaagauuaggaccagugauggcaagacagcucauuugguaauagcacuuucuguuaccaaguccgauaaucccuggaacgcucuugguagaacucuugccaguuguccuuuggcuuccacaagcacaccauggcauguaccaagcauacacacacaaauaaauguaaugagaagaccaaaaauacaaaaacaguugaggguuggcuuguuagcauugcauucauguuagcacagaauuaucucuauaagccaaauggaauauuuaaaauucuccaucuauugccaaacccaaucuccaguaaauauucaucaaaaauuaaugugaccacuagcuucaugagguaugcuaguaaccccuuaaacaccuccccaggcaagcagacacucacaggaagccaggaaaucaaaauaucaagugucaagggucauauaauucugggauuuuuuuaacuuucuaugauugaacuacuauaguccaauuguucacaccuuuaacuccagcacuucagagggugaagcaggcagaucuaaguuuuaggucagccagggcuacauaaugagaucaccuuuuaaaaguaauuuaaaagcuggacauggugguacacgccuuuaaucccagcacuugggaagcagaggcaggcagauuuuugaguucgaggccagccuggucuacaaagugaguuccgggacagccagggcuauauagagaaacccuaucucgaaccccccgccacccccccaaaaaaaagcuagacaguguagcacacagcuuuaagccuagcacuggagagacaaguggaucucugaguucaagaccauccucucuccagagugaguuccugcacagccagggcuacacagagaaacccucucucagggguggaaaaaagcaaaaaaaaaaaaaaaaauauugcuaugaacaucgaaaccuagauaaauauaaaauucucucaaauguuccaacauuauuucacaaccauuacacugagaaagcaguuccuaccucuuccuuagucaaauguuguucucgcauaacauccauguagguucuagcauucauuuuaggaucgggagucuucccuccugcagaaaagaacagcaacaggacaagaauacaauaaauaaaggguauuagguucaauugauuucucugcccugcucuaauauuauguuauuccauaaucauuuaauuuaguuuuugauggaaaacuuugauaauuauacaucuuacuuuuuuauugaguuugcugaucaauuuaaccuguuugaacacaaacauaucuacagcaguuuaaaacaauuauuuuaaugcauauagaaagcaaaaugacagcacaguuuagucuucagaagugauggguuccuggguugcuaauccggaauacguacacuuucgugccuuugucuccaucagcaguucugacuucaagcagcagaauagaagccuagaaaauuaucucuuuaccauuaguaacacuuuggaaagauauuuauauucaaaacauuaccuguugcaagcuguuaaaauccugacuacaguaacugacuaacauuaaguucuucauacagugaucuaaacaguuguaacuuagaaacucugauuauaaaaaaauaaaccuacaaucauauucucacgucacauuacuaaaagggcuucgugcuuuuuaaaguuuuuuccuugacccaaaauauaauucuauuucuuagaaaguacaaucacaacuggaaacauacaacuuaagauauauuauucuaccaguuacuacaaugcacacaaaagaaaagugguguacaaagagaugugucagucucuugguuaaaauuucaguauuugcuuuucaaauugcaaaauaucuuaaagaagcccaaacagugcauaacaagaacacgaaggcacacuaugcuuuagaaaagugacaauagcuauacaaguaguauagcauuacaauuuaggacaaaauaauaaaauucuaagacaucuccuaugcugacgaucaugcccaauugguagugucauucuuucuaacacuagcucugauaagacuuccuuuggaauacuuuuucaccauaaucuagagaggauguguugaacugcacccuuaagaaugcagacaggacuggcauauagcaguacugcuguaggaaagaaauuaaggacaguuaguaugggccugugaauucugacauacauguuuaaaucaauuacaauuaugcaaguaaagcaaagaauaucccuauuaauucaugcaggcugaaagucuaauuuguaaaaaccugcagcagaaucuaauuuuaagaacaggcacuuaguuuugaugcugggacucacucaccugaggaaaucuuccaucaggcucacuaugccccuugcacacuacaauuagcaaaacagacuccaacuauuaaauaccaaagucuuuguauauagcuuuguuuuaacuauauaaaguugacuagagcaaaguaggugcauuuacuaagcuauaacaauaaggggaacuagugugagaaauaguuucucaaaaguaacaauccaaaacucuagaauuuggaaugaaaacuuugcaauaauuugaaaguauuuugagcagaaaaacacauuuguucaaaguauaccaagaguacccaaaacaaaaguaaaagaaaaaccuuuaacccuuugcguuucuauggcauuggcucauuauuuucuuguccuucuaccuggaaagaaaacuugcauuauaaagaugaagaauauggcaucuuugacuucaaccaaaucuauacaaaucuauaaaggggucuuuaaaaacgaaaagcaaauucauaagcaugccaaaaaaaaucaaagggcuaaagacaagguaauuaaaauaaauuucugaauacuuauagaaaagugggaaagaauuaccaucugcaaaaggaucaagacgcucuggggaaauuaucaugguccgccuaugcuuuuuguauucaucuucccgaucggcaaucuuuggaggacgaugcucagcaaauggaucauacuaaaaaaaaaggcacaucucauuuuaauacccacccuauuuaaaaaaacuaacccauccucaccacacacacaaaugaauaaaccauuauuuaagacaaaaaaaguauguguggcugaucaguuuccaaaacuccagguuuggcuuaaugaaugccuuuacaaaacaauuauuucugacucccccaagucagcucuucucucaaaacauucucagaacugcuaaaauuccugugcucccauggaaacugacucccuuuuuguaagcugaauaacugcgaggcaucaccugcucuguugacugugguauaucauuaagcaacgccacgggggcaugauauccaggcuucuucugaccgagcaagcucguggaugaugaguagucaucgucauccugcaaucaaacacccaaaaggucacaacauaaaaagcaacaugacaacuacccaugaguuuauuuggaacucuuaaguuuuauuuaaccacagaaacaagucaacaauaauuguuaucaaagcuauuaacuuccauaacaacauguuuacacaucacuauacacucauacauucuacuuuaaaauaaaauguuucuuaauucuagaacauacagccaccacugucuuucacuacuagguaagaaaaccaagugcuauggccaaguauggucaugccaacacagaauuccuaauccuaggacuugguuaaggcagagacaugaagauucuaaguaugagaucaguguaaacuagaauaucaaaacuaucucaaaacacgagcaaauaugagagagagcaagagacacauagagauaguauaugcaagaagacacccucugaaaaacuagucucuagaauuucacuuuugggacaaucauauaaacacauuucuaucaagugggaaagaaaagugccagugaccaagauaugacuugaauuuuauaaaacuaaccagguugagccaggcaugguugagggacacacagcuugaaucccagugcaugagaggcagaagcaguuaggucuccgaauuuaaggccagccuggucuacauaguaagcuggaggcuacccaagguuauauaguaagauccuauuucuaaauaaaauuaaauaacaacaacaacaacaacaaaucuucaugggggauagagagauggcucagugguuaagagcacugacucuucuucuagagguccuaaguucaauucccagcaaucacaugguugcucacaaccaucuguaaugggaucugaugcccucuucuggugugucugaaaagaacaacuauguccucauguacauauaauaaauaaaucuuuuuuuuaaaaaaucuucauaaccaguauaaggugucaaaaaguaaucacgaaaaacccauuaaauaacuguaucaacaaaucugaauguuugaaauagucaaaagaaaacuauguagaauuuacauaaaaagacuuuaauauucuauuuucuucagccaaaauggaacgucuguaucacagauuccucugaagguucagaaacucuccagaagagagggaagaaagauucuaagaggcauaccggaaaggauaggguaacagugucuucuagacaugagagaacugcugcccuuagagcugccuguacaagacuaaaccagucaggacugcagcaugaggcagacuucaugaauuucaaccucuaacugaggagcuauugacagcugaugacuucugaggggaaguuuuaaggguauggcugccauaccacaguagauguuccacacccaugaguauguuagcagcaaaaacuagacucaauaaguuauuuuuuaaaaaggagacagaguugaaaggucauaaggugagucugggaagaguuaggaagaggaggagguggugaguaagaucaagauauaauguaaucaaauaugaaauuuccaagaauaaaaauagcauauuuaauuuucaaaaaacugaaaucaagaaaaacuuaagcuaaguauaguggcacaagccuauaaucccagcacccggacagaccuauaaggagagccugucucaaaacaacaauaacaacaaaaauacauaauuuaaaggguugguuagccaagugguaaagcauuuguuagaaugaacaagaccugaagcuucauccaaaaacagaaaucaaaucucaaaaaaauauuuacagucaguucagucaugucuuccauaggguacuucagacaggauuagguaacaagaauuuaaaucacaaaugaugugaaaaugcuuuauauaucaucuaacaauauucagauaagucuuccacaaaauauucaaaacugggcacuuuaggagguaucuaagggcccagugaggacccuaguauuaagcaggcaaaaacaagcuaacugugaaacacucuaucuaaccagggaggauuauuguagcaugccucuuuagucccagcaguuggaagacagacagguagagucuugaggccagcauggucuacuacauaaaggaucacauaguggcagguaugaguauguguguagaugggucuauauauccaguuccaggcuagcuaggauuacacacacacacacacacacacacagagagagagagagagagagagagagagagagucuguuuucccucuauguguuauuaacuguuucucuccauuuaaccaucaacucaaacagaaaauuccccuauuuauuuucucucaaaaaaccaaaacaaaaauccuugccuccuagauaaucuguaacuuacaucuucaaguucaguugcagcaauugaugucacauauccagcaaaucugcuaucacuuccaccauaaauuucuuggucauaauaaccuguggaaucaaggcccacuccuugggcuucaucaagagcugccuucuugccuugaauuucucgaaucugugcuucgauaucuguaagaaagaaaaaaaauuucauguuuuaaagagcucucaguauaauuuaucuccuuacuagaucuuuucaaaauauccugaaacauagaaaauuuuaguaagagguuaaaagagcuagcuguaaaguacaucuacacauguaucuccugaccucaucaggugaaaggaacacaaagcugauuuacuaucucaacaacuuucccuaaccauuaggugggcuaucaaaaauaaucucaaaauucuaaaacuucccccacgggaaaauuaaagcuacuuuaaaauauguauuugugaguggcuugaagauauggcucacugacugcucuuccaaggguccugaguccaauucccaggaaccacauaguagcucacaaccaucuguaaugggaucugaugcgcucuucuggugugucuucaguacucacauaaaauacauaacuccuuuaaaaauauauguauuuaucacuagcaugcacaaauuuauaggccugauacucagaaaacucaaguuuucuacuuuuuugcaugguuccagggaucaaaccgaggucacuuaagcuugugugacaagugacuugcuaagccaucccuggcagucaaaaaaauuaaaacuguugauguguauuaagaaccagggcuguacucacaauuauuuaaacuugucacuaccagaacuaaucaagagacauaauucagugguacaucaguugcucagcauugaauaagguccucaaucugguacccagcuucacauauuauguuauagcacaaaauaaaacccacuaccaaagagguaaaacuaacugcauagaucacuucucaguccuuuagcuacgaucaaguauaaaacagcuuaaggcuggggccagugaaaugggccagcugguaaaggaccuguucugagccaucuccuucuacuugcuaagucuuguuucucaacuguacaguggagucaacuguaucaguaguuagcuggcccaaaaguuuccagccaauucuccugucuuuauuuucccucuugcaguacaaguacugauauuacacauccacuuucaugcagcuaacuuuuuacacaucuagcuuuucacaugaguuucagggaucaaauuccuaaucccuaagacaaugucugaguuagcaugaccagcacucuuuaguuuuuuucaauacacacuaauugguuuggagguguugcucaguucuuagggugcuugccuagcaugaacaaaugccccagcacuguauaaacaagugcaguaacuccaacuuugaaaccagaagagacaagaauucaaggacaucguuggcuacaucacaauuuuaagagcaguuaggguagaauuuauggguaggucuuacagccuacagacagauucuccuucacuagagggaucaaaugccagguacaaauuuucguauuaauugcucaaccccacugagccccagcuaagaaaaacacuguauucucaaauguagaugguuaagaaaacuuaacaaguuuauguagccaaagaauagcugggccccuuccccaauaagaaagggacaggcccaaggaauuaaaaagaggcaaugagccaggcagugguggcccacgccuuuaaucccagcacucgggaggcagaggcaggcagauuucugaguuagggccagccuggucuacagagugaguuccaggacagccaggacuacacagagaaacccugucucaaaaaaccaaaaaaacaaaaaacuaaaacuugagucucauauuugauucuagcaaucaagagacagaaccaggccaaacucaaguucaaggacagucaaggcuacuuagagauccugucucaaaucaacaacaaaaccucccccuagaaaaccaagcugagcaucaacaaccaaaaaaacccaaacuugaaucaagugugguaguucacgcuugagaccccguauucaugaggccagggcaggaagauuucacauaaguugaggcuagccugucuuuauaguaaauuucagaugugcccagggauacauagugagaucugucucaaaacauacacacaaaagcaaaaacaaaaaacaaaaaagcaaaaccaccacccaacacacccaacagccugcaaucccucuucuaccucaucaguauaguaugacgaccacccaaaucagaaagauauaccuauaaaaaggguggcacccuaaccaucacacagacacaggaacucagagagucccuugugauaacacauauagcucauuuuuuaauuuauuuuuuccuuuuuuuuuuuuuuuuuugguuuugcgagacaggguuucuuuguauagcccugguuguccuggaacucagaaauccaccugccucugccucccgagugcugggauuaaaggcgugcgccaccacgccucauuuuuuuauuucuugagacaaaucuuuacaaaguuaccugggcugacaaccucaaauuacuggcaauccuccugaaaacuagaauuagagauuagccuccaguucuuuugcccauagaaaucagguauuguguucauccuauaaccccaccauuagauaagacuuuuuauauugguggcccaugccuuuaucucccaguacucaaaagacaaaagagagaggcagguggaccucuaaacaaccuggucuauauaaugaaacccaggccaggcaaggccacaaagugacagucugucaccaaaaaaaaaaaaaaaaaaaaaaaaaaaaggcaagaaaauuuaaggucauccugggcaacauaucuuaucacagagaguuugguucaauaaucaaaucaaaagccuaagaacacaaccauggaagcugagcugaggcugagguaugauacuacauagguaacauggcagcacuucugagguagaggcaggaggaucaggaauccaaggacaaacucagcuacucagcagguucgaagucaaccugggcaauaugagacucuucaaauuaacagaaaaaaaaggccaagggggggggggggggagauggauggacauguccauagaaggaagacacaaccauaaucaaugauucaaguaaaaacugggguagcuaucucuuuaaaaauaaacaauauagccgggugugguggugcaagccuuuaaucccaguauuugggaggcagaggcagguggauuucugaguucaaggccagccuggucuacaaagugaguuccaggacagccagggcuacacagagaaacccugccucaaaaacaaacaaacaaacaaacaaaaaauuuaaaaauuaaaaaaaaauaaacaauacacaacuaaaagugcuuaauaauauggagaacuauuauugagaaguuaguuacaccaggaaguucaaauccaagaccaguuucaauuacuccaauaacuuaaugauugccuccaauaaaauuauccaauaacuuucuucuuaaaacacaaaaaucaucuggaguggagagaugauucagccaguaaaaaugcuugcauagaacccaacuucaaauccccaaaugccauguuaaaauggcuggcauaguucugcacaccuguaacuccaggcuugcuggccaacaggauagcuccagguucaguaagauaccuuaucucaggccgggugugguggcagacgccuuuaaucccagcacuugggaggcagagguaggaggauuucugaguaggaggccagccuggucuacaaagugaguuccaggacagccaaggcuacacagagaaacccugucucgaaaaaccaaaagauaccuuaucucaagggaauaagcccaacugccuccuuuggcuuccaugugcacacaacacacacacacagguggagauaccuacacacauacaaauacuacacaaaugcacauaugcauaugcaugacacacauacaaauauuaaucuguuacuuggggaaaggaagaucguauuuuauuauauauucacugggaagccaaaaccaaaucuugcaguuaucuacagucuuccaacuuuaaggcuaaaucaucuuuuccucucaauucagaagauucucagaacaauaauaggcuauuuccuaccugucugaccaaacugauguaccaaaacuggguuuuaaauaccccuuuucagagugggaggguaguucaaugccaaaugcucuguaguauaaauacaaaauccuggggauugaucccaaacuuugagaucuagaaggcauaguggugguacaugccaaaaaucccaguguucaggaggcaaaggguuccuccaaguaugagaccaacuuaaguaagauacaaaaugaggauguaguggugcaugccuuuaaucccagcacuugggaagcaaaggcagauggaucucgcugugagucugaggccagccuggucuacaaagcaaguuccaagacagucagggauacauggagaaaucuggucugggucucaaaaaaaaaaaagaaaaaagaaaaaaagaaaaaaaaaggaaggaagcaagcaaacaaggaaggaaggaagcaccgaaagcaaccagccaaccaggcccacacgauaauuccauuuccaagagaaaacaaaagugaagucuaccaagauggcucagcagcuaaaggcacuugcagcaagccugaaaaccugaauccaacuccagaaaguuguccugacuuccacauggacauagaagcaaaaauacauagauaaacacaauagauaaauauaagggaaaaaauacaaauaaaugaucccauuucugugaaacuuuucccauaaaaaccacaggguuugugaauucacgggccaaucuauaaaucuagcacuuaagagguagaaaaucagaagucaaggccagccugguugacaagaaaaucuuucuccaaaaguaguaaaguaaaucuaaaacaugcuaaucuagcaaguaaauguugauuuaacauuuaaauacccauuacugaccagacacuggagcuauuaagguauauaaaauuccuguuuacaccaacaguagagaaagcuuuaaugagauuacucugauuaaggguguaaacucacuuccugccaaaccugacaaccuaaauuggaaucccagaaccuacaucacccaaagugggaacagacucuuccaaguuguccucucauuuuugcacaaagcaaauauaaauauaaaaauuuuucaaaaacucuacuuuagacaggcaugguggugcacaacucugaucccagcucuugggaggccaaucugaggccagcauagucuaccaagaguguuucagaacagcugaaacuacaugaagagauugucuaaaaaaaaaaaaaaaaguucuaggccagacugauaaacagagcaaauuccaggacagagcuacagagagaaacucugucucaaaacaaacaaacguagcaacaacacaacaacaaaaaaagacuaagacaauaaagauuuauacugagggaccuuauaccaaauugugacauacuucuauaauauuuuuuauuaauucaauaauaaaauaauccuaaauaaaauagcaauuuuuacaaaaaaaaaaucgaaacucagcacucggaaggcagaggcaggcggauuuucugagcucgaggccagccuggucuacaaagugaguuccaggacagccagggcuacacagagaaacccugucucgaaaaccaaaaaaaaaaaaaaaaaaaaagcaauugcaauuuuugaaaacaaguuuagcugggcuucuacaaugaaaaaggaaaggaaaggaggagggagggggaagggaagggaagggaaggggaaaggaaagaggaaaggacccuaaacuuuacauuuaccagggccagaaagauggcucugcagcugagagcaguggcugcucuuccagaagaccuagguucaguucccagcacccauguggcaucuuacaacuguccuuuaauccaauuccagggaaucugacaccuucagacagacguuacaugcaggcaaaaauauuaaugcacauaaaauaaacuuugcauuuauccaacugggaguaugcuacauugaagauaucaauaagccaacaaucaaagcuacaaaauauccauaaaucuccauaaaucaauaaccuauuaggguaugggacucuaccuaugcagcuauaaggaagccaguaaggaguaaaccaugcuuuccuucaguaagcacuuccccucccccaugcucuggaaguccaauaauuucacugguuccccacaauggaaaacaauuaaaauaaauaaccuaccacugacugaacaaaacagcgacacgauucaauuuccuaauuauuuuacaaacaauaucugaaguagucuaaagauaaauaaugaggccaaaaacauuucuggcuuuaaaaaguguugggcuaggggcuggacugcucuuccagagguccucaguucaauucaauuacagauggcucacaaccaucuguaauaggaucugacgcccucuucuggugugucugaagacagugacagaguguauucacauaaaucuuuuuuuuuaaaaaaaguguugggcuaaccaggcacaggccuuuuacccagcacuugggaagcagaggcaggaggaugaguuucuuugaagugggacccagucuccucuauucaggaaguuucagggcaaccggaauuacauaguaagacuaucucaaaaaagaaaacaaaaacauguguuguacuuucauguuuaaagacaaaagacuaguuaaugcagggacauuucuggcuuucaaaaguguuaguauuuucaguuccucaaaugucccagcuauugguccuaaaccaucucuuuagauucgcaucggaauucccuccuuacacccuccucuauccuaccacagcgacacucacugcaugguacaagauguucccuccggcucagacauccuccccuaauuuaaaacugauugauccuuuuuuaucagcgccgcgucaccaccucccaaaaauaacuaagcauaaauuaauggcuccguuacccagcuucucagaaaguacuggcuuuacuucucuguacacauuccuuugauuuucuaagagaauauucacacaucugcuuccacaucaaacugucaaauuucugacauccuuagcuuguuaccucucucuaacaccgagacacacacuuagaaaggacggguuuagugacuuagugucagcguaaauuuuggcuucuuaaccgggagccaagaaacagggauucugucucucagacucaaauuccuucccgucuucucugguuacuuuccuuauggaaucugguugcuucucaacauguuucuagcucuguuuacucuugugcagcauaaaauaagcgacuacccagaaaacuuuggcaacuggucaaaucugccuuuccuucucucuuccuccugauucuccaacaccuagcucucaaagggaaaaagauagaacaccaggacacaagugauuaaaggaguaaacuaccagauuuucugccggaaucauuuagugcaagcaccacaacacgauccagccgccuuggagaugccuguaucgcgaaggcugggauuggcaggccugcgcugaagcggccuccguuaggagcggcccgaaagcggcugccgucauucagggcuuuccagguacgaacugccgacgauagcgcccggggggcgagaaagucggccucccacguccgccuccccgcucccuccccgggagucccccggggcaagccgcucgagcgaggcucuccggucagaacaagagaacucggaagcaccaacagccagcgcggaacaaagcgccggucccggagugcgagaggacgccauuacgcgggcagcggccugcgccgacgagccgagcaggccucgccgcgcggccucggucgagaccagagaugccacgcgaagacgcagaaagccaggagagagggccgcggcuggcuggcugccgaggucgcgcgugggaagggaaaggccgcuuaccuucgugagucuuggcgaucuucgccauuuuguccacucgaacacacagacggaacuggcgcucccaaggacuuccgcucgccgccgccagaaacagaggccgcucucugagcgugcgcacccgggagcgcgcgccgcacuguagcacguacuucaacug

SEQ ID NO: 162 - RNA, 42340 nt, Mus musculus
caguugaaguacgugcuacagugcggcgcgcgcucccgggugcgcacgcucagagagcggccucuguuucuggcggcggcgagcggaaguccuugggagcgccaguuccgucuguguguucgaguggacaaaauggcgaagaucgccaagacucacgaagguaagcggccuuucccuucccacgcgcgaccucggcagccagccagccgcggcccucucuccuggcuuucugcgucuucgcguggcaucucuggucucgaccgaggccgcgcggcgaggccugcucggcucgucggcgcaggccgcugcccgcguaauggcguccucucgcacuccgggaccggcgcuuuguuccgcgcuggcuguuggugcuuccgaguucucuuguucugaccggagagccucgcucgagcggcuugccccgggggacucccggggagggagcggggaggcggacgugggaggccgacuuucucgccccccgggcgcuaucgucggcaguucguaccuggaaagcccugaaugacggcagccgcuuucgggccgcuccuaacggaggccgcuucagcgcaggccugccaaucccagccuucgcgauacaggcaucuccaaggcggcuggaucguguuguggugcuugcacuaaaugauuccggcagaaaaucugguaguuuacuccuuuaaucacuuguguccugguguucuaucuuuuucccuuugagagcuagguguuggagaaucaggaggaagagagaaggaaaggcagauuugaccaguugccaaaguuuucuggguagucgcuuauuuuaugcugcacaagaguaaacagagcuagaaacauguugagaagcaaccagauuccauaaggaaaguaaccagagaagacgggaaggaauuugagucugagagacagaaucccuguuucuuggcucccgguuaagaagccaaaauuuacgcugacacuaagucacuaaacccguccuuucuaagugugugucucgguguuagagagagguaacaagcuaaggaugucagaaauuugacaguuugauguggaagcagaugugugaauauucucuuagaaaaucaaaggaauguguacagagaaguaaagccaguacuuucugagaagcuggguaacggagccauuaauuuaugcuuaguuauuuuugggagguggugacgcggcgcugauaaaaaaggaucaaucaguuuuaaauuaggggaggaugucugagccggagggaacaucuuguaccaugcagugagugucgcugugguaggauagaggaggguguaaggagggaauuccgaugcgaaucuaaagagaugguuuaggaccaauagcugggacauuugaggaacugaaaauacuaacacuuuugaaagccagaaaugucccugcauuaacuagucuuuugucuuuaaacaugaaaguacaacacauguuuuuguuuucuuuuuugagauagucuuacuauguaauuccgguugcccugaaacuuccugaauagaggagacugggucccacuucaaagaaacucauccuccugccucugcuucccaagugcuggguaaaaggccugugccugguuagcccaacacuuuuuuuaaaaaaaaagauuuaugugaauacacucugucacugucuucagacacaccagaagagggcgucagauccuauuacagaugguugugagccaucuguaauugaauugaacugaggaccucuggaagagcaguccagccccuagcccaacacuuuuuaaagccagaaauguuuuuggccucauuauuuaucuuuagacuacuucagauauuguuuguaaaauaauuaggaaauugaaucgugucgcuguuuuguucagucagugguagguuauuuauuuuaauuguuuuccauuguggggaaccagugaaauuauuggacuuccagagcaugggggaggggaagugcuuacugaaggaaagcaugguuuacuccuuacuggcuuccuuauagcugcauagguagagucccauacccuaauagguuauugauuuauggagauuuauggauauuuuguagcuuugauuguuggcuuauugauaucuucaauguagcauacucccaguuggauaaaugcaaaguuuauuuuaugugcauuaauauuuuugccugcauguaacgucugucugaaggugucagauucccuggaauuggauuaaaggacaguuguaagaugccacaugggugcugggaacugaaccuaggucuucuggaagagcagccacugcucucagcugcagagccaucuuucuggcccugguaaauguaaaguuuaggguccuuuccucuuuccuuuccccuucccuucccuucccuucccccucccuccuccuuuccuuuccuuuuucauuguagaagcccagcuaaacuuguuuucaaaaauugcaauugcuuuuuuuuuuuuuuuuuuuuugguuuucgagacaggguuucucuguguagcccuggcuguccuggaacucacuuuguagaccaggcuggccucgagcucagaaaauccgccugccucugccuuccgagugcugaguuucgauuuuuuuuuuguaaaaauugcuauuuuauuuaggauuauuuuauuauugaauuaauaaaaaauauuauagaaguaugucacaauuugguauaaggucccucaguauaaaucuuuauugucuuagucuuuuuuuguuguuguguuguugcuacguuuguuuguuuugagacagaguuucucucuguagcucuguccuggaauuugcucuguuuaucagucuggccuagaacuuuuuuuuuuuuuuuuagacaaucucuucauguaguuucagcuguucugaaacacucuugguagacuaugcuggccucagauuggccucccaagagcugggaucagaguugugcaccaccaugccugucuaaaguagaguuuuugaaaaauuuuuauauuuauauuugcuuugugcaaaaaugagaggacaacuuggaagagucuguucccacuuugggugauguagguucugggauuccaauuuagguugucagguuuggcaggaagugaguuuacacccuuaaucagaguaaucucauuaaagcuuucucuacuguugguguaaacaggaauuuuauauaccuuaauagcuccagugucuggucaguaauggguauuuaaauguuaaaucaacauuuacuugcuagauuagcauguuuuagauuuacuuuacuacuuuuggagaaagauuuucuugucaaccaggcuggccuugacuucugauuuucuaccucuuaagugcuagauuuauagauuggcccgugaauucacaaacccugugguuuuuaugggaaaaguuucacagaaaugggaucauuuauuuguauuuuuucccuuauauuuaucuauuguguuuaucuauguauuuuugcuucuauguccauguggaagucaggacaacuuucuggaguuggauucagguuuucaggcuugcugcaagugccuuuagcugcugagccaucuugguagacuucacuuuuguuuucucuuggaaauggaauuaucgugugggccugguuggcugguugcuuucggugcuuccuuccuuccuuguuugcuugcuuccuuccuuuuuuuuucuuuuuuucuuuuuucuuuuuuuuuuuugagacccagaccagauuucuccauguaucccugacugucuuggaacuugcuuuguagaccaggcuggccucagacucacagcgagauccaucugccuuugcuucccaagugcugggauuaaaggcaugcaccacuacauccucauuuuguaucuuacuuaaguuggucucauacuuggaggaacccuuugccuccugaacacugggauuuuuggcauguaccaccacuaugccuucuagaucucaaaguuugggaucaauccccaggauuuuguauuuauacuacagagcauuuggcauugaacuacccucccacucugaaaagggguauuuaaaacccaguuuugguacaucaguuuggucagacagguaggaaauagccuauuauuguucugagaaucuucugaauugagaggaaaagaugauuuagccuuaaaguuggaagacuguagauaacugcaagauuugguuuuggcuucccagugaauauauaauaaaauacgaucuuccuuuccccaaguaacagauuaauauuuguaugugugucaugcauaugcauaugugcauuuguguaguauuuguauguguguagguaucuccaccuguguguguguguugugugcacauggaagccaaaggaggcaguugggcuuauucccuugagauaagguaucuuuugguuuuucgagacaggguuucucuguguagccuuggcuguccuggaacucacuuuguagaccaggcuggccuccuacucagaaauccuccuaccucugccucccaagugcugggauuaaaggcgucugccaccacacccggccugagauaagguaucuuacugaaccuggagcuauccuguuggccagcaagccuggaguuacaggugugcagaacuaugccagccauuuuaacauggcauuuggggauuugaaguuggguucuaugcaagcauuuuuacuggcugaaucaucucuccacuccagaugauuuuuguguuuuaagaagaaaguuauuggauaauuuuauuggaggcaaucauuaaguuauuggaguaauugaaacuggucuuggauuugaacuuccugguguaacuaacuucucaauaauaguucuccauauuauuaagcacuuuuaguuguguauuguuuauuuuuuuuuaauuuuuaaauuuuuuguuuguuuguuuguuuguuuuugaggcaggguuucucuguguagcccuggcuguccuggaacucacuuuguagaccaggcuggccuugaacucagaaauccaccugccucugccucccaaauacugggauuaaaggcuugcaccaccacacccggcuauauuguuuauuuuuaaagagauagcuaccccaguuuuuacuugaaucauugauuaugguugugucuuccuucuauggacauguccauccaucucccccccccccccccuuggccuuuuuuuucuguuaauuugaagagucucauauugcccagguugacuucgaaccugcugaguagcugaguuuguccuuggauuccugauccuccugccucuaccucagaagugcugccauguuaccuauguaguaucauaccucagccucagcucagcuuccaugguuguguucuuaggcuuuugauuugauuauugaaccaaacucucugugauaagauauguugcccaggaugaccuuaaauuuucuugccuuuuuuuuuuuuuuuuuuuuuuuuuuuuggugacagacugucacuuuguggccuugccuggccuggguuucauuauauagaccagguuguuuagagguccaccugccucucucuuuugucuuuugaguacugggagauaaaggcaugggccaccaauauaaaaagucuuaucuaauggugggguuauaggaugaacacaauaccugauuucuaugggcaaaagaacuggaggcuaaucucuaauucuaguuuucaggaggauugccaguaauuugagguugucagcccagguaacuuuguaaagauuugucucaagaaauaaaaaaaugaggcgugguggcgcacgccuuuaaucccagcacucgggaggcagaggcagguggauuucugaguuccaggacaaccagggcuauacaaagaaacccugucucgcaaaaccaaaaaaaaaaaaaaaaaaggaaaaaauaaauuaaaaaaugagcuauauguguuaucacaagggacucucugaguuccugugucugugugaugguuagggugccacccuuuuuauagguauaucuuucugauuuggguggucgucauacuauacugaugagguagaagagggauugcaggcuguuggguguguuggguggugguuuugcuuuuuuguuuuuuguuuuugcuuuuguguguauguuuugagacagaucucacuauguaucccugggcacaucugaaauuuacuauaaagacaggcuagccucaacuuaugugaaaucuuccugcccuggccucaugaauacggggucucaagcgugaacuaccacacuugauucaaguuuggguuuuuuugguuguugaugcucagcuugguuuucuagggggagguuuuguuguugauuugagacaggaucucuaaguagccuugacuguccuugaacuugaguuuggccugguucugucucuugauugcuagaaucaaauaugagacucaaguuuuaguuuuuuguuuuuuugguuuuuugagacaggguuucucuguguaguccuggcuguccuggaacucacucuguagaccaggcuggcccuaacucagaaaucugccugccucugccucccgagugcugggauuaaaggcgugggccaccacugccuggcucauugccucuuuuuaauuccuugggccugucccuuucuuauuggggaaggggcccagcuauucuuuggcuacauaaacuuguuaaguuuucuuaaccaucuacauuugagaauacaguguuuuucuuagcuggggcucagugggguugagcaauuaauacgaaaauuuguaccuggcauuugaucccucuagugaaggagaaucugucuguaggcuguaagaccuacccauaaauucuacccuaacugcucuuaaaauugugauguagccaacgauguccuugaauucuugucucuucugguuucaaaguuggaguuacugcacuuguuuauacagugcuggggcauuuguucaugcuaggcaagcacccuaagaacugagcaacaccuccaaaccaauuaguguguauugaaaaaaacuaaagagugcuggucaugcuaacucagacauugucuuagggauuaggaauuugaucccugaaacucaugugaaaagcuagauguguaaaaaguuagcugcaugaaaguggauguguaauaucaguacuuguacugcaagagggaaaauaaagacaggagaauuggcuggaaacuuuugggccagcuaacuacugauacaguugacuccacuguacaguugagaaacaagacuuagcaaguagaaggagauggcucagaacagguccuuuaccagcuggcccauuucacuggccccagccuuaagcuguuuuauacuugaucguagcuaaaggacugagaagugaucuaugcaguuaguuuuaccucuuugguaguggguuuuauuuugugcuauaacauaauaugugaagcuggguaccagauugaggaccuuauucaaugcugagcaacugauguaccacugaauuaugucucuugauuaguucugguagugacaaguuuaaauaauugugaguacagcccugguucuuaauacacaucaacaguuuuaauuuuuuugacugccagggauggcuuagcaagucacuugucacacaagcuuaagugaccucgguuugaucccuggaaccaugcaaaaaaguagaaaacuugaguuuucugaguaucaggccuauaaauuugugcaugcuagugauaaauacauauauuuuuaaaggaguuauguauuuuaugugaguacugaagacacaccagaagagcgcaucagaucccauuacagaugguugugagcuacuaugugguuccugggaauuggacucaggacccuuggaagagcagucagugagccauaucuucaagccacucacaaauacauauuuuaaaguagcuuuaauuuucccgugggggaaguuuuagaauuuugagauuauuuuugauagcccaccuaaugguuagggaaaguuguugagauaguaaaucagcuuuguguuccuuucaccugaugaggucaggagauacauguguagauguacuuuacagcuagcucuuuuaaccucuuacuaaaauuuucuauguuucaggauauuuugaaaagaucuaguaaggagauaaauuauacugagagcucuuuaaaacaugaaauuuuuuuucuuucuuacagauaucgaagcacagauucgagaaauucaaggcaagaaggcagcucuugaugaagcccaaggagugggccuugauuccacagguuauuaugaccaagaaauuuaugguggaagugauagcagauuugcuggauaugugacaucaauugcugcaacugaacuugaagauguaaguuacagauuaucuaggaggcaaggauuuuuguuuugguuuuuugagagaaaauaaauaggggaauuuucuguuugaguugaugguuaaauggagagaaacaguuaauaacacauagagggaaaacagacucucucucucucucucucucucucucucucuguguguguguguguguguguguguaauccuagcuagccuggaacuggauauauagacccaucuacacacauacucauaccugccacuaugugauccuuuauguaguagaccaugcuggccucaagacucuaccugucugucuuccaacugcugggacuaaagaggcaugcuacaauaauccucccugguuagauagaguguuucacaguuagcuuguuuuugccugcuuaauacuaggguccucacugggcccuuagauaccuccuaaagugcccaguuuugaauauuuuguggaagacuuaucugaauauuguuagaugauauauaaagcauuuucacaucauuugugauuuaaauucuuguuaccuaauccugucugaaguacccuauggaagacaugacugaacugacuguaaauauuuuuuugagauuugauuucuguuuuuggaugaagcuucaggucuuguucauucuaacaaaugcuuuaccacuuggcuaaccaacccuuuaaauuauguauuuuuguuguuauuguuguuuugagacaggcucuccuuauaggucuguccgggugcugggauuauaggcuugugccacuauacuuagcuuaaguuuuucuugauuucaguuuuuugaaaauuaaauaugcuauuuuuauucuuggaaauuucauauuugauuacauuauaucuugaucuuacucaccaccuccuccucuuccuaacucuucccagacucaccuuaugaccuuucaacucugucuccuuuuuaaaaaauaacuuauugagucuaguuuuugcugcuaacauacucauggguguggaacaucuacugugguauggcagccauacccuuaaaacuuccccucagaagucaucagcugucaauagcuccucaguuagagguugaaauucaugaagucugccucaugcugcaguccugacugguuuagucuuguacaggcagcucuaagggcagcaguucucucaugucuagaagacacuguuacccuauccuuuccgguaugccucuuagaaucuuucuucccucucuucuggagaguuucugaaccuucagaggaaucugugauacagacguuccauuuuggcugaagaaaauagaauauuaaagucuuuuuauguaaauucuacauaguuuucuuuugacuauuucaaacauucagauuuguugauacaguuauuuaauggguuuuucgugauuacuuuuugacaccuuauacugguuaugaagauuuuuuaaaaaaaagauuuauuuauuauauguacaugaggacauaguuguucuuuucagacacaccagaagagggcaucagaucccauuacagaugguugugagcaaccaugugauugcugggaauugaacuuaggaccucuagaagaagagucagugcucuuaaccacugagccaucucucuaucccccaugaagauuuguuguuguuguuguuguuauuuaauuuuauuuagaaauaggaucuuacuauauaaccuuggguagccuccagcuuacuauguagaccaggcuggccuuaaauucggagaccuaacugcuucugccucucaugcacugggauucaagcugugugucccucaaccaugccuggcucaaccugguuaguuuuauaaaauucaagucauaucuuggucacuggcacuuuucuuucccacuugauagaaauguguuuauaugauugucccaaaagugaaauucuagagacuaguuuuucagagggugucuucuugcauauacuaucucuaugugucucuugcucucucucauauuugcucguguuuugagauaguuuugauauucuaguuuacacugaucucauacuuagaaucuucaugucucugccuuaaccaaguccuaggauuaggaauucuguguuggcaugaccauacuuggccauagcacuugguuuucuuaccuaguagugaaagacagugguggcuguauguucuagaauuaagaaacauuuuauuuuaaaguagaauguaugaguguauagugauguguaaacauguuguuauggaaguuaauagcuuugauaacaauuauuguugacuuguuucugugguuaaauaaaacuuaagaguuccaaauaaacucauggguaguugucauguugcuuuuuauguugugaccuuuuggguguuugauugcaggaugacgaugacuacucaucauccacgagcuugcucggucagaagaagccuggauaucaugcccccguggcguugcuuaaugauauaccacagucaacagagcaggugaugccucgcaguuauucagcuuacaaaaagggagucaguuuccaugggagcacaggaauuuuagcaguucugagaauguuuugagagaagagcugacuugggggagucagaaauaauuguuuuguaaaggcauucauuaagccaaaccuggaguuuuggaaacugaucagccacacauacuuuuuuugucuuaaauaaugguuuauucauuuguguguguggugaggauggguuaguuuuuuuaaauaggguggguauuaaaaugagaugugccuuuuuuuuuaguaugauccauuugcugagcaucguccuccaaagauugccgaucgggaagaugaauacaaaaagcauaggcggaccaugauaauuuccccagagcgucuugauccuuuugcagaugguaauucuuucccacuuuucuauaaguauucagaaauuuauuuuaauuaccuugucuuuagcccuuugauuuuuuuuggcaugcuuaugaauuugcuuuucguuuuuaaagaccccuuuauagauuuguauagauuugguugaagucaaagaugccauauucuucaucuuuauaaugcaaguuuucuuuccagguagaaggacaagaaaauaaugagccaaugccauagaaacgcaaaggguuaaagguuuuucuuuuacuuuuguuuuggguacucuugguauacuuugaacaaauguguuuuucugcucaaaauacuuucaaauuauugcaaaguuuucauuccaaauucuagaguuuuggauuguuacuuuugagaaacuauuucucacacuaguuccccuuauuguuauagcuuaguaaaugcaccuacuuugcucuagucaacuuuauauaguuaaaacaaagcuauauacaaagacuuugguauuuaauaguuggagucuguuuugcuaauuguagugugcaaggggcauagugagccugauggaagauuuccucaggugagugagucccagcaucaaaacuaagugccuguucuuaaaauuagauucugcugcagguuuuuacaaauuagacuuucagccugcaugaauuaauagggauauucuuugcuuuacuugcauaauuguaauugauuuaaacauguaugucagaauucacaggcccauacuaacuguccuuaauuucuuuccuacagcaguacugcuauaugccaguccugucugcauucuuaagggugcaguucaacacauccucucuagauuauggugaaaaaguauuccaaaggaagucuuaucagagcuaguguuagaaagaaugacacuaccaauugggcaugaucgucagcauaggagaugucuuagaauuuuauuauuuuguccuaaauuguaaugcuauacuacuuguauagcuauugucacuuuucuaaagcauagugugccuucguguucuuguuaugcacuguuugggcuucuuuaagauauuuugcaauuugaaaagcaaauacugaaauuuuaaccaagagacugacacaucucuuuguacaccacuuuucuuuugugugcauuguaguaacugguagaauaauauaucuuaaguuguauguuuccaguugugauuguacuuucuaagaaauagaauuauauuuugggucaaggaaaaaacuuuaaaaagcacgaagcccuuuuaguaaugugacgugagaauaugauuguagguuuauuuuuuuauaaucagaguuucuaaguuacaacuguuuagaucacuguaugaagaacuuaauguuagucaguuacuguagucaggauuuuaacagcuugcaacagguaauguuuugaauauaaauaucuuuccaaaguguuacuaaugguaaagagauaauuuucuaggcuucuauucugcugcuugaagucagaacugcugauggagacaaaggcacgaaaguguacguauuccggauuagcaacccaggaacccaucacuucugaagacuaaacugugcugucauuuugcuuucuauaugcauuaaaauaauuguuuuaaacugcuguagauauguuuguguucaaacagguuaaauugaucagcaaacucaauaaaaaaguaagauguauaauuaucaaaguuuuccaucaaaaacuaaauuaaaugauuauggaauaacauaauauuagagcagggcagagaaaucaauugaaccuaauacccuuuauuuauuguauucuuguccuguugcuguucuuuucugcaggagggaagacucccgauccuaaaaugaaugcuagaaccuacauggauguuaugcgagaacaacauuugacuaaggaagagguaggaacugcuuucucaguguaaugguugugaaauaauguuggaacauuugagagaauuuuauauuuaucuagguuucgauguucauagcaauauuuuuuuuuuuuuuuuugcuuuuuuccaccccugagagaggguuucucuguguagcccuggcugugcaggaacucacucuggagagaggauggucuugaacucagagauccacuugucucuccagugcuaggcuuaaagcugugugcuacacugucuagcuuuuuuuuggggggguggcgggggguucgagauaggguuucucuauauagcccuggcugucccggaacucacuuuguagaccaggcuggccucgaacucaaaaaucugccugccucugcuucccaagugcugggauuaaaggcguguaccaccauguccagcuuuuaaauuacuuuuaaaaggugaucucauuauguagcccuggcugaccuaaaacuuagaucugccugcuucacccucugaagugcuggaguuaaaggugugaacaauuggacuauaguaguucaaucauagaaaguuaaaaaaaucccagaauuauaugacccuugacacuugauauuuugauuuccuggcuuccugugagugucugcuugccuggggagguguuuaagggguuacuagcauaccucaugaagcuaguggucacauuaauuuuugaugaauauuuacuggagauuggguuuggcaauagauggagaauuuuaaauauuccauuuggcuuauagagauaauucugugcuaacaugaaugcaaugcuaacaagccaacccucaacuguuuuuguauuuuuggucuucucauuacauuuauuuguguguguaugcuugguacaugccauggugugcuuguggaagccaaaggacaacuggcaagaguucuaccaagagcguuccagggauuaucggacuugguaacagaaagugcuauuaccaaaugagcugucuugccaucacugguccuaaucuuuuuauuguuguuugaaugaaguagggucuuccuguagcccaggcuaaccuagaaaugacucuguagccucauagucauaggcugacgcuccuaccucagucuccugaguguuaaggaaugacagguauacaucacugagauucccgugguuccuguagcaauauuaacaauaaaaguaggguuugcuaggcgauuuaaagggaucuggaaccucauuuuaaaaugaaagggugaauuaaaugcauuuauuaugacacuaaguuuuguuuucauguuucuaguucuuuucuauuuuugagaaaagagucuugcuauguauuccugacugggcuagaacucacgcauugguuggacuugaauucaaaccaauauaccugccuagucuauggaucauaggcaugugcuacugcaccuggcuuauuuuugugucuugagucuuaaaaacuuucaguugcauauuuuucaguucucugcuaaguggauauuuacuuacugauuagggcgauuacaagacuaacuucacuagucucacugacuagagauuuuauuuuucaauaagacuuucccuagcuucaaaacauaggcuguugcauguguacuguuuagaaagaaagcuaaugcuguguguacacacacagacacacaaacacacacaauauuaaagauaaggaaugauaucacuaggaacagaaugaguuuuuuuuuuaaagauuuauuuuaguauguauacaacguucugcccgcauguaugccugcaggccagaagauggcaccauaucucauuacagauuguugugagccaccaugugauugcugggaauuaaacucaagggccuauggaaaagcagacagugcucuuaaccucugagccaucucuccagcucgaguguuuuuuuguuuuuuuccccccauuguuuuggagacaguuuuguuauaguccuggcuguccuccugccucugccucugccucugccucccagugcugggauuaaaggcgugcgccaucgccacccauccugcugugaauggaauacuaaauagcgcauugaaaagaaaugauuaugcuaguagaauuaaaacuuaacuaaagaaauuuuuucuauuucuggugcuggggauugacuaggagcuuaagcaugcucgguaagcauagcuacuugaguuuccuccaucuaaucaaaugauuugcuguuugaaauguuuuucagagagaaauuaggcaacaacuagcagaaaaagcuaaagcuggagaacuaaaagucgucaauggagcagcagcaucccagccucccucaaaacgaaaacggcgcugggaucagaccgcugaccagacuccuggugccacucccaaaaagcuaucgaguugggaucaggcagagguaaucuuuuauuuuuuuauugcuauuuucauauuuuucucuauggacuguguucauauuugggcuuguaaaacaaguuacuauuuacuggauggcuuaacuuuauauccauuauuucucaauaauggagguuugaaguagaggaugaagugguagcaggauuguugucuggggagaauacuuugucacuguuuucucauaacuuuucccucaaucuucuuccguuucaucuaaccuugaauguccccagccuccaaaaucggucacauuagggcuuacaaccucaauaccuuaauaaggcuuugagacauaguccaguccguauguugaggaauggaacguucuuuuuuaguuuaauuuuauuugugucuuuuauuuuauuuuauuuuauuuauuuuuuucuuggaggcauguuuugcuuuguggcccuggccagccuggaacuuuuuuuuauuaauaaaaaaaauuguauuuacuuagaagcauucagaaugucaacaaagcagccaccaaacuacuguccccauauauaacuaauuuguacucugcaccaacaagaaccugcuuuaaauuuccaugccaauuuacaacccucagacuguaccaggcaagguuaguggcuauugaaaauaccaccaggacagggcuaucacauucaguaguguguuaauuauacaaaaaaaagacauuguacgguuuaaaaacaaaucuuacacagccuuacauuacaauuuuuuuuucuuuaaaaggagcgaguuguguacaggggggguuaaaugcuuuuuuuguuuugguuugguuuuugguuuuuuuuuuuuuuuuuuuuuuuugguuuuucgagacaggguuucucuguauaguccuggcuguccuggaacucacucuguagaccaggcuggccucgaacucagaaaucugccugucucugccucccaagugcuaggauuaaaggugugugccaccaccgcccagccuaaaugcuuuacagacaagaaaaagaaacugugcuacaaccaacuuuuuuuuuucuucuucuucuucuucuucuucuucuucuucuucuucuucuucuucuucuucuuccuccuccuccuccucuuccuccuccuccuccuccuccuccuccucuuccuccuccuccuccuccuuuuuucuugcucuuuucagccuugaccacccccuuuuuugcugcaucagguuuuccuuuagcucucuaggcaacaauuuccuucucauacuucuccuucagcuuggcagccuucuucucauaggcuguccucgaacucagaaaucuaccugccucugcccaccgagugcugggauuaaaggugugcgccaccacacccggcucagaguuaaauauuuaaagccacaauaaauuugcucuacucaaagcugccuagcuguuuguuuguaauuagauagaaaaguuuauuuuucuuacaagauuuacuuuuauuagguguuugucugaauguacaucacaugugugcagcuacuuaggaguaauugucagauccauuggaauuggaguuagagguuguugugagcuauuacugugagugagugguaggaacugaacucagguucuaugcgagagcaguuaaauggucuuaacuacuaagccuucuaggaaagaauguguuucuaggaaaguaauuaggacuuagaccuaccuuucuuuuuugcucauuuauggaaaaaauaggaugcauggcaguaagauucauauuaccaccuuuuuuuuuuuuuuuuuuuuuuuuugcauaggaagggcaaauuaaguuugugaauaauucauuuucauucauuacuuaccuaauccagagguuuuuguuguuguuacaguuuugagacaggguuucccuguguagccuugguuauccugaaauuccaggcuauccuugaacucagaaauccacauaccucuauccagaaucauuuuuguuuucccaucacgaauaaaaauccuuauuagcugaguguggugagagugagggaggauuaugaguuucuggguuaucuugucucaggaugacuuaccccaccuccccaagcccugccaccaccaagacacuggauauucagagcucuuuuacauucuuggauaaauuacucaaauccacuucuaaucuuucuucccucugagcuugcugcaaagcuugauagugugaguuccagauacaagauucaugugguagagagagacagugcacucccauggguuagucucugaucuccacgcuugcucagugacguguguacucaaacacaggcauacaaauaaauaaucuuuuuucuuuuuuuucuuuuuuuuuuguagcugggauuaaaggugugugcuaccacgcccgacuuuuuuuuuucuucauuaagauuggguuuuacuacguggcucuggguugccugaaacucaagucaaccagauugacuuugaacucacagagaugcacuuuucucuggcucauaacauauuucuuuaaaguauuuauuauaauacauguggauuccuucuuccccagagguucuaaugucucagggauccaguuuggggaugcacuaauuucagagcugaaagucuugcauuggaguuguagauagacaaaauuacaugaauuuucuaaacucagaguuuaaacucaguguauauuucaggguaccuuguaucaucuggagauuauuacaguagcuuugcuuuuaguuuucaaugagcuuauuaaguauauaucauauaagaguaaaagaaagcuacacagcuuccauuccaaauggcuguucuaaccauauagaaguuuagugagcuuuguagacuuuuuaggccugguuauucugguuauuuugauuuauuuuucucaauuuacaauuuuuuuuauaauuuuuuuuuuaaaagagaagucaaaaaaaaagagaggaguuaaagaaccauggcaaauaauagauugauagguacagcagauaaauaaaacuucauugaaucaggguuucauagaaucaagcacggagaccgcuggaguagccugguuaagagaacaaagguggggcuguuaagauggccagugguuaagagcgccgacugcucuuccaaagguccugaguucaaaucccagcaaccaugugguagcucacaaccaucuguaacgaaaucugaugcucucuucuggaguaucugaagacacacuacauuguacauauaauaaacaaauaaaaaagccgggcgugguggcgcaugcccuuaaucccagcacuccggagguagaggcagguggauuucugauucgaggccagccuggucuauagagugaguuccaggacagccagggagggcuauacagagaaacccugucucgaaaaacagagagagagagagagagagagagagagagagaagaggggaggggaggggaggggaggggagggucuucucauggcggaacugccuucucuuuccugcugcagccagauuuuuuuuuuuaaagauuuauuuauuuauuuauuuauuuauuuauuuauuuauuuauuuauuuauuuauuauguauacaguguucugccugcauguaugccugcaggccagaagagggcaucagcucccauuucaguugguugugagccaccaugugguugcugggaguugaacucaggaccucuggaagaacagacagugcucuuaacuucugagccaucucuccaguccuauagccagacauuuuuaucauggggcaaauaauagacgauuuaacuguuuucaagaacaguguuuuauuuuugggcucuuuugcuauucuucugucuucuucccuuguaaaagggagucagccugagccaggauauguguuuuggaaauaguuugagacaaacaugcuugggucuaaaauggggauuauuucucuuucagaguuaucuuuuacaagcuuaagcagcucauggcaaauuaccaacacauauauauucacaaagguuuauaacccagaauguuuuguguaucuuuaaaauucuauuuauuuuaauuugcauuuuuuucaucugcauuuaugucuguauuaggguauugacucucauggaauugcaguuacagauaguuguaagucacugugugggugcuaggaauugaacaggguccuuuggaagagcagccagugcucuuaacuguugagccaucucuagccuuguguuuuaaucuagugcuuuuuacauuguucaguuccaaaugaaagcuguaaauuuguuuucaucauaagcauuugcaaaucaguaagcaaaaugauaucuaacuuccacugaaagauacauuuauuguuuuguuuuuuuuuuugugcaauagaaaauuuguaguuauaucucuaagguguauagguaugugaaacaaaauuccuuugcuuuguacagaccccugggcauaccccaucuuuaagaugggaugagacaccgggucgugcaaaaggaagugaaacaccuggcgcaaccccaggcucaaaaauaugggacccuacaccgagucauacaccugcgggagcugcuacuccugggcgaggcgacacaccaggccaugcaaccccgggccaugguggugcaacuuccagugcucguaaaaacagaugggaugagacccccaaaacagaaagagguagguacuuuagugcaguguagaugaguguguggaugagguguugacuccagcauuuugucuucagacugagguccuuauuuccuaguauaaauauagauuucuauaaauaaccagcugauguggaugugccuaaaccuaccaaguuuauaaaacuuguuuuucuuguacuguuugucucaguacccaagcugaaaucuguuagaaccuuucuuaauaaccuuucgacuuuggacuggugacguggcucagagguaaaggcucuugccaccaaccaaacuggaggaccaggguaugaucccugggacccacaugguagaaggagacaccagcuccacagguaaccucuaaccuccacauguguaucauggcaugugcuccccaacauacacaguaaagaaaggcaacacacuucaacuuuguuuaaauuaaaauuuaaaaaacuuagguaauauuguacucaauuaauuuccccucuuuugaagaggcugaagguuuuaggaagaaucuuuuuuuuuuuuaaacuuaaaaaaaauuguuguggauacuauuagccuucuuucuuuccucagccuccugugaguacgcuguguguguguguguguguguuuaaaugcacccguuuuaaccauuuuuaaugugcacaauuuaguggcuuuaagaauauuuccagaguugcacaguuaugacuuugacugcuauucacuucuauguuuuuuucagugauccaaacauacugcauucuuuagauacagauuuuccuuucucccauuacuuucuggcuucugccaggcuauauuuuauaucucucucagaaauuugccuaaaucuaguguuugcuauauagugaaaauagcuggaacauggcucaagaugaacagugagguguggaugaagaaaguuuuguuuuucuguuucucauuaguucauaucuguggcuuuguagucagugaaaaggaaacaaauacugggcaaaacuuuaacuggaucuuguuuuagaaauauacuccuuuugaacuuaaucgaauugcauguaggggaagcagcauuuuaagaguguuaauagugugguuuuacugauccuuugucuuucaagauacuccugggcauggaaguggaugggcugagacuccucgaacagaucgagguggagacucuauuggugaaacaccaacuccuggagcaaguaaaagaaagucucguugggaugaaacgccggcgagucaaauggguggaagcacuccuguucugacuccaggaaaaacaccaauuggcacaccagccaugaacauggcuaccccgacuccagguacaaauuuuuuucaucauucuuucucuuacagcuauuuuaauuuuuuuugcuguuuuuuuuuuuuuuuuucuggguuccacuaaugcuagcuuuucuauuaagaauguaaauauaaauauauaacugccuugauuugcauuugcaauguaaaaacaacucugauacggacugauguuaacuauuuuguaucugaagggccuaagucuuacacuguuggucauuaacaauuuugcuuuuuugguaggucacauaaugagcaugacaccugaacagcuucaggcguggcggugggagagagaaauugaugaacgaaaccgcccacuuucugaugaagaauuagaugcuauguucccagaaggauauaagguacuagcagugaauauaugaugacuauguuguauugaggauaugaguuuuaaauauuuaguuaaaaaaguugccugguaaauuagcauuggccuuucugaaauuuacuaauuucauauuuuuagguauuaguaagugcauuucaguuugaaaaaguaauagagaugaaauaaguaacauggagcuuuuauuacuuuggcaauccuaaugauuggugggagucagaaguaggcggaucucuugaguuugaggucaguuugguccagauaacaaguuuuaggccauccagggcuacaaaaagauacucugccucaaaccccucccagcagaaacuuuuauuuugggggcuggagaaauggcucagugguuaagaacauguauugccuuuaaagagcagcaaugaucucuuggaaaccugaggucuugugcuggccuuccaggcucugucuucaaguguacaaaguuauauucaggcacacauauauacacaauuaaaaacugucuaaaaacacuauuuuauuuuuaauuauaugcaugaauacgugcagguuucugcagaagcgaguauaaccuuccaguagaauuauaggcagcugugagcacugggaucucauuuugaggugcaagugcuuuaaaucacggagccauuuuucuaauaucugcuuugagaaaacaacaaaagcucauuacuuuuugagacagugucucacuauguaaccauggcuggccugcaguucaagguacagacagaccaggugacuuuaaaggcauagagucuugaaggguaugcuaccgcuacuggcauuuauuacucuuucugugaggcaucuuaagggcuucuggagguccacagacagugcuuagagaaccucuaaauuaguuuugugggacugagcucagauaacaugccgguuuuauuuguuaguucaauaaaacuuugucucuaaaugacauagauugauggugacacaaagaauguuuuaucaauaauuugaaauuuauuuuuuguuuuauuuuacaacaggaccuuacucuguaguuuggguuuauugaaguuuauuuugaacuaaguaccuauuaucauggaacuacuuguuggcaaagagcugucugugaugauagcuagaguccggaucaagaccucaggcuuacaaggaauggccuuuagagagccuuucuguugacuuugucaaaacaaugugcugauuugugugcuacccccguugcacuuaagcuaguauuagauuauuugcuuuagaugcacaugucguauugcuuagugcuagaguauuugcccaggagggcaaggauuugauuaaccacuauuaaucagcaaaacuuuaaaaaccaaaccaccuauagccuccuuguaauauuuuguauguggacaaucuaauaaauauauuucucaauuauaguccuuggguuccuuaauaccaauaggaggaacauuuguucuuuugugaguuuacuaauuaaaaucuuaaauacaccuuuagguccuaaauguagagugacagcaauguguuugacauacuguaagacucagcgaauaaauucuuuuuuagucaauaguccaugcugcccauggacugaaauaucuaucauugacauuuuuagauaugacaacuaaggauguuuggagaggaccuguguuagucuuuauugaccuaacaagaaaguguaauuagcaacaacaacaaaaagaaucuuacagcuuuaaacucauauuuuuaagacuuucuuuuuugcaauggguuuaauuugguguuucuuuccaagugucuugacagauacuuuaauuuuacucucauguauuuaagucaaaucuguagaguuuaaucuuaaaaaauguuuuauaguauuuaggucuuuauguaaaugguaauaugcaugaucuuuuuaaucuauuacauaaaccauauauucauuuccgcugaaaugaguaauuguagaauuucuaacagugucuuuuaggaaaucacugaaucggguuuuaaauuuuccaguuuuguuaguuugacauguuggcuugacaacaugauauuucaagcauguuaaggugaugagaaucuuuuaaagagugcuucauauauuuucuucuuuuccacuuaaauuuuaauuagcaaauaauauuuucuauaauaaucuuaacuuuuagguaacauugcauagugggauauauuuucuucagguaaacuugcuagcuaauacauuguaaaaucucuuaagugcagaugcuacucauucuguugucuuaagaguauaugaagccaagggcguuauacuaacauguuuauaacucucuuagguacuucccccuccagcugguuauguuccuauucgaacuccagcucgaaagcugacagcaacuccuacaccuuugggugguaugacugguuuccacaugcaaacugaagacagaacuaugaaaagugucaaugaccagccaucugggaaucuuccauuuuuaaaaccugaugacauucaguacuuugauaaacuauugguaaguggugauagcaaaacuaaaguauugcucuuuguuugggaguuacaaaucauaaauuugaucuauuuugaaauuuuauuguagguugauguagaugaaucaacacuuaguccagaagaacaaaaagaaagaaaaauaaugaaguugcuuuuaaaaauuaagaaugguacaccuccaaugagaaagguaaguucuauuuauuuuucuaucaagacaggguagcccuggcuguccugguacucuguagaccaggcuggccucaaauucacagagaucugccugccucugccucccaagugcugggauuaaaggugugcacugcuacuuccuggcuuuuuauuuuuuuagacagggucucuacauaguccuacuuguuuuguaauuuacuauauauaauagguagaccagguggccuagaaccuacagagauccaccugccccuuguucccaagugcucagauuaaagauaauguauccccuuuaauaaacauugaaguuguguaucacaucugauuccuaguucuagguuuuugauuuguuauauucauuauauuuguugguuaugaaugagauagguucuugaacuaucccagacugcccugaaacucguagcccaggcuggauuuagaccaauagcaagucuuuuugaaaccuaguuaccuaagugauggaguuagcagaauaagacaugacacucuucugccuugguucuguuaacuuuguauaugguuucugauaaguugcuuagcuuggccauaagcuuguucaggcagggcuugagcuuuggauccucuuauucuggacuagcugcuugggauuacagucuuaugcucccggcucaaugaauuuaauucuucuaaucaaaggauuuuuguucugauaaggauaugagaaggcuaaauucuuuuucuccuugacagcuuuaaaguguuuaaaaccuagagguauuuuguggaauauaauaugacuuccuauauuagcaucaaauaugacuugaacauagaagguuguucaagcagaacuaaggcauauggcacauggcuccaaagcucuacuaaauuaucaaauuauccuuuuuuucuuuuuuuuuuuuaaaaaccaucuuauuuaugggcaugugcacauggagcacaaguggaaggucaggauaacuugcaggaucaguucuuuccuucugcugucuggguugugaggauuaaacucaguugaucaucaggcuuggugaccugccaguaccuuuuacccacugaggaaggagucuugcuagcccucuuaaguuacccuuuuuucuuuuaugcucaucuauuuauuuguuacacacaugcaugugugcaugcauggugcaaggauaugugugcaaguggacagguaggucaugcuccaggauaaacauggaguucagaggacagcuuuuggaaguugguucucuccuuuuguugucuggaucucagaguugcaauagagucauuauuaggcuuggugguauaugcaccguuaccucuaagcccucaccugccacuaaaugaauugcccuuuuaaaaugaguugcuaauguugaacuuagauaagaguuugaauaucaaaacaauuucgacagaaacaaauucagacuacuuuauguaaauugucuauaaaaguauacaguauauuauuccuggugcaaauugccacuuuggaauguuugcucauaaaaaaauaacuuuucucauuucucugauuuuccucaggcugccuuacgucagauuacugauaaagcucgagaauuuggagcuggaccacuguuuaaccagauucuuccucuguugauguccccuacacuugaggaucaagagcgacauuuacuugugaaaguuauugauagaauauuguauaaacuugaugacuuggugcggccguaugugcacaagguugguuuguucucgaaguaguguuuaaugguuuaacuuuuauuuuucugguucuauuuuuccacuguguggaaucuggaaguuguuacuuuccuuuguguguauauguagcccuggcugaccuggaacuuaguccaggcugcccuugaaggaaugugcaauuacugccagggaauuaaaauuguuuaaccuaucccuuaauuaacaaaugucuuugauaaauugauguggaaauguauguaauuccucuuuuuuuuuuuuuuuuuuuuuuuuaauucuuucagauucuugugguuaucgagccacuguugauugaugaagauuacuaugcuagaguggaaggccgagagauuauuucuaauuuggcaaagguauucacauuaaauuccuagaaaaggaaguuugucuuuugauggguugaggauuaaugguacuaacuuaaguggcuguugucacuuuucucuuuaggcugcuggucuggcuacuaugauuucuaccaugagaccugauauagauaacauggaugaauauguccgaaacacaacagcuagagcuuuugcugucguagccucugcccugggcaucccuucuuuauugccuuucuuaaaagcugugugcaaaagcaagaagucuuggcaagcgaggcacacugguauuaagauuguacaacagauagccauucucaugggcugugcuaucuugccacaucucagaaguuugguugaaaucauugaacaugguaagugguguaucuuuuauagaucagcuguccugauggggagagguguauguguaauuaaaugaaagacuucucacgcaaauuuugaaaugggguuuguaauauuuucuguuaacaaauuaccauugccuaaauuuuauguacuauaaaaaaauuauugcaguuuggauacaugguuagauacauugcuaaaauuuggauuguauuaugaaaauuagguguggguaccuacucauaaccaugucugauuguauaggucucguggaugagcagcagaaaguucggaccaucagugcucuggccauugcugcuuuggcugaggcagcaacuccuuaugguauugagucuuuugauucugugcucaagccccuauggaaggguauccgccaacacagaggaaaggugaaucgcucauuagaucaguuuuuguugcuaguaagauaaccgaaacuuaauuuacuaacguauauauuuuuaaauagggucuggcugcuuucuugaaggcuauuggguaucuuauuccucuuauggaugcagaauaugccaacuacuauacuagagaagugauguuaauccucauucgagaauuucagucuccugaugaagaaaugaagaaaauuguuuugaagguaaguaauuaguugcucaguuuguggguaugugcauguuuuaggaaguucagagagaucuuuauaacauuaaaaacaaaucaaaccuauuuuuguacuguaaaaguuauuacagcuuggauacaugguuagauacauugcuaaaauuuggauugcauuacgaaaauuagguauugguaccuacucauaacuguguuggauuguuuuguguuuugccagugcugcauuugauauauauauuucuuuuuuauuaaccuuauagguggugaaacaguguuguggaacugaugguguagaagcaaacuacauuaaaacagagauucuuccaccuuucuuuaaacacuuuuggcaacacagaauggcuuuggauagaagaaauuaccgacaggugaccuuuuauugcuaaacuuugauucucauaaaucuuuuugacuaauucuuuaccuacuuagaaugcauauuacaugcuauaauuugcuuugacugucuuaaaauuuauacuuguauguacuuuacugugacaagagauggaauuuuuaaaguccauucuuucuguuuggucugucugucugagauagggucucacuaaguagccuagaaaucacucugcagaccucaaacugcuccaucugcugcugcugccaucuucuauguccuggaauuaaaggugugcucagccacaccuggccucuuuuugggugucuuuuuuuuuuuuuccccuccccuccccuccccuccccuaccuccagauuuauuuauucauuuuauuuauuuauuuaauguaaguacacuguagcugucuucagacacuccagaagagggcaucagauuucguuauggaugguugugagccaccaugugguugcugggauuugaacucgggaccuucggaagagcagucgacgcucuuaaccacugaaccaucucaccagcccccccccccuuuucuuuuaaaagcauacauuuaaugugaaauucccauuaacuaguguauuuaaaacuuaaauguuuauuuuuuauguguauuaguauuuugcuuggacauguaucugugcacuauauuuggugugugucaugccugcaaggggccaggccaucagaucuuguauuggaauugcaguuaugagccaccauguggguccugggaauugaauuugggucuucuggaaggaaccccaccacuauccccaguuuucuagcccaggcccuguguguauguauauaugcauauguauuguguuuaaauuacacuuacuuacuuggucuguauaugugccucagggcaugcaugugugaagagagcagcaggcaagaguucccucuuccagauggaucauggagauuaaacucagguuaucagauuuguugggaagugccuuuuaccuuuugagucuucccuacagcccuguuuguuucuuuucuuuugagacaaaauuuuacuuuguagcugaagcuggucucaaaaucuuggucuuucugccucagccucccagcucaacaguacuaagcuaugagcugaugguuuugucugguaaauugaagcuuuagcuagcugaaaccuaaguauaguuuuacuuagaauuguuuuuguuuuggagauaggaucuuaaguuuugggcugccuugggccuuguccauccagacuggcauggaauuugaacgauccauaucuaggugcucucacaauuaaaguuuaguauguuuuauuuccuuggaaaaguaauagauuuaaagaguuuuguuuuugucuuucaguuaguugauacaacuguggaguuggcaaacaaaguaggugcagcagagaucauaucuaggauuguugaugaucugaaggaugaagcugagcaguacaggaaaauggugauggaaacaauugagaaaauuauggguaaucuaggcgcagcagauauugaccauaaacuugaggaacaacugauugaugguauucucuaugcuuuccaagaacagacuacagagguaaggguagccaaccaccuucuuccuugcuuuuaaauuuuauuuugugugcauaugugugggugaaaauuagaaggagauuuuggggaucaguugucuccuaucaccacuugucuccuggggcaugggcaugaggcuuggaagcaggcacuuuaccagccgagccaucacccuggccugucacaaacuugauuauuguggcauauugccauugacuuucauuuauguagaaaaccuacuuuuauugccauugacuuucauuuauguagaaaaccuacuuuuauuucuuauuuuuugaaaaccuacucuuaaaagcagauaucccuuuuauauauuuuuuaaaagauuuauuuauuuauuuuauguauauaaguacacugugucuguacagaugguugugagccauccucucguugcugggaacuggaucagcccugcuugcuauggcccaaagauuuauuuauuauuauacauaaguacacuguagcuggcuucagauacaccagaagaggacaucagaucucauuacgggugauugugagccaccaugugguugcugggauuugaacucaggaccuuuggaagaguagucagugcucuuaaacugcuaagccaucucuccagcccaagcagauaucccuuaaaagacauuuuagugaccaguuguccucaguuuaacauguuuuuuuaccucagauuuuuugguuuaaaaacaaaugggauguuugggugguuggaaagauugaauauuauugaacaaugaacuuucagucaaaacuaaauuauauauuuuuagugauuuguuuuuguuuuucuaaauauaacuuaacuuuucucuuuuaggauucaguaauguugaauggcuuuggcacaguaguuaaugcucuuggcaaacgagucaaaccauacuugccucagaucugugguacaguuuuauggcguuuaaauaacaaaucagcaaaaguuaggcaacaagcagcugacuugauuucucgaacugcuguuguuaugaagacuugucaagagguaaucuauucuaccagauguauauuuuuuaaaacagguaucuuaauggaaaaaguaacauuuuuaacauuccuuuuauuuaggaaaaacugauggggcacuuggguguggugcuguaugaauauuugggugaagaguacccugaaguauugggcagcauucuuggagcacugaaggcuauuguaaacguaauagguauggaauuugcuggucaugugagaauuuggccuuuuaauuuucuuuguauuuugaaagcaagauguaaaguuguauuuaggaguuuguuuuuuuuuuuuuuaaucuucuuuucuggagcacuuuaggauugucagauguaaccaaucucccuuacuauuaucuauuuauauuuuacuuaaaaauguuaaaaaggagaaauuuaguacagaaauuuaaaguacagaaauaguaacagcccaaaauguuuugaguuaauggaagagagggcucuaauagaacuaguguaucagcugaaaaauaaucuagcaucuucuguaagaggaaggagcaacccucaagguguaauuuaguuuuagaaauuuccuuucuaugguaagguauuuugacugguugagauuuauuuauuuauuuuuuuuauacuaugaguucaaagaagaugacuugguuaaaaaaaaagacuaucacgucuuuuaucuauaaguuaaaaacacaacaaucucagguauggucacucuuuuucaaggaauuaugaugaagcaaacaaaaggauuccuggguucaaaaucucauuguauuuaaacaguguugaaaguaacuccuuuaggacugugaaaggguuagaaaaggcugagaguucauaggaccuggcuguugguaaucacuguucuucccauuuuggggaaaggaguaaguaguauagagcaguuuagagcuuuagcagaauacucuuuuagcucagauauguacagauaaugacuugccaacagucuuuuagccacuugugauucucugguuugccagaguuguaaaccauaugguuaaucugacaaacaugagaaaagcaguggagaaucagagcuucuaguaauucuaguuagaucaagagcccuugcuagcugucucuuuuucucucuucauagguaauuucauggagacuagaggucugauuuguuuuucaguuauagggacccguacugauuugaucugaccuagcuuuggcuuauauuguuguguuuggccacaacauaggcuguccccauauuuaaaugucaguguacuaauaacauuucaaaagcaaauaaaaucuuuuuguuacugcauaacccucuuuuuuuuuuuuguuuuuguuuuaaaaaucccuucacugauuucuuugauuucuaaauguaacaaggagcuguuaauaguuuuaaaaaauuguaauuagaaucuggggucuuuauccacuauccacugguagcuuauaacuuauuuuuacuguacuguaaaaagaaaaaagaaaaguugcaguucagguuuuaauaguuccuugauuucugucaaauagguaugcauaagaugacaccaccaauuaaagaucuccugccuagacucacccccauuuuaaagaacagacaugaaaaaguacaagagaauuguauugaucuuguuggacgcauugcugacagguaaacagauuacauagcaacaauucucguuuguauuuuaguucaaguauaggcaguauuucuuuuuagauuaagcaagauuucacuuugagugguaauaggaaauagugguauaguguuuuguuuugugugggugucuuccucucccccucacccuggcacccugcacgggguuuuucuguaucucuggcuguccuggaacucacucuguagaccaggcugucuuuaaacagagagccaccugccucugccucccuccugagugcugugauuaaaugugccaccacugccugacuuagcaguauaauuuuuuaaaauauuuauuuauuuauuauauguaaguacacuguagcugucuucagacacuccagaagagggcgucagaucucauuacggaugguugugagccaccaugugguugcugggauuugaacucaggaccuucagaagagcagucggugcucuuaaccacugagacaucucaccagcccccgcaguauaauuuuaaaaccaagucaggcuugcuuucuuucuuuuuguuauuuucuuuucuuuugagacaaggucugacgguauccuuggauggccaggaauucacuguacagaccagguuggcuuugaauuuaaaucagggauuaaagcugcacagcaucacuuaacaagucaggcuuuuuaaaagggugauaauaguuuucauuuaauauuuaagauggauuaauaacgauuucagaauugaauaugcacauucacucucuaaaugcucauuagaguaguagaacccuuauuuggcauucaugggcccugggcuucauccccaacacuacaaaaacaaagcaaaacaaaacaucaaaaugcauuaacaaaauguuaauucauuuaauugcauuuuuuuuuuuuaauuuaggggagcugaauauguaucugcaagagaauggaugaggauuugcuuugagcuuuuagagcucuuaaaagcucacaaaaaagcuauucgaagagcuaccgucaauacauuugguuauaucgcaaaggcuauugggugaguagguuauaauaaacccauuguguuggaaaguacuuucauguagacauaucuuuggaggcauaguauaguuaaucauuugaagaaaaagcauuuuauuuaaccagugaccuuaagaauauuuucuuauauuuuuguuuaacucagaaggcuuuaaaauuuucccuagcaaaguauagguauuuuuagaggcacauucaaguuuuuguugguccuauuuuagaauauugcuuuuuuuuguuuguuuuuugagaugggagucuauccaugcauucuuggcuguccuggaacuugguauguaaccaggcuggccucaaacucauagaucugccuauuucugccuucccagugcugagaucaaaaacauauuaagaacauguaccauuaugccuggcuggaauauugcuuaaaacauuaaggaaugaguauucuacagucuuuuacucuccucacauugucagauugugggccuugguuuuaauugcucuuaacaaaaugaagcuucucugcggccagaaaggugacucagcaggaaagagcccugcccauuguugcagaggagccagguuugaucucggccuccacuuggcucacacaaccuaugacuauaaacuccagugccaggggaucugauccccggugcagacagugaacacaugcagacaacacucauacguacaaaaauaagugaagguucucaaccucugauaaggucgagaagugcacugauuuauggguauaaagaggaaaaaguuagggugcaguuuaucauguccauuaaacauaauagugggcaauuacauuauaccccuuauucucaagauuuggugaucauuuuggaagaggggauguaaagauuguaaaagucagagguaguaggcaucugcagcagaagaacacuguuuggacacgacauugcaauugcacacaugaacucacaucagucaugacugcaaggacgagaucaagucagccaaacuagcugcaugggugggagagggauucuugaagucucacucuaucuggguagcuauuggcaauuggugacuucuccagagauucaguuuuaagagauguggccccugaaagucuguacauacuucaguaaacgucuacacccacgcacauacuacuagcacuaucuggacuuaguggguuuaauuucuuuuuaaagauuuauuuauuuuauguuuguugaauguuuugcaugcauauauaugcauguguguacaccugugcauaccugcugccauuggcgcucagaagaagguguuggaugcccuagaacuaaagguauggaugguugugagccaucaagugaaugguggagucaaaccugggcccucuggaaaagcagcuagugcucuuuacuacugagcagacuuaacucgguggauuuaauaaaaacaacauaaaguuggggaggaugauggaggaagggagagagaggagacacauuagaaaggagagaaggagggauggauuugaucaaacuacauuuaugugcauguauaacauucuuaacauuaggauuuuuuuuuauuaaacguacuuaaucuuuuuuguuguuucuaauuuuuauguauauaaaugcuuuggcugcauauauguuuguaugccacuugugugccuguacccuuaggaaccagaagaaaguauuagaucuauuggaauuuggaauuagagaugguugauaauugccaugugggugcugaaaaucauacccagggccucuggaagagcugcugcaugcucuuauucucugaucuaugcauccagcccuucuuuuuuuuuucuuaauuuuuuuuucuuguuuuuuauguucauuguaacaggugccacacauuugccauguggguacugguaauugaauauuuguauauaauuuguaucuuuuuuuguuuguuuauuuuucaggacagggugucucuguauagcccuggcuguucuggaacucacucuguagaccaggcuggccuugaacucagaaauccaccugccucugccucccaagugcugggauuaaagacaugugccaccacuacccggcuuauaauucauaucuuauauuccgugguuuaaaaacugcauuguuccaagaacgauucacauucucauuugcuuuaugaauucauuugugguuauuugcuucuucaucagaacuaggccgagaaaagcaguuaagguagaaaaugagacuaucaguguguguuuuccaauguucuaauuagcuucagcuggaagcuggacacagcccagagucaccuuagggagacaaggaauugcacagaucagaugggccugugaccaugugugugagacguugccuugauaauugauucuuguggauaguacauggucuugggcuauauaggaaagcaaguugagcgugagccaguaagcaacaugccugcaugauuugugcuucaauuucuguuuggcucucugcccugacuucaacccucagugauagacuaugaccuggauauagaagcuaaaaugugggcugaagagauggcucagugguuaagaacacugucugcucuuaauagagguucugaguucauccucagcaaccaaauggugauucacaaccaucuguaaugggaucugaugcccuuuuuuggcacacagguguacaugcagauagagcacuuauucauuauuugaauuuaaauaaauuaagucucuuuuuaaaaaaagaagcugaaauaaacacuucuuucccacauuucuucuggcuagauuauuuuuaucacagaagcaaaaaggaaacuagaauggaaauaauuuccaaaaacaugcaaaagucugaugaguuagguagcauucccuucaggauagguaaacaucccuuuucauuucucaggaguagaauagaacuguuucagugguggugugauuuccaaaaaaugcugcaaauagauacagugcaaaauugauuagcccuauugucucuaacuguuagcaaaggaguauguaaaagcuggguguggggcagccagagcuagguagggugacccugcuuaaggaaaccaugggagugggcuaauggggaagaugaggaacagauuguauaugcuaguaguccagaguuuugggauaguuuuacauuuauaaggcugcauggcucuugaggccauuuagaccagucaaauuccuuuauauuucaaaaaauuuaaagaguaaaaagagucuaccugaauuaacauuaagaugaaucuauuugugugaagcuuuuuucccuguuuuccuguuuuguuguuguugauguuuuuuucuuuauuuacauuccagucauuguccccguaguuccucaucccacuccucuuuccccuugccucuaagacggugcucuccuccugcccccuaaauaggcaucccccuugccuggagccucaagucucuugaggauuaggcccaucuucucaccgagggcagaccucugcuauauacgugccaaguggggccuccgaccagcuaguguaugcugucugguugguggcucagucucuuguagcucccagggauugagacugcuggucuuccuauggggucgcccuccccugaagcuuuuuuuuuuuuaaaccuuuuuuccucuuuagccuuuuuuauuuuuggaaguuguaaugacauccuuuagugauaagaaaguaguguguuuuauccauucgcuugcagguuuuguagucucugagagcaaauuuccuaaguaugauaacaugcugauguguuucuucuuucuuuuuagcccucaugauguauuggcuacacuuuuaaacaaccucaaaguucaggaaaggcagaacaggguuuguacgacuguagccauagccauuguugcugaaacaugcucccccuucacaguacugccugccuuaaugaaugaauacagaguuccugaacuuaaugugcaaaauggaguguuaaaaucacucuccuucuuguuugaguauaucggcgaaauggggaaagacuacaucuaugcugugacgccuuuacuugaggaugcguuaauggacaggcaagugacuaaaggaaaugcagaaaaauuauggacaauuaugcgucaguguagaguuuacuaagauuacuuuaaauguuguauuguuaaagaagaaauauuacugugauuauuucacauaaguauaauuucuuaccuuauauuuguuauaguuagguacccagguuuucucucccagguucccuauucuuguuaaucuuuucguauguguuaagcuaaguagauuuugaaauacaauaauggauuuacuguuuuuuaaaacaauuagggaaaaaaaggugaacaugaauuaguauggcagagaagccaauaguuuuguuuuugagacagggucucaggucacccaggguggcuuugaacuuacuauguagcugaacaugaccuuagacuucauuucucaucccucuaccuccagaguuucaggacuguagacagguaccacuaaaugccuggauuuaguuagcacuguguguaacuccagggcuccauacauacauguuaagccaguguucuacaaacgaucuuuauucucagcacaucugagguuuuuuaaucuuaaccuuauauugaagaugaagauagcuugccagagucauagucuuuccucugcagcccucccuccaguguucagauguuagcuauuauuaguuuaauacuacuuuuguguuaccugauagucuuacauuuuaucucuagauugagguccagaaauuaauuguaccuaccaagauuacaaaggaaguauaaguaguuucagugcugcuuaaguuuuuagcugguugcuuuaguguacagcuuaaaguguuaccuaaacuagccacaauguagccuguaaucucaacuacuguggaagcugaugcugggggauugaaacuuuccacgccaaccugugcaccugcccugucucacaacaacauuuugagaguuaggugggggguuguaauucagugguaaagcacauuucugucaugcaagaagcccauauauagauucagucccugguauagccaguuacucagggaccuucauaaaggucauuuuauaaacagauuuagugagguacuaggaagugcagauguaaguuauggagucagucugaaaaggcuaccuuucugggaccaaacaaaauagcaguaaaucaccuugcuucucccuuagacugcuucuuagugaggaauuccugaacauuacaacuguugagaggugggacuugagguuaaaaguuuuguucugaauggauggaauuuugugaaaagaaaacaugacuugucucuucacauacugacuacaaauaaaagugauaguagaauugaaaauuuggcaaacuuucuguugugggggcuguuauucauaagaaaaaaaagguucuugaauauuauacugcaaaauauauuugaaucucauauacucaguuaauauaucaaauuuauuuauagaaaauuuagacuccugucaaaucuuuuuguaauuuucauguaaauuuaaucaccagaauaauuuucuauucauucuuuauugagaucucaacuguuuuagaaagguuuucaaguucauaauauuuugaaguucauaaaauuuugaaguucauaauauuuguugcuucuauauuuauuuuaaaaauacugugcuuuagagauuguuuucaauucuaaagaaauuuuuagaaagugugcaaguugagguaguaacuugaaaauuacuaaaaagaauacuucuucagcugugaaacauugaaacuuuaucauuaaauaaguuagauagcaaauuauaguguucagauuuuuuuccuaaugccuuugagggguuguuaauauuuuggcagaaaguaugaacacuauuuugguugcacucaguauaugaauaauagauugauauguccuggauacaaauucagaugcugcuagagauaaaaauucuuauuugugcagguuuaaaaaccuaguagauuuuucucuuaaauugaauuuuugaaugaaaucauaccaguuugagaacaaauuucauuuugacuugugacuuaacuaucaaauauuuaagguuacagaauuuaaaaugagauugacuccugagaguaauuaguuccgcauguacaagugaauauaaaaaugggacugauuuaaagagacuuuucccuuccauuauuacagggaccuuguucacagacagacagcgagugcaguggugcagcacaugucacuugguguuuacggauuuggcugugaggauucucugaaucacuuacugaacuauguguggccuaauguguuugagacaucuccccauguaauccaggcaguuaugggagcucuggagggccugaggguugcuauuggaccaugcagaauguugcaguauugcuuacagguagguuaaauguggguuuuuacuuuuuuuuuauuaaaugcggggauugcucaaaaaauuacuuaaauauguugaagucagucauucccuaauuaccauguggaagacaguucuguauugagauacagauuagauuaaauuagguuagauuuuguauuuacccaccacaauuuuguuacucaguuuccagacuuuuuuuccuucccucuucaaaguaaguacuuuuguuuuauuuuauuuuuugagccuuggcuggccuggaacuuacuauguagaccaggccagcauugaaguagauagauccacuugcuucuguuucuaagugcuaggauuuaaaugugugugccaccaugcaucauauuuauagcuaauaguguauuaaaguuuguuuauuuauuuauuuuccccuugaagauagaaguaacucuaccuuuuauuuauucuagggucuguuccacccagcucggaaagucagagacguauauuggaaaauuuacaacuccaucuacauuggcucccaggaugcucucauagcacauuacccacgaaucuacaaugacgauaagaacaccuauauucguuacgaacuugacuauaucuuguaacuuugugucuaauacagcuguuucacaccuuaaaccugcuucaaucugaugauauaaacuuguaaaacauugccgaucaguguagagcuggucauaguggagggauagaaauccaguagcaugauuuuuaaauaacuuuuguuuuuuugauguuaaacaguaaauggcaguagugaccaaggacagugcuuauacacacuauacuggagggauaucauuuuuuauucaucuuuaugaagauuuagaauucauuccuuguguuuaaagggaauguuuaauugagaaauaaacauucguguacaaaaugcuaauuuguguguguuuuuugaauaugacuuguaaaaugcaaaacuuugguaaaguacugguuuguguagaauaaguggauuaauuucaucuuuugucaccuaguuuauuauggaacacagcagcacgcaaacuauauagugauggccuguuugucaaaagcccauuguuuuguugguaaugaagaguagcuuggggugccccuccccucaguguagcauaacaguuccagcaccauagaaaaguagcacucugacugagcugucuuaaguauuauuuuguacuuacauagcaccuuucaccuugauuucucaaaaugcuuuaugagcagacaugaaggauauauuuuacuucuuguccaacuuuggccugugcuuauaaaguggagaagcugucuguaacuuagaauaguguauuuccuguugggagugaggcuaucuaagaaauaauuauauaguaggacagucuuugggcuuuugugugaugccucuaaucaguuuauuuauaagcagcuauugaacaccuguugaaugcuagccacugucuguugaagaaggggcuucgaaggugcacaugauccggccuuucauguaacggaagggugggcgcagauccuuagguaccagggugcugugcaauggaagaugcagagaugccuagauuugcuuagcuuguauguagcagucagauacuguauuggcuuaagugugagcauaagccaaaaugccguucaguuuaugaagaacaagcauuaaggggcuauuuuaauguuuugggucaacuaaugaaucagcuuuuuuuuguuguuguuuauuguuuuuuaauuuuaugccccaaauuucuuguuuuuaaaacuuuucuagccaucacuguuuugucucccucuguacuuguguggacucuaaaaggaaauaaauucugccaucagugugacuggcaugugacucuaccacccucagacugucaggagugcuaggcagcuugugcuucugacuguuaacaaggaagacucugguggaagaucagauuagauuagagacagcuucugcucugcuuucucagaauggauacugagcauuaaccguccccaugcaggacgcacggauucuuguucuuuguauguggucugacuaucauuguguaguaaaccauuucccuguucuuagaaaauuccuagccauaccuaagcacuuuuaaauguuuuguauaguugauuucaaauaacccuugguaauuacaaucuugaauugaguauauuucucaaaguuaaaauuugacuuuaaaccacuugggaacauuuuauuguauuauuaauuaaaauacuuaaguuuguuuaacuucuugcuuuuuauuuaaaaauuaaauuuugcaguagaacuacagcucacaggagacugcuuaccccuuaagugacauuuuccugauggagguaaucugagaauggauaaggggaaaaaaugcugaaggcugcaaucucaagauuaggaccaaaauagauacucaaagauguuuggauugugaaaugcucuuauugaauaaggaaagcauuuugggauaaacccuugugaaagaugcuaugucacguuuuaacacuucucaacuaagaccuuuucuuuagcacuuugauguuucuuaaggugaaacuuaggcaggaggaauucauguucuuaaggggacagagggguggguuuuucucugggcuuugguuuuuuuuuucucugggcauugcccucugauggaauugauauuucuuuggcuguuugauuuuauuuuuuuuuauauuguauuuuuaauauuuguuguauggugcccugugagcaucaaguaccaccagauaaauaaaacuuaucacaucuaaagucauaguau

SEQ ID NO: 163 - RNA, 1796 nt, Mus musculus
uaaaggacaacauuuaauugaggcugauuucagagguucuguccauuaucacggcacgaagcaugacaguguacagucaaacauguccuggagaagccaagaguucuacaucuugacucagaagcaggugggaagagaugcccuuuuccaggcagccaggaggagggucucuucugcucuggccaaagcuuaagcuuuggaccucaaagcucacuccuacagugacucaccuccuccaacaagcccaaaccuacuccaacaaugcuacacuuccuaauaguaccacuucccaugggcuaagcauauucaaaccaccacauacaagucacauaauuacccgauaaugcaguacacauuaguucuaucuucccuuuuggaauaugagcuaugugaggagacagacucauucacaccuccaacaucuaguaagucuuucaaaauauauuauugccuauguuuaaccaacaaucucauuuauuccucaagcucugcuaaccaaaugcagcaggcaggauggccuacuggguagaacuugcugugcaagucugaugacucaaauugaaucuccaggaacccacauaaagauggaaggugaagaggugacuucacaaaugugccgucugacuuucauaagccaaacacacaucacacacguacauucauauaguaauaaaauauaauucuauuuuuuaaaaaacuguauuagagucagugagauggcuaaucauuuaaaaaaaaacaaucgcuaugcaagccuguuaagugaguucuuauuccuuagacccacaugggaagacucugaccuucacauaugcguuuguuacgugugccccucccuuauauguaagucaggaccucauccaaucccugaauguggcaagcaaaauuguugcuuuguauagaaugagaaaaaccuggaucauaaaggcaacacuacaccauaucuuggccacguaugaagaaggcagcuagaacugacaggucacugggccuguucggggcgguaugacccgaaguugcucucugaacaacaccucagggucagcacagcagguaccguuugagaucgucaauacacaguaaaaucugccaggcucggcagcaggagcgaaaacacgcugggccagcgcuggguggggugggugugggaggcaguuacauaauuagccagcuccugggcuuuccucccccggcagggcggcccucacgagccgagccucgagacucgaccccaaauagcuccaggaaaaaacccggaccguaggugaacccaggaguucgucacgaagauuacauaaguggcagacuccuggcaggagcagagcgugucccggagauccgcgccccgauuggcugucccgaggcggcacuggacacgugcgucagccuagcgucagcguggcgucaugggguugggagggacuuagugggaagaggcguguccagcugcucagagggcucccggauuggcugagaggcgcaggagccgucccuccaggccggccugagggcggcgccucguuccgggugcccgcguuggcuaccggcuucacaaagaugaucauggcagcucggaccagucagagggcccuggcgaggguggcaucggggugccauccgaagucgaccaccgugacggaagccccggcgcgggggucugcgcgcgacgucagguagcgagcggagguuuuccgggcggcggguucgggacgggccuguggccggggcgcugacccuagucggcuccggagacccggggcgcggcgcucggccggcuggucugcgugcaccucaua

SEQ ID NO: 164 - RNA, 10414 nt, Mus musculus
cagaaacuuuaaacaaaauuuuauuacacaaagguugucacauaauuggauacuucucuacuuuguacacaaucauucccacccuccacagaaaggcugcuucugaacucucauguggugacacagcgcuacaguccugaugcucacagaacaguagagaugccucagugauuuaaguugaaagcaggacacugguauauggcucuugcacccagcaucaggaauguacaaaugucuuuauucaaaaauacaaaauaaauuaucuguaggcauggacaaugacagcaguaaaccauuauauaucgucaaaggaaaccaguaacugaugauuacaguggucagccagccuucucuucagucauuuucuccaggugacuucucugaaguuauuggugaggaaccugccuugagcuuccugucacaguucauugauaagggcaaagcacuacucuaggaguuagaacaugccgccucccauacccccucccaugccacccauugcacccauuccaggguccuucucuucuuuaggaauuucugucacuacagcuucggcuguaguuagcaaggaggccaccccagcagcauccaguaaggcaguucucacaaccuagaaaaaauuuuaguaaaauaauuuaugaauaaaaaccaugcagagagcaagacauccaguguguaugaaaugcugaaucacuuaccuuuguuggaucaaugaucccuuuuuccaccauguucacaaaaucuccaagcauggcgucauaaccaacuucugaggaacucugcagaauuuucucaacuaucaaagauccuucaacaccugcauucuuagcaaucgucauugcaggaauuuuaagugcucuuuuaauaauuucuauaccuauaaaacaaacacauuuuuacaaauuugcuuugucuucucuuucuggggagccagaggacuuaguuuaauccuuagcaccaauguaacuccagguccaggcuaccuaaugcucccuucuggcccagagaauacuguaaaugcauagcacacaagacaugaaggcaaaaugcaccccccaacacacacaaaauaauuaaaaagaaaacaagaguuuaguaaaugagaagacuuauccaauccuaccauaggugaaauaauucccccuguaaaauguguuacauugcuaaucaacaauacuuuucaauaagaaugaggccacaaacucauuugaaagaugaucuuuaccuauuuucuggucuucauuagcaggcuuuaaugaauccaaggcugggaugcaccgaagcagagcgcagcccccuccuagaacaaugccuucuucaacagcugcucuuguagcauugagagcaucaguaacucugucuuuuuucucauucacuucaacaucacuuguuccuccaaccuagagauuaagaaauuccaguuagcaugaccuuucccauucaaugaccaccuaaagccaccuagaaugcagacauaagcuggguacagcaucauguaagucaugaccccugcaguugagaggcuaaagcagguggguuacaccaacugaggccagcuagggcuacagcagaguucaaaacaaaagcaacaacaaaagaagcaacucuagaauaacauauauauuauaaugugucccacugacaaaauccugaaccuccccacacaagcuguacugcugugugagaaaaggauacuagccaaacagcagugcacaugccuuaaaucccagcacuugggaggcaaaggcagauggauuuucaguucaaggauagccuggucuacuaauugaguucuaggacugaaaauccugucuauagagugaacagaaugaguuccaggacagucaggguuacacagagaaaaaggaaagagaaaagagcgagacugggaaauuggguagggguagacugcacaacacagcacaagaacgguuucauacucaugcauaauaccaguaggggauagaugccuauuuauggcucagaaggcauugggauauaacccaaaugggccaaaggucuugcuugcccugcaagccaauggccugaguauuccuggaaucacaguggaaagguagaugaccaacugcugguaguugcccccgauugcuacauguacucuauggaaaguuuggucauaugcacacucaaaaaacaaaacaaacuaaaaauucugggaaaggagauauucauuuaguuacuauugguaaauaccacagaaccaguaucacgauacucagccuaaaauguuuaccggcaagucagucuuaccuucaacacagcuacuccaucugaaaguuuagcaagucgcucguucagcuuuucuuuuucauauucacuaguugugaugucuagcugcucagugauuucuugaauacguuuuucaaugugagcuuugucaccuuuuccuuucaaaagcauggcaucaucuuuggugacaaugaccuccccaacuuuuccuaagucaugagcuugaacaucuucaagauuuagauucaaccccucuucuccaaacaccuauaaaagcagugugcuauuaguggcuuccauuauaccaggcuuauuacuauaugucacagauauuuuguaagaagaaacagcuuuucagggcuagcaagaugucucagcagucaagagcacuggaaggcuauucugcucuuccagguguccugaguucaaguugcaacauggcagcuugcaacugucuauaaacugcaguccuaugggacuggauggacgccuucugguaugcauacaccauacaaacaggcagacaaaacauccauauacauaaagcuuaaaauauccagaaaaagaaaugcuguuuuucuuugagaugucaagaccacugguauaccagaacaaaaucacuuaaaguuuugagaagaauguuuaacuauguccauucucacgccaggcucagcaaguuagaaacaugaccuuaauccaauaccuguguaccaagcaaaaaaauagcaagccaggcgugguggcgcacgccuuuaaucccagcacucgggaggcagaggcagguggauuucugaguucuuggccagccuggucuacaaagugaguuccaggacagccagggcuauacagagaaacccugucuccaaaaacccaaauaaauaaauaaauaaauuacuuagcaacaguccuaucuauuuaugaaguauacauuguauuugcagccuggaagcauagacaucacuaagcaaagcaguaugacaagauuuacuuacugcaccaccaguagcaauagccauaucuuuaagcugguucuuccuauuguccccaaauccuggagcuuugacugccacaaccugaagaccaacuuuuagccuguaaagaacauuuaacuguguaagauguaaacugaagggggaguugggagaaagcaucuaauuuaguuccugguaaguucuaguacuauauacaacuauuaguacuauauaacucuaucccaauccuacucuuuucccacaacuccuggucugaaaaaagacaagauggggaccucuacucaucaaaucuuguuccaagcagauccccuucuuaaacaaaugcugcccuuauauugcagacacaguugugagucaguacuaaccauaccaguguuaaaagacacguauaguucucucugggaggcugugggaagcagcggcucagggauuaugcacauuugagaccgcuuuaagauggacucauaaugcauagagcacuauaucauacacuacaccucuaagacacacaagcaaaacagggaauuaauuuuaaaaagcaacagcauucaccuucuaccuaaaaacauaacaacccaaucuauuaccuguucaaaaccagcgugcuuagagcuucuccgucaacgucuucggcgauuaugaccaauggcuuccgaugagcauuagcaauuucaagagcagggacaauggacugaacacuggaaauuuucuuuucacucaacaagacauaggcaucuuggaauucacacuuuugaccuguaaauacagagagcaguaaaaccaaauucuaacaguacugagaaaauuaacaauuuacuuccacaaugagaccaguaacucaugaucuuuucuucauuuacugaaucauuaauguuuugaaauaucacaauuuuuauuguaccacccacauccacugccuacagcugacaguaaguuuauagcuuaaaguauaguguaaagauuucaucucuggaccagcucuuaccuuuugauguguuaauaaaauacggggaaauauauccucuaucaaacuucaugccuucaauaauuucuagcucaucauucaggguuuuuccauccuacaaagucaaagaauuagaggccaguuaaaccuaaagauggcucagggguuaagaacacuugcuguucuucucuuuaagauaugcuuauuuuauguauuuuauguacucuaucuccauguacaccugugugccagaagagggcaccaaaucccauuauagauggucauaaaccagcaugugggugcuggggauugaacucugagccauucaacuuuccagccccauuugcuuuucuugaauagaaccggguuagguucucacaccuacauaauggcucucaaccuccagggauucugcuguuucuucuggguuccaaggccccaguacacauauggugcacauacauacacaugugugcagacaaacacucauacauagaaaauaaaaaucuuuuaaaacaaacacaagccuauuuuggacuaucuacaaaguuaagacccugucucauaaacaugagcaaacccaacacuugaaauuauauaccuaacuagcaagagauggcauaggcauuaagggguucaacauggaaaugcugcacagcaccuuuaacuacacucccaccaaaaucucaagacacacacuaaagcugagcacaggagcacaugccuuuaguccccaugagaugauagagggaucccucuaagguugaagcuuaagaguuccaggccagccaggauuacagagugaagcaccagccuauuuacagcuagcggagagcuaauaaguuagaugaauucauuguuaagaggcaaagcucccgauucagacuaauggugagcacauacuacagauguuaagacagaggaaugaauugugugggcacaaacaagagauucaaguuuuuuauuuggaaaacaggugacagauaccccauugaagguacuaucaaaacguaucaaaucccauacuugccuucacugugaugacacccuuucuuccaaccuuuuucauugcaucagaaaugauguucccaaugucuuugucuccauuugcagaaauuguagcaaccugaaauaaccaaguuacuucaaaauuaaauacugauuaguauuuucaacuuugacacucuauacuaguacuuuacaguuaauaguaauuuuaaugaaguccugguuaaauggagacacacccucaguccuuccauuaucugacaaaguaagaauaaauaaacuaaaggggcuggagagauggcucagugguuaagaugacuugcuguuguucaggucaguacccagcauccacacaguggcuggcaacugucucuaacaucuccuucuacggguucaggcaugcauauggugcacacacaaaaaaauacuugucugcuaugcuucaagggcuagguuugaacccacgcagcacagaguacacugauaucacuaagaauaucugcacaauaacacaaaucuuacuuacagccacauacaacuacaacaacaagccaccuauuaagauccaaauuaguaggcauggcagugaugagccaaacacucuggaggcagaggcagaggcaggggaauuugaguucaaggccaaccuggucuauagguugaauuaguaaaauucuuaccugagcaauuucuucagggguugucacagguuuagacuguuucuuaaguucagcaauuacagcauccacagccaacaucacaccuaguucaagaauguauguuacuaacaaugcuuaucaagguccccaaguauaaacuuacagacucuuuuaacauuuacauguaaccucgugccagcacucuccuaacuguaccaaacaacacaguaugcacucaaucaaucucagaauuucauaauuaaguugaaaaccaacaacauuuugaaaacuugaccuagauguugugugguggcucacaccuguaaucccaguaccugacuaagacuaaagacuaagacagaauggcuaaaaauuugagaccagcauguauuuauacaggacaccaugccagggaaggcuaagaccuacucauucuuggcugcagagauagcuuaaagguuaagaguacagggucuuggucugggugugguagugcccaccuuuaauccuagcacucugaaggcagaagaagcaggcagaucucugaguuugaagcuaacuagccuggucuacagagaacccugaauuuucacuuccauuaauugagacaaguuaaaaaacaagauguggaagauggucuaggggauaaaaguacuugacccacaagccugaaugaagccucaguuccaccuuggaaacccacauaaguaaggaaagggcaauuccaccaagaaugaacacucacaaacucuacaacgaauguaauaaaaaggacaaagauaaagacaacagaauucuuuacaggauaagaucaaugauauacucuuaccucuccggauuuccacuggauuagccccuuugcugaucuucucaaagcccuccuuggcaauagaucgugccagaacaguggcagugguggugccauccccagccucuucguuuguguuauuggcaacguccugaacaaguuuagcuccaauauuuuuguauuuauccuuuaaaucaauugacuuugcaacagugaccccaucuuuuguuacuuugggacuuccccaacucuguucaauaaucacaguucuucccuacagcgacagggaaaaaaaaagcaacccucaaugauaacccucaaauuugucauuuuuaaccauccugcaacaugaaucucaaagccacguuaaucaaccaucuuaggucuauaaaaaaugagcacugaucauuugccaggaguccaacauugaaugaagcacaacaggaauucccugguacuaacagaugccacccauaaaacaagaaagcacagauguuaaucgccaaaucccagaacacucuucacaucauuugcacuugaguuuuggcuaugaccuagguuuauuuuguuuucugagacaggacauuucuguguagccuuuccuguccucaaacucacaaaacacaaagaucugcuugccucugccuccuaaaggcuagcuggaauuagaggcaugcaccacuaccacuacagcccugcuuaugaacuauuuuuaaaacauguuuugcuuuaaaauucauucacuaaauaucagccaguaagauaaugugcuuuucugguucgcucaauaaaaaacuucaaauaugacaccaacaaguauuggcaacuuuuggauuugaaccaaacuucuauugucuugagcuauguaaacaguucuuaaagaugcagguuuugggggggggggugcauguguggaagacuuuugggauagcauuggaaauguaauugaggaaaauacgagaaaaaaaaaaaagaugcagguuuuuuuguuguuuuguuuuucaagacaggauuucuauuguugccaugcuuuccugaaacuuagagaacuaccagccuaagccuccugaguguugggauuaugcagcucuuuagaccaguuuagcauuaauuuaaaaugacugugcaccacauccaaugguguccucaaaguacuauagcucccuauucagccacacaaaugugugaucacaaccucugaucuuagcacugcucugaguucaaggcugacuuggccagcuaugguuagagacccugugaguauaauacugaauuccuacacuugagauguaaguuguucaaggacagccuugccacaagggaguuagaacucagacuaagcuagugagacucucucaaaagcaaaaacuggacaauuuuuuugcaaugugaaaauuguagcaaucacgagguguacaaugaagggacgaauggaagaccacaaagguuuucucccaagggcaagugaaaacagucuggugauauguguugcagaagcugguggauggaucgcucugagucucaggacagucuaggcuaccggagaaaugcugucuuaaaaacaaaacccccaaacaacaaagcccauaaaguaaaguuuguaaagauggcucagcggguaagagcacugacugcucuuccgaaggucccagcaaccuucaaaucccagcaaccacaugguggcucacaaccacccguaaugagaucugacacccucuucuggugugccugaaaacagcuacaguguacuuacauauaauaaauaaaucuugaaaaaaaaagguuuaguuacuuaaaaaaacaaaacaaaaaacacagaaaccaaugauucuaugcuagugcauuuugccuuauguguuggaguauuucagcacaaugagugaacucucacauuacagcuauauacuuugagguauuauuagacuuaaguuguacuuuccccucuauacccucuaacuacugggacgagauccaaaauuuaaugcaagcaugcacaaaaucaugacuauaguuugaaaauccuccuugagauauuacuacucuauuacaucacaauguacaaaagucccccaaaucgccuggagcaguaguaaggacaccauggugguagaaugaccaauagaccuccugacuaaauaacaccucuagaccacuaaguuguaccacaugcaaauuagauuuuucacaaaacuugauaacaaauugcugucuugcagcuacuauauucuuuaacaccauuuaaguauacugguaccuuuggccccauuguaacagcuacagcaucugcuaaaaggucuacaccuugaagcauuaaggcucgagcguccgcaccaaauuuuacaucuuuggcauaggcccgagugagaugaggagccagugcccgggacacuggucucaucuggcgaaggacuguggguagucgaagcauuucuggggaaggaaaaaagaaaaaucacuacaaacuuguccaacggugcuucaaaacaugggaggcuagauuggagcugggcuguccucugcuaaccaccaugccugggcgcugcagauucagggcauaaucugcuagccaacugaucauggaggcugaccccaagccugaccaacagcauaagcacaaagcacagaaaaccacauccccauggccacccacucugcccucucaaguuaaucuuucacugccaaagcggccuugggagcagauccacuccgaaaaguguccaaaggaaaaaaaucaaguuggugcaagcaaggcagguucuaaaugcaauugccuagagaacuacagaaguacucaugacggugcaaaacccucugagugugucgccagguauccacccgaagcuacgguaacacagcagcuagcaaggccggaggaaaagacaguaggucaguccagccucgcggccccacgugucuucccgaccaggagccccgagcaaggucaaagugaacaccggaccgccgcggccaccggggacuaaaggaccccgaccacccucccacagaguccugcagugcgccaggcgcagguggcaccagagggcccaaguugcuuccacccuagcccgcccuugcuccggcgcucggccuggaucgcgugguccccgccacacgugaugaaaccagcguggccccgcugggccuggacaagugagccgagccugcggcgucgcugccagacuucucccccuaguccuccgugcucgguccgcgcugcaagcagccccccgcgagcgccggggcgcccugcacgccgaggccgcguaccugcggggcggcggcaggagagcacgaggcgaggcaggccgucugcggcgagugagggacccagcucugggcgcgcaccgcaaugagcccgaguccccucccuccccgccccgccccgcggccccgcgugugcgcgcgcgcgccccccgcucucucccacgccggggcccugcaaucugcaugcggcgcgcgcggccccgcccuccguaccagagccgccucagcucugcggccucagcccucucccgccgcccuacgcugguuccugggccacgguccguucuagaaccuuccggaaggccccgcgcgucccgugggugaaaggucaaguggcgucauuuccgggaggggggcucguucuuucaccucggcggccggccuggaaaagccuagaaagugcuccccuuuucuuccgccuccggccgcccgcgucggcccccuugcgcggagcccucgccaccaaucg

SEQ ID NO: 165 - RNA, 802 nt, Mus musculus
gaugccuaagggaaagaaggccaaggagaagaagguggcccuggccccugcugucaucacaggaggucaaaaagguguucaauccuuuguuugagaaaaggcccaagaacuuuggcauugggcaggacauccagcccaaaagagaucuaacacgcuucgucaaauggccccgcuacaucaggcuacagcgguaaagagucagccucuauaaguggcucaaaguaucuccugccauuaaccaguucaccgaggcacuggacaggcaaacagcuacucagcugcuuaagcuugcccacaaguacaggccagagacaaagcaagagaaaaagcaaaggcuacuggcccgugcugagaagaaagcuucuggcaaaggugacgucccaacuaagagaccaccuguccucggaacaggagucaauacugucaccaccuugguggagaacaagaagguucagcuggugcugauugcccaugaucuagaccccauccauugagcuggugguuuuccugccugcccugugucgaaagauagaggugcccuacugcaucaucaagggaaaggccaggcuggggcaccugguccacagaaaggcauguaccacuguugccuucacacagguuaacucggaagacaagggugcucuggcuaagcugguggaagcuauuaggaccaauuauaaugaccgauaugacaagauccauugccacuggggaggcaacguccuggguccuaagucuguggcucgcauugccaagcuggaaaaagcaaagacuaaagaacuugccacuaaauuggauuaaa

SEQ ID NO: 166 - RNA, 23671 nt, Mus musculus
ccccgccccccgcgcaagcugccggcccccacauccggguaccgacgccagccgcccagacucuggcacuauggucauggcggaggggacggcagugcugaggcggaacaggccaggcaccaaggcgcagguaucgucccuacggcuuuccugucacagaguuggcggggccgagccggggcucuccugcuggcgggacuccgucuaggagaggccagggcgagcgggugggggccguggccgcgguggcuggccugcgcuuccggagccgcggccccggaggcagccgagccggcgccggccgcccuggaggccugcuagacgcaggaccccgcuguguucgccgaggcccggggcugacgcuugucaccagcggcugcugcugcgcugccugcugugaguggcagcugacggcgcccggguguggggugggccagcuggggaccagggggcuguccccgcgucgggaccgccggcgucgagggcuguaaacacugcccaccucaccgggagcaagcuuggccggugacguaccugccggucggcuccauccaguuggucuagccggaugcagguggcacuaguuugcguuauccuccuguuguuugucuuugccaccacucccuucggcuucccugcagcuguucucugguccagcaaguuuucggcaccagguugugacuuguuacaugucauuccuugcguauauucaugcuaaugcgcguggacaauagucggaaugaacugauuauauacaucaaaauaauaguagggcacuauggggaguaaauuggugcuucuuaggacuugcaaaccagggaugcuucacaguaaaaaagaacagaaaagaacggaaaagaccccccccccaaaaaaaaaaaccacccacguugacauucaaacuugauaggauuaaucagccuuuggaaauggguugagucguugaguagaaguucuaaaaucaaaagagauauguuuaaaauguaauuuuagcaggcuguguucuuguugcugcccagccugcugccucuuaccguguacugaguaaacuuuuucuguuaaaauguaauuuuuagggucaaguggaaaucaaaauacuuaaugcuacugaguuuuagagaguuacuguuuuucuuuucuuucuuuugucuuucuucuuucucucuucucucucuucucucucucucucucucucucucucucaaggguuucccuguguagccuugacuuuccuggaaguagcucuguagacuagguuggccucgaacuccgagauccaccugccucccccauacacacacauccaauuuagagacuugcuauuuauuauggauuuugaagguucucaaagucaggcuacccucgaauuauacuauauaguugaaggugaccuuggacucuguuugccgaaacucugggggcuagacuuacaauacauaccaccauucagggcuuauacaguguuggggaaugacaccuaucaauugagcuacaucucuagcccuagagaauugcuuuugagucaaaaaccauugagucaugagcugucaguuugccuugauuggguuggaaauuuguauacuauguauacuuucuacuauuuaacaacucuucuuucuaaggguucuuguuuucagauaacuauuauugugcauaggcaacauuuuuucuaauuuuuaagugauggcuuccuuuaaaaacaauucuugggauuacauccaggacuuuuccugugguaaauuaagagugcacaauuuauuuuaagcauguacucauggcucagcuauauccuuagaugaaaaauuuuuaacuuugaaaaauuguucagacuaaacacugcaauaugucccuuugcuguguuguuaugaguaagucaugugcagacuuuuucauuuucccacuuuaugacaagguuaaauaaaauguaauagaagagaauuaaaagaaaaaacugcuuuuuaaccaaccuuuucuguuuaucacauaacuuuuuuucacuaaaauaggccuguuccaaaacgcuguauauuguguuacuauguuacacaugaguaguauguggcauagcuccugcugugggguggggagggauugucucauguaucccaggcuggcuagucuggaacggagagggaagggccugagagugacuucucauccuaccuccauuuccugagugccagagucaggcaugugcuguagaacauuuaaaagugagaccagaacauagacacuaguuggguggcuuuuagcaucuauugacugaauuaaaugagcacauguauuugucucuuuguuuauaaauguggccuggaccucacagagccaccugcuucugccucccugggacugugauuauaggcaugugucaucaccaccgggugagugagagcauuaggcuggauuuuacuuuuuuccuaagugucuaaggaaugucauaguuauguggcaaaacauuuaauaacguguugacuuuuccuuuuucuuuuuuucuuugagacacuuugcuuuuuaucuugggcugguguaaaacuuucuguggugucuggauuggccuuggaugcuuggcucccuugccacagcuuccuuacauaucuaucuauaccuguguguauauaucuucuacacuaugcauauuugcucauuugcuuauuuauaaagggucucauguaguacaggcugaccugaagcauauuguauagccaaggauaaccuugaauuccucuuccuccuuccuuugugggccaacacuauugacuuuguuuugagguagggucuuacauauaagccugauuguccucguacccacuguauaguuucuguaagccuugaccucuugauaauccuaccuuagauuccaaaugaagggauucuccuccaccucccaagcgcugggauuauuuauguuguuguuguuguugcuuuugagacugggucuugcuuucuagcucugguuggccugguacuugauuuguagaucaagcugguuucuaacaugaggcuuuuugucucagccucuuguauggggauuagaggauugcacugccacacauggcuuaauauaugcauuauauccaggaauaugcuucuuuccuuucuuaaucuuuuuguuuguuuguuugguuuuuugagacaggauuucuguagccuuggcuuuccuggaucaccugccucuaccuccugaguacuggaauuaaaggcauguaccaccaccaccacgacacagcccauccuuaauuuuuaaaaaacuaaguauuuucuauguaugaguguuuugccugugaaccacaugccugcauaggccugagcaggcuagaagagggcaucagaugcccaggaauuggaauuacagccaauugugagcuacauugugggugauaggaaucuuaccuggguccucugaaagcgcagcuuaaccacugagcuaaucuuccguuguuguuccuccuccuccuccuccuccuccuccuccuccuccuccucuuccuccuccuccuccuccuccuccuccuccuccuccuccuccuccuccuccuccucuuccuccuccucuuccuccuccucuuccuccucucccuccuccucuuccuccuccucccccuccucuuccuccuccuccuccucuuccuccucuuccuccuccuccuccucuuccuccuccuccuccuccucuuccuuccccuccuccuccucuuccuccuccucuuccuccucuuccuccuccuccuccuccuccuccuccuccuccuccucuuccuuccccuccuccuccuccucuuccuccuccucuuccuccucuuccuccuccuccuccuccuccuccuccuccuccuccuccucuuccuccuccuccuccuccuccuccuccuccuggugggaagggaauugaaacaggguuucacacuguagcccugccuagccuggaauucacuuugaagcucaggcuggccuugaguuugaacagugauucuccuacucucuucugggauuauagacaugagcuacccggcuacuuuucauuuucuuaaacuuuaaucaaugagguguuauacacugcauucuuagaaguuuuuuuuccccaaccucaauuaacuuuuguugguugguaaagguuuauaggucauugguuuaauaaucuuccccuuuccugagcucauuuuagcuuagagacauuuguugaagaccaggucuaugccaggauuugugcugcuuuuuaaagauacauaggagccaugcaugccuggacacaggccuguaaucccagcuauguaggagucugagguaggaagauugcaaguucaaggccaguuuguaaaauuuaaugaaaaugaaaaguauaaaacagguuggaaauagagcucaacaguagaucuuuucccuaacauauauaagacccaggucuguguccaguccugaaaaacaaacacacaaaaaaggaagguaugagauauauaagucuugcugaaaaaucaaauagguauucaaaaccagugcaaggugugccacaaaaauauccccuuuuuuaaaaaaauggagcugggcagugguagugcauaccugcagcagcacuuaggagacagaguuccaggccagcuagggcuauacagagaaacccugucuugaaagagaaagggaaauucauuugaauaacauccuucaugcuggggauuaaacccagggcuuuucacaugccugccaguccaucuuaagcagcucugaauaaaaacauuuacagauuuuaauuacaguuguguuugaguaguaccugcaugugugucugcaccauguacauguagugcucacagaggccaaaagagggcacuggguccccugggucuguaguuacagacagugaugagcugccaugugggugcugggaauagaaccuaguucuacuggaagagcagccauugauuuuaaccacugagccaucucagccccgacauaaauauuuuuugauggggucauauuucuauuuagaaauuuaaaauucuauuuguaacuggaauaguaauuuauacuauuuguuuaaaauaguauuacaaaguuauaaauugcucaccaguauugcuagcuagcucuuuaaaacucugauuuguguguguguguguguguguguguuuggagauuuuuuuauuuuucuucagcgcaacuuuuaugaguauuaucuaacaauuguaaacgaaaagugaugaacuuuucuuuccaguuaaacaguccaugaaagauuaaugagaaauguauuugagggauugugguuacaaaaaauuacaauguauauaguucauugauguccauuuaagaagauuuuuuaaucacauuguaaaggcauuucuucuacucuggugugagguuugguucuuuauuaagauuugauguuuauagcagcauuacuguaucuuucauauuacuuuguauguccuuuaaccaugaguuuacuuuuauaggauuucuauaauuggccugaugaaucauuugaugaaauggacaguacacuugcuguucagcagguaauaaaauuuucuuuuauaacucucacaacaaacauuuuauuucuuuggcguaguugaauauucccauguuguguaugagggggcacaaaccagauuccauuggguuaauggaauggccauuuaacaauguauucaaagcucauuuuauuaaguauguuaugaaauuugaauauauaaggaauuaaaaguaauugaaugacaaauuaggauaacuaaauagaaauaaaugcuguaccuuugauagcauuuuugagaucuguaucuuuuuauaauuguaguucauauuauacccucuaugugaaagcagagauguuuuccuuuaguucaucacuacuaucuccugacuccuuccuguacauuggcucccaaggagggcuuccauagcauauuuuguuucaguagaaccuugggagauguuuagacauuuuuguugagaaucacuuucuauauggugguucuuucaaauugaauagaaucaggcaggaguuugaugaaaaaaaaauauucauggcuaauuguuaaaguucaaauuaagggguuaauugugguugcuggccacaagaugaagccagucauauucuaucuuagaguggggagcaguucaugagcauccuacugcuaacuuaaguguuacugauggaaggggaagaguugguaaaugaaaucaaaacauauaaaguucuuaguuaauaagaaaaaaaaaaggaauggcagaaaauaggcuauccaggggcaggauguauugcucgugguagagcacuugucuagugugcuugaggagcuaaguuugagucccuaggacuggaggagaaagaagguaauauugaaaagagaaaaaagaugucuguaaagccacaaaacucauaacaaaagccaaaacaacagcaaaccccagagaaacugguaugaaaucgauuagauuagguauagguuaaguaagguuuuuguuauuuuuuuaggagagugaggaguucauugugcugggaaugaaacccagggccucacacaugcuaagcacguacuugaccacugagcuauuuccagaguuacagcucaccuucuuauagcaucagauuugaaguaaauuuccuauaaccaacagagaacugugggcuuuauuuuuucauuuuauuagucuuugucuauuaauuuccauacuauauuauuuaaaauuaauacaguuauuuucagauauguuuaaacuuagguuaacuuuuauugcuuguuuucaguucucugauuuuuaaaauuuguaauuuauuuuguguauaguguuucagugccuguguguaugacugugcaccagguacaugguguaggagacuguggaggucaaaagaagacacggagccccagaaaaggaguuacaggcucuggucagccaccauguggguacugggagcugaacccaguccucugcaagagcagcaagugcccuuaacuacugagccugcucuccaguaggaugguagugggggguggggaguccuuauuuugagaugagcccuccuauuugccagcuagccucaaacuugaaguaauagccaaggacgaccaauuucccaauccucccaguccuccacuuuccuaguguuggcauuagagguaugcaacacuuuaucugguuuauguggugcuagguuuugaucuugggccggcuucaugcuaggcagguaguuuaucaacaagcuaauacuccuagcccuguuuguucccuuugucuuuuucuucuugcaagucacuuuccccccuuuugacagguuauuugacccuuuuagcauuguuuuugguuuuucgagacaggguuucucuguguagcccuggcuguccuggaacucacuuuguagaccaggcuggccuugaacucagaaauccgucugccucugccucccgagugcugggauuaaagacgugcgccaccaugccccgcuuuagcauuguuuuaauuguaauuuugaguaugccucuguguguguguguguguguguguguguguguguguguguguguguguuuguuuguuaguuuuguuuggugauagcauagauuacugaagucuuagucuaccuauguagaaucaaguguuuuauuauuaguuauuauuacccuuacaugggccccuuuccucacugauuuuacuucuuauucccuuauauauuuguagacauucauugaaacccagucagacagugauauuuucuuugguaggacuaaagagugaauuuaagcacuucuuaaguacuaggcaauuucucuaccauugaacuauguauuuguagccuaauguuucuuuucuuucuuucuuucuuuuuuuuuuuuuuugacaaacuucauuauuuacugucuguauauguuuuccuguguaugaagguacauguuggacauggugcuuguauggaggucagaagacauaguucuccucuuucuaccuuuauguugguuucagagauugaccucaggguauuccacuuguaaagugagcaccuuuucuugaugagcccucucacugacacaauguuucuuuauuuuggcuugaggagacaguuucacucucuagcuugaagucaugacagucugauuuugaccucccaagagcuggaguuaggggcaugaggcaucauacccaccuugagaguuacuguuauuuucucuuacugagacauggucucgcuguguagcucuugauggucuggccucgcuguggaaacuaggcuggccucagacucauagagcuucugucugugccucccaaguucugggauuaaagauuugcaccacccugcccugccuuguaauuucuguuacuucuaauguuuuaaauuuccuuuuauuuuucuuuccuugaacuuuuuagcaguuuuuguuuuagcaugguuuguugucuaggaauucucuuuucuuuugcuugcuuguuuucuuuuuggugcuagugugaguccagaaccuugcaauacuagcaaccacuguggucucugccuuuaguuuucuuuaauuugaaaauaucuuuaucuucauuuauuuuggaacauagagaauucugguuggcaguucucuuaguacuucuuucauucuuaaaaauugcacuuauuagggggagauauguggguacacauaaagaggacagaggauagcuugaagaugauugguucuuuccuuccaacuuguugaucucagggaucaaacucaaguugucaugugccugagccaucuuucugucucucuuccauguuuuuugaugagaaagaaguggcuaguugauuucuguuggucuuuuuuccuuuagucuuucuauuagucagcauugcuacaaugaaauacuauagaguuuagacaaauaaccugucucaaggcacaguucuggacgucucguuuuauuuuauuuuauuuuuuucuugagacaggguuucucuguguagcccugacuguccuggaacuugcucuguaaaccaugcuguccucaaacucacagagauccaccugccucugccuccugagugcugggaucaaaggugugcaauacccaaacccagggguucuggauggagguuuccguuugagauuggaugacccuaaugcuuugggccucaaagaaggaguuagauggcaaucacgagcucuuacuuacccucagguucuuagggauacuguuucuacuuaaacccgaagagaacucggccucacaucuaagaugugcuucuuucacuccugagccaaaacuggaaagugccguacaacagacacuugucugugacccuguuguagguuggaaccacuguuacagaccuauuucagcauccuaguagucacuuuugaguucagucuuugucaguuuggggaagggguuaauaagcaaacacggccaguucauugacaucugucccuucugcucuuuauguuucugagaccucagauuuuuggugcuauguuuuuuuucuauuuuaauauauauucuuagaccucuacuucucuuccaccccuuaucccacccuaaugccuucuaacccccuaacacuagguaggagaggaaggugagaggggaaauggggcaaacaccucuauagguuuugcugauuagggguguugaguuucuuggggucaguccagccuucauugucaggaucucuccaacuucuuuugguuaaaccacaacagcagccaccuccuccuuugucuuauucuucugaacaccucugacuccucucagggcucuggcauuuauacccuccccaggaucccuagaauuuaacuaucugcagcuggcaaagaucaugccccuccuagugcacagggcaaauuguaaucaccuacugagaagcagccucuuaaccacacgggggucuaaauaaaagcguguucauauacuguaacuggguuuuuaaagaaaccaaaauucucacuacauuagauagcagagccaggugcagucaguccagguuaugcuuucauucacagguaaagauugauauguucauuccaucuucucugaaauuggaaaccauaaaauaauuuugugugcaguuauauauaauacuuguaucacauggccccaaauuauuucuaaaaacugccuuagaaaauaguauuaggucauuaugauuaaaacgucaggguuuaaauauaacaaaaagaaugauguuuugccuguugcuuuuuaaugggcaugaucucacuguguagcauuagcugaccucaaauucgcagagaucuuccuuucucugcuucuagagugcuucugcuuccacaucuguuguacaucauugaaggaacucaggacaggaacuuaaucagggcaggaaccuggaggcaggagcugaugucucacuccucauggcuugcucagcuugcuuucuuucuuauagaacccagaaccaccugcccagugcaggcaucacccacaaugcgcuaggccaucaccuaucaauaacuaauuaagaauauaucuuugcuugguuaaagucacaccaagauauuuaauauuauuugugacuauuguuaaggguauuauuuuccuaauuccuuucucaauccauuuauccuuuaaguagaggaaggccaccaauuuguuagaguuaacuuuauaucuagccacuuugcugaaguuuuuuauuagcuguaggaguucucugguaguauuuuuggggucacuuauguauacuaucauauaaucugcaaaacgauauuuugaauucuuccuccccaguuuguauuccuuugaucuccuuuuguugucuaauugcucugguuaggacuuugaguacaauauugaauacguaggggguuuagugggcagccuugucuagucccugauuuuagugggauugcuacaaguuucucuccauuuaguuugauguuggcuacugcuuugcuguauauugcuuuuuacuauguuuagguaugggccuugaauuccugaucuuuccaugauuuaucaucaauggguguuggauuuugucaaauguucuuucagcaucuaauaaaaugaucauguggcuuuuuuuuucuugaguuuguuuauauagugaauuacauuuauggauuuccauauauugaaccauuccugcaucucugggaugaagccuauuuggucaugaugaaugaucguuuugauguguucuuggauucaguuggugagaauuuuauugaguauuuuugcauugauguucauaagggaaauugggcugaaguucucuuucuuuguugggucuuugugugguuagguaucagcguaacuguggcuucauagaacgaauuugguagugcuccuucuauuuuuguuuuuguggaauaguuugagaaguauugguauuaggucuucuuugaaagucugauagaacucugcacuaaaccaucuggaccugggcuuuuuuaguugggagacuuucaaugccugcuucuauuuccuuaggggauaugggacugcuuagauggugucuuagucaggguuucuauuccugcacaaacaucaugaccaagaaucaaguuggggaggaaaggguuuauucggcuuacacuuccauacugcuguucaucaccaaggaagucuggacuggaacucaagcaggucaggaagcaggagcugaugcagaggcuguggagggauguucuuuacuggcuugccuccucuggcuugcucagccugcucuauuauagaaccaagacuaccagcccagagauggcaccacccacaaggcgaccucccucuugaucacuaauugagaaaaugccuauuagcuggaucucauggaggcauuuccucaacugaagcuccuuucucugugauaucuccagcugugucaaguugacacaaaacuagccaguacagaugguuuaucugauccugauuuaacuuugguaccugguaucuguuuagaaauucauccauuucauucagauuuuccauuuuuguugauuauaggcuuuuguaguaggaucugaugauuuuuuugaauuuccucaguuucuguuguuaugucuuccuuuucauuucugauuuuguuaauuuggauauugucucugugcccucuaguuaguuuggcuaaggacuuaucaaagaaccagcucuggguuuuguugauucuuuguauaguugucuuuacaaagauggacaaugacuucucuuuuucuugaauagucagagaccaauauuaauuggcccauuuccaauauuguuauaggggccugaggagaaagaaauaagaaaauggcugaucaguuaaauauucagaacauauaguauuugugaauuuuauuugcuaucuuauaugaccauaauaauucauuacuuaaaauaguaacaccaaaagaucauuaaccacagguuagcauacagauaauuaaauaauaguaauaaaaauguuugaaauaugagacuaugaaagcuggaugcagggcugagauguaaaguguguacauaauguuugagaaaggauaucaauacauugcaggcuugccacauuuauuuguuaaaccacaggacugaaaaguguaauaauguagaguacaauaaaaaugagcuaugaacauacugaacagguuguauguauguauuuaagaacauauaugaguauacauaaauguauguaacaaugaaaaaagcagccaugaaauugaaagagagcaagggggguaugggaggauuuggaaggagaaaaggaacgggggaaauaauguaauuuuauuauaauaucaaaaaguaaaagguaauuuuaaaaauaaguuuuaggcugggcgugguggcgcacgucuuuaaucccagcacuugggaggcagagggcaggcggauuucugaguucgaggccagccucgucuacaaagugaguuccaggacagccagggcuauacagagaaacccugucuugaaaaaccaaaaaaaaaaaaaaaaagaguuuuagauuuaaacaugaauuuuaaacaugaguauauguugaaggagggggagauuuggaaagaauuauuguguggaauuugagaugguucagauuaguugcauauacuuaagagcauuaaaacuuaagaucauuaggaugagcugaaaaaaaaucugaaaaaaauucuaggcaucaugugcucauauuagcaucucaugggaggcugaggugcagugaugacuuaagugcuaggccaggcugggcagcauagugagaacccauucccucacaaguccucacaaugcaagggguuuacauuggaacucaaaucuaguguauuagcacaugccuguaauuucauuacuaagaaggcgaagaguugauguucaaucuagccuugguagugcacgccuucuaucccagcccuugggaggcagaggcagacugaucucugaauugaaugccagccuuggucaccuaauauggccaugaggaaugaggcugguuagagaguccacagcaagacuuaagcuguggcaauuuuauugggcguagucagacuuuuuauaccuuuauuagaaagagaauaugguggcaauugccaggaucuuuacauuuguaguugucgggauacaaugauguuugcaaacuuuacuggguaaaaaugauuaaugucuaaagaccaauuguccugucaagcuucuaugcugcuauaacuucuaagggaacauacagagaaacacagaguaacugaacacuuuacuaccugagggagugcauuggucuuucaggaacugcaaggcacauugugccccaggaccuaaccugaaaaaccuaugacauaugccugucaaggcagcuaagcaaagccaacuccaugguuccuuucacauagcaaauuccagaaccuccagaucuacacagucucaaaaaccaaaaaauauuaaacauacuuagcaugaaauuuaacauccaguauaauuuaauuaaccauaagaacuucuuucuuuauaguauauucaacagaacauaagggcagacugcuccaauauugacaaaauucuugaaccaccugaaggccaagaugaagguguauggaaguaugaacauuuaagguaggucuuuaggaaaucccaggauuguacuaacaguucuaguaauaauacacuaauaauaaguacccucuaaugaaaauuaugacucaaguaaacuuuguauaaagcagaacagggguuuuuugugucuuuuuguguauuuugagacaaguucucauguaguagcccaggccuugaucugucuacuugaucaacuugucuccaccuccuacaagugcuaggauugaagacaaguggugucacagcuggcauggaucuccuacuucagccuccugagugcuagaauuagaauuacaagcguaugaaugauuauuauuaauuccaacagaguuauaaggauccaaaucuccuaauagcccauauugaaccucugugauuaggaaaaggugccccauuugaaaggcucguaaucaugguaggauguguggauuuuagcucuggauugucuuuucauuguguuagcucuguaguagauugacuuaaagcugucaguuuugugcuuuugccagguuauauuugcagcgcugccaaaugagcuaguuggacuguauaagccuaugcuuaucauugccaaucuuuguuaccucuuagucaacaauaacucagaaccacguaaaacauaguuugcugauaugaaguaguggucagugauaggugaucaaaaauagugucauugccaggcggugguggcgcacgccuuuaaucccagcacuugggaggcagacgcagguggauuucugaguucgaggccagccuggucuacaaagugaguuccaggacagccagggcuauacagagaaacccugucucggggaaaaaaaaaaaaaggugucauuuuaguaugaucuaucuuccugucacaguguuauuuuuauagucuuaagcauagaauuacccaggaaaguaaguaaaauccuaaaaaaauaaaaauguauccuuugcuuuuuguuuucuuccauuaaaauauauuuacguaggcugggcaugaugacaaagccagauuucugugaguuuaaggccaaccugccagcagguacuacauagugggaaucuauaucagauaaacaaagugauacauaaaaguaugcuuaaauaaauagugauuuuaauuaauaaguuucauauaagucuuuuuucuuuuugguaaccuguuuuaucuucuaaauauaaggcuuuaauauugcauuuuuggggaaccaaaguguuuuuguuugaugaagaaacacuagugacucuaccuugauagaguggaguacauaccauagguaggguuuuuagagugaacacauucaauagugugacaacuauaaaauacauuuauuuuuauuacagaggauugucuuacaucaaaugucuaccuaaaauugucugacauucauuauaauuuccuuuauuuuuaguauauugaaaacuauugagaaccgggccugccuggcacauugaucuuagaacuugggaagugaaggcaggagcugaagucauccucagcugcauaucuaguuuaagggcugagacuaucucaaaacaauuuuuaagaguaguaaauggauuuuaggcauuguauaagcuuuacaguuuuuaguuuuagaaaaaaugaauauccuggaaauucuaacaaaagucaggaaguuacauuuauacauucaagauguauguauuacauacauucugauauguuuucaucuaugcauguaaacaguagugaaaugaaggacuuaaauuuuguauauuguauguaggauagcuuuugaaacuucuguuauuuauauuuugaugugcugggaagugaaccuaggaccuugugcauacacacuagguucacuagugcucuuacuagucguggucucagcccagacucuguaguugcugcuccuucucuggauauuuuguguggugauggugguggugguuuguguguguguauucccucauggauauguguacaaggaaccaugcgugugcauucaugugugcaugccugccugcauguuuauguguauaugaguuugcgugugcguucaugugugcaugccugccugcguguuuauguguauaugaguuugcgugugcguucaugugugcaugccugccuguguguuuauguguauaugaguuugcgugugcauguuuauguggagaccugaaguugauauugagauucuucuuugauuuauugcuaccuuauuuguuaagacauagucuaccauugaacuagcuugcucagggcauccuccuucucuaccuuuuaaguguuagaauuucacaagggagcuggagagauggcucagccguuaaaggcuaggcucacagccaaaaauauaagaauuucacaagagccaccaugcccaccugguguauuaguccugacuuuuuuuuuuuuuuuuuuuuuuuuuuuuuuuuuuuuuggaggggguuggaguggauuagggacaggaucucucucuauguaacccuagcuguuuugggaacucauuauauagaacagaguggccuugaacccacagagauacaucuguguccugucaccacucaccucaccuggcaugauuuaguguuuguuguagguuuuuguuuuugucucaagacaggauuugucugugugguuagccucaagaaauccacuugccucugccuccugcgugcugggauuaaaggcgugcaccaucauaccugguugguuaaguaugaaaguucuaaucuauaaaaaagguuuagacauuuuuuuauguauguaauuguacauagaaaacaccuacauaauuuuuauauaacuaaaacaucuuucauguuuaaucauacauaucaacaacuuccuauccuucaguugaucauaaucagaagucuuaccacauauacacgguuaaugugaacaccuuuguaacauaacuguauacaguucugaaaacugcauuacaauagauucucaaucaaaaaguacuuguuuuucuagagucuuggugaaauuucuaaguacuauccagaaaaauuaaacagauuuuuauuguauaaaaggauaaccagcuugaccaccuuaaaaaauaaaagaagaaaauacacaaagccuggauaauaaaugugcuuuuugcauuuuuaggcaauucugccuugaacuaaauggacuugcugucaaacuucagguaguauuuucuuuauguuaaagcuguaauucaaaguucucauuuuuaaaaaugauuuuguaugcuuagauuuuuccaguguuuccuauuauccuuuuuauauuuuauauagaaauauuauaacccaaaugaccauuuuuuccauuaucauucuacauauuaaaaaaauaaaauuauuuuuaacagagugaaugccauccagauaccuguacucagaugacagcaacugaacaauggauuuuucuuugugcagcucauaaaacuccaaaagaggugagaauugagagcuuccaguaccugcucauuggcaccauuacuuugggccugaagugaggccaaacaucucagaugggagcauuuagggaagcaagucugcuuacauggcauccaagaaagagagugaagagucaggagcccagugcccucaaagacacugcccauggccugcuuccuccaacucggccucaucucccaaaguuucuaccacuccugagagacuggccagcugggacccacaucuucaggagauaagcccuuggggaacauuccauauccauauaugaacagaaauauuguggaauguaguggguguaguuguacgauauuauacuuaacacugcugaauuuguuuaauaucugugggugugauguaugugcaguuguguguacauguguguacaugcacccguggagaugagagaaguccauaacccuauacucccaugaggccugucuuucagugaaccuggagcuaggcuggcagccagcaagcccuagagauccccuuucuccucccccaccgcccagacugugcuuaaguuccaggugcuucugggcaugucagcguuuauguauauguuugggauuugaucucagcuccucaugauuacacuuagccaccgaucaucuucccagaccuccaaaacugcugaacgcaacaugaggggggggggagagaaugaguuaauaugaaugaauaugagaauucugcaugcaugcauguauguucauacuguggcacaagacagacgucuguagaacaacuacaaccuugugcaagucaugaaucauccagaguuccugcuucuccaguucuccugaggguuagagugggaacccaguguucuuccuguccccaacacuguuuccuuaggguuagcgucggagugaaaguaggaauuagcuaauguaucugcuagaagccugaugauacaacucacagcaacaacagcuuuauuuauugaugggaugcacuucaugaucauucugaggucggaagacacuguuucuucgaguauguuugugucuuuagaauaagauaccugacaugguuaauuguauacuugcuuggauugagaccaggcuuggagaugaauaaaggaugugguacaucagagggcauuuacagauaauuaaaucaugagagcccugacauaauaaaugguuuaauaccucauagauauaaaguuugaacaguguugagagauggagaaaaugggacggcugaauuuguuuagaagcaggaugcuggagauugauggucucugaagggcauuuucucaccuuaccccuuccuguugucgaccugcuuccugucugcugugaguugaugauuccucccuccacagccuucccaccaugguggauuaaaaccucuaaaaagaaaccuuccuucuuuauguggcuucugucaagcguuugguuacugugguaaggaaaacuagaaaauauuaccuaagaaaagagaggccuuuuguuaaugaauuuaauuuucucuuuucuaguguccugccauagauuauacaagacacacacuggauggugcugcaugucuucugaauagcaauaaauauuuucccagcagguaaacaaaaucuuuaaauaugguauucagcuuuuuuuggguuucauuuaaaagauugauguuugaaaauuaaaguuaggguuuugguuauaauuuuuuuuauaacuauauaguugacuuguucagauugaguuugaaauuaaggugugguuaaacaucagaacugucucccuccacucauagacuaguguagucaauggaaucccugcugcuccacgcugcuccuucucuaggccacuucucagcaagcaguagaaucugcuuccccugauaaaacaaaggagcacacuugcuuaagggagacugcuguuuuuccuuauuuuugccuguagcaaaacauuagcauauauuuaauuauacauaauaauggcaucguuaugacaugcguguauauccugcauuuaucauauacacugcguuuugauacuguucacucuguugcucucuuaccucacucaccccuuucaaaacuucccaacaggcccccuucuguuuuccuuguuuucuuccucuuccucccucccucucugcagccccucaucuuuugccgcaguaacuuugauuaggguggcuuagauacauggaugggagcugcuuacaaaagccugugcacugcagccuugauccagaugcugcucggccuuggguauagccaguaccagacuugggaaucgacaagauugcauuguauguuucuaacauuuuguccaaccugugaaucuuuugguuucucuucuuuuuuuaggguuagcauaaaagaaucaucuguagcaaaacuaggaucagugugccguaggauuuauagaauauuuucacaugccuauuuucaucaccggcagauauuugaugaauaugaaguaaguauaugucucagcuugcuuaauauuucugugcuaaagaccaugaccaaaaacagcuuggagagaaaaggguuuauugccacuuacaacucuuagguuacacuccauuacugggaaagucagggcaguaacuuaaggcagaaaauggagcagaagccauggaggacuacuacugcuuaucuugcuucuccuggcuuccucagccugauuucuuuuuguuguuuuguuuuuuuguuuuguuuuguuuuuugagauaaggugucucauaaccuugaccaacauggaacucaguauguagaccagguuggccucaaaaaucuuuuuuuuuuucuuucaguuguuacagaauuucuuucuuucuuuuuuuaaaauuggauauuuucuuuauuuacauuucaaauauccccuuucccaguuucccccagaaacucccuaccccccuuaccccccccccccccccccccgcuucuaugagggugcuccccacccacucccaucucccugcucuggaauuucccuacacuggggcaucaagacuucacaggacuaagggccucuccucccacugaugcccaacaaggccauccucugcuacaugugcggcugcagccaugggucccuucauguguacucuuugguuggugguuuagucccugggagcucugggggagucugguugauugauauuguuguucuuccuauggaguugcaaaccccuucagcuccuucaguccuuucuguagcuccuucauuggggacccuuugcucauuucaaugguugacugggagcauccaccucuguguuugucaggcacugguagagccucucaggagacagcuauaucaggcuccugucagcaggcacuucuuggaauccacaauagugucuggguuugaugacuguauaugggauggauccccaggugggauagucuuuggauggcuuuuucuucagucucugcuccacacuuugucucaguauuuuguucccccuucuaagaaggacaaaagcauugcacacuuuguuuggucuuccuucuucuugcgcuucauguggucugugaauuguaucuuggauauuccgagcuuuugggcuaauacccacuuaucagugaguguauaccauguguguucuuuugugacuggguuaccucacucaggaugauauuuucuaguuccauccguuugccuaaggauuccaugaagucauuguuuuuaauagcugaguaguacauuggccucgaguucuuagaaaucccccugauugagugcugggauuaaaggcucaaccugcuaucuuauacaucccaguaacaucugccuagggauggcacuuuguacaucacucaagaauauaugccaacaggcuuugccuaaagcccaaucuuguggggcauuuucucaauugagauacccucuuucaagaugacccuagcuugugucaagucaacagaaaacuaaccaggacgguaugucaaaaauuaucguaauacauucuugucaagauagcaguaaaguguuuugauauuacuucuaucuagccuauugauuuuggauaguaaauggcuuuuuuuccuuucuuucuacagaaugaaacauuuuuaugucaucgguuuaccaaauuugugaugaaauauaaucugaugucgaaggauaaccugauuguaccaauuuuagaagaggaaguucagaacucaguuucuggggaaagugaagcaugaaggaaucacguagaacaauguacugaucacauaauuaacaaugauguacuguauauauaucauuuuagacacaucaaucauguauccauauuauagcuuauuuguuuaguauagguuuuuguaugcuauguguugccuuuuuaaaugggaaauacauuuuaaguuauucaugagcuguauauucacugguguggcacucaugguuuuuaaaucaguuuaguauuaucuguugauaaugccuguuaauaaaagacuuuacaguuugguaaaugcugcuaaacaaucauuggaccccaguccuuccaaucuauaaacgaaugagcuuguguuucacacaagcaccuaacaaguacuaaagacagcauauuugcuuuguuuucaucccuaaguuuuaauuuaauuuaauuuuagaaaacucaguaguauuccaucuauacuguuaacuuuuccaaaaugagauaaaaguguuuaaaaguucugucuauagcauuugaucugcauaacgauuauguguauguucagaggaacucgaggagcuguuagugauacuuaagcucucuccuacauaaaguguacuccaggccaguguacuuggaaacauugccuguuuugugacaguggauuauuaaguccauggugacagugacaaggcacaaacgugauguuccauggacuugcccccucuuguuucccuuaguccucugggaaguacacuagucaggaaauuuauuuaccgaacuauaguuagugauggcgcuucccuauuuauauuuguauuaauugcuuacaaagcauaccucauacuagcagugauguuacacuacaggaaaacuguacuguacaggaaaacuguacugccuaccuuugauuuuugaaauuguuguaacuacuuagaaaauaguccuuaauauaguuugacuuuuccuuuuaguaauauuaaucuuuucaccuaacccuaggcagcauuaaauagauaugaaaaaagauaguguauuaauuuuauuuucccuccuuaaaagcuuauuauuugaauuauaugcacauguaagacuauuuacaauaauucacagguuaagugguguugauaaguggucauacuuugauuucuuauuucaucgucuuaagaauuuaagugcagccgggcggugguggcgcacgccuuuaaucccagcacuugggaggcagaggcagguggauuucugaguuggaggccagccuggucuacaaagugaguuccaggacagccagggcuacacagagaaacccugucucagaaaaccaaaaaaaaaaaaaaaaaaagaaaagaaaagaaaaaaaaaaaaaagaauuuaagugcagacuuacauaacaugacaugauuaguggaguuucucauuaaacgcugaggucucuaugccacacuguaacaaggcacuaagacagaauagagaccugugcaguugggacagcugaagccaucuuuaccaauuuaacaaaagaaacuucauuuuuauuuaagagcuauuugcgaaugaaauugaaaaaugcauucaucuuguuuguuuuucuaauuauuugaagaaaugauuuguauuguauuauaagacaaguauacacagacaaauugggaaaugacagcacacugagaguguguguagaguugacgccugucagagccugugcugugccaguggucacggucaucacuguaccugagcccacaguuaucuucuaagaaguuauguuugcagugaauagaacauugacugaaauuagguguuuauauuacugucaccaugaaucauugggguuaguaauuuuuaaauaaaccugguaaauauccgagagacuaaccuauacuaaguucauaaauuauaccuaguguagcaauguugcuguucucuaguuggagucucacgguggguuucugucaucugacuguuucucaggggacaguuacgguagugauuggguugugggugugacugaguaauuggaacacuuugugaauauauggcuuaguguuaacaggaaaauaaaguaugguuuucuuuuuauacuuacuccacccucccuguaguauguuugaaauugaucauaaaucugcaaaagcau

SEQ ID NO: 167 - RNA, 489 nt, Mus musculus
aacauguaggauucacauucagccggugguucggggagacguaccuuccaccuuagaccauggccaagcucauccguaacuucgcagagacggcaccaucgaugguggcugcugccgugacuuacucgaagccucgauuggccacauuuuggcacuacgccaagguugagcugguucccucaaccccuggugaaaucccuacagcuauucagagcgugaaaaaaaucauucaaagugcuaaaacugguagcuucaaacaccuuacagugaaggaagcugugcugaaugguuugguggccacugagguguggaugugguuuuauaucggagagaucauaggcaaacguggcauuguuggcuaugagguuugaagaccaaucuuuaacuuccgauuugaguucuuauuugaauguucuuggaccauguguaacgggacugcuaucugaauaaaauacuagguguugaaaaaagaaacauguaggauucaaa

SEQ ID NO: 168 - RNA, 3680 nt, Mus musculus
agucaacgcuugccguucauuggcuuccgcgccggaagcggcgguaccguccagcugcgcacgcgcccuuucccgugcucgggaacaccgccuccagugcuggggccggcugucaccaugcugcggcagugugcucgcuggguguugacgcgcacccgguucggccgcggcugucgccgcuacgguucgugcucgccgagcgcuaguggcgacgccggggaagcgcgggccuacuucaccacaccuaucuucuacgugaacgccgcgccgcacaucgggcaccuguacucggcgcuacuggccgacgcccugugccgccaccgucgucuccgaguucccggcucugcguccacgcgguuuuccaccggcacggaugagcacggccugaagauccagcaggcggcagccaccgccggcuuggccccgaucgagcugugcgaucgagugucugcccaguuuuugcagcuuuuccgggaggcugacaucucuuccacggacuucauccgcaccacggaggcucggcaccgaguagcggugcagcauuucuggggugugcuggaggcccggggucugcuuuacaaagggaucuaugaagggugguauugugccucggaugagugcuucuugccggaggccaagguuacucggcagguggguccguccggggaucccugucccgugucucucgagagcggacauccugucuccuggacgaaggaagaaaauuacauuuucaagcuuucucaguuucgagaaccacuccagcgguggcuuggaaacaauccucaggcaaucacaccggaaccguuccaccaggcaguucuucaguggcuggaggaggagcugcccgacuuguccguuucucgaaggaguagccaucugcacuggggcauaccaguucccggggacgacucgcagaccaucuacguguggcuggaugcccuggucaacuaccucacuguaguuggcuacccagaugcagauuucaagucuugguggccagccaccucucauaucauagguaaggacauucucaaauuucaugcuauuuauuggccugcccuucuccuaggggcaggauugaggccaccacaucgcaucuauguccacucgcacuggacggugaguggccaaaaaauguccaaaagcuugggcaacgugguggaucccaggacuugccuugaucgcuauacuguggauggcuuucgcuacuuucuccuucggcagggcguucccaauugggacugcgauuacuaugaugaaaaggugguuaaauugcuggacuccgagcuggcagaugccuuaggagggcuuuuaaaccggugcacugccuacagaauaaauccuucuggaaccuacccaucuuucugugcugccuguuuccccagugagccaggguuaacggggccgucaguucgugugcaggcagaagacuaugcgcuuguaacugcaguggccacuuuacccaaacugguagcgggcuauuauaaugacuuucagaucuauaaggcucuggaggcgguauccagcuguguucggcaaacuaaugguuucguccaaaggcacgcaccauggaaauugaacugggagagcccugaggaugcucccuggcuggguaccgugcuucacguagccuuggagugcuugcgaguguuuggaacuuugcuucagccuguuacuccaaacuuagcagauaaacugcugucaagacugggagucucuaccacagagagaggccuuggagagcucuacuuccuaccucgauucuauggacacccaugccccuuugaggggagaaaguugggaccugacacugggcuuuuguuuccuagacuggaccaaucuaggacucggcuagugaaagcccacaggaccuaggaacucagcucuuacugacugguaguaaaagaucaaauguauucuuuuugcguuuuuaaguaaagucaugcuuaaagaguauguaucaaaugagcacauaaacuauguccuuaugaacagaacgauucaggucucucuaacccaguccuuuucauuucucagugccauuaaucacuguucuugcucaccaaugucuccaagagaaggauggaagaugcugacacuuccuucucauugcaccuucucccaacccagggucagggcuucugcuccccaggcuaauuuaacacagccccuucuucaacuaaaucuaggguuggaagucccugcucuguuuuuacaugucagcccuacuuuguuaaacagagucuccuguuaaagagguuuuuuuuuuuuugaacuuuaggaacuaguguccuagacuuuuacccaugucaacccagcaguugugcuuuguaauacuacacuccauccaguagauggcucugcucgcacacauugagcuccuugagaguguccuuucagaagacagaauuauuuucagcuguuuaauucacagaauuuuagaauuguacuguucuuaaaggauaacuuuggaaacacugauauuuuuacaacagaaggacacuagaauucuaauuuuaaaacuauuaaagugacauguacaauaggauauaaguaaauaugacagguuuauauuaaaaaacuaaaaagcucuugagguacacuguacuacagauaauaguaacaguuacauguucaucuauaaagcccucaaaaggguuguauucuuuauauuauuucuuauccacauacauaauuuaccucaugauuauuuuuggucaaccaggauacauaauauaggaaagauauaauauuguaauuagugaauuuaugucaaaauaguuuuuguugauuacucucuuugagacaagcuuucacuauguaauuuguuaucaucagucucuugcuuccacuuuucagguguugggauuacaggguaugccaccaugccugccuuuuaacuuauuaaagugugguucuaaguaccuucuuuacagcuguuugguuacacucauugacaguaauguugcagggagaaaaugaucaguguucagaacugucugggauucagggcucucuccaaggcuccagagaagauguuacaguaacaauuagugcagugauuagauagucagccuuauguuucaaauuaacgggacagcuaggccacaguuuaaaaugagcuugcuuuggaacauacauuuuaaguaugguauuaaggaaaaagagcucacuauggaguaaauaauugugcuggaaguuucuccaggcuuacucuaaagugccacuuuucaucucuaguuucuacuaauuaucaaagugacagauuguagguugcuagggagcacagcaugguaaggugaaggaccauuuccacaagcuuuccuuuggacuccuuauaucauuuugugccuuagaucaucccaggucucaauauggcauucucuacuuaccugcugagacuaguaggauaaacuacugagguauagggcagucucgggacuguguagugaugcaaggugguguuucucagaaaguuagacaucuggaaaaguagugagauucuaaccucuccuuuggugagcucuuacugcaguguuuuaguuugccauggaccuagugucuuccauaggcgagccucaugucccuguggagauuugcuugcuguuugaguuuuugcagcuuguuaucugugaaggcauuuaacuagcugcuauuagacaugagaugggagucca

SEQ ID NO: 169 - RNA, 5721 nt, Mus musculus
ucucuaucuacccaguauagaguggcaauguaccgcauugguguuagcuugaguuauggaggaaggcucuuagauaagauguggcuagugaacacugaugcuuuaugacaauuuauaauugccuucucauggcaauuucccaucgucugugguucagcuucaucugcaguuucaucguuugacauuucuugugguagcucuggguguuauaaacuuuggugaguucuuaccuugucuuuuacccaaguauuuggagacagaacauguuuuugcagcaaaguuuuaccaguuuguggguagggaaggaacuaaagucagauuaggguacccaagagcagaaauuguagaagaaagucuucaauucuccccuaaaacuuugaguaugcacagcugauccuguccucucugcuggagcuuuggaugggacuggggaacuuaaaauuuuguuuuaaaguuuaaauauuuuuguguguguuuguguguguauaagaaugagagcgagagcuagaguuggguggggaguggaggaauggauggguguguuuguauucaugggugcagacguguguaggucagaagguggauagggugagguauguguccuuaccuuuguaccucguuugagucaaagucucuugacuacugaguaagccagguuagccggccuucacauauucuggagacucuccuguuuccagccacugcuuccuucagagccugcuggcauucauuuuguaccacuuucaucuaggaucuggggaucagaacuugggcugucaagcucgaagguuaagcacggguaacuaaguaugcacuuaucgagucaucuccuuagccccaggaguggugagcuccgaccaaggaacauagugauuugguuaauauuuaagagcuagaacagugacaaucacauaagguugacuacucacauuuuaaacuucuauauugugugugggucuuauuucugaagacagcagcaaagccccagcuuaaacugcugauaacuauuuaaacagaagggaagagauuaaccaauguaaagugaaauuuguuucuuuuuuuauaacuucuuuguagucuugggcuacccaaaauuaugccuuugaagucaaggaacaaucuuacaggaaagagcuguaagcacuguuuaggaucguguuauaaguuucaugaugaaggacaggacuacacuguggguuugauaucugggaacccuuugcugcuucuguguacaaguugcuauugggaggcuuagccaccuggauugucgucaaacuuaacaggcaauaggauacacauuucaucucuaguaaacuguacaguuuacagcagauauuauggauuuaaauaucuaggauguuguaagaugugaggauauuucaggaaaguuugccaacugcaaguagaaaauugaagcuccaaaugaguucugcccugaguuauuaaggauguuuaguucugcagaggcaugaaaguggguaacugggggaagcacuaggaagccuguaacuagaaggugccaccuugucaguacaauguggggaaauguaacagccgucucacaugaguagaucgcagucuuuguuaguugagaaucacggagauacugaacacgagcaugacuuucaaagacuugauuauggucaaguuaccgauuggaauagcaugauuuuaauucauuaauuuaguugaaacaacaaauuucuuauuuuaauuuuuuuaaauuaggucccuuccucgauauccucaauggucucacuuuguagucuuggcugucuugguauucguuauuuagaucagccuggccuugaacucacagaaguucaccgguuugucucccgagggcuggaauuaaaggcauguaccaauacugauggaauaauaagcccaaucaaauacuuucuuucauaaguugccucggucauggugucuuauuagagcaauagaaaaguaaaauaacauauaaaaauaaaauaagaauaaaacuugugguuugaguugcugacuucaguuugauuuuuaaaaaaguuaaaugaacugcaguuugggauuagauuagaauuuccaauuucugaaacaauccuaaacauucuucugccauuuuguaugauguauuuauaugaagcggcauucuccgcacuggugauuauaaaauaaaaauugauuuuguaaucugaaacauguugaagauguuuuaaaucuucaaguguuugcauuuagccaagauuuaacucguacagguguagaguauuuuuacugucgguaugugugcaucugaucuaugucuuggcacauauggagaugucagaagaaagcucugugaagccgcuucucucccuccgccugugcacggugcugggauugaacucagguuccuagacucccacagaaggcaccgaugccuggagagccaucucacuggcucaguuaauuauuuaaacaacaauaagcacauucauuuucauauacauauuugguuuaggcuuuaauaaaugguaagauuauauguguacaaaaggauugcuguaaacuaaauguaugauuuaucuuguaaauguuuggcaugcauauacuauucauguauaucagagucauauaaaaaugucuuggcugaaaagggagucacauggagggaguuuaagaaucugcuaaagaugaaaaguaucuugucauaaauucauaaggguaauaauaagcaucuuugaaaugacauuuccucaaaacuuuauauauuuaucuuuagucaauagucaaguuuauuuuaauuaacuauuauaguaacaaagcuagagaauuuacuagaggccacaaacagugaaacuuuauuucauacauacaguauaauacaaaugaacauauuaauaaaacuuacucacuuacuaacaguuuaaguucuaugacaucauucuuaugacuuuccuaagaagauugcagaaaccagguccuuuggcuaugguuauuacccauuaucuaaaugccacauacuggguaauuauugauaaauuuuuauuucauagcauagucaauacauucucaucucuuuaaacuaguaccuauugugaacugcaaaaaagaaauacugaguauuuauagcuguuuuguuagaugugaguuucacuucaaggaaaugggaugagaccaucuuuauauaggucucagcucuuaagaaaaauguauuuuaagaaaucaaauguuuaaaaauccuuguuaacuaggaaggccaggaaaucuacauuuuaauuuuggacuuaaaguaaguucuuuagggucuuauuugaauauagacagacguugguuagcaagggaugauguuguuagguucuucaaaaaaugcacaguaggucaugaauggccugcugacagaacaccuuuauaugccaguuacuagaggaacugugaaagcauucauaacauacaaacuuucaaucuuaguaaacuagaaucaauacacugacguuuauaguuaaauuccuauaaaacgaauuuuacagaaacuuccuauguuguauauaaaagcagauguuuuuaguguuaaguuguauucuaguuucauugugaauugcuuuuaaaaaaaugcuguagauugaaccagggucuugugcauguuaggcaaacauucuaccauugaucuauacuugcuagccauuguuuauuuuuaacucauuauuggcaucuaauuaaaauaagcuuacuuugauauuauagacgaaaucugaaaguacuuagguuaguuacugaaaauguauauaguuaguugcaugaaagaugguugguuggauuuucaugccacuuuaaggauuuuuauuuggaugcaaaggaaacauuuuuaacauucauugugacauuguuuuaaccuaguauaaaauauuaaaaaugguugcuuagugcucaagggaauuauuauuauuuuuuuaguuaagcuauuguucuaauaauaagccucuguaauauaacuaauucacaccaaauuuugaguaaaauauuuuuggauguaacugaugucauaaauuaguuuucuaaccuaagagaacauacuuuuuuuuuuugguaguucauggaaaucauauagagagcuaguaacucugacaugaacagacuguauaaauguauaguuguaguccaguguaaauguauuaggaaaccacugugauuucagauggacagacaagagucauagugaaaacuuguuccuuaaaaaccaaguaauaaaaagggggcuagucagguuagaccaaauuaucagaaaccaucauugguaacuuuguugagguagacauuuaaauauuaaauauuuaaaaguguguaugucugagcucaacaguuuaaaacaaauucuguaaagauuauauauguagccagggcaugggcuuaaacacauaagccccuguaaacuugagauuuuugcugaguuuauuuucauuuuuuuuaacaucaggauaguaaauguuauuuuaauuaaaagcaguuuucacaguuugcaauagucugagaagaauacuaccacuacuauacuagucagcacuuagcuuuuuacaaagggcagaacaauuuauguuuacuaguaucuuuuaaaaaucuguccgcauacuuuuauauguuguaaaaaauguuauggguauauacucuguagcuguguuuaucuuggugcugaaaacaaagauccuaauauugauuagcaagaaacacacuguauuaagucuaaucucaaauuguuaacggauacuuuaaaguuauuuuuuuuuuguaucucuaaagugccaaggaaagaggauguauuucagcaguaauuuuuaggcugauuagacauuccuuuagauacugcuagugguuguuucagaacugucugaaacuuaggaugagguuguagaagauggcuuaugaaaagacuuuagaaacugaaagcuuagacacugauguuuuauaguuguuaaaauuacuuuuguuacauuuguaaaaauaaaagcaaggcaucacaacuuaagcagaggaguaucuuuugagggauuaccuuaguauauuuucauguuaucuccauuuaauacuuuacagucuacagagagaaauauaguaauauauaauuuuuacagaauugaaugaaaauguggaaguacaguauauuuuaggagacaacauaauugccugaacuaaacuggguagcaaaaacuauaaguuuuucuuuaaaugcaaaauacaauuacucucagacucuuggaauuuauaaagguuuuagaaaugccuguuauucauugaauaagccugaauaauaaauaugggacuaaaauguacacugaaaacagguaaccugaacaucaaauauaguuucaugauauuuuggccugggcucugguagauuacauauagcauguuacuuuuaaaguaacucuagcaaaagaaaauacuuuuaaguagauggaauggccuuaggauguaugaagauacuaucuaauacacaauacuauuauaucuuauucacagacaugcauuuuagccccaaaauauuaggaucacauaccccaaauauauauguacauccaugaguauagucaucauccuuuaugagacagaauaaaaaaauaauucaaauuauuugggaauugcuuuucugauaagaacauuuaaaauuuauaauuuauaauuucuacucuuucccaggagacguauaagacaguguuaauuguacuaauaguauucuugggaguagauguaaauuuaacauacuga

SEQ ID NO: 170 - RNA, 18347 nt, Mus musculus
gggagcggagggcgcggcuggaggaaggacguuugugguuggcggacucagccccggccgggaaguucgaacggacguggaagagcccgcagguugggcccaugcacagcagcagcugcucagggucagaguuuccucggguucuguauaaaagcuuugguagguucauccucacggugaagaugugucuuuguuaauuuaguccaagguaaagaagaaugguucugaaagucuuguacuugcucagaaugaaaagaauccccuaugucccgaaguuaccuaguuagggaauuucuggcuccacaccaagucuagcacauuccuaguugguagagagagagagcuggacacuuaccuuagggaagauagagaaaaggccuacuuguucacacauuuacuguagggguguuuacagcuuaucgaauuuccgauuuaggguuuugaaaccacguugaaaaguauaggaaagucguggaaauagcaacuucuuacuuaaaguuguguagaaauaggacugggccaaauuuaugcuaaaggugggaaaagugaaucuuguuuuaacauugugugugcacaucggacacgcacaugcaucuguuugcugcugugggcuugaagugacuuuggguguaaaggagauuccuggaaagaaguugaaacuugaaguuucugcaggagugauuagcugauuagaacuuaaaugacuggggagaaauuauguuguaaguucaaacccugauuaaaaauuaucuugagcugucuuucgcucuuuuaauuaauagccuuuccuagcuaaccuguguaccuaaacagccagcauacuagugaguaucagaugaaaccuuugaaauguauuagcuuagcuuccaccagcccagaagcuaagacuuauauuagaggccuauagcagaaauuuucugucuguuaucuuauuuucaaagucuuaaauuauauaauauuuucuauuuugauacuguaaaacuugagcuaacugauauguggcucaucuuuaaggugagagcaguuuuuuuguaucacaguacauuccucacacuccaucuuuuaaaauuuuuuauugauuaguuuauuguuugacagcaucuugcugaaccugaagcucauggauuaggcuagacugggcuagccaagaagcccccaaugguuugccuguuucuaacuucccagcuacuggguucucuguuuuguggaugcuggggauccaauucagcccccaugcuuuggggaaagaggcaggcaccuuaccaacuaggucauaucccaagccuuauucuaauuuuaaauuucuuguauuuguuaacaaaguauaauugcucuguacauuuucuuagugucuuuauagagguaugcuuuaccaauuacuuugacaaaaacuguuagauucuaucugacauaauaaauguaacugagguguuuugauugaaaauggcccccacagacccauauuugaauacuuaguucccaguucauagaacugguugagaagggcucugauguauggaguucuuggaggaaguguuuuucuggggaugguuuuggggauuugaaagcccacaccauucuaaguuugcccacuacuccuccauccuuguaggucaagaucuaagcucuuggcuacuacauuagcaccauguccuacacuagcaccaugucugccugcugccaugcuccccaccaugagggucauggacucuaucuaacccucuggaacuaugagcccacaguuaaauacuuucuuuuauaaguugcuucgguuaugguguuuuaucacagcaauagaaaaguaagauacaaaccaagaauaaauuauuuaauuccuaccacaaaguagauugauugcuuuauuaaaauagcuaguuuagaagcagaggucaggauagaaucacaccaaggaagcugaucuucacuuuuguuuugcaaaucauguuuucccagggucuaggacuguuaagcuguagucuacaaguccaaauguggguguauauugcuaauguagcuuuugauucuugugguuuuguuuuuucagguugacugauuagugaaauaaucauaugcugaagagaacaggaaguacuuguguuuagaaaaaaaaguaauugcagcaaaugcuaaauaucucaaaguaggcuuaguaucucuaagauaauugaggccuuugagaaauacaaaagaagaaccgaagagcaaagaaacaagcugaaguaaggagagcgccccacuccccaguccaagauuucugcugcccuacaggagacauguucuugggaaagcagcaucucucucaauucgucguuaaagguauggguguuguuuauaugcuaugucauagacucuguagcuacuucuuauauguuuccuuguuauuaccauaauauuuucucucaucuucaucuucucccacaaaaucaacccugaugauucugaucuuucuacaaucauccguacaaguggacucuacuuucuugccuuuuagucuuucucagaaccagacuuccaacucaauaagagguguuacaagaacaaaguuacuauacccaguugaguaaaauguccucuuuucuaguucuuugugaucuucaguuggcauuuuauuguugguagugugcaaaccucuacagcccauaucuggcuucuucucaguucucagaauguuuccugaugaguccucggagcaccaugcuccucaauauaauggaaaaaaguugaaacuuuaaggacucccagaaagacuaaguucaucauaaaggacaacagaaagagaaugaagccauuuuaucguaaucaguaguaaaacuggccuaucucauguaacaggaagugaaagccugaaaaacuaagggauuugucacaacugaagaaguagcucacucuucauuaugaggcagcuguaagaugaaggcaaugcucugcccgaauuucaagucuuuaucuggauaaaucagauacacagauguuuauugcuugcuaaccuauaacuguugauauguaauuugaccaagccagcccagucagucaacagguucuccagagcaggagugaggauuaaaaagaaaagagacaauuggacaacauuguaucgugaccccagccaguucugaggcugagguggguuuauuuuuucccaaacugcuuuuauaccauuuuaauuacaugcaaguaauaagguuaguucuagauugaggaacagcaagcuaauaaacacaaauagucaaggaacaagcaaggcaauaaaguccuguggucacuccuacaaucacuguuucuaagggcuuaacaggaugaccaagauaucugagccuacaucccuguccuagcccaaagucagauuccugccugaagccuacuucuuuguuccaaccugaaaucagauucuugacugaacuuccuucccagucauuggccuaacguaagauuccugccugaagcccauuccauuguccuuggccaaugucagauuucuaucaagcggcucuaaaagcucuccacagcaauuaaauuaauuuuguaucaaauguuugcacaagucagauuugguucauaggcuacaaauauuuaacuuuucugguugaagauuacaaauggauauguaagaccaggagaugaagagaaagagauaagaucuuuaaauguggcuuccucuaagagacagagaaggaaaaacuaugggauuuaauugaaucccaguugauguucuaccaaauacuuaauuuuuuuaaauuaaucuuuguuuugaaugaugauuguggggguggcugugguaguuauagugguugugguggugguggcggugguggcagugguguguguauaagaagccucuguacugaaacuagaccuugagaaaaacagacaauaaaugagauaugucacucuagcauauaaauuugccccaaacauucuaaauggagugaagauagagaauaaauccauuuagggauuugaaagcauauuuugguaaguuucauuagcuaaaaugacaaauuuuacacuuugcuuuccuguugaacacacauuuuauuaaaauauaaaucauguguguagcgauaaacaugcacucacccaccaaagagcuaucuggauucaugaaugaaagacauacacacacacacacacacacacacacacacacacacacacacacuaauuaauuuuaaauaugccuugauuagcucaaaggcuggacaguucuaauucuccuugcugcuaacaaacacuccccuucauuacuucugaguuaauaucuuuuaaaaucuaucuuucaucucugcuacccuaaacacaauuagggaaguagcccauguggccacuuugccugauugucaugugauggcggguaggagguaggucuguucuuucuucuuccuugccauggugaucucuccuuccucucuuccugucccuagccugugcaaauccaaaaguccugccucagucugccugcacagccauuggccguuggcucuuuauugauuaaucaaaaaccaaauggggacaaggaccuucagcgggauuaaucaaaaaccaaauggggacaaggaccuucagcguucggacauccugauuuugggggucagauuauuucaaagcauuagaaccaauucccaauacauguguaucaauguuaaacagauuaucacucacugaaacauccugcauaaugguuaacuaauaguauuugcauacauuaucuuuacuugcuguuaaaggacaagaaaaauauaaucaauuaaaaacuuaaguugucaacaaaauacuaucaucaggaaaaaaauccaacaauguguaaagaagaguucuggaucauaaucaagugggauuuaauagcuagguugugauggugcacacucuugcgcgcgcccgacucgccagcaagaaugacgcugcaacaggauccuucugcacacguuuauuaggagagcuugauugcagaggcaaagagaccccaagcccagaacuggugcugcuuauauaggccuaggagaggcgugucucacacccggauugguuaugaauggguuaugcuuaacaccucauuugcaugucucacaucugauugguuaacuucucucucaucugauugguuaacuucucucucauccgauugguuaacuugucucucaucugauugguuaauuuugauuaauucucaaaaccucaucuuggcaaaauaacuuuacugccuauguaugcgugguggccagcggaagccagugccacccugcaacagcacauguggcuuccuacagcacaacuauaaucccagugcccaggauacugaggaaggaagacuaugaugaauauaaggacaaccaagcuggauaguaagacccuaucucaagaggacagcaagaaagagauugcuuccuggauuccagagauauauuucaggacucuaagaugguuugacaucugaaaaucaauauucuauaccauaugaauaucauaaaacuaaaaauaccauagacaucuuaauagacacacaaaaauauuggcaaaaacuagcauacuuucaagaugaaaaccauucugaaaacuaguaauagaagagaauuuccugaaacuaauaaaagucauuaggaaaaacuuacaacuaauguaauacuucaugguugaaagauugaguauuuuaacccuaagaucagaacaagauaaaaaugccugcucuugcagcuucuaaucaguaucaugcuagaaguuuuagccagagcaauuacaaaaggaaaaaggcaucuagauuggagaggaaaacauaaaucuaugcagauggcuugauacuguauauggaaaaaucuucaggagccuacugaaagugauaaaugaguugagcaauguuaaaaaaucaauauguaacaaucaaguguuuuucaguucacugguaauggaaaauccaaaaauaaaguaauaaaaauuuuauuuacucuaguaaaaacacauuuaugaguacauuuaaugaaagaaauauagaacaugcauacuaaaagcugcaaagcuauuuaaaaauuaaagaaagcauagaaauucagugucagugaaucagauguuauguuauucaagcugguacuuguuuucaaaauugaucuguuuauucagagcaauccacauuaaaauaucaccacacuuguuuugcugguccugagaugcacauuaauccaucuugcuaaaaauaauaaaaguuggaagacucacaauuuuccauuucaaaacugcaguccuguguugaucgaagaggugucuacagucauaguggcagaaacacauaacagcaaaaugugauucaaauucuagaaaccaacuuuacaguaguagucgauugauuuucaauauagguggcaagauaauucagugugaaggaaaaguuuuuaaugaaugguguugggacaccugaauagacacaugcaaaauacagaaguccucuccauucuguacuacauucaaaaugaugaauauaaaaauuagauuugaauguauuaguuaaaacaaaaaaucuugagaaaaucaggaauaaucaucaucaaugauaaucauauccauuaauaagccaauguuuuguaaacaauaauaaauaaaaaagaaucaaaagaaaaaauagacaaacuuaauuuuagcuaaaugcaacagcuuuuuauuucauauacuacuagucaaaaaugaaaaagacaauccccaaaauaaaauaaaauauggggaaauugcaaaccugguaagaaauauaucaaaaugcauuaauaaaaaaaucccugguacuuaauaaugaagacaaggcagguuucaaaacaaaggaucuacacagacauuucacagaagacagucaauggacaagaaucauguuagcauguacucaacauuagacacuagggaaaugcaaaucaaaaccacugaagcuucacuucccauuuagaguagggaugcaguuaaacacuaugucgcaaguguugacaaugauacaugagagcugugaagcucaugcgcuacuaggugacucucacacggcugauaagagugauagaacugcuucugaugccauuugauagguuuucaaaauauugaagagauuuuccauauauagaaacgacaggauaucugacaaaagaaaacugaagaaaggcuuaaucuggcucccgguuuuaagagagauacaguucuucucagugaauuaggcauggcagcaggagugugacccggcugauuacauugugucaucagucaagaaaaaagugcauagaagagguccaggauguaaauucuccaggcccuccuggaauggcccaguucuuucaccaagauuccaccuucugaagguuccacaagcuuucaaaacagcaccaccaguugggaucccaguguucacacaugggagccaaugcggauauuucacauuuaaaccagagcauucuagcacuggucccuagugguguacagucaucugauaauauaagugcauucauuaugacuucagaagucuacaaagucuaaaaaccucaacucuguucaaaaguccaaagucccucucuagacucaggcaaucuccaugagcccuauuuuaaaagucacauauccccaaugugcauuggcacagcaucacacucacuggaaaagggagcaauagaggcauagcaaagaaaugccagaucaaggcaagacugacaugaaacagagcaaaugccacacucugcaguuccauuucugacaucuggggcuuauggcagaaucaucugggccccagggggccacaugaaguccugcagccacccagagcauaaguaagcucucuuagucuaccuccauaccacgggagcagcgcuccucgacagacguucauguucuuggcauugcagagauccugggucuacguagccguaacuuaugcuucucuuuccugguuuuaugcaauggguuuucagggucuucuugcagggaauccaugccugucacacauugcaugacuucauugucuuucuggaacuuuugugcaggccccucucaccuucuuacucuuggaucuuucauaucugcaaaacaugaucaaucgugcuguagguacaggugcacacaugcuauauuuacaguguagaggucggaggacagcuucuaggaguuuuucuaaacacaacggguugagcucauguugccagccuugugcaacaagugcuuuuacgaauggagccaucuuuacauccuuaggccauuccuucugaguugaccuucacugaaguucuagggacacagggaaaaugugacaccaacaacuucuagcccacucccuaauccacuuguugugcagauuuugcccuuuuaaaaauuuggguuaucucuucucuuguuucagugugagugcuuuuacuucuuuuuggauaccaguccuguacuggaaaguaaguaccuugcagagacuuccucucagucgccacugcuuuaacuaucuuuugugaagcaaacuaaacugccaguugcuuuuuucucucuuccaugcuccaucuuuggauauuguacuaaaaagauaucacuaagccaaagguuuuguagcguuuuuuccccccaauuauccuccagcaauuuuauaauuuugcauuuccgacuuaagccuaugauaaauucugaguuaauauguguaaaauuuuuauguccagugucuacauuuauucauguaaauacacagaugcauguaugggaaaaaauggguuuguucccuuguaguucaguuucuuuaucaaagaucaguuacuacguugguagggaccuuuauuucuguuuuauuccacugaccuagucaguagccuuuuaacaauucaguuaugcuaguuugaucuggauuuuauuccuugcagcugaaauaaaucacucguuuauuugaacacuaaaaaucucguuauauaaauguaauaaaugaggaaauguagacuuagcaagguuaacugacacgaucacgauugccucacuaauaacuaacagggccaguauuuggcccgcagucugcugcaugucuacacgucacugacugggaaaggugaaaaaucaccuccucccccuaccuggacuggcacuguuauuggaauagucuucuccuaauuacugccuuuuacaaagcuggaguuccuucuaaaugaaauauccucuuagccagcauuuacaucuagcuugcgucagcuuuuuccaguauucuauuacaugcucaguaggaugacucucuagucuuacauuacacucauuguauacaagcaauauaggagccuaaacuccuccuucaauuugggggcaucucuaaguauuaaaaucccacuuguuauucuucuugauugcuaugcuuuuaauuuuuuucaguugugugccccccauuauauccuaaaacuggaauuaagcauucuuuccuuaaaacaacaaaaaguccugaaauucuucuuuaggucguauccuguaccuucuguuuugguuguagguauuugauuuaccuaggcucucucaauggauauaccacggaaccuggcuuuuaucuuaaaaauguugaucacauaaauuuacaccaaaaauuuugauaaguguuggaguuucaaagauaaaagucguagccucugccuuaauaauagcuuacaaacaggucagaugagacaauuccuuccuauaguuccucuuguacuauaaaacagaaugcccagcagggcauacuuaaugcuguuugaguguuggaaagggaaaugaguaugggcuagccagcucaauuagcagugugugcacuacaaagaaggccuaagcuaauguuauggguuaaacuugcaaacuuuacauuacuuugguguugugguuugaaaacauuuagggaugcaacuggagaggugggauggagcugugucuuuaagaaagcuuugcuaguagaggaguugcagaucuuaggcaagucaaugucguaauguccauaauaauuucauaauugcuagaaauccugaugaggcuacguuaauccugacauucaccagaaaaaccagcuccaccauuuuggaccauuuuugaagcaagauuuauucaauguuaaauacugaccaggggauggacuuuggccaggaacauuccccgaagguuuccaccugagaauggauuccauuccagcuauauguuguaggaacguauaaggacaaaucuauaggccaccaugaggcuuuguuauuuaccaagaacuacaauuaccagcauuccaaaaaguuaccugguuccuggcuagguggacuuuacaggucaauuuugggaauuacagcugaauuauuaauguagcaguggcuggcuggacaaguggaauagccucaaccauauuuaguguuguucaguuaguagcaacaacuauucucacuggccagguguagagagaccuuuaagcaguaaagugaccaagcuuguugccucacuguacuuuagcaucccagugauucucuggguuucccucuuucugugcauucagucaaaagaguuuacacuguagauguuaagcaaguaaauuucuuaaugucuugcuuaaaugacccacagaaaaggagaccagcuagcaauguguaaauguugucuagguaaaugcuauuaggguuugaauaggccagaaaggaaaagaagcauauuugaaagauguuuaggaaauaaauugucuacaacacugugucuuauucauugugaaaaaaugaaucaugagugauaaacagguuuccagucaucaaagccaaaucuuuuaguaaagaaaccaauaggggaacuaucuagauuaccagucaguuauuucucuuuagaauuuugaauaaaauuguuagacacaaaagaaacauaguguuuuugugaagggguguuugugacaucaaugcuccaugguuagugggggaagauuuuagugugcauaagaggaagacaguauccagagaggaaagaaaaugagucuggacauggccagggcuagguaagcuagauaguaggagagagcaguggagauagagaaagauacuagagcauccaugagaacaaaaggauaggaagagacagagaagggagggaggauagcaggauaaagggaguagggugggaaaaucaugcagauuauaaggaaggugaauaucuugggggaggaaagggacaggaugcuaggguggacucugaaagucagugugggcuuugauuugcugauaggugccacagguagccauacgucccucugucagaggugaggggaaagucuccuuuuggcagaugggaaccaguuucacaagcuucugugagcuuugaucuaacuaucagaaagccuuagucuagccagagcucauuucuagauauguggacuuccuaugaccucuaacacgugcaacggcuccuuccuccuccuauuaaccaggaggcucagagccugucagacuuggccacaugcacuugucccaucuacucagcuuuuuccuuagccacauguuuuucaaaaccuguuuuuaaugaugguuauuaaacucuuuaacaccuccaucccagcccacuacccacaagaaguagugagaaagaaaggauaugggagaagugggccuguuuagaaacgggaacaaauccaaucugcauugucaggaaaucaauuuacuucauagaucagcaucagcagcucgauucacuugcaaacacuucccagauacacaagcaguccaguucaguagagucaggauaguaaacacaaaucagcagugguggcaugaucuagcagcaacagccaggcuuccgucgaauaggcacaagucagcaggagggaccagggcuaacaggaaugucaggaaaaguucuuggcugugccucuguuaucaaagcaaacaucagugaagaugugagaccaacaaguguugcacagcuagcucuacacacaagccuagacaagccucucacaguccaaugaguccuuuuuauacucccuccaaacaucacgucaacaggucuuaccucaaaacaugucuugccuuagcaugugaaucugacuuaggaaaagucaguaugagucugucucaguugacaucacucuuucgauaggccugaguccuugaaagugacaagaagccacagcacaccaucagaaauuuuuuaguucauuucuauggaguccugauaaauggagcucaacuacacaauguaagguggaccaauacuugcuucauuagugaagaauccuucaucaaguguccuuucacaugcuugcuuuagcagaacauuuuuuuuacgugugucugcuucaucaaacuguuccuucacguauuugccucagcaaacaccauccaacacaacugacuuuccaccaaacccuuaaaguuuccacuucacuuuagguucuuuuuuaaaauuuuuaauuuuuuuuucacuuuuggaauugaaaacaaacccagacaccacaccuuauacccuuuauguacuucaaaguccaguucuauuaucacauuugguauuugccugcucccuuguaaagucauuuaauuuguucuauagucuuccacaugcaaaguguaagagcacucuaucuauccccuuacaaucauaugccauauuaaaacacagugcagugaacagggguugaguugacuggaucacaggguguauggcaaagcaucucuuggaauauguccacccuguuguuucugggugaaacugacauguauuggugauggaaagaaagagauuacucuucccaauucuccagucuuuugauauuuccacacugcuccucuguguucagacuuggagcuagacuggaauuugcaccauugccuauccugacuuucagacuuccaggcacagacuaggacuguaggcucuuaaucucacacauggccagauauagaucuugagauuucuuggcuugcuugauugugcaagccaauuccuuauaauauaaucucccuuucucuccucuccauauucauguauauguguaucucucuagauacuuucacacacacacacacacacacacacacacacacacccuauuaguuuuuaaaauccuaauacaaaugacuauuguuucuguuuaguaaauuaguuuaguaaauaugaauauaauaugcuguuguucugggaaauguucaugaaccccaaaaagaccaccaaggagccaauuccaaugcaaucacauuagggucucuuuauucaagcuugagcuugggccacaccaccaucucugacacaggagaaugggaaggaauucuaagccuaguuucagacaaguauuuacagagacaaguaggggguauagccugguauauaucugaugggggugggguggggggagaagagaggagacauuaugaucuucaacauaauugguuggugcugggagccaacccauaaacuuaacuucuguuuuccuccugacuggugauugguaggaagugaagugucagggccaggcuuguaaccuggaggugcaaauuuguuggggaauaacuuagaagcuggugcuggaugcacaguuguuagggguaaccuggaaacuagugcuagguacuggacugcuaguuaccuugaguucaaccucaggucagguuuucuaagauggaaucugaacccaagaucuggucucucaaugccauguuguuuucagauagcuucuuauguaaaugcaauauaucauugauguuacacuaacuauacuuuguauacuuuucuuacccacucagaaguuuauauuugaauaaaaaaaaauccuaagagcuguugcauguagcuuugcuaccuggucugagcucugggaauaggccgcacuaccagucuccacucagcuucccuugaauccaugaauaaaagacacacacacacacaauuguucauuuucaacuugccuuuugacacaguugcugggcgcuaccuauccccaccugaaaaaguguaaccccaucaauuuucucagcucugcaccucuccacccagccuaaacuuuaguugcucagcuaaauuuaguccugcuaaacauccccuagcgcccgccuguaggaguggucacagucugccacucuucuugagauucccacauggcugcuuggcuuuucucucuuugaagcauggagaaagcucuuuucucugggucccucucuugcccccagggacccagaagucccuccuaucccuucugcccagcaauuggccuacagcuucuuuacugacagaucaagaaccaauugaagaacagaaccuuagcgucagaaccaccccugcaccucaccuuuucuguccaauaaaaaaauauaguaaaacccucuucucccagacauaaauugaacaaaaccauaacaauuauguaaauuacauaguaugauauacaaaugucauccuguccaucauuuuugucaauuagauaaaguacucuaccaucauuccuaacuuaaagaauuaugauucuaccccuggauuacguuuagauuuuagccuguaacaccaucugaaaaccaugucuuccacucuauaaccucucucucaauuuuaaauaacuggaguuugauuaugagacuaaagguaguccucaacccugucagaaaugugagaaugacuuaaacauuaccuggauuuauaggaagcaccaaacauagcuucucaaauguaaacaaacuguagagauggcugacuaucuggacagcccccuaauuccucaaaucauuggagcaucagucuucagcuuucuggcccagguucaucugacaaaccuuugcaaagcaggauuaugaauggcuguuuaccuugccuuggcagagcuaacagucgacuauucuacauaauguguccguuuauguuuugucugcagaugaaauaggcaauuucugcccagugacuuccuugcuacgauaaacaaccucgccuggaggugaagaugcucaguuucuucuuugaaccaagaaggcggugcugucaggagcagacaugucucauugucaaaugaugaaauaacauuaaauguaacauuuuguggauuucugaugcuuuugaagacucuauauaugagguaaucugaacuguuaaaccuugacuacucuuaguauuucuaauuggaauauauugaaaacacacuuuuauaauuaaauaagaaucuaacauaaccaugaguuugcuaucuggcccuuaacuuguauagcuuaaucaucuaaaaauaguuuguaauagcaguuauuaggaggacugggucuaagcuuuguauucuuaaaugaguugcauagguacaaugccuaucuaagagugacaauauuaaucucaaauuuuguaucaauauaagaaauucauaccaaugaaaaccuuaaaucuguaucaaaauaaauuauguaccaauguaagggaauuauaauuucaacuuugcaucaauuauaaagauuucuaccaauuaagauuauggcuacacaaugcuuuguucaaggauaaaauucaguaaucccaccuauuuccucgcuguucaaaauuaugaccauuccuaaauugucccuuaaaaugacagcuuuucuauaauuuguaaaauacccauuaccagacaccccacccagggaauucggcugaugauucuccauggcuucuuccugcugaauagcggggaugaaaauuucuuugaagggguagaaagggguagaaaaaucagaaaauuuagacuuaagaaaccuagcuuuaacaucuguuauccagucucuguaugcuuacaaggcucagggcuugacugaaguucugacuggauuugucugaaaguuuugaugaggcaaggcaaccuggaaucagugucaaucacuaaagcuguuuugggcagcagccagaagcagggggccaagccaucaguucaacaucuuuuaggaugaaucucaaaaaagcuguacauucuguaauauaugaaucuuacaaccaaaauuucaauaccauuaagauauuuguauagauugugcaaaaugcacagaucaauuaaggcugaaauuuugguccuuguuagagcagguggaagacaacugucuuuuuuaugcguuaaucuuauuaauaaccaguuauaagaaguucauucaugccaugugaaagauggcaccaugaaucuuuaccuguccuguuugauuuucuugaacuuuuaugguuuuucagggguucucccccugucauaucugauccauaucacucuggaagagguccagagccuacucuccuuuccugucaacacaaaugcagagccuuucucccaaaauagcaaauccuuggcccaguaaccagaaaucauuaaacguuuagcuugaccucucucccagaggaauuuuaauaugaccaccaaacucaaaaucacacucauuuugauaauugaaacaauucaaagcaaauaagacaaucuaaagaaauauuaucugugaagacagugcuucuacuguccccugccccaaccuucaugagauuaaggccuaaaguauuuaauaucucugucuacuuaccauaugagccuauuuccaggcuuucuauuuauauaauccucagggccuaaauuucuacugucugagguaggcuaggcacccuagucccuaccuucuaucuaauuuuuuaagaucaaaugccucaguauuuuaaucucugucugcuuucugucuaaacccauucuuagucuucuaauauguaaugccucugcuccccuccuccccuccucccccuuuucuuccagugaauaagacacaaguuuuuguguuuucuaggcaaguuaccuacaucccuagccuacaaacuugcaaaaaaaauauugaagacuuuuuacaugcauugguacaccaacaaauggggaagagucaagaagaagggcuauuuuacugcucaccuugauuaguauugauauuucuccacaagauucuaaagaguggaucuauuuaguuuacuuuauaacuacuuuuacauuuucuugcagauaauacacuucuuguuucaucucccaaagcugauguauccacaccacucuccagugcacuguuuggcaucccucugccucugcaugaguuacagaugggaaaacagaaauuagaguuaccugcaaaacuaacaagacagugaauggaaauggccugaauaugaaucuucauucuucguuuuaccagcaaaauggccagggacuaaauaaccuuucugagccucaguuuccccauaaugaaagucaucauaguaucuguuuugugucuaacaaaacccauaauuuaaagcaguaauguuuaacauguacucuuaagcaaaaguaauucuuugcugucaugaacaucuuaacauuuucuaggauccaguguuuuaaaaauguguuuuucuuuguuuagggaauucuaacuauacauagcacgauggauaauuuucaacuugauagaaccuagcaugguggggaugggaggaggcuucugggcgagaauuguguugacuuuauugaggugggaagcccuucuuacuguggguaguuccuucccuggcauggcuucuggauuguguaaguggagaaagugagcugggcacaggcaaacuuggcuccaucuucccugacuguggagcaguugcuucagucaagcuucugcugacuugccuucccaccuuaguggacugcacuuggagcugagagcaaaacuaaaugcuuucaucugugaggcgcuuuuguccguguguauuaucauaguggcgagaagaaaaagacacaguacgagcugcuuccucaaggagaguccuaaaacuguuuccagaucuuuggcguuggcuuuaccugcaggcagugauuugaauguuauuagcuuaagggagggagacugcuaaacuccaguuuguguuaaaggccccugauaggguggauuccuaaugcagcaguggcuggccggacaaggggaguaaccuccaccguguuuaguacuggcagaugagucaugagagcugucuuaggguuccauugcuggggagagacaccaugaccaaggcagugccuauaaaggcaaacauuugauuggggcuggcuuacaguuucagagggugagccuauuaucauuauauugauaagcagggcagcaugcaggcauacauggugcuggaagagccaagaguucuacauuuugaucugaaggcagccaggaggaggcucugauugacacacuuccuacuccaacaaggccauaccuccuaacagugccacucccuauggccaaacauucaaacacaggaaucuauggggccauaucucuucaaccaccacagacacucucacuggcuaggucuaggagaccuuuaagcacuaaagugaccaagcuuguugccucacuguucucuaacuucccagugauucucuggguuucccugucuuugaauaaacuucuuuucugugaaugcaguca

SEQ ID NO: 171 - RNA, 13902 nt, Mus musculus
cgguauaggccccgcccaucuacgucaccaguuuuuccgagaagaagcucgcacugcgucuguccgcaccauuuuguguugggagaucgucguaaucguuugcagacuucucgccgucgccuuguaagcuuugucuucgccuugcaagcuuugucuucaggguuggaaagguaagacgcggugucugucagggccuuuccuuguaucuucccgccgccuccaaggaccccgcugcggcucuucacggcggagccacgcgaaggggcucugugccccggcugcggagcucuggccgcuggcuucugcguaggcggggacgaugcccgcaggcuccgcgucccgaggagggccggccgacugcaagagcccgagcugccgcggcgggaccuaagauggcgguagggggaaggccgcgcucguccuucgccauggcggcgccagggcgcggccuucgcuuggacucggucgguccugguuuugcucucggcgguggcacggcgcagguuuuggugcuguuuuucuuuauauuugaagcgaaaggucuugguaaccaggccggccccacacgcugcggucgcugaucuuguuagagaugggcgcugcggggacagcgucacagcaggcugucaccucaguucuguguaguuuccgccuucgacgaagaaaagaauuucagaggcggucgauagauagcgaagucgagcauaaugaaaacgaggcacaccgggacagcgcuugugagagcgaggaacaagugauuuuuaagaagguuuaggauuuacuuagguuuuguaacauuaaaacucaagacggccgggcuguacugccugucgcucgccuuuuaauccccuuugagccugucucaaaaaaaaaaaaguuauagaaaauuuccuuuguaaacaaaguuguaacgggggaguuguuuaccuuuaggaaacaggaggggaacacccuaagauuguacgucacuuccgcucugaacagcuuuauuuucaacaucauggccuguccuguacaguuaaguagaguggcuuuauugguggagcccgaauuuuguugacucggcauaaaaggcgcgccuguuaccuucucaggcuuuccucccauauuuucauaauuuucccagucucccucugcuagcaguaagagugucagcggggaccgugggcauuuacuugacggugaauugggaauugaggucaucugcugagcagcuuuuuuuuuuuuuuuuuuuuuuuuuuaauagcuguaaacaaacacuucauaacauccaaacugguauuuuaccaaaaacaaacaaaacacuuugggggcgggggcuguuccagacaggguuucucuguauagcucuggcuguccuggaacucauuuuauagaccaggcuggccucuuacucagaaguccgccugccucugccucccgagugcugagauuaaaggugugcaccaccacgcccaguuaaaaaaaaacuucuuaauuagggucacuugugguuacguuggucggagacuugguuuggguagaaauugaaccuugugaaccuguaaguugaacuucugaaagagcugucauacauuuuucuuaaguuuuaaccuuuuucacuuaagguuuuaaaccuuuuucacuuaauaugaauuugggcauugugaaaacaaggugaaaaaaaaucuggccgggcaugguggcgcacaccuuuaaucucagcauuugggaggcagaggcagguggauuucugaguuugaggucagccuggucuacaaagugaguuccaggacagccagggcuacacagagaaacccugucucgaaaaaccaaaaaaaaaaaaaaaaaaaaucugugaauaaaguuuacauugcagaaucugaggcaaugcaauaauuuuuaugauugcagacaguugacuaaaauuuuagaacuuugauuuuaaacaaaacguuaaugcugggggucacaugcauuuuaucccaguacuccagaggcaagaggcagguggcucuuugaauucaagggcaacuuggugcacauaguuagagcuacucuauauugaggcugucuggggaggggaaagauggaaacuaaugggaguuugcaaagaaacauuuacuacugaacaucacagaacuacaguuuaacugguaaaauuugucuuucauagaugagacauucaaagagaacuuacuguccugacugggaugaaagagacugggauuauggaacauggagaagcagcagcagucacaaaagaaagaagagaucacauagcagcgcccgugagcaaaagcgcugcagguacgaucacuccaaaacgacagacagguaagaaaggcgguuaugggcugggaagauagcuuagcugguacuuaagcuuggcagaggacaguuuggcucccaacacuucagacacacuaccacuaaccuguaacucagcuccagaggaccugaugcccuuuucuggcacuccuuaguauacuaccuauacacacacacacacacacacacaauuaaaaauucaucuuuacaaggcauauaaaguacugcaauauaaaaguagauuuauacugggagaguagcucagauauagaacguuugccuaccguguauaaaauccugggggccauauauaaugauauacuuagaauugcuuaacugcauaaucuggagauuuguggaaggacuguaguccagugguaaaaugccuaucuuggucaaacguguugaguucaguucucuacauugcaauuguuugguguagcuguaaaacaaacuuuuuuucuccucuagcuauuaucuggaaagcagauccauaaaugagaaagcuuaucauagucgacgcuauguugaugaauacaggaaugacuacaugggcuacgagccagggcaucccuauggagaaccuggaagcagauaccagaugcauaguagcaaguccucugguaggaguggaagaagcaguuacaaaaguaaacacaggagucgccaccacacuucgcagcaccauucacacgggguaugagugccuuuuaaacguucugaaagguuuuauuucccauggagaacaggaaacaguuuuguguuugagaaaauuucaagauaaaagucaucacaacucuaccuugcaggaguauucuuuuaguauuuguguauuacauaagaaauucaugaaaauagugauauuuaguucuguaaugauaggaaagauugucuuaaugcuauuccaagaaauacuauuuugauaaauugucaguuuguuccaaggaauuagguauuuuuguguuaggguuaguuaugacuuauuaacauguguaaauuuuuuuccucauuaaguuacagauuugaaguuaguguuuucauguauuaauuuggaaaucuaucagauaacauuuuaaauguuauaguguuauauaccuuuuuuuucccuucccaaauuagggcuaucauuuuauuuacuauuuuaauauauauuuucuuuauuaguuaggccaaaucuuaauuuggccacaggguacuaaaguaaauacuacauucuacaguuuuguaguaugaauuuaggacacuauguuugagugaaugccacagauaaguuuuguuuuguuuuuuaagaagaaaagcaaauguguuuauguuuuguugacuuaccacuuugaguaucuuaucugaaaaucuguuccuugccauguuuuucuccuguuaacauaaacuaugugcccugugaauuucuggggacugaauuugaaauugcuccugccaaccguuuguggccuggcguguaucugaauaucuccccgcugaaugaauuucguauucugcccugaauucacucggguguauugauuggcuggaugauguuggugcuggugccgcccacuugacguguccagaagagucaccgaaggaaaagaucgaggaguguagaggaugaugaggagggucaccugaucugucagaguggagacguacuaagugcaagauguauagaauauuuuucaacacuuauuuacuuuucagauaacauaaucuauauguauauauagauuaaaguuucagggauuuggaaaucuuuuucuuucuuuuuuuucuuuuuuuuuuugcuuucauuucuuuuggugggaggggauugucuuugcuuucuuugaaguuuuaauauuaaauuccacagcaguaaaucaaguuaaugaaauuagucugagaaugaaauuagaucuaagaauaguuguauguuuuuuggaugguguuggcugauaaguaauuaaugauaaggaaauuugcagcaucaccuagaauaaucugcauugauaauacuuauaaguacauuguucucauuuccuguuaugaauaauaauuauuccucuuuuuuagaugaaauuguugauacuuuaggugaaggugcuuucggaaaagugguggaaugcaucgaucauaaaguguaaguuucccuauuuuuuucuuuuuuugguuuuucaaaacaguuuauuuguguaacaucccugcuugucuuggaacucacuuuguagaccgaccagccuggccuagugcucagauugaccugccucugcuucuagaaugcuuuggaauguuuuugagacagcgucuaacuuugcaggccuggagcucucacagagaucuacuugccucuuugaguguugggaucaaagguguacaacaucgaaccuggccucuugguuuuuuguuuguuuguuugguuuugguuuuuugagacaggguuucucuguguagccguggcuguccuggaacucacucuguagaucaggcuggcuucacucuuguauuuuuuuaaacaaaaccaacuaaauaguauuugcagcuuccuggcuggagaagggacagagaguuuuaauuccuagcaccaaugaguaugagacuuguuuuuucuuuuuucuuuuuugguuuuucgagacaggguuucucuguguagcucuggcuguccuggaacucaauuuguagaccaggcuggccucgaacucagaaauucgccugccucugccucccaagugcugggauuaaaggcgugcgccaucacgcccggcuguuuuucauuagaugaauugucaugacagagcugggugucauaggugugauuauucggguccaucaagcuucauuagugcuuuucacaccacucaacccauguuggugaucagaccuagggauucaacaugcuaaugacagugauuuuuauuucuaauugugugugcacucaugcauaggaguacagaggccagaagaauguguccaggaugcaggugguugugaguugggcugccuggugcagauacugggaguugaauucuggacuucuguaagaccaguacauggcuguuuuuguguuuucucuguaucuuuauuuuuuauacuuuggaauaaaugaaacuuuuuugagggacuugcuggggaccugccaguagucuacuaagggcaugaaaacuuuuaauacaguuuaaagcuuaggccuuuagcagaggcagucucccagcugcucuuuacuuuguuucuucugguuuuuccagacaggguuucucuguagcccuggcuguccuggaacucaauuuguagaccaggcuggccucgaacucagaaauccuccugccucugccugucaagugcugguauuaaaggcaugugccaccacugccaggcucagcugcucuuuacuuaaccugacuauucuagcacuuguccugccagcaggcuaucuguuuaccuaccuauucuguucccuucaguguccuuuacaauucugcuuuugagucucaaaccucucuggcugcucugccuugguacuucuugcccuagcuauuggcagucaguucuuuauuacaguuagcagggagacagcacgugauacaucucuuagauuggugauacaucucuuagauugccuuuaggcagguaaggaaggacaaagguuacaaauugaaaacccagugaugagaaaaccuggugaugagccauagagaugacaguaccaaaauucugccagcauugagcucugugccaguacagaauuaacaguugaaaauacaaacaccuuaauacuauaaauacuuguauguguuuaguucugggaaaaguccaugggaccuuguucaucuaaagcaaccacuuugaucagcuauacauuuucugccccaagaguagcaaaaacuuucuaaaugaguugaguugagaccuagcaccaacuuuucugauaaccuggaacaaagauuugagauaguauuugacacaguggugggcaauauaggaaacaaacugcauuuguuuugagucuuagaaaacagguugagggguuggagagauggcucaagugguuaagagaacggacugcuccugaguucaaauuccaacaaccacauggugguucacaccaucuguaaugagaucugacgcccucuuuugguacuuagauauaauaauaaaucuuuuuuaaaaaaagaagacagauugagauaguguuuuuuuuuuuuuuuuggguuuuuuuuuuuuuuugguuuuuuuuuuuuuuuugguuuuucgagacaggguuucucuguauagcccuggcuauccuggagcucacuuuguagaccaggcuggccucgaacucagaaauccgccugccuccaccucccuagugcugagauuaaaggugugcaccaccacugccuggcaucuaucaccuuuuaaaacuuacuuuuauuuucuuuaacaggggagguagacguguagcaguaaaaauaguuaaaaauguggauagauacugugaagcugcucaaucggaaauacaaguuuuggaacacuugaauacaacagacccccauaguacuuuguaaguaucacauuaaaacuugaaauagagagguuugaauuguaagcccuauuauugaguuguuuuguuuuuuuaacguguuuauagccguuguguccagauguuggagugguuugagcaucgaggucacauuugcauuguguuugaacuucuggggcuuaguacuuaugauuucauuaaggaaaacaguuuucugccguuucgaauggaucauaucaggaagauggcauaucaaauaugcaaaucuguaaacuguaaguucuugauauuucuuguaaaauuugaguuugagacuaaugucagacuaauuuggaucuuuaaaaaaaagaaucuggugggacucuagggacucuagcucagugacagaaaugaggccuuuuuguucuguccccaugacuacagaagacuagaagaugagaucuacugugggauuuaaaagccuagccugagaguauauacagacuaauugggggauuggaugcugauuaaguuagcaagcuuguuaagagugguuuaaaaggucaggggaugguagacaccuuuaacuccccagcauuuccaaggcagaggcaggcggaucucugaguucaaggcuagcaggugccauaaaacccuuuugaagaagaagaaaaaaaaaagauuugaauauaccucuuaauagcuauaguugacaauaggggugggaggaagacuuaaucgcacauccuuggguucaaucuccagagaagagaaauuauuguaaaguaauauuuaguugcuuacaaguugcuggucuguaguauuuaauucagugaacagaaagcuagacuugugggcuggagacaucucuuagcgguuaagagcacugacugcucuuccagaggcccugaguucaaaucccagcaaccacaugguggcucacaaccaucuguaaugcagcccaaugugucuaaaauacagcuacaguguacuacucauauauaaaauaaauaguuuuuuuaaaaaacaggaagaaagcugggagugugguuaaguggguguuggcucagcaugugcagagccuggguuggaucuccagcaacguguaaguugggcauguugaugcaugccucuaauuuuuagcccuagcagauggcaaaaacaauaacaaaaaaaaaccaaaagcaaacagaauuucuaaaaaaaagauucauuuacuuaauguaugaguauucuaucugcauguaaaccugugugccagagagagcaucagauccuacuauagaugguugugaaucaccauguguuugcugagaauuaaacucaagaccagaagagcgaccaucuuaacuguugagucaucucuccagccccaaaagaucagaauuuucaaguaguuuuuuaaucuaaguuugaggccaucuuuuuaucucaaaacaaaagguaaaagguguaugcauaagacugauuuagccuagaguccuaaaaaaauuuaaaugcaacaaaucucaguuugguuuuugugguguuuuuuuuguuuuuuuuuuuuuuuucuuuuaaagauuuauuuauuuuauucauaugaguacacuguagccuucuucaguuacaccagaagagggcgucugaucccauuacagaugguugugagcuaccaugugguugcugggccuccuacccccaaacaagauauguaaaccagaaauacccuguugucauugucuuaauuggcaacccucugaguuuuuuucuuuuaaguacugggauuacugauggaagccaauauuuucaguuccuuucuuguuacugagaaacauagucucauugugcagucuagggcaaccuuguacucuguccuaguucuaagauuguagugcuacuaacuacacccagcaucacuagaguuggcaauguuaguguuucaguccucaaugauuugagacaaucugauugucucaggauagcuucagaucucaguauccugcccuaguagcuaucuaccaccugaauguuguggauagaaccuuguauggauggaaagcauuuauuaucagacauagauccucacaccuucucuggugaauucguuacuggacuaagauuuuugauuacuuucuacauuauauaagaagacaccaaaggagguuuuuguuuuguuuuguuuuuuguuuuuuuccuuguguuuaauuuuguuauuuucaugugugcacaacaugauuguaggguuucagaccccccuggcauugagauuucaguugguuaugccacuuaauaugggugcuggaacuugaacccaggucuuugaauaauaguaguccauguccaugccacugagcaaucugaccagaccaucuuguugguucugacaaucucagccaggccggguggugaacaucuuuacucacagccaggccagacuguuccacaggggaaguauuaggaaagcccagggcuagagagacccuuucacaaagaggacucauucaguacccuaccuaggcuagucuuagacuuagauuuucaugugucagcuuuuuuacugcuuugauuauaggcacauguuacaauuuagggcuuaugauuuuguuuugauauuugagacugauuauguguacuuucuccaguuuugcauaguaauaaauugacucauacagacuugaagccugaaaacaucuuauuugugaagucugacuacacagaggcuuauaaucccaaaauggugagcacuuacagcgugauuaucauggugcuauugaauacuuuguuucaguaguauggcuuuauaacuugucgcuuuugcuuuucagaaacgugaugaacguacuauaguaaauccagauauuaaagugguggacuuuggaagugcaacauaugaugaugaacaccacagcacauugguaucuacaagacauuauagagcaccggaaguuauuuuagguuaguacuugguaugcugaaacaaccuacacugcuauauugaauccaauaaaaauuuguaguuugggguguuauuuguaugacugcuuuaugguuuuuucaaggcaggguaucucuauguagcccuggcuguccuggaacucacucuguggaccaggcuggccuugaacucagaaaucugccugcuucugccucccaaguguugggauuaaaggugugugccgccaccgccuggcuuauaugacuguucuguugaucauuuucuccuuaaauaauacuccagacuaaggaauguagcucagugguacagcucuugccuaagcuuuuaucaugaaaaaaagaaaauagacaacaguauuagaaauuauguugagaaucuucaaauugcugggcaugguggcacaugucuuuaauuagagguugguagauucuuugaguuagaagccagccugagccacauagugagauccuguuccaaaaacagaugguugauaucucaacuaaucagcugugaaacuagcaagugaugcuuagccuuaaaaaugagauuguuuuugagaaauguguuguugagugggcauuuuguaaucuuagucaacuccagguauguugucugcucaauacuaacccgaccuacacaugcagaaucggacgugaaaagaguguacuuuaaagaaagaacaaauuguauuggcuaccaugcaucuaaguauggcagagagacgauaugguguaauccaguagugcucuugguguggugaagaaaaugaaaaugcaagauuaaucaagcaccuugcacacugugcucagggcauuucaguaaauucagaacauggugggcuguccuagccuaacucgcucugaggauuucuacacugacauugugcuuugcuuugcagcccucggguggucacagccaugugaugucuggagcauaggauguauucuuaucgaguauuaucuuggauuuacaguuuuuccgguaagugacaaagaauggugugcuuuaguggcucugaauuaaaaagugccuauuuauguaaacuacucuaaagaauguauuuacagaacagggguggguuuuuuuucaguuagauuaauaaagcacaagaaauuaaaauuguguacuuugccuuaggcagcuuuacgacuauuguaagcaguugucuccagcuauuuagggaagaugaggugcaagcuugaggcguaugauccuuuguuuuccugcaguugagccgggugucauuuugaugguugucauguaugugacuuugaacagcuagaacuggagaaccaauuguuaaauggggcacacaguauaagguaacaaauguuuuuauuucagacucaugauagcagggaacauuuagcaaugauggaaaggauucuuggaccacuaccaaagcacaugauacagaaaaccagguauguuuuacuugagccacggcaucuauaguaguaccacuggauuuugauuggaacuuuuauuuauuuauuuuuuaagcuauuuguuccuuugcucuaacuuucuagaaaaagauuagauagucuaauauccuaauacaaaucuuuaccuuugcuauuuugacuuuggggaagucagcaugguaaaugugaacauuuaacuguuuuaggaaacgcagauauuuccaucaugaucgauuagauugggaugaacacaguucugcuggcagauauguuucucggcgcuguaaaccucugaagguaggccuuggauacucuuuaaccaggacaugcaugcuaccacuuuugggcuauagagaauccugauuguuacagucugcugaccuucacccucugaaggucucuguuucugguuuugaauugcuuuuugagauggggucuuguucagggacauaaaaauauguaguccaggauggccucagaaauuuucaucgaccuccaaaagagaggccugguaaccuggcaucccaugauuguaaaugguuccuucuguuuuuauguuagaagaaagugcagcaguaagaaauguuugucuuucuguuucaggaguuuaugcuaucucaggaugccgaacaugagcuucucuuugaccucauugggaaaauguuggaguaugaucccgccaaaagaauuacucucaaagaagcccuaaagcauccuuucuuuuacccacuuaaaaagcauacgugauuuauaaacacagugcucugaaaggaaucuuacagacuguaucagucuagcuuuuaauuaaguuauuuuguauagcuuaauuuguaaaacauuuuauguuuuuuagaugcuuuauuaaauacauggccaaaccaaauaacaucuuucaguaauuauagaaugauuuauuuggaauaaaauuugugcuuaugaauguauaaaggucuauagcuugguguacggucuuucuacaguaagucugaagauagcucugccuuuguauguacgugggcauuuucaccuacauguaugccugccccacauauuugcaggccagaaaagggugcuggaaaucaaacuugggcccucuagagaacagcagccaguucucuucuccagacccaacuuuguuuacauuuuuaggagauuuuuuagugaguauuggggcauccuuucucuaaguuaaaagauuuuauuuuccuuuuauucuugcucaaguuuaguacugcuguuuucuggucuguauggugguguguucuccuuguuaacucuuacucuucaggcuaagaaaugaacucuaaagucuuuguagccaucgugaggcagauguucggguacccuuguucauguaucuguacaccugcaugugcaagugccuguggaggcugagguaaccuagucugccucaauggcccucugcuuacacaugcagaugggguaugcgaauccugugcuuuaucaggacuucaccaagccucaauuccauggacuuuauuuauuauuuaauuuugguguuucuuuuaaaaauugagcaggccucagugacauuugcugauagguuggauaacccgaguuugagcucuggaagcaaacagugucaggaaagagccagcucuggggugguucuuuaacuucuacaugggcacauacacaggauacuuuuuuaaaugaguugaaaaugccuagagaggcuuuaagaauugcaggucacuuuacaaauccucuugcugcccagaggauuccaacuccaaguggagacccuaaagguaaaacuacuuaaguaauaaaaccuugccguggggcuggggaaguguacacaugcacacgagagaaugagaugcucagugccuguuaaaagcuccaaaggcaggagcuugaguggagcugaaaacggcaaacuucgaagagucugucuccaaucaguuugauucugggccaugccugagagcacagggaagacacggcacacgcugcauagauggcccugaguacagcguguccagcugaaacacuagcauuuuuagauugauucuacagucauuucacaguugauucacucuaaagacagaaaucaugcugggugcuggugaugcaggagagccuggucuacagaguuaagggcagccagggcuacacagagaaaaaagguagaaaauaggaacuauaggaauaggcaauugacuguccaguugcuauucuuuuuccccccuaggcauagcauuguguguucccauaaucauacugcauagcauucagugauauuguucaugucuuuaguugguagcuuuucucaagugguaaucauuuauuuagucguuuuccuuuccuuuuguugaucccagggauuaagcaagugcucuacugcugagucacccuuguagcuuaguuauuuucuguuacaauaauucaguauuaaauagagguagucuuuuauaaaagucaacugugaaggcuuaguaugcuggcacauacauguaaucccaguacucagaagauggaagcuggaggaucauggguucuaggccauccuggaucacuuaaaaagcaaaacgauccugucucaaggcaguaagguggagcucuacagaccaagacaaccccagccugcucugaccuccgcauggugugcauacacacaaaucauacaaaacaccaaaaccccaguuuccugggcauagacguguuuggaaaucauuguuaugguugaacaggaucaugacaaauaaaaaaacagcuugacuggaguugag

SEQ ID NO: 172 - RNA, 15123 nt, Mus musculus
ucugcuuccgacuccaggccgcugugugaaguugggcggaauugguccugugcguucugcuucccacuccaggccgcuguaugaaguugcugggcgacagcggguucugcuucuuagugagguuguggguagagcucucaggggccgaggggugaggugcgugguccuccgaguccuagucggugugaugaggagagacugacgggagaguagggcguccccugcggagggcuccgggcuucacuucuguggcgcacagacacgccuuuggaacccgcaggcaugccggcccuuguaguugaggcuuuuccguucccgcagcaguggugcugagcgcagugggugagugugggggaaaggcuuuuauccuuuucuccgugcacucaaacgccugcugcgccccacguuggugcaaauuuauuucuugggauccucguggugaacucucgggcuggagaugguauuccugggacuuuuaaauacgauugauaaguuagcaagauguggcguuugggaaaaaacaaaacaaaagugugaaguauagaaauguauuguacagacgucuuaaguaaaguaggugucccggguaaagggagcuccaagugccuaucuagagcacuagaccuggagguggggcuaugccucccuugcagaaagccuugaagaaaaugaguaaaguaagugcgcacugggguggcuuguugcauuggguaggaucaacacuuuuaugauaggauuuucauuuagaggaugcuagucuaagcuuuucguuguaaaucuaccauaaagaugaacaaguauggugggaacuugauaggguaaagugaacuaauuccucucucuuguaggagauuugaaaaauuaaacagugcuuccuagaaccaucaagaaggaaaauggugaguauguaucauagaauuauucuaacugggugguugguugcuuguuucuaaccccuuuggguucccuggagcuggagacacaagcagaugugggugcugggaacugaacaggcccugcugcaaaagcaacaaguccugguaccugccaagccugcccucucagccgcccauuacaugguuuuuaauuuguguguguguguguguguguguguguguguguguguuuugguuuuuugagacaggguuucucuguguagcccuugcugucguggaacucacucuguagaccaggcuggccucaaacucagaaauccgccugucucugccucccaagugcuaggauuaaaggcaugugccuccacgacuggcuguuuuuuaauuuuuaaugaauauuuuuuuggaggaagucagacaggauagugaguguguagcucaguggcagagugcguuccuaggauaaggaaggagaggggaagggaggggauguggcgagggagagacuguguguaccaguauagagggaacaaaguagaauaaacaaguggacaugaucauuacaacguuacccugcugguguggucccagcacucaggagguaaccuugcucccagccucuauaggccgucgcagucucagaccuuucauuaaaagacacaaaaggaaauaaacgagcaaacagugugcccuuuccccgcagagaugagcagcacagguagaauagcagggaguguagcuccuguguccacugaagcaccccacucaccuccacccuggcccacucacugcgggacacuguuguaagaagacaggcacaugcauacacuagcaagauuuugcugaaaggacccugauauagcugucucuugugagacuaggccggggccuagcaaacacauaaguagaugcucacagucagcuauuggauggagcacagggcccccaauggaggagcuagagaaaguauccaaggagcuaaagagaucugcaacccuguaggugcaacaacauuaugaacuaaccaguaccccggagcucuugacucuagcugcauauguaucaaaagauggccuagucggccaucacuggaaagagaggcccauuggacacgcaaacuuuauauaccccaguacaggggaaugccaaggccaaaaaaugggaauggguggguagggaaguggggggggggauaugggggacuuuugggauagcauucuaaauauaauugaggaaaauacguaauaauaaaaaauauuuaaaaaaaaaaaaagaagaagaagaagacaggcacaggagcuggggcaggaagacugcuccugcugcaacccuggcugcacagcaagauuugacucaaaaaaaggggggaggggugaggggaagccuccaaauaguuuucuucaucucugagguaaagauguggauaacaaguaaaggucccaagcaacagauaccacaagaaaaggaagaggccuucgagaaagcacuguggccaguaggucuuggaaaugccgacaaauuuggauuguugucuuuaguaaaugaaguaauugcuuuuuuagcccauuuccuuaaagucaaacuacccaaaagaaauaguggaaacuguuuggaaaacaucaacuuauuaacauuuuuucaguuaaauauuugugauguugagacauaaaaauuaggaauagguguaaccauuguucucaacucaugaaaaauucaagguaaaacuaauuauuucuacuacaauguuugcaucuagaauuuagcagagaugccgcuuuucaucuguauacgucuucaagagauguucuuccugcuauugaaauuaauuuggagaaauaagugcgacuuaucuauuagagcugcuuuaugugaacaagccaucuuuaaugucuuuaaucagauugccaacuugaauauccagucaaagaaauaauacagaaccuauaguuacuggaagaaauaucucuuguuuucauauucuccuucuuuuagucugugacacugcauacagaugugggagauaucaagauagaagucuucugugagagaacacccaaaacaugugaggugaguaucauugcauauuaaaauucaaguaaugagguaguacaugacuuuaaucccagcacucaggaagcagagucuaguggaucucuugaguucgaggccagccuggucuacagagugaguucuaagccagacagagcuacagagugagaccuguccuuaaaacaaacaaaacaacaacauaaacacacuaauauaacaggaugacaguucuuucuuuauccugacuggcucccaaauaaaugaggcagaagauuuauuuaaucaagcuuuauggcacaauagcugagcuguauaauccauuuuaguccucuaaacuaauauggcuaccucccagcucaaauccccaagccacuuucaucucaguauuggucuggaucucugcuccaggcguguucccauggugucgccucaaccgucuccucgcagugaauccucuucuccucugucucuccugcuccccuggcugggaucagaaguccagcccuguucucuccucugcucagccauuggcugaccagcuuuuauggacaaauuagagaauaaauggagagcgauguuuacaccacacugagaccagagauucuuagaauaagcauuacgaugccaugucaggauugcaggcagauaugggggcagagaaaucagcaaucgaauaauauaagaauaauuuuuacacagugccuuuugaaauugaauuauuuaaauaaauaaaauuucugugaacccacugucaggaaaagcuuauccuaauuucaggucugucuggugucagaguuaaauaagagaaaggaggaugagacuggggcaauuacucagcagagaagaguguuugcuaugcaagcauaaagaacagaguucaaauucccagaauccauagagaauacuggguguggucacacuggccuguaaucccagugccagggggugggacaaagacaagaggacuccuggggcuuccuggacaguagccagcuccagguucagugagagacccugucucagagggauucucaacuuucucuugcuucugcuuaugcacaaaggcucgcuuaccucacacaugcguguacacaccacaggugcaccacacauacaaaggaaauauaaauagguaggugcuucuccuguaaccaucaaguauccaguaucuuuuuuucuucuuuugccucauuuguuuucagaaacuuugacuacuuaaucuguugaaaugacaaggauaaaaggaagaagagucaacuauuuuucauucaugcaauuauuuguuaaaaggcuauccagccaugucuagggaacagugacgagcaagggacagucacugcccucauucacuccagcugugaaugaagacgagcagcaaguuaagugacugcaaaagagcagaaugccuuaagcugcagagagugcagggcggagcaugcagggcuccugggaccagcugaaaccugacuauuuuaucccaagagcugauccuaacagucguaguuaaaugugcuacaauaguguuuucagugaccauaacuggaccuuuauuucaaauauguuucuucccaagcuauuucucaaucacuguuuuuauucucuucagaauuucuuggcucuuugugccaguaauuacuacaacggcuguguguuucauagaaauaucaagggcuucaugguucaaacaggagauccaacagguaaguuuguccacuaacugaaauuaggaaaauuggauauagcauaugaaaaagagauguguaaaauaguugaaaaauaaagugccuuauaacaggacuacuuugacaauagcagaaaaguuuaggaauuuguuucaaagauauauuuacuuuuaagaguuuuaccugcaugugugcaaggacucuacaugcauaccuggugacuccugagccaacauuggcauucuggaaacugaacugaacccagguccuuuguaaaagcaguguucuuucuuuguuacagcauuucucccuccccuucagccccuccaaaccuuccaauguacucacccaucuuugaucuccuucaaacucauggaguccuuuugcaucaguugucauugcauggauauauguuuuuguacauauugucccuguuaauuuuaugucaacuugauacaacauagagcagugguucucaaccugugggucacagcccuuuucuaggugaaguuuucauggggauugcuuaagaccauuggaaaacacagauaccuacauuaagauuucuaacaguagcaaaauugguugugaaguagcaacaaaaguaauuuuauaguuaggggucaccacaauaugugggacuguauuaaaggaucuuagcauuagguaggcugagaaacccugagcuagagucaucagagaagagggagccucacuuguugcuaacaaaauguuaacaucaggcuguaggcaagacuuguaggguauuuucuuaaucagugauugaugugggaggacccagcccauuguggguggggccauccuagggccugugguucuauaaggaagcagacugagcaagacagaagcagcacccuccauggcaucugcaucagcuccugccuccagcuuucuugaauccuuaacacacugcuuuuccuuuucucucucucuuuuuuuaucuuuuuauuuauuuuauuucuuuugguuuuucaagacaggguuucucuguguaguccuggcugucauggaacucgaucuguacgccaggcuggccucaaacucagaaagaucucucugccucugcuuccugaguguugggacuaaagaugugcgccaccaucacccggcuacccacacugcuuuugaugaugaacuguuauauggaauugugagugagagaaacuauuuccucuaccccaaguugcuuuuggucaugguguuucaucgcagccauuguaaccuguuaagacacauauauuccuagaugugaccuguugagucagacauacaugucaccuguauguaugucuucaaagcuaagcaguuggcaguggauaacggauugcugugcucuuccuggggacaccuuuccugcucucacauuacuccauucccuguaguucuuuguguaggguuaaguccucaaggacauuuccccaugcaguuuggucuugucuccuccuugugcagcucaucaaguguuugcuuuuugguuuggggggauuuuuguuuuguuugacacaggguuucucuguguguagcccuggcuauccuggaacaacuucuguagaccagauuagccucaaacucacaagagauccaccugcuccugcauucugugaaucagcaaguauucuuaacagcugagccaugaaacaggguuucaucauauaacccagauuugccucaaacucaacaauccuccugccucucuaccuuaugggugcugggaaugcaggcaugcaccaucauacauuaagaaauuaaugaacuugcuuuugguucagccagcagcaauuuuuuuuuuuuuuuuuuuuuuagaaaaaggagguauuagcccauagcuauaaaauaugagcaguauuaaugaggaggguuuucucuuuguuaugaggcugcuagaagccagcugguguaugacagacaacagacucuugucuuggguacuuggaaggcugaaacaugagcacuauaaguucacggucaaccaggauaacuuaaggaaauucuaccucaaaauauuaguuuaaaaaaaaaugggaaugcuggagauacguaacucauugguagacacuugaauagcauacaucaaguccuguguucaaacuucuaaacgauuucucucucuuacacacacacuuaguuauauuuaaaaaguucagcuagggcuggagauuaccucugugguagugcacuugccuagcauggcacauaccuuuaaucccagcacuugggaggcagagacaggcagauuuuuuaguucaaggccagccuggucuacagagugaguuccaggacagccagggcuauacagagaaacccugucucgaaacaccccccuaccaccaaaaaacaaaaacaaauaaagcacuccuccuacuugaauaauggaguuccccuugaaagcuaauuagaugccacuuggcuugcuugucuuguuauacagguacuggaagaggagguagcagcaucugggccaaaaaguuugaggaugaauacagugaauaucugaagguauaucccugugauuccaguuacacuugaaaacuuuuuauauaugaugucacacaucaauaucaucaugagcuagguguggugguacacacccuuagucccuacacaugagaggcaacagcagauggaucucugugaguucaaggccaguuuggucuacacagugaguuccaggacagccaaggcuaucucaaaucauuauaaaauaaauauacuuucuuguaguguuuguacacuuggugaugucagaguugaacuaaucaacaguuguagccuggcuaaaacuggcucuggagucaugcaucucugcacugggaugaaagagcuuauccuugaguccaacuugaaguauuucggggcuggggagauggcucagcagguaagagcaccaacggcucuucagagguccugaguucaaaucccagcaaccacaugguggcucacaaccaucuguaaugggaucugaugcccuugucugguguaucugaggggagugacaguguacucacauaaaauaaauaaauaaaucuuaaaaaaaaaaaguauuuagcaagacauauaggaagggcuuaccaucucaccacggaguuugaguuaacugacaugagccacuggccuuuugaagaucuguguagccuuggcuggccucaaacucaugguggucugccugcuuugacugcgagugcuaggauuaaaggggugcaccuccaugccuggucucucacggccguucucgaugagggaaggaaagacuggguugcaguauuaaccaucaucacucucuguuuuuauuuuuugaagacuuauuuucacaauuuuuaauuaucuaugugugugcguguuucaaaaugucacuaugugcccaugagugcagaugccucagagaccuggaguucagcagagcugcaguaacagcuaguugugagcugugugguaugggugcugggacccuaacugggguccugggagagcauuacuaaucaugagccacauccccagccccggcgccaacuuuucuacuucucuauuagacacuuggauaugccuguauuaucuuuacuucauacuugcacugagaagugcguauaaagaaucaguuacuagggagcuggagagaugguucagugguuaagaacacugacuccucuuccauaggcccugaguucaauucccugcaaccacaugguguggcucaaaauggugugucugaagacagugacaauguacucacauacauaaaauaaguaaaucuuuaaaaaggaaggaggaggagaagaaucaguuacuagggcuggcaggaugucucagugguuaagggcacugacugcccuucuagaggacccagguucaacucccaacauucacauagcuccucacaucuguaacuccaguuccagagaacccaacucccuguuuuggccucuacggauacuacauacuccugauacacacacacacacauugauucaagcaaaacacucauaaacuguaaaaauuaaaaaguaaauaaacuuuuuuuuuuuuuuaguuuuucaaacaggguuucuuuauguaguuauggcugcccuaaaacuugcucuauagaccagaucucuugaacgcagagaucccccugccucugccucccgagugcugggauuaaaggugcaugccauauaccuaaaggcuagcaccagaucuggugaccuauguugauaagcaaaugcugaagaaaauaagacaggggggcuggagagauggcucaguggguaagagcacccgacugcucuuccgaagguccgaaguucaaaucccagcaaccacaugguggcucacaaccaucuguaacaagaucugaugcccucuucuggagugucugaagacagcuacaguguacuuacauauaauaaauaaauaaauaaauaaauaaauaaauagaaaauaagacagaaggguuacuaauuugagaccagucuaagcuauaucuuucuccugaccuggggauguagcucaguggauagaaugcuugacuggcagguagaaagccuugggcucagucccuagagaaacaagaugaagccauggugaugauaccugaaauuucagcaucccagagguugagagaggcaggaaggucagacaucuaaggccagucucaacuacagaaugaaucaaaugaguuggugaaucaaaugaguuggugauggguauucaagguucacaaucuauauaugccagaggagcucuuguacauauacuccaaucuuguagacauacuccuagggacacaggcccauuaauuaucaaaugacauuuuagcauauucaguagugacaaagcauacugcagucuuuguacuguguggcucaggugggucuugaacuccuaccucagcuccccauaugcuaagauucuaggcaugugccaccacaccugaacaguacucaucugucaccgauguaauaauguauuauuuagauguagcuggccgggcgugguggcacacugcaccucccuagcuuuucuagcuagugacaccugaccaacagcuaaugcuagauuaaucagcaguuagcuauguuuuacugcuguugaguggcuaccacuuuauggcacagcuucauuuauuuuagugagauacuuucaauucuucuuuaccaugccuuauaaauuaguaguauugaugauaauagaacuaggugagaccucaggucaaccaguccugggcuaauaaauugauucaguggccauggaggaagauucaaggaugcauucuuuuuuuuuuuuuaauauuuuauuuauuuauuuauuauauguaaguacauucagacacuccagaagagggcaucagauuuuguuacggaugguugugagccaccaugugguugcugggauuugaacucaguaccuuuggaagagcagucggcgcucuuaaccgcugagccaucucaccagcccucaaggaugcauucuuuaugaccauuaagagaagaaaucugggggcuggagagaugacucagcaguuaagagcacugagugcucucccagagguccugaguucaaaucccagcaaccacaugguggcucacaaccaucuguagagggucccgaugcccucuucuggugugucugaagacaucgacagugugcucauauacauaaaauaaauaaaucuuuuuuaaaaagaaaaagaaaagaaauucuugggcaggagagauacacuguugaacuugucagcucuaucucugcucaguuguuaguuugcuaucugcucaacucuugugagcaucugcaucuugaagugguccaacucccuuguuuuucagauuaagaagcuagccuaguguauuugagaagagauuuggaggauuugggguuugcugccugauuauuuuuucauuguagugcacuauuccuuaauauaagaguaaggacuggggcuggugagauggcucaguggguaagagcacccgacugcucuuccgaagguccugaguucaaaucccagcaaccacaagguggcucacagccaucuguaacaagaucugacccccucuucuggagugucugaagacagcuacaguguacuuacauauaauaaauaaauaaaucuuuaaaaaaaaaaaagaguaaggacuguuucuguuauacacagaaauaaaagugucugugacugcuucuucaaaaugaaaaugagaugcacuggaggaugugauaauuauuuaagcaaauuauaugcuggguuuuaguaauucagauaauacauagccugcacauuuugauuaauacuaauagagaagcaagcggaaucaugucuuaguccccugaauauugaguaagccgagaguucaguuugccuuuggaaucugcaguuaacagcacagucaaauuaaugccuugguuuuucuuuuuuagcacaauguucgagguguuguaucuauggcuaauaauggcccaaauaccaauggaucucaguucuucaucaccuauggcaagcagccacacuuggacaugaaauauacaguguuuggaaagugagugcugucaucucuuucuuuggcauguuggcguucuugcauggugugaucacagcauagcuaacacuggaaagaccaguuccacaacuaaacgcccuggacaccccagucaucagccaucagccccugaggaaguuauccuucuuucuucccucccuuccucucccuccucucccuccuucuccucucccuccuccuuuuuuaaagaguuaaaaaagaaagaacuuccccaaaaggucuagaacuuguugauguggccgcaccuugccugcagguagagugggugauguuucucagcugugccuucagggaagugucccugaucagauccgagguguacaguguacaguguaccugaucagauccgagguguacaguguacagugucccugaucagauccgaggagcuguuuggcagcucuugcuuaauuaugcguuauaaacauucaaccuuaaagccacuuuuauaauucauuaggagguaaaauguauccaucaacaugugucugucacauucaguaauaaaaaacuacacggcccuggaguaccaggacauauuuguuugguuuuaacaagauuuuuaaaacaauguagcccagacuuuccucucuaaugguccuccuggcucagccuucccugugcugagaugaacagguagagucaccuugcuuggcuagaguuuuauugagaaguuuggauguuaaguuagguuuaaaaauuagacacuccucuguuuacaugaguuccaaacaccugugucuagcuuagcauauaauuaaugcagcaacuggagcauuaggcugaaggcaucuaaucaucuucacaagugcagaccaacacccuaaaacuaaaggguagccuuuaguucauggauuacuugguucuuaggggcuuuuuuuuuccucaauuuuauuuauaugauugaauguauauucacugugugcaugccugguaccugcggaggucagaagaggguuuugggucccuuagaacugaagcugugagcagccguguggugcugggaaccaaacccagguccucgguaagagcagcaagugcccuuaaccaauuugcucucucuagaacccuaaacuacuugaaguuguauuucuacgcacauuuuucuggaaagaaaacauauaaguuuucugugguuuccuaaggaccucaucgucucgauuccuggccuacaagucugcgcccccauuuauuuauuuuuuuuuuuugcagaagcucagaauuucugaaguucucugguuuucauauagaccagaagacaauuuauagaccuuaauugucuugacauaggaguacauuuaaaaggugugguuguugagguuauccccuccaggaauucuucuuccgugcuucucuuguauuuuguguuuguuuuguuuaagcgagggucucacugcggagccccagcugacauggaacucacuauguagaucaggauggccuugaacucacagauaagcgccugccucugccuccuccuuccaagugcugggguuaagcaagugcacuaaaccuagcugcucauuuccauguucuucuguagcuuaguggaaaugcaaaauguaacucuguuucguuuguuuuguuugguuuuuguuuuuaaaguacacguuucaugaaguuggagaaauggcucauaaguuaaaagcacuggcugcucuuccacaggaccaggguucaauucccagaaccuacacaguagcuuccaaccucuguaaccccaguuccuggggaacuaacacccucuucuggcuggcuuccugggguacugcauacaugugguuuacaggcauaugugcuggcaaaacaugcauacacauaagauaaaaauuuaaguucauauauaaacccugaugccugcuuugcauugcauugaagcaccauuuucccucaguaacugcauuggcucagauuccaaccaugguuucuauucuuuuuuuuuuuuuucuuuuuucuuuuuuuuaacuauaaggcuucuucgacccacaauuguacaaguuucaguccaugaugauuuguuccagugcuuugucguguuuagcgaaucauggaagcaugugguguaccaacgcuguucacuucauggccaagaagcaaaagaaagaggaaaagauacagucccacaauuccccuuaagagcauaacccugccaggugugguggcacacgucuuuaaucccagcacucgggaagcagaggcaggcagauuucugaguucgaggccagccuggucuacagagugaguuccacaacagccagggcuacacagagaaacccugucuugaaaaaccaaaaaaaaaaaaaggcauaacccuaugacccaaacaaagaccucccuccaugcaccccaccccugucuccuccaccuccgugggugcgugcgugcucaaguguacagaugagaauguucaugagugugaaaaccaggugucuuccuuaaucucucacuggucuggagcugcuucagcuagccagcaagccccagggauccuccuguguccacucagccagcucugggauuauagaugcuaggguuaaacucacacccucacacuugcccagaagcuaucuccccaagcccucggcccuagcccuuaaaggcuugugcaccucccaguagccccaaacuggggaccaaaccuucagcauguggaccucugagggacacucaaguuccaaaccaaagcagcaaguaaguacacguguacuugaggucacccaguuaucgugagaaaggccuggggagguguguguccuaagccuccugaaucagggccacaggacugucuuggucuuuugugcaugagaccagccuuuaugcuccacuuugccacuuggguccaggacacacaauccaaccaggccacaugaguguaaaggaaggcagaggagcgcacucuccucugaaggcuguaauugcuguagauacuuuauauuucaagugagggauuuuuuacaugcugugcuguuucuauuucaggguaauagauggucuggagacuuuggaugaguuggagaaguuaccaguaaaugagaagacauacagaccucuuaaugauguacacauuaaggacauaacuauucaugccaacccauuugcucaguagcugucauggaccuggacagauacuuggugaacacuucacuggaacacgcccauugugguuuaaccaguucuccuucuccugguguuugcaggaaugggcuccauguaggagcccuguagcuucccucccaucugagcauauucucugccacugcuguuguucaguguguucacuuuaaauagaaagccaugccuuuuuuuuuuuaucacaugugaguguccuuuuuuuuaaaagauuuauuuauuauuauuauacauaaguacacuguagcugucuucagacaugccauaagagggcgucagaucucauuacgggugguugugaggcaccaugugguugcugagauuugaacucaguaccuucggaagaguugucagugcuccuacucacugagccaucuccccagcccgugaguguccauuuucaaugcugauccucaugugcaggcacuuuuuggagcaccugaauuaccacgcuagugcauaugcuggaaauacuuucccuucacuauucauguucugcagguagugggacgaaugcauggccuacuaccugguguugcucgccuuuaaucucagcaccucagagguagggggagcucugugaguuuggggcaagcuugguguacaaauugaguuccaggacagccaggacacagaguagcaucuucucaaacaaaauggaaagaaaggaagggaagagagguggagguagagagcuggccugucacaguagcacuugugacgcugagacagcaucauggauuugaagccaggcugugcuacaaagcaaauccugacucaagagaacaaagaugacagugccaaggaccauuuucu

SEQ ID NO: 173 - RNA, 27241 nt, Mus musculus
cuaacguuucaauuagguauuuuauuuaaguuaugaaucaccuuguauuacuuucagagaaaaucuuuuugguguaaaaaauacaggagcugauuuucuuccaguggaccuugggugacauacugacucacaaccauccagguuaaacaauggauucuuuugaacuccacagacuaagguguauaagcaguacacauauacacaugcaagaaaaacaagagacacauagacacacauggcccaggcagggaacuaaagcuauaguucagaagugaggcugugagcuccauccccagcacaaacaccaagugacacaagucuaauccugucucuguggaggaaguucaaugucacucuuggcuacacagugagucuacgcaauaagaccuugucucaaaaaccacacaucaagaguagugaaugauaaaaaucacaaccaccuucguccuucugaagcagauagcagaauguucucaguuuuaaaacucgagaaggcaagggaaacauaagaucuuaaauuggucugucuaaucaccaccuuccaaaaagcuauuuaaaacuuuggaauuuccaauucccggcaacucacuuuucaacaauaacaauaccuagucugauguuaaguucaacauagaaagggcuaaagauucucugccuaaaauauaaagagaucacaaaacugccuuauaauacaaagaaaauauuuuauuuguguaucaaagacuaaggucaacaguugaugucaagacacaaaaaggcuugaaaagcuagauauucaaccucccuugauuauuugagagcaucugaugugcucugcucccaacugaaucguaagcaugauguguucggggacagggcuaugguuccuuuacauuagucuucagcaucuuucuucuuuuucuuuuucuucuuuuucucuggacucugaaaauaaucaagaagaaaucuuuuugaaauaguggccauuuuaaaaugaacuuuucgcuauauauuuagaacauaaauuuuguacuaaaaaaucuaaaacuguaaugucaacaaagcaagcuucaguaaaucaugaguugggggcauggugacaguacuuaccuugcauacauaaagcuuuuaguuagguucaauucuuagcacaguaaacuguuucaggguaagaaacuaaauuugagggcuugugagauagcucagcaguuaagagcugcucuucuagagguccugaguucaauucccagcaaccacaauguggcucacaaggaccugaggcccucucccagcauguagguguacaugcagacagaacacuccuacguuuaaaauaauacauaaauaaaugaauuaaaaaaaaacaaacaacuaaaauugagaacuggucucuauaauaaaaauaucauuaagcauuuuugauuuucuauuauguuuucccuaucaaacaccuggucauuucugacuaauaauacaguaccuauuauaaacaucuaugcuuaagguuuguuuuaaaugcccugaaauaaacucaaaagguaaaacaacaccaaaaucacauacaggaacugcugugcugguacauggcuccuccucggaaaguggcucuuccuuuauguguuucuuuuuauccuucuucuuuuucuucuuuacagucggcuccucuucuacuaccuguucuuccuccgccuccuccuccuccaucuccuccucuacuucagcugguguaagaauuaugauuguauuagaccuccuucuuucugucauuauagucaacucuuuuauccuugucuaauacuauuaaccuuaaaauaaucuaaacaaagcugaaauaacuuuuucacaaauagcuguuauauaauaaaagucaucauuagaacaaaggugaaaucaauuacguagccugaugguuuuggaaggucaagaagugaaaauuucuauaucuuuaccuacuuaagaauguuugauuagauuuaaaguuuugauccugaaagcagagaaauggcucaauagguaaagugccuacuauacacaagcauaaggaccuaaacuuagcucuccagcacaaggaagaaaucagauauagugcuggaaggcugcauuccaacauugggggaggagacagagguguuccuguaacuugaugguuaacuaaccuagacaauccuagagcacuaaguucagugagaugcugauguucacucuagugccuaucucuaguaucuagaaacacaugcaaaaccccagcacacccaaagagcuguuauccuuaugacuauucagugagauaggagaggcgcaaaguaaauaauauaccagacaagaaaagauaauacuaaggauaaaaaugaagcagagguuagggagauauuuaagaaggcguuauacauggaaauucaaacacaaaggucaaagaugaaggaaagugguaucaagucaagaguaugcaagaauacugugaagcauguauuuggguagaagacuugcagguguaugagagccaaagggcuaauauacaacugacauuguuaaucagguauagauagcguucuagaaccugucuugaaauacuacucugacaaugaacagcaggcugcaauuuauucuaugaaccagagaaugaagaaaaucacugcuuuaucaauccuaaagcuacccaguuccacaauaguucagcauccauacuaaagcuuuuguauauuuaguaauauacugaauucugcacacuuaaugacacauuacuuuauaaaaucuaacuuaauauucucuuaacuacccaaagaacauaaugacauauuaaaacauccguuuucaaugaaugcaauacuuaauaaagcuaugguuuaaaaaaaaagauauuugaguguauuauuauucaaagaauuaaauggaaaauagggcaucagguaaaggaauuuguggcaaggcuugugggccugcgucuguucaauuccuggacccagucacaugaugugcccuccacaagugugcugugccaugcuaccccauccauccccaacaaaaauaaauaaaaaugcaauguucuuuguuuguuuucuuuuugaaaaaucaaacuaaccuuuaauuuuaaucuuggcuuuuuuugcuuucuuuucaguaauuucauccucuuuaucuaccucuucuauuuugcguuuuuuagaacaaguuggaaguguggagucaccagagggaucguaagucuucacuucacugaaaaaaccaaauaaauuguggaaaaucuuuacaaauaccuguaacugaaauaguucaagagaaaagcaauacuguuguauaauuacaagaauacauaaugcuguuuaguucaagcagcuuuaggggacuuuaggucagucacagucaagaaaugacucuagacucuauuccacgaaaagcagcagcauuagagggggaaaugaucaagugaaccccuguccaaguaacuaaaaguaaaccugcacuaagucaaugcuuauucacauaaucccauguagacacaucuucaccacaagcuguaagugacaaagaacuuacagauccccuauaaagucaacuaaaucucaaggcuggcguguuaaguucauuuaggugcaggaaucuaaaauauucugcccaccaaaguuguaaacgaauggugguuucacuucauaaguugcaaauauuaaccauuuaauaauaaaaagcuacacacaaaaagacaacugaauggaauuuauauguucauaauuaugucauuaaauauugcugugucuauauauacccuaugauuucauugaacuccacacuuaacuagcucgggauguuagcauaugccuaaaccccagaagcugagauguugaggaagaaucauucugaauucaaggccagauaaaaggauaguaaaacagcaauaucuugccuuuucuuuaaaacaaaacaaaacaggguucucuguagcucagacuggcuuccaacuugcuaucuaggcaaauaugaacacuuuaaauuucuagccauauugccucuauuucccaagccuuucccuaaaggaccuugauacauaguaucaaguuugucaauagacaaacuacuccauuucagucaucacaacucacaauucccacuuucccuaaaacauacaaauaaggucuaaauacucuaugaugauagacuauuauuuaagucugucggggguuuuagaaaaacuuucauuauagauaccucuuuaaguuuuuaaacaaauggcacacaacagaggaagugaaaugacugaauuaaacccauguugaugaagcagcagcaguuggcagacaagaauaaaaacaucugaugccaaggccaaccuuauuucaaucccagagacuauagguuggaaggcaaaacaacucaaguuguccucugaucuccacaugagcuuuggcuuacccacauaagcacaacccccaacacauacaaauacaugcaaaaaagaaaaauuuaucuaugauaaaaacaaaaaccgugaauguggaaaacaaaauggcaaggaaaaauuauguaaggaaugcguauacagacagcaugguggugauuguaauuaagauguucccgaaaauugcucacaagaccuuaagugcuguugacacacaaaauaucuugccugucagcuugauuuagcaauucuacaacucaauacauuucucaaauuacugacaugcuaaaugugauuuuuuuaauuugcccuuuuuaaaauaucuugauuuccuguaugccugaaauuugaucaaacucagguacucugcaagaauaguauauccucugaacuacugagccauuacuccagacuucuuguuauauuaaaaaaaagaaaggaaaaagaaaaaaagaaaaagaaaaaaaaaaagaccugagcauuuugucugcauguauguaugcacauauauguacaagugugucugguugugagcaaccauauggguacugggaacaaaaacuuagguccucuaaaagaugaccugaacaaaugcuuuuaaaugcugauccaucgcucuagccccuugccaaauuucauaagaauuaguccauacugcugugucucaaguuuacaauaauaauaaugccccccaaaacaaaaaacaccugucaaaacauuuaaauuaacaaaaccaauucuuuauucuuaaaugacuuuaccuuuuguguucauacuuuucugcuuuugcuaaugccuuuccuguuccacuuauuuuucuuaucuaaaaagaaaaaugaaaauaacaucaaaaccgguaacacaucuucuacugcauauagcaugccauaguaugugauaaugguuuugcuaauuugaauaaacaugugucaaugacuaauacuauuagcacaucagcucuuaucuaagaaauaagaaaugcuguuguuaacacgaaaugcuuauagcucaugaagacagucagcaagcauuggccacaggaagaaugugguucuuaccccucuguccuccaaaauccucaaccuggccucuaauuuggcucuguucucaauucccauugcagaacuggaaucuucaccaaaagcgucguaucugauagccagaacaguuuuggcugccagcauucgagaaaucuaucaucaacaaaagcauaaaaugagaggcagcauugauucuuuucagaaaacguaaaauccucaauuguuuacucaggagaauauuauaggaaaucacauuaacauuuauucuaugccuauuaauaaaaagucgaauucagucuuucucucuaucccuuccuaccuuugacucagaagcugcuccuuuaacauuuaugguguccauuuacuauuuuguguuaguaacuguggauuucaugaaauucuaguuuaauccuacuuaauuacuuaaguaucuaguuauucuuaaguauucuaguuauacuuaaguauauacuaguuaaguaucuaguuauacuuaaguauucuaguuaaauccuacuuaaguaucuaaagaaacacacagaaauaugcaaaauuagaccuccaaaucugguuuuuagaaaaucuucaguacauuguauaugcauacaauuuacuauuauauauaaaugucaguagcagcagacuguucuuuaaaaaccguuaucuuguaacguauaaaaauaccuuuuacuuauaguaaacaaaaacuguuauuaguuuauauaguguauauaguuauuauacacuauaauuacaguaggagaaaaaaaaugaaaaaaauuaaagcucauggguaggagagaaggcuuagauauaaacacuauuugcuagucuuacugagaaccuggauguaguucauuuuagacauggcagguaacaaccccucaauucccaaguaccaagggacuugaugcucuccucuuccagccuugaacauacuauagacauauaccuauauauguacaggcaaacagccaaaaaaacauuaucuugaaaaguucaaaaaaagguagaaaaacuacaacucaccuuuccuuuguguuugggacuugacuggccuacaagagaagcaugauaaauaaguccauauuuaggugugucucgucuagauuugagggcccugaaaagugcuuuuucugcuccaagaaucugaacuguagaagcugcaugcuuggccaaauucaaaagagaaccuaaaauaaaauaaauagauaaguaaauuuaaaaaaaaaaguuuacaaaauacuuccagguauacucuggauucuauacuagaguauugauuucccugaaaacccuaaugcuucuuccuguuauuccuagugcaaggaacgcuaugaacuggagaacugaaucuguacauucaguagcaugcccacaagagugacauggacauuaauuagcaauuuggcccacccucuaagauucugaaaaucaagcaugccauagcuguagauacauuaggucauaucauuaguauugagcuggaguuuuuguuucacccucuacaggggaaugaaaucuagauguauacuaagauauucugauggauuugcugcauggaauacaguuaaaaauacauaaaacacuaaugguacaaacucaaaguccagcuggucaaugcauuucuaccacuuuucagguuaccuacuggguaaaaguaaugauaacagcccacagcaucaugaucuuauagcaaaggguaccaguauuugucugauacuacugaagaaauucuuuuagcuuuaaaagagaucugcaaagcauagacugcauugugucccauuaauacuguaauuuaaaaaauucauucaaaacuuggucuaaugaacucuuuuugauccugaggacugagcuuaagacuuaaacaugauaaugugaacuaauuuuauccuuuugaccaaggaccacggugucucagaagagguagugacugaagcugcccucauuauucaaagagaacucaggcaaagcaucagaaaucaucauugaacacauggucuuuaguccuuacaaaucacauuaaaacugucaccugcaugagcaauaagccgugcuccaacuaauucuccaaccaugacuguaacguuaggugcaauggccaucauucgauuuugcagauauucauagagcugaguccuauauucagaaauuucaauuaccuaaaguaagaauaaaauaaggaagucaaaguauacacuuaauucacuuugaaacuuuuagauuucaacauucacaaauggaaaugcacaggcaacucacugacagauccuaaaaguacagggcugagcugagauuaugugaguaugggaguuagaggcaagccugggagccugauaaaaauaagauacagagcuaucuuauaaaagcaaaaacuaaacaaaaaacuguguaacauaaaggauucacuuaucuaucucaccaugucuaccuaaauaugcacaaaaagauggcaucagaugagguagugacugaacaccuucauauauugucaggugaacaaauaagaaaaaucaucauugccaccugcaaauuaucagacuuagaccucaacugcccccuguggauguaauguaccugcguacacagauguagaauguugcaaauaucuucuucagaaaccucuguucccauagauaucucugcagcugcuuucacuucugcuucuacuuccucagacaggaauucagagagagaggcagaugcauaguucuuccuguccccuauggaauuuuugcagaugaagcagaaucauuucccagcguuaucuuuccuuauguaaaggcuuaauuuagaaauaaacuuucuucaaaaaacauccagguaaaaauaagauaaagcaucuuauaaauucacuucagaaagggugccaauugagaaugggauuaaaaauaaucucauuugaagauguaguauuuugaaacuguuuuuccccccucucucugagacaagguuauuuguauagcccugguuguccagaaacucuacagaccaggcuggugaauucagagacccuccugcuucuuccucugggaagugcuaagacugccagcuggagcucucuuucagucuaagagacaagaacuuuugcuagaccacacagccaaagcuaauaauauaccuugagauuacccugagauuaacacugcuacuguccuacucugccuguuuaaccugccuuuaauagaacaauucaauaaucaaccucauucgacuuggauuucucauguaaacaacuuuuagaaucuaauccaacgaauagcuguaaucuuuuuuuuuaaagggccagauuugaagcaagcuuuauuaaaucuggccagguccauacucaguauucccaguauauggccaaauaacuguaacuuuaaaaaucuaccauaaagcuaaaagcaacauuuuuauguauuagguaauaaacaauaaucuuggcuaucugguucaguuggauucauuaggauauugacuuuacccguuauuugcaaaguuagauauucaaaagaagccaugauuauuuaaaaaaagaaaaaaaagaaaacugaucagggcagcggugguacacaccuuuaauaccaguauucuggaggcagagauuggcaaauuugcauucgaggccagcuuggucuauagagugaguucuaguacagccaaagcuacacaaagaaacacuguuucaaaacgcagaaucaaaccaaaccacaaaguaaauguucaaauuauuuuaagauaauagauguuaguuccauuuguaauuuuuaaaaaacuucaauaaucuuaaguauuuaauacaauaccuacugagcuuuaucaaauuaauuuuuaucuauaacaaucaacucaccaacuuucuguaaacacuugcaguaugucagauuaucugaaauaauuuucccuaacucagggaaaugccagccauaccauucccuacaccgcauaauguaguuguuuaguucuuuauccaagucaucuaauaaggcuguaaaaggaaauaaaaacagaacuaaugagacugauaauaguaguuaauauacacaacagauugccuuaaagcaguuaaguaaaaauuuaguuguauaaaguacauuuaugccauauaaccauuauacccaucucuuuuuaaaauauccuccaaauugaguaucuuauacccuuuacccauggagccagguacuaaagguuuaauaccagcaaucuagagguggaugcugcaguucaaggcuaguaugaucuucauaggccagcuagacuacauaguaagaauccauuuccaaccaagcaaacaaacuaaagacaaacaauggcccagggaguaaagccacuugcugccuaucuugauaacuugagucuaaucaccaagacccacaagaugaaacaaggaaugagauuuacauaaguugccucugacacaaugaaugcugugguguauauaaggccacauaacauguaauaauacuccuacaacuauugacugaucuccuacaacucccaagaaucucuaaacucugugucuauucuaggaaucucaugagugaaacagacacaccaugucuagaacuggauagguaagacccacuuugggcauuaaauccugcuccuuuagaagagccauugguuucuguucacacugugacaugcauuauguuauuucucucaaaggccaaauagccucacaauguauguauauauagcuauuuauauauuuacauuuuguuuauucacuguugguuaauguuuuuccuuaaaaagagauuuauuuauuauauuuauaaguacacuguaguugcuuuuagacacaccagaagaaggcaucauauuccauuacagaugguugugcgccaccaugugguugcugggaauugaacucaggaccuuuggaagugcucuuaacugcagagccaucuucuccagccccaaaauuuuccuuuuuaacucuaguaaauaauacuguuaugaacucagguaugauaacccaaagaacuuaagucuuaugauuuuaauucuuuugauacacaucaaguaauggaauuguuagucaaagcaauuuuuauuacuuacaaauacuauagcuuugauauuucuuuuuuuuuuagauuuauuuauuauuauuauaucuaaguacacuguagcugucuucagaugcaccagaaaagggcaucagaucucauuacggaugguugugagccaccaugugguugcugggauuugaacucaggaccuuuggaagagcagucagugcucuuaaccacugagccaucucuccagcccaggcuuugcuauuucuuaaaauugcuuaauuuaggggcugcucaauuuagccaggcaguggugacgcacgcguuuaaucccagcacuuggggacagaggugggcagauuucugaguuugaggucagcauggucuacacagugaguuccaggacagccagggcuacacagagaaacccugucucgaaacacccccaaaagaaggucaagcauuuggaagugggggccauaauguauguaaaguuuauaauaaugauaacaugacauacaauguaacaugauauauguauuauacacuauauuacauauuuguacuacagauauguuaugcacuauuaugcuaaauuuaugagaaccuaaaaaaggacaggugaaauauagaacuauaaagauuccucugagaucaaucaguauguauugacagucccucaucaagagaaucaaagcuuauauuuuuuucuacuaugcuuucccaauuaucuacucauuaaaguuuuaguugaucauuuucaacagaaauaguaacaacauuuaggaaaaaaauauaacuaaacagucagauggccauguacuuacaaauugccugaacaaucauuguguccacuuuaucagcacugaauuucaaucuguaucgagacaggcuggggaaaugaaagaacuaaaucagacaacauuuuuuacaagcacauuaauuaacuucauuguaugucaccugaguggguaccuaaguguaggagagagaucucccuuguuuuuugagguagguaggguuuaccacugaacuggaacuugcagacuagguuaggcuggcuagcaauggagcugcagggaucuguccgucucuccccgugcccuggaaauuuaacuguggccacucccaggaucuuuaccugggaucuaggggauugucaaauaccuuauaaacugaguuaucuccuaaaacuccuuggucuuucaagauagagauucacuguauagcuuaggcuggccuuugaacccaguguuuucccgccacagcuucugguuacuaggguuaaacccaugucaaaagcucagcaaaugaaaucuugacagcguacuaaauucaccuugaaaagguuuuuaguguuaaaucucuauucucaccuauauuguuuuuauaagugggaaaaaaacccugcuagaugaguguguugcauaaagccauuuugugaugauguaaaucuaguuauacuuuaauagguuguuuuauuuacauaccuagaagggcuuuaauauagcucaguauagcuagguuuuuuuuucuuuuuaaagauuuauuuacuuauuuuauguaaguacacuguaggugucuucagacaucccagaagagcaugucagaucucauuagggaugguugugagccaccaugugguugcuuggauuugaacucaggaccuucgguugagcagucugugcucuuaaccgcuuagcuuugaauuugccacauacugaggauaaauagaccuauaccaauacagccuauuuuucuguaugaauuaauuuguuauggugaguaagguaauuaauaugauagagcaagucauauuguauauuuuauaguuuuguugcuuuuuuuuuuaagaauuuauuucauauaugucaauacacugucacugucuucagacacaacagaagaaagcaucggaucccauuauauagaugguugugagccaccaugugguugcugguaauugaacucaggaccucuggaacaguagucaguacucuuaaccacugagccaucucuccagcccaguuuuguugcuuuuacacaguaggucuuuaauacacuccaaaguaagaaauaccacagccuuuguauaauaucgggauacagaaaauuauagagaaggcuucaugugagcuagcaaaucgugguauuaaugacaucuguagcccuacaauugcauaccucaggguguuaucuuuacauugcagaacauuuucaguaucucuaaauaaauaaauaaauaaauaaauaaauacuuuccuucuucaagacaggguuucucauuguaacccuggcuguccuggaacugacucuguagaccauucuggccuacagaaaucugacugccucugacucucuagugcuaggauuaaagguaugcgccaucacugcugggcuaguaucucugauuuuuaugagaaagaagcaguuguguuuucuuaguguuguacuauuuuuaagcacuauacauaaaacccuuuguuaccuggcuguccugaaacuucaucuguaaaccagacuaucugggaccucagagugcugggauuaaagguauguuucacugcggccuauuaggauacuacuuucaacaauccuagcauguuauggcucgcugaauaauacagauggcucagcaguuaaguguacuggcuauacaaucaugagcuguggaagucugaucccuguaccuacauaacaagucagcaauuccaugugugccuaaacaaaccucagcugggaggcagaaggaucaaugagguuugaggauuucuggccuagccccggaaaccagggggagagucugccucaaaggaauaggaagaaugaagggacaccugacagccuuuucuggcccaaucagaaacacguguacacagcaaaguucuuucucagaccaaagcaaagcuaugggaagaaaugauccaacacugaagauauaaagaaagccugccauaaguuuucauuuuuaaaagaauauaggcaauagccagguugggguggcacacucuuuuaaucccagcaccucggaagcagaggcaguuggaucuuugaauucaagaccagccuggucuauagaccgaguuccaggacagccagagcuauacagacaaauccugccuggaaaaaccaaaaagaauacacugggucuaauaauuguauuuuuaccacuuaucagcuuuauugaugcugagcaaguuuuuucuugagggcaacagcagcaucucccugacauuaauacuuacacacuuuuaggacagauguauauaaauauguguauguauaugaguaagcauacauuuaacuucuguacuuaccugugggccaauccaagacacauggcugccaucucacgugguucuaccccaggaaucaagccauccauuugugaucggauuccucucauaaguucauuaacaacaggacuauggauacagcugagauucaauuuuuccuauaaaaacauucacauuaaaugaaaaauaaguuuucuugaaaauucaccguuguggguuuucagauauugucuuuuaagaauucaccaauguagccaggcagagguggcacacaccuuugaucccagcacuugggaggcagaggcaggcggauuucugaguuugaguccagccuggucaaaccccgucuugaaaaaccaaaaagaauucacuaaugugaauucacagguucaacuuaaacucacaggaacaaucugccucagucuccggaaaugauaaguggagccucccucagcccugaagcaggcugcuccagacuuugaccuugcugccagugagaaggaaauuaccuaagguggagccuuccgaccuagauggcuucuuuuguucugccagcugccacugcucucuccaagacacugcuaccugcugagaagcaccugauacauuccagaggaacauucuauucugcgcaucaccuauaggcuggcuccagacaccaagaauggacuggaggggaugggccuuccccuuuuauaagcacacucucuuaggaaacggagggccuugaacugaaacaugucucggcuccauuaaccucucgcagucuaagucucuuucagccccagcuugccucccugguguaccugguccuuguaagccacaggccgggauagaacagauaagcaugaucuaucucauuggaaucugguauuuuaaaacaauauugaucucggguauaauauauauacuuuucucaacuguacauaguguuugcuucuaguauguuuguuaagaaguugauggaaauuaaauagagaaaccuuccaauuacccuuuuggcuaggcugcaucccaagaugcaaagcauuauuaaaucugaggaaguuuuuuucuugcuuguuggacuaaguggacuacugcuauuuuauuugauuuccagacuuuuaaaaucugcacauguaccuaugugauuuuuuuuuaaagaaaagauuuauuuuauauauaugaguacacugucguuaucuucagucaccccagaagagggcaucagauugcauuacagaugguuguugagcuaccauguaguuuagugcgcuuagccacugagccaucucucuagccccagccaaagggaguuuuugugcacuaguuaagugcaggugccuuuaaaggccagacaguaucaaauccccuguaacugagugauggguaguaaugaccuguguaaugcugguaaugggaucugaagcccgguguauuaaguguacuaagcacuuuuaaccacucacccaucaucacuccagccauuuguuuagcuuuaaaauuacaaaguauugggcuggagagauggcucaguuaagagugcugacugcuauuccagagguccugaguucaauucccagcaaccacacaguggcucacaaccaucuguaaugggauccgaugcccuguucuggucuguuugaagacagccacaguguauuuauaaauaagauaaauaaaucuuaaaaauaauuaaguaaaucuuuaaaaaaaauuacaagguacucauauacucaccggauuuuaaccaaaaguaacagcaaaaaguuucuaucuuuucccuauggauaagugcaucccucaaauaacccucccaaagaguauuaaugaauaguauaaacacagauaacaaguaucuuuuugacccuggauuuuguggcacacaaauuccauguuggagaaaaaaauuuguuuuaaaaaacaaaacuguuucaaucauaacacuuucccugucgcauauauuuguuaauucccucauauaggccaauauuuuauaauaucacaagcaaguaacucuaggcaugcaccaccacagaccauuuaaguccccucuguacuuuaugccugcuacuaaagcuuccaaucaacucacuucuuuacucaacagaaaaaaguuuaaauucuaugaggaucaucacaaaugugaacagacggcaugaguggcuggcuuagagcuuauauuaucauuuuuguccaucuuuauuuucuacaguguacagggaaaacguguuuuugcaauuucuaguugagauuaugcugccuaacaggaaaacaucaacuaugagaacacaugacaaauacuacaaagagcaggcuuagcagcucuaaaaggccuggaagaaucaugccuugcccuuuaagccacagccacagccucagccucagcccaacuuuaccuuuauuaccccuccuaguuuagcaucagcgacagccagagguucaugggcuucuuuuacuauuuucuucaaaacuuucuucagcuguuuauugauuuugccuuccaucagagcugugaaugcuuuacagaaaaacagaaaauuuuagaguuacaacugagaacgcuucugauguaaacuuuaaaggaaagaaaauauuucuuuuaaaagguauauuuuuaaaaaaauaaaaauuauuuguguaaauguuuuauaaaaaaccaacucauggcuaggcaugguggcgcacaccuuuaaucccagcacuugggaggcagaggcaguuucaggccagccuggucuacagagugaguuccagaacagccaggauuacacagagaaacccugucucgaaaaacaaaaucaaagaaacaaacaaaaaacaaaaccaaccccccccaaccucauaaaugccaggcaugaugaugcacaauguuuaucccagcacuugggaggcaugaaaaagcagggcaaccugaguuaaagccagcuggguauacaaagugagauccuacucugaaauaaauaaguuuguuaagauucagcuucuugggcuggugagauggcucaguggguaagagcacccgacugcucuuccaaagguccggaguucaaaucccagcaaccacaugguggcucacaaccaucucuaacaagaccugacgcccucuucuggagugucugaagacagcuacaguguacuuacauagaauaaauaaauaaauaaauaaauaaauaaauaaaaagauucagcuucuuuuuauagggcagucuauagccucagcuggcaucaaauuugugagccugccuuuagcuuuccaagugcugggauaaacaugugcaucaucauuccuggcauuuaugaaaggguuuuauagaacccuggcuauuuucuucugccuucuaauacuguauacacugauuccuaauaucuaccuuuuuguaaagagacuuucuuuauucuuuucuuugggcuggggauaaagugucuguuuagcaugugaaagaccuugggccuaauccuuaguacuacacacacacacacacaaagcucuuuaaaauuaaaauugcauuucauguuccuagcuuaaguuuaaauuuuuguuuuauguauauggguguuuugucuagauguaugucuaugcaccaugugcaggccuaaugccuauaagggccacaagagcaucagaucccuuccaauugaauuaggauuaugaauuccugugagcugccaugugaguacugggaauugaaucuggguccucugaaagagcagccagucucuccagcucauuucuaguuuguaaucuucuguauuacccaauuuuaguuuuaauccagcauacacaauaguccuucccuuaaacauacuuuuucuuuuuuuuuaaaaagauuuauuuauuauuauacauaaguacacuguagcugucuucagacacaccagaagaaggcaucagaucucauugcagaugguugugagccaccaugugauugcugggauuuaaacucgggaccuuuggaagaggagucagugcucuuaaccguugagccaucucuccagccccaaacauacuuuuucuaaguguaaaaucucuauacuagacuaacacuagauuccacuaggucaccaucuucuucaaucaaacaauacuuaucacuucaaaaaacuugcucauauaacuucaggggccugaacuaagcuauucucuagagguccuggauucaauucucagcaccacacuacagcucacaacccucuaauaauggagaguuccaugggauccgaugcccguuuuugaugugcagguaaacauguagagaaaacacuuauuuacauaaaugccugaaucaauaaauuguuaaaaaguaacuucaaauaaaaaacaaggccaaacaagacaccccaaugggccaaggcuucugccaccaaacugagccccuaaguuugacccccaagaucuaucugguaaagagaacagaacacucucacuaacuguccucugacacaauuguacccuuccaaguaaacaaaaugguaaaagaaaugcuauaaauuaacuucuaucagagaauauuaauucuacaaaaucuaaauuguauacucugaucuacaguuacuccguuuugguucugccuuauaggaccaggaaggugguucuguagguaaaaugcuugccauucaaucaaccugggaaaccaaauccagucccuggaaucuauguaaaggugaaaaggagagaagugacuucacaaaauugucuucugucaugcuaaguguaccugcaugaacugcucacagaaccuggcauacuggccaguuugguggagugcuugucuaaggccacuauaaauuaaacgccauccucaguugcagggucuucuagcuaugcuccccagccccaaagcaaaccaacuuguaagagacaauauaccaucaauuaccaggaaaaaaaaaauucaucugauaaaaacuaagacauuaauuguagaaguuucucucauggaauucuugacauaguucccucguuuccaaaaauguuuauuauaaaccuauguuuuaucacuuauaacaaagauaauauccuucucucauaggucuguuucaaagauugugaucaguucauuagauauugguaguacagaaacuugcuuuguguuuggccaugucuuuuauuucagcacucaggaggcagaggcgggcggauuucugaguucaaggccaaccuggccuacaaagugagcuccaggacagucagggcuauacagagaaacccugucucaaaaaaacuaaacccaaaaaaaguguggaccaaauaugguggcacaucccaguagucaggagacuacuuauaucucaauauuuccaucaaagcaguaucuuuuccccaugugugauuaaugaaaguguuuagaccuauaaaauucuugucgaguuuuaaaccauuuuuauaguccuucauucucaaucaaucaaauaauugggugauuaaugacacagaacaugccugucccccaacaugacccaaauuugaaggcucugaauuacccccuucuuuaaauuaaaugaaacaaacaaaaaauuauguuuccuuauauaagcucucaugcccuuuugugugcgcauauauauauauauauauauauauauauauauauauauaugcacacacuuauuuauuuuaaagaacuauuuccuuucaacuuuuaauauugauaugcuuuuguauacucuggcaagcuuuauuaccaauuguuuuauuucuaguggcuagucucaacuuuacccuugaauuaauaaaauuauuagagagcuggguacauggccacauuaccuuggucccuuguagaacagcucuuacugaauugugcuucagcauuaggcuguugguuuuccacagggagaucaauuuaaccacuugucaucucucaucacaugggggaaaccaacccuauggugaaaaaagcuaacucaauguugucucagugguagugacgaauggguuagaucacuuaaauucaguuccaauaagaugcaucauugacaacauugaggaagauuaacucaggcaacggaagacaauaaccuuuuaauaagaaaaacaaaugcuacauuuuuaaauuaaaaaaaaaguaaagaaaaaagaaaacuuuuacuuuaaauucuuauuuaccugcuaaugcuucugcuguauccugaaauuucucaaaauguuuuagcuuuacucuagaauuagaagagaacaaauguuauugaaagaaaugauucugcaaaagcuacauagccagaaaauagaagcuagcuguuucuauauagcauauacuaaauaaaccaaaguuggaaauuugguucaaugguagagcauuuccuaguauagccaaggaccaggguucuauccucagcacuaaccaaccaacccuccagguagaagaagugugauugaaaaauagcuuauugucagccagggcuauacagagaaaucauauacauauacuuuauguauaugauagugcuuucuguacaaagaaaauguauuaguuaauucauuguugucucagugguagugacgaauuuuuguuaaaucacuuagauucaguuccaaaagguauacaucauugacaacaaugaagucuccuauauuccuuaaaacacuauuaguugaagcaaauuuuucuuaucuggaaagguaaaugcugauaguccaaaugcacacuuauaagcauacagaugcuaagaaaaaaguacugauuguauuucuugguccuauccuaaccccauuucugcuuguaugaaacuccauucucuaucucucagaucuugucuagauauucaaggauacagagagauauaaguggaauuauauuaaauuacucuggagcacgguuuuccucaguguaucaugaacaucucuccaaaucacuaaaagaccuaccccaugcauauauacucaaucaauucaacaaugcuauuacugauggaaccacaaaugaugacuguauuuauguuucacuuuucucucaguuagccaugcuuuacucuucggugcauuuaucagcaguagcagauguaugacuaaacaugggcauccacagguauggccccucccuuggggguagacaacuggaucagaguuucuucucaggacuacacacaccugcuggguuauuuuacaggaugauucaggaaggguuaaaugcugacccuaacucuacccuacugccuugccccucaaccaauuuaguugaggagacaugggaguacuuuaaaaccuagaauuuacaaccuacuuuuauccccaagagcuagacagaaauaagucauggaagauaaauacacuacagaguaaacuagaaagccuuugaauuaucaacccacaaaaaagaaaacuugcucacacuuuauacaacuccuucuuugaaaaguuuacauuuaauuaugguauaguauguccucaaauaucccuuggguaauugcccacuguaaucuacaguacaaauugugaugaccaauguuccaaauaaaacagccucaauuacugggcgguggugcacaccuuuaaucccagcauucuggagacagagcaagugaguucgaggucagccuaaucuacagcacuaccaggacagcaaagacuacaaccugucuuaauacccacacugccaaacaaaauccagcuuucauuaaauucacacuaacacuguucacaaaauagauuuccaaaaaccaaaaagcugaaaauagcauacaaaugaggagguccccacaaacuacuauacaccuaaauucuucaagauuacuuacauuaaaaaaaaaaaaauauuuauuuauuaauauacauagguacacuguagcuauccuaagacacgccagaagagggcaucagauccuauuacagagaguugugagccaccaugugguugcugggauccgaacucaggaccuuuggaagagcagucagugcuccuacccgcugaaccaccucacccgcccgauuacuuacauuuuauuugcuuucucuggaguuucaaauucuuuccacaaacuaucaaccucuugaaguuucuucucauucagaaccugcaauaaaccaguuuuuuucaaaagcaauuuagacauauacaacuauuuuucaaguuaacaacuauucacauaaaauaagaggaaaaaguuuuucucuuauugaaauaagcuaguuuucuuaugcagcauuaaguuauagucaaauuaauugucuaaguuaaaccuaguuauagucuuuuagaaucuuuccuauauuauuaccaaucuagacuugugugaguauacaauaauuucugucccuacugguauuuaaauguguucaauuuuuucuccuaagugccuaaccauacuuuuguguugacaaacacuuagggcagauuucuguaagugggguuaacuaaugaaaugaaaucguuaagcuuuggggcugagaagagggcucagugggagaguauguuguacuucuccaggacucaaguuauacugccaaaaccuacauaugguguucacaacaggccacaccuacaacuacagcuccagacauaucagguaccccuggccuaaucaggcauuugcacucacaaauacauacauaauuaaaaacaaaccauugccucacauccccagugcuggauuaugggcuaugugccaguuuacgcaguguucaaggugcucugugcaagcauuccuaacuaagcuagaaccucugacccacuuuuaagacuuucuuuacauagguuucuuuacauaaaaucaagaguaaauuaaagggacuggagagauggcucaguggguaagaacaccgcucuccagaaggucccgaguucaaauaccagcaaccacaugguggcuuacaaccacccauaaugagaucuggugcccucuucuggugugucugaagaaaacuacaguguauuuauguauaauaauaaauaaaucuuugggucagagggagcagggacugagcaagcagaguugacuggagcaaguagagggggaaaaaaaaaaaaaagccaggcagugguggcgcacacuuuugaucccagcacuugggaggcagaggcagaggcagacagauuucugagcuugagugaguuccagaauagccauggcuacagagaaauccugucucaaaaaaccaaaagaguaaauccaaaagaguaaauuaaagauucauuucaacaccaauuuucuguaugauaaaucaagccaauccucaaaucuacacucucuauaccaaacaccccucaaauagggauauuuuacaauuaaugacagguuaauauaaucagcauuauaauaaagcaugcuaacuaugacacaaugcacuauacaauuaugcacauacuuuuuuugacaaaauagccgguaauugucaggucuagaucacagaacaguuacauauuaacauuuauggguuauccuugacuaugcagcaaaugaggucagcaccagauauauauuucauucucucauauguguguguguauauauguguguguguguguguauauauauauauauauauauaucaauuaacuuuuaucucuaugcuuuuaucuuauguacauggguguuuugccugcaugucugugcaccaguugccagaggagauggguucccugaaagguuauuacagaggguugugagcugaacguagguguugagacuuaaucuagguucucugaaagaacaaccaggacuccuaagggcugagcuaucucucuagccucagaguuuaauuuuaaucaaacaaacuugaaagacugaagaaaucaagcaauagagcuaccaauuacaaaacagugcuggugucaaaaauuguaagcuacaacuuguacuguauagcauacaccaguugaauuaguuauuuuauuuuguauaugauauagacccaugaguauauauuagaaguuaucuuacccacacaaaagucucaauuucuaauuguucugagacucauugcucaccaacugucaagaaaaaaauugagaguaacucuugaaaaauucacauuuucuucuauuuaaaaagaaaauauuagaagauaacagauuaacagaacugucguauuuggaagguuuauuuuuaccaccauucgcuuuauuuuauaugaauguguuugccugaauucauguauguguaccacuugcaugccugcuguuggaggucaagaguguccccuagaacuggagguacaaauaguugugaggcaccaugugacugggugucaggaagcuggguccucugcaagaacaagugcucuuagccacuaagccaucucuuuagcgccaaauuaucaucauucuuaaaacuaaaguuaaagcaacaaagaaaauguaauaaaagcaugaugauuaauaguuauccaaauauuuagaaaauguguagagcaaacaaaacuuuggcuauacccaaucaugcuaccauauauccuuauauuguuucuaguaacaacaguuugaacaaaauaaaguuuucggccaggugugcggugacacacaccuuuaaucccagcauuugggaggcagaggcaaguggauuucugaguucgaggccagccuggucuacaaagugaguuccuagacagccagggcuauccagagaaacccuguuucaaaaaccaaaaauaaauaaauaaauaaauaaaaauaaaguuuuuauaguugucuaauuuuuaaaaaaauuauuaauuuggggcuagugguaagagcacugacugcucuucagaggcagagguccugaguucaauucccagcaaccacaugguggcucacaaccugaagacauaguacacugcaaguaggcagcagucuaagcaguaguuggaacacucacugccuaacccaagcaugaggaaguagucaauguaacugaagauauuuggaaugucuggaauuugaaccuagggccacacaugccaggcaaguguuuuacuaugagcucuaucccuagcccucuuuuuaacuuuuauuuugugacacgaucucauuaaguuacuugcauaacuggaacuuuuggucaggauucuugucuucccuuccaggaauuauaauucauuaguacaggcauuagucugugccaacagggcuuucucucaaaaucuaauuuauauucuagcauuuugaaagaucauggaaaaagaaggcagcaacuaguauuaucuaauuuuuggagggauucacaaaaaaaaaauucuucaccuacagaaaguauacaauucccuucucacaaacugcaaucacuagcacuaggucuagaacaugccuauuucuagguaagggauugcuaaauaccaaauaauuauaaacugaaaacuucaccauaauacucaaaacuuuccaauagaguaguaacacagcauauuuaucacaaaaaaucacugaauacuacauguaauaugaccuaauaaguaaauaaauagaauguuuagcacauagcauacuuacucuaccucauuguuccccacagcucaauagcaucucauuguaggaagaugccacuguuagaccaacucuguacuaauaaacuuguaagcuauuucuuauacugagaaauagcucagugacuaaaagcaccaacugcucuuccagagaccuggguucaaaucucagcacccccauggcagcucacaauuaucuguaacuccaaggucugacagcucagagacacaugcaggaaaaacaccaaugcacauaaaauaagaaaaagcaaacaacaaaaagaccaaaaaccuuuccguauuuaaauaagggacacucaaguuaauagaagccaucuagacuucuccccuaacuuucaugcugguaauuaugaacucccugguuuacacaauuacaucaggauagcucaugagcaagccucacauagaccaaacuggaaauggugaauaccauguccccaacaacuccaugucuuacuuaaaacaaaaacccccuucaauccuacugcuugcaguccaaauuucuguauucaagcagacucacugaauaauuuuaaaaaaaggacaugacaguccuaggcacgagagguuucauuauagauaccaggggaagaauacagccagaggcaucuagaaguguccugaaagcagggacaugaaagaagagagcaacagaaaacagaagaccaagagaaagcuguauagcuggcuugguuauacaggaaucaaugaagcuggggaaaggguuccagcucaguuucugggcugaagaauguacagcccagucagccuugccaugauaauaagcaccucagcauuuguccugagaccuaacaacauucauguugucuacauuaaagcacaguauaccuuccuccuccuccuguuaucaucacauaguaaaauaaucuuuaaagaaaacaaacuauagcugggcggugguggcccacgccuuuaaucccagcacuugggaggcugaggcaggcggauuucuggguucgaggccagccuggucuaaagagugaguuccaggacagccagaacuacacagagaacaacugucuuggaaaaacaaagccacucacuacucaaaaccuuccaaucaugccuggaaggacccugaucuuggaccccagcuuuaaucuaguuaaauauaaaugaaauguuaggggccagccaagccuacauagggaaagccugccucaaaaguaaauagagucuggcggugaugaugcacaccuuuaaucccaguacucaggacgcagagguagguggaucucugaguucaaggcuagccaggucuacagagggaauuccuggaaagccugagcagcacagugaaacccuaucuggaaaagcccaaaauaaauaucugaggcuggagcgauaacucggcgguuaagagcacugacugcuccuccagaaguccuaguucaaaucccagcaaccacaugguggcucacaaccaucuguaaugggaucuguagcccucuucuggugugucuguugacagcuauaggguacucauauacauaaauuagauaaacauuaaaccgaucuuggauuggagguguaacuaggugacagggcgcugaucuaacauguacaaagccucaggugauuaaaugaacgcuuuauugucacuuguaaaaaaggguccugcccauuuuuuaaacugaguaaagcagaggucgcccuaaauucggagaagccacguguucaccugaaccagcgggcucuugauuuuucacaucuuuucggagcccggggacuugaagacacuaaaauguguuccguuguucgucucuccuuaaaucuuacccagcucucugucccacauaagccucuuagcucaacaacuccaucucaccuaccuuaaagauggcguagccaacggacguuucaaacaggaccaacaugaugagaccaggucagggcggcgcuacgcggcuagccgcgagcccuuacgccacugcaaaugacuaccuuucagucgcugaagacccgcuaggccuuggacgcgggggagcgcaaacgccgucgccuccccgcggacgaacagaccacguugcucagccgcuccacaccucuccucguggagcagcaaauaugcgagucuccuucucuaagaauucugggaaguaacg

SEQ ID NO: 174 - RNA, 2637 nt, Mus musculus
cuacaaaaaaagguuggcagugccuggaaacaacaugcaagguugcuccaugaauacacauacaccuucacaaguauagauacacacacacacacucaaacaaaguaccuuggucugguagacuagauugguaaucugucaccuggaaaaguuaggggugaacagaguauggagccagccuaggcuguuguagcccaguaagaccaugucuucuaagguguuugaguggaaggcauaagaauacuguuuugaguaaucauccugggagucaaaguuucauccagguugcuuaaauaaaacccaauuuuaacuuuuguuauuuuuucagacagggcuuaucuuuuuuuguuguuuuuucgagacaggguuucucuguguagcccuggcuguccuggaacucacuuuguggaccaggcuggccucgaacucagaaauccaccugccucugggugggagggaggcuccacuuaucauuucuggagacugaggcagauuguuacugugaguuuugaguugagccugugaauucacauuagugaauucuuuuugguuuuucaagaccggguuugaccaggcuggacucaaacucagaguuugggaggcagugcuucugccucccaagugcugggauuaaaggcgugcaccaccaugcccggcuucagggcuuaucuauagcccuagcugucuugaaacuuguucuguagaccagguuggccuggcucugccucccaagagauuaaaggcaugcacuaucacgcccaguuuuuaaauuuguaagauuuaaaauguuuuaaauguauguacguuugccuguauguauaugcaccaugugcauacuuguuaccugaggucagaaagggguaauuaauuggucccugaaauuccuuggaguuagccaugaauaugagccaccauauggaugcuaggaacugaacccaggucucuucaagguccagcggugcuuaacugcugcaccaucucuucagccccuaaauuugauuagaagugcauuguaauagauaaauaaaaaccuauuuggugguggugcaccaaauauuuaaucccagcacucuggagggagaggcagucacaucugaguuugaggccauccugcucuacacaacaaguucaggacagucagggcuuuaaagaaaaacuuuuaucuccagaaaauaaauaaaugaaacuacauuuuucuuuuucuaucuggagagaugguuccacaguuaagaaugccuuuggcuccuccagaggaagaguuuggucuggcagccuagaauuauagcucugagagauuugacuuuuuuggcuuccacagguacccacccagcauguaagcaugcauaugcauauauacauaccuauaaacuuguuuauuuuucaagacaggguuucucuguguagccuuggcuguccuggaacucuucuguaggccaggcuggccuugaacucagaaaucuaccugccucugcaacucuuuaauuguuguguuuugaggcugagucucacuguguaucucucacuggacuagaacucagaguuuuaccugccauucugcaccacaugcaugccuggugccuuuagaagucagaagagggcauugguuucucuggaacuggagucagaugguugugaacugcaauguggaugcugagaauugaggcuggauccucugcaagagcaacaagugcucuucauugcugagccaucucuccagccugcuaaaugcugggacuuuaaggaugugugcuacaacuaacauuauucuuaaugaaaaguugugaguugaugguuucuacaucauagacuggcaaugguccugugaaugguaagccagugccccaccccacccuguaaugcaucuccgacccuuucuaauuuuuauacaauacuuagaauuauacaccuguuaucaccagucugaguuuauaacuguguuuucuaagcaacagaugcacacugugcucauugagguuuuauuguugacuaaacuguagcuauguaugucuccaaaagaacugaguauuugcaaacagcccacgaaccuuaagauuaccuugauauuaccugucagcccuuuggaaagacuuucugacuucaggcuuugauuaaaagggauuugaaagagucaaauacaguguauaagccuugauuuaucuuaguuccaugagaaaagaggucagauauugaauacaggauaauaguaaaugguuuggaagaauugugucacuuuuuagauguaauaauggcacuauaguuaauuagaagaauaaccuuaguuuuuaaggguaggaagaaguagccgggcgugguggagcacgccuuuaaucccagcagaggcaggcggauuucugaguuugaggccagccugguccacagagugaguuccaggacagccagggcuacagagaaacccugucucaaaaaaaaaaaaaaacccaaaggaguaggaagaaguauucugaccucuaauuuacuuucaaguaguucaacagaauucauggcuauaaauagauggagccaguauagcaauauguuacaguugucacuagugguauauugcuuugcuguuuguuaugguguuucccuuuuuccuguaucuuuuaauggucgcaauaaaaagaaauccuguuuuua

SEQ ID NO: 175 - RNA, 2047 nt, Mus musculus
aaccaguuuaaggaaugugauuuauuaacaucacguucagauacagagauaaaaggaggcuugaauaagcaagcgaacaguaaggcuugaggaguguguuuaugaagguauccuggaacugcccuuagccacaaugaaagaccggcaaaaccagccuucagaacaaccuuucugccuacuagaagaagggagggcuagacuucaccucuuaagaucgcccucccacgcaaauuuuccaccucgcaguuaaagaauuaaacccagacuuccgaucauggcgccaagcacgucaucuucuccccucuccccuagcaaaaaucccacccaagucggcugacccuguaggggaucccuucccuauccugguugccugaaucaagccaaauugagauuuuuuuuuuaaagagguuuaaagugguuaggaaacugcagugcuggcgggacugucucuauucgaugagugaggagcuaggaccacacuccauaccuagaagcaacuacacugcgucgcaguucuccuuuaacaggcccugcaaagacccucgggccuuugugaauaaaacccuccccaggagaggugcgggcggagcaggagacgcgcacgcacagcaggccggcgugugcgaucuuaaguuuucucuccggucucgcgugcucgcaauugcucagcagccuugucauccaagagggccccggggauggcuguucgaggaaagcccgacccagacuagcgcacacacgucagcuucgcggucuucaugacugaggcaggaggcuuuuguuugggccgcgacgggagggggacccgacgaggcccgggucucggcuccugggaaaggcggcucggucgggauucucagggaaaccgaggaggaugcgcccgccgccaccaacaacgacggcgugccuucgaggcuucucgcccaccuucccggguagccuuuaaccuacguuaaacaaaagauuguggccgcccucccuuacacgcuugaacagaucgcacggcguccacgugcggagcguucgccugugugaggaaagggaccuaggcugcccacccgcagcccacgacaacccuucccugcacugggcgcccaggcgagagacgccgcgcgagggccucacucuccagcaagccugggagugaggggcggggccgggcggggccgcgggcgcgcaggcgcagugcggcucaguggcgccgccgccgccgccgccgccgccgcccgcgcugcaccacaggcccgagacagacaggggucggcuggagagccggagacugagaggaggcggcggcgggggcggggcgacuccggugaccgggagcgccucagacuggcagcugcggcgacuccccccuuugugucuggucugcuuggaaccgcuggaggugcuucccggaggggcucgggguguuucgcaagcucagcugcccacccccuuccucggccaccuacguccgucuucccgccgccccccgcccucggcccgcgacgcccgagcuccgcccggagcccagagcugcggagaacgaggcggcggcggcggcggcggcuuucuccagaggggcugugauucgcucccgcaagccaucgacgggaggagacccgguuuucaugguggaauuuacuucaggcaagagcgaggggcuggaguagccgagagcgaggccgcgggcggagcgcccucgaagggccagccccgcaccuccccgcgugucgcucgcccgggcucgccgcgucgccgcgacccuccccucccccgcgccccgaggcccggccugagcgacccucgcgcgauuguuccgaggaagcuguggacucgcccauggaagcaggcaccuuuuucgacccagucggugggaaggauuuguugaugucgaaauccgagugaaggaagcaacgaagcgaaacuuuaaaaggaaccccacuguccucggaguacggagcgaugcuacuccggcggccgggcgccgcugccugccccgcuucgcccuucccggcggucgggaacuuguucugauccucagugcucccaucgagucccc

SEQ ID NO: 176 - RNA, 115619 nt, Mus musculus
caguggcgccgccgccgccgccgccgccgccgcccgcgcugcaccacaggcccgagacagacaggggucggcuggagagccggagacugagaggaggcggcggcgggggcggggcgacuccggugaccgggagcgccucagacuggcagcugcggcgacuccccccuuugugucuggucugcuuggaaccgcuggaggugcuucccggaggggcucgggguguuucgcaagcucagcugcccacccccuuccucggccaccuacguccgucuucccgccgccccccgcccucggcccgcgacgcccgagcuccgcccggagcccagagcugcggagaacgaggcggcggcggcggcggcggcuuucuccagaggggcugugauucgcucccgcaagccaucgacgggaggagacccgguuuucaugguggaauuuacuucaggcaagagcgaggggcuggaguagccgagagcgaggccgcgggcggagcgcccucgaagggccagccccgcaccuccccgcgugucgcucgcccgggcucgccgcgucgccgcgacccuccccucccccgcgccccgaggcccggccugagcgacccucgcgcgauuguuccgaggaagcuguggacucgcccauggaagcaggcaccuuuuucgacccagucggugggaaggauuuguugaugucgaaauccgagugaaggaagcaacgaagcgaaacuuuaaaaggaaccccacuguccucggaguacggagcgaugcuacuccggcggccgggcgccgcugccugccccgcuucgcccuucccggcggucgggaacuuguucugauccucagugcucccaucgaguccccgcccuccccccccccccccccccggcacucuggauauguuuucucccagaucuggguauuuuuuugauaucgugaaacuacgagggaaauaauugcagggguuucuucugggcucccugcgucuuccccauggacaugccuucaauuuggggagccgagacaccccguccuaggcgaaugaagccccccagccacgagggagcgaaaugaagggaaauucugcaguggaaugagagcucuacuagcuagguccucgcaucugccauuuguccuuucaaacugcauuguaauccgggcaggauaaaucagacgaagagcagccuccuagccggauuucuccgcccgaauuuacuuuccagauuucuuuucuuugcccuccugcuucuuugcuggcccagggaugacuuccucgcugcaucggcccuuucgggugcccuggcugcuaugggccguccugcuggucagcacuacggcuggugaguagcccuaggugguaugucccagcuccuacuccaguggguggcgagggagagagccugcagaggccgagcccugugcucuccccucgcaacgugugcucucggauccggguggaggagccagccagggaaaucaccuucgguguuugcguguuguuucccgucccuacucccguauucccugaccccucccccacggggggaaaaagacauauugggugugguaucuugacauuuuuagcugugagguaaugcaaggauuaaaaauaauauuuuaaucacuagugaacugucuauuagauuuuuggagauaaaggugguuuuuuuacuuugauggaaagaagcagauuugguuuacaauaaaaagaacaacuagacacacacuugauugaaccuuauuuuuacauuuagaucacucuuugggaauccacauuacuuuucguuauuuaaaaauguuaccugaaaaaaaauguuaccugaugaauagaguaaacguugaggaagucacugugugagaaucuugauaacaguguauacuaacacaguugaugucaucauuaauauuguuuugcucccaagaaucuuaacuauucucugucucuuuauccuggauauucuuaacuuuguaucccuuuggaauuacuguugggcacagaaguguuuuugauaacuuuucuauuagucaucuggcgucuguugguuuuccugucauugagacaauuuugaccucacaucagacuucgaggagauuugacuccugaaaguucuuugacauuuuccuaacgugugaaaggaaaugcuacuccccuuuccuuuggccauuuccucuuuacuucucaaucgccuugagaaaaaaacaacucauauucucauugcaguuauuuucaagcaacagucuucugugauuugcuuuuagaaaauuucaggaaugaauucuuaaauagucacaugaaguaugcauuuaaaauugaguacacaaaguaaugguuuuacaauuuuuuaaaaaguaauuuucacauucagugaauucuucauugcuguauuagacacagagauuacuuguuuaauuuacauuuuagaugucuguucugggaaaauacugaaagaaaauuugaaguucccuuuugugaauuugauacuauugucuauauugauuaauauguaguauuucauauuuuuaguuaugaguguagucuuuaauggcaaagccauuucucaagcaccauuauauuuagaguuuuaauaaugaaucuauguauuguuaaaaaucaugggaaauaugauuugauuacauauugaaacuugauauuuuaauauuuucgauuguuucaauuaucuuugaagcaaaacugaacacauuuccuccaaauuuccuuguuagcuguuuaaauucucuaaccacaaaucaugugguuccuguaaaauaugaaaagaguaaaaauggccuugacacguaagcagucauucggcaagcagaagcccaagaacauuuuguuuuaaaauuuugaucauuuugaucguuuuagaaucuuuagaauacagauucucauuuauaguguugugcugauaaaaaucagaaaaaacaccccaaaacccaaaacccauugauuucaaaacaauuauuuaguaaauggauuuauuuugucuucuuuuuaaaaggguuauauuuaaagaauccuuguauaaaagugagcuuagccagcccccuccccaccccccauguuauauaugauggcaucuuugaagcuggauuucagagcuguaguagcugaguuuacugagugcuugcuaugcaccaacaaguauuaaaugaccuuuauauauauuuccuccuccagucaggccucucgacaauucugcguuguagguuuuuauuauuauuuuccuuuuacagcauuugagagagaauuaaguauaaaacuuuaaguaacucaucacauaguaaauuguggagccaggauuaaaaccuguaucuuucucuuccuccuugguguuaacaacagcagcagagccagcaacaacuuccucuccuuguaacuggaacaugagauaaagcaaugcuuuugccagguuaacuuugaaaggagguuuggauauuuauaaacuagugguguagguacugaucaugcacugccaugguucugaacauguaaaaacuuugucuaacagguggaucucuaugaguucaaggucagcaaggucuuagugagugcuaagacagccagggcuacauagagaaaccuuguuacagagaaaagacaaaagaaaacuuugcccaguaguggauuaucuagugcagcuucacuaaguacaaagugacuagggagggucuguguagauuuggaguauacugaugaagugauguaacugguaggugcaauugauguaauugaauaggagaaaaaauauugcaagacuaauaaauauuaugucauucuuugggauccuggauacguuaucuuuggugguggugguguuuuagggcaguguguccugcaacucuguguagucuaguuggaugcaagcucuuggcaguucugucucagccucccaagcacugggguuacaagugugagcuaccaagucagcuuuacuaaauauauaauuucuuuugagaugauuuuaaucucuuuuacucugaguaaguuuuggacucccuaauucuaagaacagucgauaugcaaauaauuggaauuuguuagaaaauagagauguacuugcuuaaaauaaauuauuuuaauaaaaauuuguuaaaugcacucacuaccagcuuuaauaagguaauucaggcuugcuugggggucagcuuuuguaauacaucugaaauaauucuuuugucaauauuucaguuuuaucucucuucaggaauauaguugucuaaagugagaaaaucauguuuagcauuauugagugguuagugaauuuugucaaguagcuaacuguaaguuuaguaaucuucauuuguguuucucaguuuggacacuacaaaaguuaccugaguuucuugaugaguauuuuuuucucuguaguuuaguuauacugaguuaauuuguauauaacacacuuuuuugagggguggggaguucuuuacccacagaauuuuaaaagagaugcaugcuuuauaucaucagugcuaacugaaucugaguaugguggauggucacuuuuuuuuuuacaagauuauuugcagccacaaaaucuucauaucauauaacaacuauuuaucuuguuucauuugucuuuuugugggcucaaaucuggagggagggagaguaauaccuacccuaccuaccuaggagcagugugugucgaggcagugacaaagggcaagagggcaagccuaguuccacuggcauauaugcagauuuuauuccucuaacauuccauuguccugucaagacauaacgcugcgugaaaagacaagauguaugaaauaguagauuuguguauaaugaggcuacauguaacauaugaagcaucguauaauuauagaggaaugaagaauucagaauaccagucuacuccagaggauugggaagaggguacagaagggcauuucucuuauuauuugaauggagcuuugcaugaaaaucuuacaaacuuugguuuuuacauccuggauuaucaccuguaguaucacuguuaguguugucugugaaauacagugucucccagcacuccggagacagaggcaggcggaucucuaugaguucaaggcuagccugaucuaagcaagcuccaggauagccaaggcuaacagagagaaaagcccuuucuugauggcagugacgaugaagacagaaaagaagagaaaagaaaaaaaagauuucauauauauuuuuuuaaagauuuauuuauucauuauauguaaguacacuguagcugucuucagacacuccagaagagggagucagaucucauuacgggugguugugagucaccaugugguugcugggauuugaacuucggaccuucggaaaagcaguggggugcucuuacccacugagccaucucaccagcccuucauauauuuuauaaugucaagaauuaaauucagggcuuccuguauaccaggcagauaugcuuaucacugaguuauacucuuuacuggcugguuuugugugucaacuugacacagcuggaguuaccacagagaaaggagccucccuugaggaaaugccuccaugagauccagcuguaaggcauuuucucaauuagugaucaaggggggaagggcccauuguggaugaugccaucccugggcuggucuucuuggguucuauaagaaaacaagcugagcaagccaggggaagcaagcaagccaguaaguaacaucccuccauggccucuacaucagcuccugcuuccugaccugcuugaguuccaguccugacuuccuuuggugauaaacagcaguauggaaguguaagcugaauaaacucuuuccuccucaacuuacuucuuggucaugauguuugugcaggaauagaaaccccgacuaagacaguuuucaagccucuuauuuugagauugcuuuguaaucugacauauugcuacauacauagaggaugcuuaauaaauacuuagugaaugaauuaugaaaaggaguuggaggacugaagagaugaugagcgcuugcugcacuuguagagaauguuguuuuuauccccagcacccacacaugguagcucauaacaaucuauaacuccagucccagaggauaugaccucuucuggccuuugcagguaccaggcaugcacacaguacacuuaacauacauguaaacaaaauauuuguagccauaaaaucgauguuuaaaaaauggaaagggucgggcagugguggugcgcgccuuuaaucucagcacuugggaggcagaggcaggaguauuuugaagccaguauaguugaagccagcccagucuacagaaugaguucuaggacagcuagggcuauacagagaaacccugucuauaaaaaccaaaaaaaaaaaaaaaaaaaggaaaggaauuggaaccuaauucauuuuagcauagagguucaaagacaacucuguggagccauuucucuccuuucacuuuuguguggguuuuggggacugaauucaaguugccaggcuuauuuggcaagcacuaagcugccuuguuuuuuguuuuuuguuuuuccagacaggguuucucuguauagaccuggcuguccuggaacucacuuuguagaccaggcuggccuugaacucagaaauccuccucccucugccucccagaugcuggaauuaaaggcgugcaccaucacugcucggcgcacuaagccuucuuaauggcgugcuuuuucuuggucuuaagaaugauacuuuauuuagugaggagggcuuugcucacucagucuucuguuaauuuaauuugcauuuugguuugguugguuugguuugguuugguuugguuuguggugcuggagcucaggcccaggcucuugaguaugauagugaagcacucuuuuggcuguauucucagucuuggguuuuguuccccccccccauuuuacuuuuucccuacuucuaucaauaccacaacuuguuugaaagaaauguguauguguguucuaaaaauuacuuuuaauuuaguuagcauagaaaguaauagcuuuccuuguggcacuguaauacauguauguauaugugucuuuuauguucucucuucuuuauuuugugugagcuuggcucuaaaaccugggucuaaaugauuuagucuuuaguccuuuccaaaagcaauggagaugacuuugaauacuauagccuuuauuuauuuauuuacaugagacaaggucucccuguagcuuggcugguuuuggacuuguuauagagcugaggcugggaaaaugcugagguuguaagauagacuuguuuuauuaucauuguuccuuuugaucugugagauggauaugauaagacugcauauaaaauguauggauaguuuguguggaauuggaaaucuggugauaaaugguaagauuuuaagaauuaguuuuuugcuugcauguuagucugugugucauguguguuccuggugccuguggaagcuagaagagggaguuagauaccuuggagcuggguuacagagguugugagucacccaccauguaagugcugggaaucaagccuaguccccuggaagagcagcuaguacuuuucaacuguugagccaucucuccaagccugacagaaaggguuuuauucuuuuugaaguaagcagguauuuuacuaguauuauaaaauaauguuacuuuaaacuuuuuugauacguuauaguauaaaauauauuaaaaagaaaguauggauuuaaucuauaaaaugaguauuccaaaaauaaauucuuagguaaauaauuugaccuuugauuuaaguaagaaaagugaucagagaagaaaaaaaugaccaguuuaccuucaaaaucucaguuaguuuacauuuuagccacaguuuaucuuuuaagcugaauggauuuuuaaugacuucuuguaaguaugaauuucuuuuaaggcuuggacagaaaaauuuuaggauguguugccuuaaccaaaguauucaucuagaacauguguaugugcucgcuugcuucuauaguuaauauagugcuugacaagaaguguugagccuuuuacaguuucuguuuggauaugcaugacuggaguggcuagaaggguagguaggggagaucuggaaggaagagcaggaguaugcucucagcacacaucuacgaugccccuguuggcaguuucuuuguaagccugcccaugcucgggcaggaaucucaugauggauggugagauaugauggguuggauugcaugcuguaugaagcaagaguggguucuugguggacuguuagaauuuuagaauuuuuuuccugucuucuuugauuucuuugggugucuuuuugcucuuccuaauuugcuuuuagaacacuucuccccugucuagcccucaguaaagagcagugaacacuuccagguuucccuggccuaaacuucuuccuuucugcucauuccuagugcagaugccaccagauugauugacugacugacuuucuuuugaaagguagcaucuguaaccuagcuggccugucccaaccuggucucuuccugucucagccuuucuaaugccacacccagcuagcauuauuuuccuaauugccaaaucuagucacguuucagcuuuuugacuuauuucuucuucuguuucucucccuuguggaacucccucuuugcuguuccucgcaugggcuuuaauuaucuuugggaguaaaugaugccaaagugaaaugcaaccaggacuggaaguucugaguuccugcuuaggguuacugcugguuguuuacuuugggcagauucccugguuuuggcuucuguauccucauaggaauacgauuccaauugaacugagggggguggccuggaugacacuguacuuaugcagucuuuuuccuuauggaaugagaaaagccagugguccacauaguuauucuuagauauauaaacauuuugaacaauauauauauauauauauauauauauauauauauauacuuuuucccccuuucucuuauacugaugauagucaaauucaaguccuucugcauguuaggcaaacccuaucccauugagauacauuauagagccaguauuucaaauuuaucauagauuggggaaaauuugaggcauuucuaaacuauaacagaucacauugagaaaaauauaguuuaauuaaaaauauguuuuauauugauugcauguguugaauuagcccaacaaaaguguaaaggugggcuccuuagagcugugcuuuacugaaaauagaaaaaugaugcacaccaaauauguaagguguacuuuacaaauaaaggacuuuaaauaauagaaguuuaguuaagauuagauucaucuuggcugagcauggugacacgcaccauuaaucucagcacucaggaagcagagacaaguggaucucuguggaguucaagaccagcuuggucuacauagugugcuccagaacagccaaggcuauauggagagacccugucuccaaagaaauuuuuuuucugcagucuuuuucugccauuauuuuuccuagccuuuaaauuuaaaguaaauaaugccaagagaguaucagcucagucuuugacccagguaucauauauuuuaaaucaaugagaucuaguuagucauccauccauccauccauccauccauccauccauugaagcagucugucacuuuguagcccagccuggucuugaacuucuagugguuuuccuaccucagccucugaagugcuggauuauaggccugagcccacauacauagcuugcuauuuagacuuagguuaauguggcuuuuugucuuuugcuuuuuuguuuagcagugcuaacaugcuaggcaagcacuuuacaacugagcuaccuucagaccucaagguuuaaaugcagcguuacugauuuuuaauucguaugucauaaaauucagccacuuaaaauacauaauuuagugaguuuuguuauaauauguaagauuugucauuuuaagcauuuuuuuuuuuuuuuuuuuuuuuuuugauuuuucgagacaggguuucucugugaagcccuggcuguccuggaacucacucuguagagcaggcuggccuugaacucagaaauccgccugccucugccucccaagugcugggauuaaaggcgugcgccaccaugcccggcacauuuucuaauuuuuaaaacauuuuuuaauuuuuauuuauaugaguacacuguagcugccaucaaacuagaagagggcaucaaauccuguuacagaugguugugagccaccaugugguuguugggaauugaacucagaaccucuggugagcggccagugcucuuaaucacugagccaucucuccagccccauuguaagcauuuucaaauguacauauucacaauguaaguuggguguccuugccuuuaaucucaugaggcaagugaaugugaguuugaaaguucuaagauaguuagggcuauguagagagacccuaucucaaaaaccaaaacaaacagaaaagaaucacaaugugauacuuguauaaccaaaaccucuucaucauccuauauaaaaacuuaaaauccuuaaaguaauaacucccuauuucuuccuccuuccagccaagaauugggauuacaagcauaggccaccguauccaauuuuagcauucuuauggauuagccauucucauuuuguagggcugagaaaagaaccaauuaaauuuuacuucacagcacuuaaguauuugaggaggauuuugauugauauuuuauuuuaaccuaucaguaaaccugccagaauaacuuaaaaguuuaaaaaauauuuuaguccuuugaaaauuuuuaaaaaguguguuuugauuauauuccuccugucuuccccuccccaucucuuccuaauccaccucccuaccccaccaagucaggcacccauagccauugcccacaccucucucagacauguuuuugcucaaugugugcuccuccucuuucccuccuccucucuucuccuuccuuccuguuuccaucuccucuugucgcucugcuggguccaguuuguacuagucauagauuccuuuguguugugugggaucauacacuggaguauggucaaccuaccaggagccacacucuuaaagaaaacugacuuuaccuuccucagaagccacuguccauagcucuuaaguuauggauggggcucaugaaacccucacccugcaugcuagaauguugacaggcuugauccucugaaggucuuaagcaggcagcuacagcugcuaugaguucaugaguacagaguucugucauguccagaagaccucuggcucuaacacucccucuucugcaauuauucuugagccuugagacuugugugugacuguagauaccugauuuguggcugagaacuccagugacauuuucugcacucuggcuacuugugagcuucuugguuaaccgcuguucacuuuacaaaggagcuucucugaugagauuggagagcugcacuagcccaugagauacaaauuagaaggcaguuuauuguuuugguuuuuuacaagugcuguuucuucuuccuuaaugagauaaacugaaaaaacuuuguuaggacauauguaaaaaauuaauuuuuaaucaauauacuagucuuaaguagacuacuaugaauguuuuaggaaucuuuuguccccucuagaugaaauuugguauguuggaaucccugucuaguaaauuaugaauuuguuuucuauguuuugauuucccauuuuauaauucuacuaguugacaggaugaaacaaucucuguuuuuuccuuuaauuaaaaaaaaagauuuaggugguaguggugauuaaugccuuuaauuugagcacuuggugaggcagaggcaggugagguggaucucugaguuccaggcuagccuggucuacagagcaaguuccagguuaguuagggcuacacagagaaaccguaucucacaacaaaaacaaaaacaaucaaucacuaaaagauuuaaagucuccgagaaggaauuauguuaccucuugcuauaacaugauguuuugugguauuaggaaucagaauccaaggcccugugcauauauauaaggccuuuacucuauuuuaccacugagccugggaagaauuuuugaauagaaauguuuuacuaaaaaugaggagaaacguaccauccuucaaaccuuaauauguucuauguccacuuuuguaaguuuuuucuuuuggcuuacuguuuugguuauugcucuguccuugcauguuuuauguuuguaguuggagcuuuuauucuuuugcuucccucuuuuggagauaggcauuauagauacucauuuauauuaaaacauacaggcuagaacaucuuuugaguaguacauuuaaagagcccagaaggaauugcauuaaaguacaggguauugcuaaggaauuacgaaucuuuaacagugaagaauaucaucuggaaagcugagagguaagcaugacuacuuggcacuacucuugaaagguaucaucuagcuuccuguccauagcaccgugacaggcacgaguaauuacucuucgcuucucuauggugaaguguggagcacauaaagggguggaagggucaucugugcguuuagcugaggcauucauuaguucccucauucugggaagcuaauagaguaaggagggucuuugauuaccaugucguuccuggaguguuacuuguagcuucuuuuaucuugauugugugugugcgcgcgcacgcacgcguucagcucaaaggacaacuuguggguuuuaauucucugcuuccaccauguggggccuugggauugaacuuagaugguuaggcuuggaggcaaguaccuuuaccaguagaggccuuaccucccccccccucccccguuuguggguuacagggaucaaacucaggccuacaggcuuguucagcaagcauuauuucccuaauauuguguuauuuauuuauuuauuuauuuugcaguuaugggcucaaaccuagggccuuacacauggugggcaaaugcuuuaucauuuauuugaaggaagauagaguuugcaugcauucuuagagauuagugugguuuucuacaguccaguaauucugagguuauguggcacaucaaaaucacuugagggacuuguucaagcagauuauauauagaguacugccugugguguuuuuacuguauugcuaggcugagaucuggaaauuuauauuuauauaaauuccuauauuuauaggaaguacuaagaaauuucugauauugccaguuuggguuugauacuucgacauuuauaaauaauaaauguaauaaauaucuguugaaugauguaggcuaacauacuaguuuuagauguuauucuuuauauuuucaaacaaauucuuuucuuuuagacuuacgguuucauuuuaugugugugaguguuuugcugacauguaugucuguguaccacagaggucagaaaaagccaucggauccccuggaacuggaguuuauagaagguuguaagucuucauguugauacugggaaucagacugggguccucugcaagaaaaaguacucucaacugccgagccaucucucuagccccuaaacauuaaaacaaaaaaaguguucuuguuacuaugugugucugugcaaguguagagggccacuuguagaucugauugucuccuucccucuguacacgaguuccaagggucaaacucgggucuccuggcuugcucagugagcaucuuuucccacugaguuaucuuaccaauucguagauauuauuuuuguaagccuuuuccauaacucauagguuuuugucaauaauuuugaaaaguacuggcuuauuugauauagaugaauaguguucaggguauggucucaagauuaguagcaucagaauccccugggagauucuuagaaaugcagauuguuuuaauuccaugccuuugacauaguaauaugaauuuugacuuguucuguguaaguuugaugcagccuuaagcaugaaaaucaccaggggugcuggaggugaacccaaggucucaugaacuuugcugcugagccacaaacucagccuaacccccuccuauuuuagaaaagauaauuuugagauauaauuuuaaguagcuuaaucuggccuugaacuuguugaugaauagcugggaaugacuuuggauuucugauccucauaucauuaauucuaaauauuauauaauauuuaacuguauuauguaaguauuauauauuaauuuuggaacauuaggauaguuaguaaauuggacucuauuugaauuuuuucaauuuucuuagugugauuccuuuuauauaaaggguaaaaaauaucuuugcaugugaauaggagaagagaagagagauaagauagaaguauuuuagaaauauacauuuuuuuucuauaaaggaacuucuguaguuuggguacuuguaaagcacuauaaaaacguugccuuacucaaacucaacuuuucagcauguguucaucaugucugaauccuaacuaaaagcauuuuuuaaaguaaagaaagaauccauuuacauuauuuuacuuaucacuuauuaaaacugauauuaaaauauacaaguuuuuaaaaaagcuuuggguuuucuuauuucaagagccauguacauguauaaaaggucaaccuuacagugcagaaaucuugcaaacacuguuuuaaccaaauagacaggauuacuuucauccuguuuauaguguauauuaugugacacaaugugguagaauaauccuuuacuuuuuuagucuuccaaaacccauaauccuauucuaaccaugagaaaaccucaguaugugacaccuucuguccauugccugauuaguauaucucaaaauuguuaaggucauuaaagacaaagaaggcuaagaaagugucauagccuagaggagccuaaagacacaugaugaccaaauauaauguguugucuuggauggguccuguuucagaaaaaggacuugaggaggaaacuagagaaacaugaguaaaguguguuuagucagucaguaacauacuaguauuggcuuacuaauuauaccauauaguaaugaaagauuuuaguguucucuguacuacauguaaacauugcuguaaaauaaaaacuacuccaaaauaaaaauuugugaaaaaaagcacagugcucauuucagaaguauuaggaaaacagagaaauaagaaaagaaaagaaagaaaaaacccacaauccuuacuaaauaugagacuuuuugaauaucauacucuucugcccccaccccagggcucaggauugaggucaggaccuugcacaagagugcuacuccaaauugcuucuugaauaucuaauuugauuuaagucuuuuccaugcaucccuuugaaagugauacuugcugugauauguugguguaugugugcauguagccuuaaaccuauuuuuuauaaguauaaucugaauuauaaagacaagguuucacuauguagcccaugcugccuagacucauuucucagccucccgaauguugggauuuuggugugugucacuuuuuucuuucuuuguucugucuguacugacucugggugauuucauacagucuuuuuguuguuguuguuggugguggugguggugguuuuuguuuuguuuuucgagacaggguuucucuguguagcccuggcuguccuggaauucacucuguagaccaggcuggccuagaacucagaaaucugccugccucugccuccugaguccugggauuaaaggugugcgccaccacugccugguuuaauuucauacagucuuaggacuuuaauuggcuucuagaggaugaguuucaaauguauuucuuuccuaaguugcacuuuuuuuuuuuaauggagguugaauccagggccuccuugacuguguaugcuaggcaagcccucucccacacugggcuccagcuccagccuggauaucuugucuaaaacugaacugagggugcuuuccaguuugucuuauaaauuuaccuuguuuagcaaauuagaaauucuaacuuuuccaguguguagucugcaaauaggaaauguuuuuugucucuuuuucuuuuuuuuucuuauuucauucaaucugacaggaaacucucuugguuaccuugaugauauguauggauugugacugcuuuuauuaguuccacugcugucaccuuaaucuaaauguccccacuaucuucucagguguaauguuucacuaaccuuuuuuccucuauuaauaccuguucuuauuacaugucuuuuaauauaagagcuuuggugaccuuuauuaaauaucauguucccccuuugcugguuguuccagggauugaauucaggacagccugugcuaggcuagugcugaaccauugagguaucuguacuguccuuuacuuucuguuuugagacagggucuuagaaaguugccuaggcuugccuugaauucaagagauagcccaaauugaucucaaaacuugugauccgcagggugugguggcgcgcgccuuuaaucccagcacucggaaggcagaggcagguggauuucuaaguucgaggccagccugucuacaaagugaguuccaggacagccagggcuauacagagaaacccugucucgaaaaaccaaaaccaaacaaaccaaaacaaaacaaaaacaaaaaaaagaagaaaguuagaugucuuagaauagguuacauuuaaauugcuuuauacuauauaauuugacagugacuauaauaaguaaaucuguaugcugagggaguaagggaauagucacauaaacaguuuuuguuuauuuauguuuauuuuguuauguuaaucucauaugugugaaugucuugccugcaugcauguauguguaccauaugcaugccuggugccuuuagaggccaaagaagguguugguguccauggaacuggaguuacaggugaugcagucaccauguggguacugagaacagaaaggguccuuuuuaagggcagcaagugcuuucaauuacugagccaucucucuagucccagcauuucuugaguguucaguauauuuaaauucuuuuuauauuuacuguuaucucacuguccacuaaaccaacugagcaauauuauuuuucucuuuucuuguguguguggggggguuagcuuugaacccagggucuaaaguaugcuagguaagaccuuuaucaugcagcugucaaccacuuuuguuguuauugcuuuucuuucuguagaaguacacaucuacuaagugggacaccugagauuaaguucaagacuuuauugcuccaaagcaagacauucauaugacauauaguguuaaccugaagauauaaaaggacccuguguaguggcuuauaaccuuagcacuugggaauccaaggcgacgcugagaaagcuaaugaaagugugucuuaaaaaauaccuccacccccaauuaaauaaacagacaaaaaagcuuggaugggcugccauuggagcucccuugguguauaggaagcccacagcuuaaucccuagcguuugguaaaugugucaguggugagugcacuugaaauagaaguuaggaagcucaccaguacagugucauccuaggcugcuuacuacauuagaccuaagcuggacugcguagaaacuacacauuuaagagacaaaagagacaacaacaauaaaaguguuuuagauauccaaaaaaucuuauauuuaauuauucaagauaauugaucaacugaauuguaucucaguuauagucucuuauuuugcuauuaaauauagcagauauuugagguuuguuuuuguuuguaauauuuaaauguugauggauauaaaaccuuuccuugacaauacaaagcuucaguuguggaaaacaacaguuagaguaggagugugaugaugacaucaguuaggggaggauauguuuauaauguuuccauguguucauagugauuagaaucccaggggaccagucuaguaugaagaguaacuuuuuauuuagugaguacacccaaagcaguaagaaagcaagcuuaaaacagucaaaugaaguucuuccuuaacguuuugaagcauaguuuuauauggauauggcuguugaguuguuuuuggccaaagcucauguguuagcuugaugaaauguuauaaaaauguuaauuuaugaacuuauuuuagcuuuaaugcuaaucuuuuccccauucaugcaucuacuuucuaggaaucauuguuuuguccauauauuuagauuucugagaaguuccuuuuucuguuuguuuucuuuuuugugacagguucacucuuuuauguaccucuggcuagccuggaacucacuauguggaucaggcaggccuugauugcacagagauuugccugccucugcccuacagagucaugcacuaucacuauugucuaagucauucuuuuaaaagcaaaaugcgggguugggggcuagagagauguuuuagugaguaagagcacuggcaguucucaacaaaggauuggauuggguucuauucccagcccuaccugagaccuuauaaccaucugugaauccaguuccaggggaucuagugccuucuggccuccaacggcaacagucaugugcaucguauacuaacauaaauggaggcaaaacacucaaacacuuaaaaauuaaagauaaaagauauggguugcuuuuguuuuuuugggggggcuauagaguagagaacaugauucuauguuccauccucaucauuaguaaaaaagauugucuuugauugguaguaaguugaacuuuaacgaucuaauacaucaucuucuaucaucucuacauaaagagauuaucuuguuuagccuuuuuauagcuuuuauagcuuuaugaguucauaaauuuuauauguaguuuuaguacuggagaguccugugacuauuacuuuuuuaauuuuuuaauuuuuaauuuuuugagaaaagguccacaguagcuggaauucucuguccuccugucuuagcuucucaggcauuugguuguagaucugcaccaccauaucuaggcuuggggauauuacuuaacguaggcaauuguacuugaaggagaacucugaauaaugaaauaaguaacaauagugaauggauguuaacaaacaucagugcuacauuacugggagaauguccuuuuguucugcauuuuucauuuuguaaauuagguaagcuguuguugaaaucuucacagccuauuugacuuauucaggccacuaauuauagaauuuguuguuuagagcaugacaucuuuuuguuaaggugcuaagagagauuccugugagauucagcuuagucauguccuuagcaauugucuugagaauuauguuggaaaagcauugaauuucuacagcaaaugaauauuucauuguuguuuaaagaaaguaguucuauauagauucacaaaaaacaacccugaaaccuauaaaauaauacuuauauauuagauacugcugagauauuaguaacaagugagauagauauauguauuaauaguaacuuccacauuuugaguaucuacuauguaucaagugugaugagggcugggucucucucucucucucuuucucucucucucucucucucucccucucuccccaucccucccucccucccucccuccuucccugccuccuucucucccuuucuuucuccuuccuuccuuccuuccuuccuuccuuccuuccuuccuugagacaggguuucuuuguauaguccuggcuguccuggaacucacucugcaggcuggccucgaacucaagaaaucugccugccucugucucccaaauucugggauuaaaggcgugcaccaccacuggccggcaccuaccuacaccucccucccucccuuccucccucccuuccucuccuccucucuuucucucuuucucucuuucuuuccuucguuguuguuuugguuuuuuuguuuuuguuuguuuuuguuuuuuguuuuuucaagacaggucuccaacucagauauuugccugccucugccuccugagugcugggauuaaaggcauacaccauuacugccuaccuuuuauuuucauuuauucauuuauguguggaugagcccauguguguggaagucagaagacaaguuggaaguuuucuuuuuccagcuuguagacuucagagaucaaacucaggucaucacacgaguuagaaugauaaucucuucaaacuaauuguauaauauuuaguuuauuagaagaagguuuucuauuacuugaucaguuguuuuccauuuaucauauauuuauuaaguaucugucauguauaauuguguuaggguauagaaaugugaguuaugauucuaguauuuguuuagaacaugacaucuuuuuguuaaggugcuaagagagauuccugugagauucagcuuagucauguccuuagcaauugucuugagcaaaugugaucagcugcuaaauuguggguuuaaauaucuagauuuggcuagauaagagguaguauaugccuauaguaccaguugcuaggggagcuaagguuggagauuagcuauggguucagccuaggcaacauagccaggcccuccucuuuaaguaaguuacuggagaauaacuguguuggcuaguuuuaugcuaaccugacacaagcuacaguuaccuaaaaggagggaaccucaauugagaaaaugccucuuaagaucuggccauaggcaggcaugguagcacaugccuuuaaucucagcacucaggaggcauaggcaggcagauuucugugaguuugaggacagcuugguguacagagugagcuucagaauagccagggcuacacagagaaaccuuguuucaaaauccagaacacaacaacaacaacaacaucaaagaucugucuguaaggcauuuucuuuuuuuuuuuuuaaagauuuauuuauuuauuauauguaaguauacuguagcugucuucagacacuccagaagagggcgccagaucuuguuacagaugguugugagccaccaugugguugcugggauuugaacucuggaccuuuggaagagcagucgggugcucuuacccacugagccaucucaccagcccccggcauuuucuuauuagugauugauuggggagggcccagcccauuaugggugcugcuaucccugggcugguggucuuggguucuauaagaaagcaagcuggguaaguuaugaggaguaagccaguacccuucauggccucugcaucagcuccugccucugaguuccugcucaguuuaaguuccugccuuggauccucuccauggacaaugacucugugugucuaagccaaauaaaccuuucccuccugaaguugcuuuuggucaugguguuuccacagaaauaguaauccuuacuaggacaucaaccaaauauggauuagacauacagaaugcuuauauaggcaguaauaaaaugauaguaucaguguagaaauuguauaagucacuguucagguacuaaaaaggaccuaaaauuuccuugaggcuugacuaaggaacugauuuuauuacagaguucuuuggaagagcauccagauggaggagacgggacuaaauaccuuguaaauguaugagccaauuggaugaguugaggucaggaaggcaugcuuauuuggcauguguuagcucaguugcgaaucuuagauauaaauaaggagguaucauccuuguggugguuugaauaagaaugcccccaccccccagguuuguauauuugaauucuuaaucauuaggaagugacacugcuugagaaggacucaagagguuuggccuuguugagaaguuuguguucucguucucucucucucucucucucucucucucucucucugcgugugugugugugugugugugugagugugguguauuuugagguuucaaaccaagccaggcccaguggcucuuccugcugucugcagauccagacaucuccagcaccaugucugccugcuugccaccaugcucccugccaugaugauaaacaagccccaauuaaaugcuuucuuuuaucagaguuucuguagucugaugucucuucacagcaaaagaauacugacuaagacccccuuacaacaagaaaggguugggaaguauauauaguuaaggagcuguuagucagagugacuaacagaauagauaugcacaccagaucucaaauauaauaucaaugagcauauuuuauuuguuugcuuauuuauuuauuuauuuugguuuuuugagacaggguuucucuauauagcccuggcugucuuggaacacacuuuguagaccaggcuggccuugaacucagaaauccgccugccucugccucccaagugcugggauuaaaggugugugcuaccacugccugacuacaacauauuuuauaacaaguaaauuaaaccaucucuucaggcccucaaaagaguauguauguauguauguauguauguauauauguauuuaugagacaggaucucucuacaugucugggcuguccuagaacucacuguguagaccaaguugacccagagauccaccugccucugucucuaagaaaguuaaaaauauuuuuuuaacuuaaaaaaauguacuuuuaauaaauauguuuuacuucuggaugucguaguauacucuuaucccagcucucaggagucagaggcagggggagcucuguauucaaggccugccugaucuacauagagaguucuaggacaguuggguacauguugaggugucuuuggaaauauauauauacaguguucaagggccaggugucauuuguauucucauuuaaaggguauguaaccuuuuuuuccucacgugggcacauacauagucaguguaucacuuugaaucuguuguguuuuuuguugauaaaauucuccccaaucauaaugaaaugcucuuacaguguuuuuggcuuugauggggggggggucauuaggacauuuuuucccucccucccuccuucccuccuucgcucccuccuucccucccucccucccucccucccucccucccucccuuccuuccuuccuuccuuucuuuuuugggagcugaggacugaaccuaggcccuugcuuuuaacucuaccacugagcuaaaucuccagcccucaacauuuaauuauucuuaguuauuuuaaaauaauaguuuguaguguuauuugguguugccaguuuuuauguuuggacuagauugauagaguuacuugaaguuguuaugacaacaaagucucugauccuccccacccaccccacgcccuaaaaaaaggaaaaagaaaagaaaagaaugauggggaaguggcuagggacugggcugaggguaagccacaugugggguggaguggggcacagcuaagccaggcauggcgccggggcugaauguagaaugggcugagacaugaguccucauagaagagaaaacuguucagaguuaaugagauuccuuauaucucauugauucuuucuuguuaaguguuugcaaagcuuaaaccaagauguaucacugcauacucuuccuaucagaagaaacuuauguugggaaauuagcccuucuccacaaaagcauuauccuuguaguggagauguuaugagcccagaugaauucuuagcaggcaguagaaugacugggaaagaauuaggguaaggucugaaggaaaugauuaauuuucagaagaaccaacauaggcugcagccugauuccuaaucugcuaucucaacagcaacaguucacuguuucuuaucuuaauauuuuauuuagccuuucucauuauuaaacguucagaguauguucauagaguauaaauuuauuuauuuuugaggcggguucuuacuauguggccuggauguccugaaacuuauguagacaaggcuguccucacacucagcacuugcugucacucagcacugagauugaaggagugugucauuauggcaggcccauaggcuuuugcuuucuauaagccuuguucaucugcaauacuccaggauauuaaacauuuauuuucuucuucaggaacauuucauauacuucauauaaauauaugaacauauauuuaaucuuuuugcagucugugagucacaauuagggccucauuguauguuuggcugaugcacugaguuaaucaguucuacuuuuauauuuauuuauuuauuuauuuauuuuugguuuuugguuuuucgagacaggguuucucuguguagcccuggcuguccuggaacucacuuuguagaccaggcuggccucgaacucagaaaucugccugccccugucuccugagugcugggauuaaaggcgagcaccaccacacccggcuuuauuuauuuuuuuagaaagagucucauauauaccaaauuugaacccauuguagcuaaggauaacuuugaacuccuaaucuuucugccucuguuccucauuugcuauaaauauaggcauguggacccagccuuacaggucuaccuaauacugaauuuuaaaccucuuuaaguuaugcuuaauuuauauaaaauaauuuuaaauuaauaacuuaaagauacaauuaggagaaauacaaguggccaauaaauaguugaaaaaguuuucaguauuuuuagcuaucaggggaauguaauuuaaaacugcucuaaagccaggcaugguggugaaugccuuugaucccuguacucugaaggcacaggcagguguaucucugaguuugaggccagcuugguuuacagagugaguccaggauagccaggacuacacagagaaauggucucccaaaauaaaacuaaccaaccaaccgacacccccccccaaaccugcaaaaacacaaaaaaccugcucugugauuucaucuuaccccacuuagcauggcucuuaacagauaaaaccaaugguaacaugcugaugaggauguggagagaaaaggacccuuaugcauagcuggugggaaugggaacugguacagcuacucugggagucaggguagaggauccucaaaaagcauaaauacagcuacuguaugacccugcccuauaccacuccucaguauuuauauaaagauucuaguauaaugugcuacuacuugcauauccuauguucauugcuccacuguucacaauagccaaaaacuggagccaaccuggacauccaucaguagaugaguggauaaagaaaauuuauauauguucaauggaacaucauuaaguuagaaagauaaauaaaacugugacuuuuccaggaaaaugaaucccaguggacuuugggaucuuuccuuuccuuuccuuuccuuuccuuuccuuuccuuuccuuuccuuuccuuuccuuuccguguguguauguaugugugugugugugugugugugugugugugugagagagagagagagagagagagagagagcgagagagagagagagaaagagaauaugagaaugagaaugaaaggguuucaaagaaaggaugggaagaaggaaucuaaacagagguaggagagagagaaagcggacucagagaauauaugugacaugaaagaagggaguaauuauuugggaggcgauaaggacccucaaaagaggagagagaugagggagggcuguggaggaggggaaugauaagaacaaaguaaaaaaaaaagugacuuguauguaugaaaaaugccacaugaaacauguuacuuuguauacuaauuuaaaacacuuaaaauacaauuaguuccaacuaauauaggucuauuacaaaaaaguucaaauuguuuaaaaggguguauaaugaagugagcagugaacagcacuucuauuaucuaaaccaaggagaagguggcaguuuuuuuucaguuagaugucgcuuagccuauccaguaugcuaauaccuuuugucugcaugccuccaguucaguagcagcgcgugauggagcaggagcgcugggcacugccagcagcacugcacagcucaucugauuuuaguuggauggcagagugaaugaaagacgucuacuagauuguuuuaauccagugaaugcauguuuuucugguaguagauacggucacaguauguugagaacauuguugaaacacauugaaggaaagguacuuagaaaugagaauacgugguuuucuuuguuaaugcauuugaaaguguuuaauaaagcugcuuucauauagauugguaauccuuaauauguauugcacgucaagcuucuauuguuugguacaaaucaguaagcuguuguauucauuaucuaauaucuuaacaugauauaaauaagaaguaaguguuuagaggguuaguuuuaaagcaaaaggaugaacaaaaauguuaagguuucaaccggagucacaguauacuauaucuacuucuuaacaaauauauaucaccuaauuaauaguuuauuuuuuguuaaacgauuuucagacuguccacauuuauuuuugagauugaucugugauuaugaugcaguaaaauguuggaaauucuuuuuuuguuguuuuguuuuuucgugggaaauucuuaaaaugaacacacaacaaagaauaguugggaagcuuuuuguaaagagcucuguugucagcauaguuuugccugugcguccugcuuauuuuaggagaagucuauaaugccuacuaguccuguugccaggacuucauuaagcuaaugcuggcucguagccaggcauucaguuggucaaaaccccacacuucccugugaccuaagaagcgcagucgagagaaagggagugaaggauggggagaaugcagagaggguuggaauagggauuuuuauacaguaacacagauuuuuuuuuuaagauuuauuuauuauuauucauuaguacacuguagcugucuucagaugcaccagaagagggcaucagaucucauuacagaugguugugagccaccaugugguugcugggauuugaacucagucagugcucuuaaccgcugagccaucucgccagacccaaguaacacagauuuuuauugaaucaaguacauuuaacagauuuuuagaauuaacuuaggccucuuaagcucuuauauucuauaguagcauucuguuguuuuuguuaagaaacaauacugauaacaaaauuguuuucuuuuuuuuuucuuguguaauuucuuucuuucuuucuuucuuucuuucuuucuuucuuucuuucuuucuuucuuucuuucuuucuuucuuucuuuuuuccuuuuugauuuucaagacaggguuucucuguguggcccuggguguuuuguaacucuguagucuaggcuauccucaaauucacaagagaucuaucugccucugccuucugagugccaggacuaacagugugugcugcuaccucagggcacuuuucuguguaauuuuaaacggacuaauacuuuuccuauuuuaaagaaauagaaacuugauuagaaauaguaccucuacaaaguugauguuagccgggcauggugcugcacgccuuuaaucccagcacucagcaggcagaggcagguggaucucugaguucgaggccagccuggucuacaaagugaguuccaggacagccagggcuauacagagaaacccugucucgaaaaaccaaaaaaaaaaaaaaaaaaaaaaaaaaaaaaaagaaaaaaaauguugaugcugauuuaaguaaguaagaaggcuaaggagugugaggcaggugaguuccaggacagucacggagcuauagugagacucugugucaauaaaauaaaauaagcaaauaaaacuggucugguggcacaggucuuuuuaauccaggcauuuaggaagcaggcagguagaucucucugaguuccaguauagccuggucugcauauugaguugcaggacagccagggcuaugugagagucucucuaaaacaauaccaccaucccaaaaaagaaaagauggaauauuuuguauuuugaggauguauuuaaagaaaaagauauucaagagcauuuacuuuguguguguauuauuugauuuccucauuggacggccagauaccuggcaagaaguagcuugcuguagauugaauguuagaagcguaucaccuaugaugguuaguuguuuuuacuuuuauauuauguauguuugcauaccacuuacauaccuggugcccucagaguccagaagggggugucagauguguugacacuguauuuggaagcugacuuguagguagguguugggaauugaaucuggauucucugagagcagucaguguucuuaacagcugagacucuaucucuggugguuauauuguugacuugauaauauugagucauugaagagaaucucagcgagggguuguguagaucaaguuggccuaugagugugucugugggguagugucuuguuuacuccuuuuaauugaugugggaagacccugugcacugugggugccaucauuccuuagacagggaucauggacaguaaaaguaaagggagguggccaagcacaaguaggcauucauguauuuauuuuuccucucuacuuuagauucugcauguggcuagcugcuuuaagguacugccuuggcuuuccugcauacauaaacuauaaccuagaauuauaauuugaauaaacccuuucaggguguuuuguuguaacaucugggaaggaagcuaggauacuacccauuuuggugaggaaggcauguaguggaguggcuuucagcuuuucagcuuuggcaguggaagcacaaagcuucuugcucacaucucaguagaauaggaaucagagaaaggagaaugccaguguugaccuuuuuauucagucagggaaucugaggccagggaugguacuagucacauucaaggcaagucuuuuuccuugacuuccuugacuguaagccuuuuccacaaauauuuucagaaacaaugcucccaggcauuuaauuaauccaauaaaguugacaaaaugaaccaccacacaaugguuaaauauuaugugauaacuaaauuucauuuugccaaauauuugguguuagguuuuaaacccaaggucuuacacaugcacacaaacagcccacccuugaacuauaucuuuauuccuagaauuguaguauaguauuugugguuagaacuaucauuuauaugugaguauguguaugagugucugccugcuguagcauguguguggaguucugaggacagcuuggaggugggcaggguugguugucuccuaucaugugaauccccagaguugaacuuggguugucaggauuggcaguaagugcuuuuuacucacuaagccaucuugccagcccuacuuacuugagacaguaucucacauuuauuacauaucagaggcugcuuugagcuuucagucuuucuacuuuuuccucccagguauugggauuacagacuucauucuccuaccugucuagaaauaaaguuuaaacaccuaauaaaaugacuccuuuguagucaucccagagcugguucuuuucuuucaccagauuuguagguuaauguccaguaguuagcaaugaacaccauugacuucauaagugacaguuaaugaccuucagauaguaguaacaucuacuaugaggauucagaggaccagagacuuuauuuaccuauuuugauuuaugcagcaaaacuacuuuacuaaaauguguauguuagaaaauauucuuaaaaaucuuuggccuugggcuggagagaaaacucagcgguuaagagcacugacugcucuuccgaagguccugaguucaaaucccaacagccacaugguggcucauaaccauccguaaugagaucugaugcccucuucuggggcgucugaagacaggaacagaguacuuacauauaauaaaugaauaaaucuuugggcuggagugaucgggguuggaaugagcagaaguccggauuucaauucccagcaaccacaugauggcucacaaccaucuguacagcuacaguguacccauauacauaaaauaaauaaacaaaucuuaaaaaaaaaaggcagaacuucagccagacaugguggcacauaccuuuaaucccaauacuuaggaaacaaagacaaaggcauaagagucacugguaguuugaagccagucagucuuaaucucuauuccaggggguccaacaggcugacuuuuuuuucauacuucaagaguaauguacuauagaagauucaguguauaagaagaauaugucuuuuuuuuuaaagauuuauuuauuuauuauuuguaaguacacuguagcugucuucagacacuccagaagaaggagucagaucucauuacggaugguugugagccaccaugugguugcugggauuugaacucaggaccuuuggaagagcagucagagcucuuaaccgcugagccaucucuccaggucagaagaauaugucuaugcuaagcuaauacuguguuugccaaaauguuaaaagugcuacucuuaauacauuuuauuuucaauuuuguaauuuuucauaaaauaguauuuugaaaaaagauuuuauuuacuuuuauguaugggugucuugcuugcauguauguuuggugcgguaucaggggaagauaguggcagaauuggacaugaguccucuggaccuggaggaccuuuuauagaugguugcuaguugccauguggaugcugggaacugaacacaagcccuucggaagagcagccagugcucuuagccauugggccauuucucuagccuauaauauuuuuuuuguauuagcagugcccccucccccgacacauacuuaaaaacaauguguaugagugcuuuugccuuuauguuugucuguguaucacaugcaucccuguuuguccuuggaauacaugugcacuguggcaugcguguguaucuacacauguaacacacacacaagcaaauaaguguaaacucaaaauacagauagauacacacaauggaaaggcaucuguuaaucacuguaugccgaagauugccaguaaacuaaugacuacaugcuagggaaaaggcuuagcuuuauccuagguuccuuuuucagaaauuucuauuaggugcugacaacuuuaaacgagguaaagugacccuaugauuacuauuguauaaaguuuagaaugacugaucaaauuaacuagcauauuaacuacuucaaacauuuaucauuuauucauucucuuuugaaccacauggucuaacagugaguucuauuacuaauuauuauuauuauuaaugugaguuccucacauuaccaaaucaucugcucacacagcaguuugcacauuacauacauacauacauacauaccaacaaaaugaaucucuaaaacucugcuuuuaguuuuuuuuuuaaagacuuauuuauuuguuuuauguauaugaguacaccguagcugucuucagacacaccagaagagggcaucagaccccauuacagaugguuguaagcuaccauaugguugcugggaauugaacucaggaccucuggaagagcagucagugcucuuaacugcugagccaucucuccagcuguuuguuuuguuuuugagacaagguuuuuuuguguguguguagcuuuggcuguuccugaacgaacucacucuguauaccagggugaccucaaacucacagagauucugccugccucugccucuggagugcugggauaaaggcgugcuucaccaccaccugguuacuuuuaguuuuguuuuuuccccccgagacaggguuucucuguguagcccuggcuguccuggaacucacuuuguagaccaggcuggccuugaacucagaaauccaccugcuucugccucccaagugcugggauuaaaggcguguaccaucacugccccggcucuuuuaguuuuuuuuaaagcaacuuuuucuauuucuuuauauuuuuuaaaagcaacuuuaugugauuaauuauauagcauauguuucauagaacuguuuguaugaacuucuggucaauauuuuuacuauaauauuaauaaaguagaaaaaagcuauuaugauucagguugugucaaagacuguuuccucuccuuucuugcuaacuuuuacugucagacucuuugaauuuagagaccagaauuagaacuagucuccaguuuuuuauuauauuguaauuuagauauuaauggaguuuugugguccuaaagccugaaaagaaaaucagauagaguaguaacuauuguugaaugguuaguugcuaaucccugguguuuuuauucacucauuagaaguccagacaagaaaagguugaauguuggcagggagccugcaccauuguguggccuaaggcgaaacagaacuguggucucucugauucaaagagcaggaagugagagcuguuaaaggagcuaaaauacccaacucuucucuuucuuuuauggucucucuuuugauauauuucuuaaaauaucauuuaacauuauuugaagaaaagaauaauuaaaauguagauuauucacaugagcuuugccauucuuuauuauuuguacaaugcucauuaaaauacagauagaaaaauauuuauuuagaaaaaguaauuauaucauuuuuauguuuacccuaccaacaugcaacucuaucugauuuucuuuucuuuucuuuuuuuuuuugguuuuucgagacacgguuucucuguguagcccuggcuguccuggaacucacuuuguagaccaggcuggccucgaacucagaaauccgccugucucugccucucucugugcugggauuaaaggcgugcgccaccacacccggccuaucugauuuucuuuucaggcuuuaggaccacaaaacuccauuaguaucuaaauuacaauuuaaaaauguugccauuuuuauauuugugaaauucccacugaaaaugcagauauaaaguacgccuuuuuauguguauguguguaccugaguauauguauguauaccauguguauguaggagccuacagagaucagaggagguuagaggaggcugucagaucucuggaauuggaauuauagaagguuauaagcauccauuuggguccuggaaacugaaucugucuggugaaagaggaguaagugcucuuaaucccuggaccauccagcccccagauauauagauauuuaauuucagcuagggaugugauucaugauuuguuagaguguuugccucacacccacaagucccuaaauucaguuuccagagccauguaaacuggacacagugguauacacauacagcgucaacacuuaagaaacugaggcaggaggauaaagcuauccuuugccagugaguuugaggccgcccugggcuauauuacacccugguguauguuuggaggaccacgaacaacuuuguaaagucaguucucccuuccaccaugaggguucuggaucaaacuacgcugccaggcuuguuuaccacgugguuuuuuuuuuuuuuuuuuuuaaucagagucagcuaacuggcuccgguuguuucucuucucaggguacacacauugguucagaauucuaccuucaacuuacaggugaauaggacagacugagacgaagagguauuauguguuucccuguuagcgucuuuccuucugugcugucaugcacacagcacaaauagcuggcuaauuuaggagaauaauaaaagcaagaaauguguaucuguaguuaguaccuuaauggugguuguguucugguccuuagacuugaguagcagaauccauacauuauuuugaguacugauauuuuuguuguguccauuaguuauuaguuuuguaguuauugguaccgucuaucuuguucagguacuuuucuuuuuaaaagacauauaaagguuauguuuacuuuuauguguaugaauguguugccuguauauauguaugugcaccaugugaaugcuugugucuguagaggccagaagcuguugggacccugaacuggaauuacaggagguuaugagcuguugucugggcucuugcccaaccugauccuccagaagagcaagugcucuugagucccauuguucauucuaucucuuaguaauauuguguucacauuuucuucugccaagauccuuuuaaguuaguauuucauaaacaggauugauugggaaaaaccaaaaucucucuauuguuugaagauaaugauauuucugacuaugaucaagccuccggugaucaguaaaguacugaaggagcuucgucuucuagagagugacuuuuaccuuugcauuuucuaggucagaaaguaauuucuauccucauuucuucacaggaaguauguauuuaugguugcuuuuuaguuuucauuauuaacuaucugccuaauuauacaaguuaaguuccuucccauaaaagauugguuuucacaguuuuuugcuuauuguuuugagauacuuuuacuauguauuauaggcugucuuugauguacuguauauccuggaguguccccagagucauagcaauccuccugucuccguuuccugaaugcugagauuauaaucaugcgucccugcucuugaaaauuuuuuguucuuagcuuuuccuuaucaucaagcuguuggcuauauugacauaguggggucuaaaagcuagggugggguauuggacagauuagugugaaugacaccagagcucucacucacuuaaguauauaaaagcuucgagcauuguccccagcauauaaggugcauaccagugauuuuuacaguaaaaacucaguuucuucuaagagugaggccuuuccaggcacucuagucaauguucuaucuuugagauuuuaaagaaacaggaaauagggcguaggaccuacaaggaaacaggaagguuucccauguuguuauuucacauuccauuuuaauuaucuuggaaacacaagggaaucauaaaacaaugguuguauaaguauuuuuuguauuuuuaucuguuuuaucuuucucuuguuuuuauuauguuaucauuuuaggacacuagacacagagucuuuucuguuuggacaugucuggaaugccaugaauugauccaucauuacuagggacuaagugaacguuugucaaaaagauacugcguuuucuuucuaauuucaaauuauuagcuaaaaagaaaccagaguucucuucuuaaauguucauuaaaacaguuuuaugaccuccugaauacauaagucauucaggucaaccaggauguggggagacgaugagaguuauauaagcaguaacaagugaagcugaugguguuauaaaugagugacaaccaugcugaaaaaguuggggaagacaggacuagccugaguuauuucagaaaacuaagaugaaagacaagaugaauuacacauaaacauuaugugcuugguuaguuucuucaucagaggagugaguuagccagcaguuguuccuguguacuugcauuaacaaauaagaauagugugcauacugagaguaggcuuuuuuuugggggggggguggggguucgagacaggguuucucuguguagcccuggcuguccuggaacucacuguguagaccagguuggccuggagcucagaaauccaccugccucugccucccgagugcugggauuaaaggcgugcgccaccaugcccggcuugaguguacuucuuaaccuucuucuucccugugaggaucuagaaguuaugccacccauaguacuggucagaucuugauuucuuguaacauucuccaagugaaacaaaaacaaccccccuggagaaaugguugauuacuagccuaggggagaaaaaaaaucaagauauagcuggauuauuuaaugauauaggaagguuacaaaguacucaaaaaaugauauggguacauggaaguauagagccagcuuuaacagguacuuccaauaggccagagcugggacaaaguaaaugaugguaucuuuggaucaagagccauacaguaaaagaaauuucuuccaauccauaguagcauaaacagaugugaaagaggagaugucuuuuauguuaaauaguuucaauuuaauaaacuacuguuuagaauacuucuauuuuucuaguaaaauuguaggaaaauaccacaauguauuccuugguaaaauauuguuucaugaaauuuuaaauuuauauuuaauauacuauccaccaguuguaacucaaaaaucauuuuguauauugaacuaauuuaacuauugauaaggauaaacuauuuuuaauacaauaaaucaguuugucuuuauuuaaaaagaaucuuuuuaucuaggcuguagaaguuggaauacugcaugauccuuucagguuagugagcuccgugcuccugaaaacauuugaggagagcaugguaggaaugguacauuaagaugaauucuuauuuuuuugagaauuugauuucuguuuauuuuuuaauaguauuucauaaaucuaacuuauuuaugguccuauuccuagaaaacaguuuuacauuuuuguaaacugucucuguuuguacuaaaaaucacuucaguguaaauuggcuuuguugcgcuuguagguuuuguaacagcaggacuuagaaauucucuauuaucuacuugucuugaaauuggaauagaauuaaauuuaugcuuuucccuccuuaguucuguauuuuuuuaauauuauucaaauggaaaauucuuuuuaucaauuaccaucuauuuuggaucucuuuuuccucaaaaaccuuaaauuuaaccucuuucuggaauuugagcuugacuguucauaucuguaauuuuucaguuguuuuugcaaguaaaauuuaacuauauucuauuaaaaaacccauuucauucacacacacacacacacacacacacacacacacacacacacauauauauauauauauaccuccccccccuuuccuuuuugucuuguuaagaacuuuugaacauccucagccuccaacgugcuggaacuacagguguauaccaugaccaccagcuacaaucacuuucuguaacaucucuacucaauuauaauacacauaacuacuaaauuuauuuagccuaaaggauucaacaugggauuggagaggugguucagugguuaagagcacugcuguuuguccaaagaccugguucaguuuccaggaccuaugugacaguucacaaccauguguuacuccaguucuaugggaacugauggccucuucuggccucugugggcaccaggcacacaagugguucacaaacauaugugcaggcaaaacacucauacacauaaaaucaaguaaaucuacagagaaacccugucucaaaaaaccaaaaaaaaaaaaaaaaucaaguaaaucuuuuuuuuuuauuuuagcauauucacaguuaaacuacuaucacuuacaaguaauuuuaaaauauuuuuaugggggcuggagagauggcucagagguuaagagcacugacuacucuuccaaagguccugaguucaaaucccagcaaccacaugguggcucacaacuauccauaaugagaucugacgccuucuucugguguguuugaagacagcuacagugaacuuacauauaauaauaaaucuuugggccggagcgagcagagguccugaguucaauucccagcaaccacaugauggcucacaacuaucuguacagcuauaauguacucauauacauaaaauaaauaaauaaaucuuuaaaaauauuuuuacaucacaaaaagucuucgacccauuauuaauaguuuauucauucuuuaacuccugauaaucacuaaccaguuuuaucucugugaauuucucauucuggacauuucauagaaguuuaaucaaguaauauuuguccuuucgugugugguuuauuucacugaacauacuuucaagauuuuuccauuuuguagcauuaaucauauguguguguguguguaguaugaacguauggaggucagguugacaguguuuuucucucauucucuaccuuauuuuugagacagcaucucucauugaaccuggagcucacuaacugacuagacuggcuggccagaaaaucuguaaggcuuucucgucuccaucucuuaccagugaagugcaggugcauguuagcaugcccaccuuuucaugugggugcuagagaucugagccaagucccuaugcuuccgcagcaagcacuucacuuguugagccauauccuugauccucguuuuauuuuuaaguucauuuuaaauaucauuacuugauagauacuugauuguuuccacuuuucaguauuaugaauaauauuguuauuaaugacuaugugcaaguuuuuauuggguauauuccuaggaguaaaauugcuggucuguauauuuuaaguguuaguucuuuuuauaugauggacaccccaauaggacccucugcauucugucagccaccuuuauuuauacuuugaagcaugggaauuacagauuuugauaaagcaauuuuuuuuuuuuuuuguauuuucaaaacucuguguagccuggcuguccuggaacuugcucugaagaccagacucgccucaaacucaaagagauccuccugccucugccucccaagugcagggauuaaaggcaugcaccauuacugcccagcaaagcacagauuuuccauucuaccuucuguguuaugucuuuccuucagugguuagaauaguguuucauaauccaugcuugcaaagaugugcugggccuaugcuuuuuuucccugaggauuauauagaauuuaacaaucuuugagcuauuuuaguuaauuuuuguuaauaacuugaaacuaggagguaucaacuugauuguuuuccaugugguuauccaguugcaacacuguuuguuagaaagguuaguuuuuuuuuccuuauuaaauugucuuggcaucgucuuauaaauaaguuuaucaaacuggagauggugcuacaugccucuuacucacugcuucggaggccaaggaaugacuaucacaaauucaaggccagccuggggcacacagugagaccuugucucaaauuagaaaaucuguuaauuaauuuacuacuuuuaucugaauggccaacuucuguuccacagauguguguauuuuucuucaugacaauacgacacuguucuuauuuggugauuugaaguaggauuugaaaucaggauagagaaaucauuuuuuuuuaaucuuuuggucauauuauuuuagcuguucuaggugcuuugaauaucaguauaaaguuuaaaagccaguuacuaguuguuaccaaaaaggcaacuacuguuugauaggguuugcacugaauaagcagguaaguuuggggaauucugccacucacagcauuguccugacacucuguacaagugaaaugucugcugagagcuuuauuuuuuuccaauaauguucuuagcuuucgguguaugaauuuugcacucacuacuauuuucuacauagaaaaauaguagugcuaaucuuuuaguaucuucucuuuuuacuuucccuuuucuguucugaaccaaacgggacuuagucccaacaaauuuauuuuuugaaauucaaagcaguauuugaagauauuuaaaauguuuuguuuuguauuccccaagauaaguuauuauguagguagggaauauuucuauuauauucuaaaauuuacuucucuuucaggaguagcuuauaagaauggccauucaugggcuaaggaaauggauggguccuuuggguaaaguuccugugugggcaugaggaccugaguucaaaucaccagugaucauguaaaagaugcuguaacccuaacacuaggggaacgcagagacaggugcauccccaaagcuugccagcuagccagccuaggugaaaugguaaauuccagcuuuguugagauggauucuguguuaguaauggaagacaccuaauguauacaccuuucaacacagaaugaucauucauuguagugugggcaaaaacagugagccauccaaagccuuccuauuuauaucacuaggauacaagcacuuugagggaauaacacuaucuuacucauaccacacuccagguguagaauacugaugccacauaacaggcacuuaauaaacauuugacucuuuaauggcuguuacugccaguccuaggauagaaagccuguuaacggcauggaauggucuuaucugccuguuuguuuaguuguugcucuggauuagaaagaacaauguuuuggguuuuuuuguuuguuuguuuuuucuauuugagagagcugaaaugaacugacuuuuagucaaacugaguugugauuugugcauguguguuaguuaccuuuuacuuguuuuaggaauuuguacagagaaaguuaauaacaggccugaggcugcuguucuuagaaagcccugcauuccuaguuggccauuggcuagcauaugugauuuguguuugggguguuuuggagugcucccacugagugugacccugcagguguccaggaagagaagugaaccugcaaagagacaagaauggaagguucggauugacuugaucaaccugggucagauuucugaaagucugaugccaggugguucauugucagaauauuuaaaacacaguacaauuugggaaaaaguuuccaagcaguaaucauucccauuccagguuuccaggcaacaaucauuuuaauuccaggugcacaauaaagcuuaaggugugauuacauagaaacuucauuacaaagugcaggaccauggcucaggggguuaagagcacuugcacucuugcagaggccucaggcucaguuccuggcaguuacaugauggcucacauccacguguaacuccaguuccaagggauccgaggcucucuucuggccuccaagggcaccaggcauauagggaaaaaaugugcauaugcauaaaaaguaaaaauaaaucuuuuaaggaaaauauuugugguguucagaugaugacucaguuugcaaaaugguugccaugucagugugagaaguugaguuuggauccgaaauacucauauuaauaaagaaagagcagcguaaagcuugcgcugaagaggcacagacagguggcucccuggauucuggcuagcuagccucaucuauuuggugagcucuagguucugagacucuuuuccaaaaaauaaaguggacaacacacacacacacacacacacacacacacacacacacgagauagggaaaauauacucucuuuccuuauaacuggagugcuacucuguccuuaggcauguguucugggaaaaggauauccuugcuucaguuauucaguuauuugccccaugccugcaagguuucugugcuguuuauuuuagauaguucauuuugacacuuagauaaacagaagccaagcacauaagcauacccagaauuagucccugaacuauguuccagggcagagauaagaugcuuagacuucuccaguacagauaaauauauuacaacuacuagaggauaaguguugugagacuuuuggauuguuuagacauagaauggcagugaagauuaaaaaaaaaaaaaagaaggauaacccggguguugugucuugugccugcacucccugccuucaggguuagagcaggaaugugaugccaagaucaaucagccugggcuauacagcauguuccaggcuagccugggcuucaaaggguugcugucuuucagggaaauucacuugaaauuauucauagugaauacagcagauguucaggauaguagucauuuuucaugucuauauuuugucuuacuaagacagcuucauuuuauuugcauucucuaaaccagagcucuugugcauuuuguuccccaguuuucaucugcccaccaguaaacuguuaguuauuacuguaauguuuuugccuccuaaaucucagaauauaaauuggcuauuucugaauucuaaaaaaguuuucuagaauuaauuugaaaaauguuucucuauaauucuguauaacuucuagauuuuuagauuuauggaugccagacuuuggagacaaaaaaaguuuaggcucuucucaaaauguuagaccaaacaacauguccuguggauaaacccaagauuguuuuugucuuuguugaaauccuccuuuuuuuucccuccuuguuucaagucuuccucauugauugaguaaacucuguucuuugacuuuccugaguugauaguuuuguggaugcaugccuguucauuaagcauccugccaguuaccaccaugccucucauuccuacauuuucugcuuuugucuacuuuugguuaguugucagauuuaccuguauuuucauacagugacaagcauguauuucuauuuauaucuuuuaaguaaaccaauaaaaacucuauaucgugaaagauacaccagcauauagaaccuuugcauuuuaaaucuauguuuggauguguugccaaucuggucuugaauucuugggcucaagucaucuguucucagcuuucugaguagauagcuggacuacagacaccaucugcccgguaugccuguaauuuuaaaaaauugacuuuguauuugagaauuaauugaaauuaaacaaagguuaaaaaaauuaguguuuaaauuuuuggcacuagaauguccaugccauuaaaaaauuuuaggccacaggguagugacacacaccuuuaaucccagcacuugggaggcagagacagguagauuucugaguucuggugggccacccuggucuacaaagugaguuccaggacagccagggcuacacagagaaacccuuucuugaacccuccccccacgcccccaaaaauuaguauguguuauuuucuuuaucugaaaaaaauuccauacuuuguuuguuuucguuuuuuguuuuucaagacaggcuucgaacucagaaaucugccugcuucugccucccaagugcugggauuaaaggcaugugccaccacugcccggcaagaccauacuuuuacaauuaauuuaaaaaauagcauccaaagugaggaguuucauuauggcauauacauauauuuuacuuucaaauucuuuuuuuauugaaaacauaccauugaauaucaaaaaguacaauaaaaggggcuggagagauggcucagcgguuaagagcacugacugcucuuccagagguccugaguucaaaucccagcaaccacaugguggcucacaaccaucuauaaugauaacugauaaccucuucuggugugucugaagacagcuacaguguacucccauacauaaaauaaauaaauauauaaaucuuuuuaagaaguacaauuaaaagaauauuauuuagauacaugacauguuuguucaauuuuaaaaaaacugaagagaaauauguauacaguuauaguuaauccuucccagguuggagaaaggaacgaaaauuaauuuuuacauuugaaaaucaagugaccauauccuauuaucucucucucucucucucucucucucucucuaucuaucuaaucuaacguaucacacagagacacacacacacagacaaugugauuucagaauggagagccaagaaaauaucuaaguuuugaacaagaaacagaauuucauuugguugagaauuagaauuaacuacacuuagcacuuguaauccugaguuugaaacuaacuugggcuacguaguaaauccuuaucucaaaaaaaaaauaaauaaaauaaaaaggcugaauuucauuauuuaccuaaugauaaagaacagaaggcccacaccccuuuucaucuucuuauuuauuacauaaacauaugcauauauggauuaguuaugaauauuucauuuuuccuauaucauuaaaaaucauuuacuguuuauuuaugugugugugcaugcacgaguaagcauacaugcaugcguguauauguucacauguaccauggugcauguguagaagucagaggacaauuuacaggaguuaguucuguucuucgacaguguggguuccagaaaucaaacucaggacuuuaggcuuggugacaaguauguuuacauauugacccuucucauuggcccuuuuccuguauuuaucaaaggucagacgccauagcauaaaugucuucucuuccuuagucauguguggaugggaugguauuuggagaggauaguucuuccgcugcaaagcuauuuugcauacuguauuuaucaccccucauuuggcauaaguagggguugaauuuugucaggagauuuuuguuuccuuuuuuccuuuuuccuuuuuaaauuggaaguauuaauaaaagucuuauauuuaaaaauuauuuaaguugcuuaagcuuccauaacuugauaagauagauauuugaagguugauucuagcuuugcgugcuugggauaaauccaccaauuacuuaucauuuugaaauucucaacuauagagugaccuuauaauuuucuagaauaaauaauuuuguuuucaaaaacuccagggaguucucuuuuuaugcauugcuucccuuauaaaauguuauaugugaguucuuccuccucuuccgucuccuucuuugagacaggugcucacuauguauccuugauuggccuagagcuugcuauguagcucaggcugaccuugaucagagaggucugccugccucuaccuccccaaagcuguaauuaaagccaugugccacagacaucuuuguuauuugcugcaguguauaccaggcucugccuucuaucuugcugaaagagcccugggauugcagguguguacuacuuccagaguuacaaugguuucugggcaaacaugacacccaugcuugcaggaccaacacuacucauugagucaaguuuuucuuuucuuuuacaauuuauuauuauuauuguuguuguuguuguuauuguuguuauuuugagacaggucucauacaucccaaauuguccugaauucccucuauagaccagucuccccuagaacucagaaauucauuugucucuuccuccaucugaauguuaggguuaaaggugugugccaccaggucuuaauucacuuaauuugauuauauucaguuucaucuauuuuccuauaagugacauaacuuucuucuucuuggcugaaaaaaaaaaucucuauguugguucuaaaacuuagcucuugugagugugcuucaaaaauaccugaucuguaaauaucccuaugagguguugacuuggaauccuugguauaaauacucaguaguggacuagcugggcuguaccauguacuacauuuguuguuggauauauguauauuacaaacauccauacugauuuccauaguuacuagaugacuuuaucuuccuagaagcaguauaaggaaggguucccaucagcuuuuguuuuuaaaacuauacccuuuugaugagauguaaucuaaauguaguuuuaauuugccugucucuaauaacuaggagguuuaacauuucuuugacauuucuucauauaucuaagaauauaugaagaaaucuguagaauaguauuugcaaaggguguuuugaccuuuucauuuucuuuuuguauucuagccccuuuucuugacucauuacuguagcuaagauaucaagcaauauaguauauugaguaagaauggauaagugagcuaggugugguggcacuugucuuuaauuccagcucugggaaggcagaagaggguagaguucaagguuaucuauccacagccauagagggaguuccaggcuaggcagggauauacucagugagauccugucucggaaaggaaagagggaaggggaaaaaggguggggggagggaaaaagggggaagaggggaaaaugagggaaaaagggaaaaaagaaaggaagaagaagguggucacgcaggccugcaagauggcucaauggguguagguacugccuccaagcucgaugaccugaguuugaucucaggguccacaugaucucaaaauauuuucugaccuccaaaacacacacacacacacacacacacacacacacacacacacaccucaccccucuaaaguuuaaaaaaaaaauaaagugaauguccuugucuuguuuugauuuuaguggagauguuuuugaguuuuuacuaguuaguaugauuaauguuggcugaagauuugucauauguaucuuuuaggaguuauauuuuuuguaucucuagucuuuucagggcuuuugugaagggauguugguauagucuaaacucuuuuauaucaguugagaugcaauuaugauuuuucugcuugaggcuauugauuguuacuuacauugacuuacauaugaaccauccuuuccucucugcuaugaagccaacuugaucauggugaaugauuuuuuuuuuuucugguguguuuuucaauucuguuuguaguauuuuauugaaaauguuugaucuaagcuuagcagggaaauuggucaguaauuuuauuccuuuuuguuuuugcuuuuaaauaaaaagaguuugguaguguccuuuucuguucuguggagugguuugagaagccuuagaagccauugcuauguacuuacuaauuuuuggaggagucaucuugccuugauuuuucgcguuucuuguguuuuuguguuaggacuuaaacaucugggguuaagucauugguugggauguuuuguuuguuuuuaccuucuuauucuuucaguguaacugcuugcaguguucaggagggaacgggaucguguuuaguugagugucauuuuccugugcuagacuagcauugagcuucagucccugcacuccccugagaguagaauacuguccacgaaagcaaugaguucucauuuauucuaguucuacuuccauugcauuccuucucagguucccagaugccuuagaacucuugucugagcuauaaauugaguuuccuuuucuuggcuuuuugcagucucugauaacacggacuucccuucuuuaguguacugaucucucaugaaagauaugaaggacugauauggagucuacauucucauuuuguacagaacccuuauuccugaugucccuucuucuuaaaauguuuaucugaagggaacaguugugccaccaugccaguagcucugacuucuagcuuauauuuuugaauugcuagggauauauauauguauauguauguguguguguguguguguguguauugcucuuuuguugguauuagugaguauuuucuaggauauuuuaaaguaauuaaaaaauauaugcaucaagccacauaaguuuucauugauuacuaucugguuugguuuguacaaauaaacuauauuacaaaaauuugauaacuguaacucuauauaccuucuguuuacuuggcuuuguacuuugaaaguacuuugcauagcagucaguguggcaggucugcuuauauaugcuggguggacagagucaucaagccugucaaugcuuuucuagacuucuuuguuauguucagaaacauuaauuuaauaaguaauaugcauugcugaagugcuccuaaauuauacuauuccaauucuauacacuucaaauaaagaacuguacuggcuaguuuugugucaacuugacacagcugggguuaucacagagaaaggagcuucaguugaggaaaugccuccaugagauccaacugucaggcauuuucucaauuagugaucaagggggaaaggccccuugugggugggaccaucucugggcuggcagucuuggguucuauaagagagcaggcugagcaagccaggggaggcaagccaguaaagaacaucccuccauggccucugcaucagcuccugcuuucugaccugcuugaguuccaguccugacuuccuuggugaugaacagcaguauggaaguguaagccgaauaaacccuuuccuccccaacuugcuucuuggucaugauguuugugcaggaauagaaacccugacuaagacaagaacugauucagaagguccuaagagaguauugguuauguuuagugauuaucuuugcuacucaaagauacuaggaaagcaaauuuuaaaaaacuaaauaaagaucagauguugcuuuuugauaaccuuuuacuucuuugguauuuucacaaugcugguuagugguuuuuaauccggucauauggcaaaugcuaaaaaucagcuaaauuacauaauauauuugaagaaagacagguuggcauuaaaguaaggaacaguuauguuccuugaggagcuauugaacauuucaucugguuauuuuauuuauuuauuuauuuauuuauuuauuguuuuuuuuuuuuuuuuuuuuuuucccuugagacaggguuucucuguguagcccuggcuguccuggaacucacucugucacucuguagaccaggcuggccuugaacucagaaauccgccugccucugccucccaagugcuaggauuaaagguaugugccacuauugccuggccauauuuucuuucuuuuuuuuuuuugucuuugaaauaguacuauuuuucccuuuuuuauuauuauuauuagauauuuauuucauuuacauuuccaaugcuaucccaaaagucccccacacccucccacacccacucccccacccacccacucccaccucuuggcccuggcguuccccuguacuaaggcauauaaagucugcacgaucaaugggccucucuuuccacugauggccgaccaggccaucuucugauacauaugcagcuagagacacgaacucugggggguacugguuaguucauauuguucuuccaucuauaggguucauauuguucuuccagcuccuccauugggggccuugugauccauccaauagcugacugugagcauccacuucuguguuugcuaggcccuggcauauucucacaugagacagcuauaacaggguccuuucagcaaaaucuugcuaguguaugcaauggugucagcguuuggaggcugauuaugggauggaucucuggguauggcaggcucuagaugguccauccuuuuguuucagcuccaaacucugucucuguagcuccuuccaugggugccuugcucccaauuccaggaaggggcaaagaaaccuuggucuucguucuucccgaacuucauguauuuugcaaauuguaucuuauaucuuggguauucuaaguuucugggcuaauauccacuuaucagagaguacauaucaugugaguucuuuugugacugaguuaccucacucaggaugaugcucuccagguccauccauuugccuaggaauuucauaaauucauucuuuuuaauagcugaguaguacuccauuguguaaauguaucauuuuuuuuucaggcagggucucucuauguagugcuggcuggcccagaacuagcuauguagaccaggcugguuuguaacucagagagauuuacuugccucuacuucccaaguguuagguuaaaggugugcaacaccaggccuggccuaugugguggauuuaaagcuaguuuagaacaugguauuucucuuuuuucuuuucuuuccuuuucuuuuuuucuuuugagauagggucuuacuuuguagcucugcuguucuggaaguuacuguguagagcaggcuggccuguaauuuacucccagccucugccucccuucccacgccccugcuggguuggauuaaagguauauaccaccaugcucuuuugaagaugguuuucuuuuccuuuuucuuuuuucuuuuuggaagaagucaaguuccuuuuuuuuuuuuuuuuuuuuaagauuuauuuauuuauuauauguaaguacacggucgcugucuucagacauaccagaagagggagucagaucucauuacggaugguugugagccaccaugugguugcugcaauuuuaacucaggaccuuuggaagggcagucagugcucuuaaccgcugagccaucuauccagccuguuuuuuuuuuuuugaacagcagaaauauuuaaugguggacagagugauaagaaguauauguguaaaggaaggcuguuaucagggaauauauuuucuuuaauuucuuauuauuuggauauaaaaauuaauguccaaaagugcuggaagguguggauaaagagaugguucaguaguacugcucuuccagaggaucuaaauucaguucacagcaaccaugucaggcagcucacaguuaccuuaucuccagcuacaggaacuucuaaugccucuguccuaugugagcaccucaacucauguacacauaccuacacacacacacacacacacacacacacgcuuaaaaaauaaagauaaaucuugaaacagaaaauuaucggguaagcauaagauuaaaaauuuauucaauaauuaaauuugaaggauuuaaucuuacucaaauuagauuaucauauauuauuaagugaaaucuuaaagguuauuacaaucaaugguauuaucaaagaaacaucaauuuaucauuguguucuuuguucuuuuguucagcuucucagaaucaagaacggcugugugcauuuaaagauccauaucaacaagaucuugggauaggugagagucgaaucucucaugaaaaugggacaauauuauguuccaaagggagcacguguuauggucugugggagaaaucaaaaggggacaucaaucuugugaaacaaggcaagucauuuuucucuaaaauuauuuaccuuuuuauuuuauguguauugguguuuugccugcauguaucucugugugagagaaucagaucuugggaguuauagacaguugugugcuaucauuugggugcugggauuugaaccuggacccucaggaagaacagugggugcucuuaacagcugagccaucuuuucaguccccaaguaauacuuuuuuucccccuuaaaauugcuuaguguuuuuuguuuuuguuuuuucuuuugggugcugggaaucagacccagacuaugaugcacacggcaggaucucugccacagggcugucuucagcacugcuuucauacaguuggagcuuaucuagaaaugacguguagguagauuaaagcccuacccagaaaaguaguauauaagaagauaaacacauaaauauaucuauuuauucacccacaagcuccaaauucauaaaagaaaguuuacguuuagucuaguuuguuuguuugcuugcuugccugccugcuugcuuucuuggcuaaaauagggccucacuguguaaauuagcccagccuggaacucacagagaucugccaucuuuugcuucccaagugcugagacuaaaguuaugguccaccaugccugggcuuuuaguaacaucuuucucuuuacaaguuaaaguuugugaaugaaguuugaaaaaaacaaaaagacuauucagaaaagccaaggucuacaacucaguucucuuaaaaauauauuauuuuuaauauugauuuguucccuuuagguauauuuucuauauacuuuaauauuuauaugaauaccagucuucuuuuaaaaucaggguaauguuacauaaaaauguucuccucuuuucccuccauguuauuauaagugcucucugaaaacuugugugccucagcaccguguuccacugggaauaugcaucccaguuuacuuacauguuuugaacaccaugcuguuagcagguuuucacugaaaugcauuaucuggcaaugaaaaauuccaaacauaaaaaaguugugucugauugcuuuuuauuuuuauuuauucuuuuuuuaaaaguagauucuuuaaaguagaaucaauagaucauaaaaauguaugguuaugcucuagauuaaaauugcuaaguuuuuccaaaauuaccaucauacacacauugauuacagaacuguaugcaagugaaugucacucagucuuuguuaugauuguauuauuauuuuaaaguuaaggacaauguaaaucuaaaauaguuggacuuugcuguuucuucaguaauucuuauauuauggugcaguuaagcauaauuguuuuguuguuugcuuuucccugugaaaugucugugguaccguuuuuauuuagguuucuuuaugacuacauuaguuuuauaagacugcagguauuucauaauuaguuguuauauuuaccauauugcuuccuaacuaacuuuaauaucgaucuguaggauguuggucucacaucggugauccccaagagugccacuaugaagaguguguaguaacuaccaccccacccucaauucagaauggaacguaccgcuuuugcugcuguaguacagauuuauguaaugucaacuuuacugagaacuuuccacccccugacacaacaccacucaguaaguauuuacaguaauuucuuuauaauuccuuguucuagaaguuuugaaaauauaaauagauaaacauucaagguuaguaaaauuuucucuaaaaucuucaaaguaagauaccaccaccagcaaagcauugguauauuuauuaucaacgaaaucugaaucaagauacaguuuucccuuugucuggcaugauggugugcgguuguaaucucagaacuccagaggcugaggcagaaggauuguaaacucaagacagccugagcuaccuggugaguucuuaccagucuggacuacauaaaacaccauaccucagcaaacaaacagaaaaaucuaaaacccacuuaaggaagggaauuuggugauaucagauguacaugauggcacaugccuuuaauccugacacuugggagguagauggaucucugugaguuugaggccagucugguuugcauagcaaguucuaggccaaccagggcuacacagugagacccugucugaaaaacaaaauaaaacaauaauaacaaaaggagagaggagagagauggggguuagggggugggggguggggagacuauagcuguaguuuggccugugacugaaguccuauucauucuggaggccaaugaaggagggucacuugaggucauguauucaagucuagugugggacauauagagaaauucuaacucaagaaacagauagcagcucacaugauaacacaggccuuuaauccagcacucggaggcagaggcagaugaaucuauaugacuuugaggccagcuuggguuacauagcaaguucuaggccagccagagcuucauggugaggccuugucucaaaugaaaaauccaaauccaaaguaagagcgaaaaccaaccaaaccaaaccaaaccaaaccaaaaaaccagccaaacaaaaugaacaucaacaacaaaauccuucauaguagauauacauguaacuauugaccaugaaauugaaacuuggaauacauguuauugauauagacuuaggaauuuaaacauauccacaaaugcauugcacauauuauaugcauauguauguagucauauaaaauguaugugcaauuaaauauaaauuuaaaaauuuaaacauacauacugugguggcuugaaugagggugaccccuauagguuuauauguuguugcuuggucuccaguugguggaacuguaugggaaggacuagaaugugugacccuguuggaggaagugugucacugggagugaguuuugagguuucaaaagcccacaccauuaacuguuagcuuucuuucuuugccucgugcuuguggaucagauauaagcucucagcuccugcuauaacacuaugccuuccugccccuaugcuaccuaccaugaugguccccaaugggcucuuuuuuuauaagcugccuuggucaugguuucuuuucacagugauagaaaaguaacaaagguagaaacugggaguggcacauugcugugacaggcuuggaaaugcuacuuuuugaagaaaugcaugagacuuuggauuaggagaacaguuaaugcaggaggcauggccauacuaguaugagcuuggaagacaguauugcugagaguacuaugggcuauggaggaccaacucaacagguuucaaagaggaacaauauuagcaacuaggcuagagucuguuuuuguuauauuuuggcaaagaauauaguugcuuuuuguuuuuguccuaagaaucuguuugaggcuuucuugugugggucucaggcauaaugagaaggcacucuacucuaagcuguaucucuaucugucuuaguuaggauuuccauugcuguauagagacaccaugacaaggcaacucuuauaaaggacaacacuggguagagcuucaagucuacccccacagugauacacuuccuccaacaaggccacaccuccuaauagugccacuuccuaugggccaagcauauucaaaccaccaccccaccccacauaaacauuucuuauuucuuuaaaaaaugaaaaaaaaaaaggcagaagcauuccaguaacaauaagccugcauugugcccagaucuuagucuguaauaguguucucugcuaaaagaaacuauuucucuuugagaaaauauuuauuccauaacaagagcaaaguaagcccaaggcugaaauacuuuaugcuagaaaguaaaaauuaccaaaaaugguggagacucaccuuaaagaugcaggagccaugcaccugguucccuguggcauugguugagcuagcuggggaagagcuggaaagcuuguccucauggugcaagugugggagaucuguugggcugacucgcuuagcuaccaccaaggccuagguccagggcuuugagugggcccaccccaacaucuacccugucugugagcugcuggagcaugaaggggccuguccuacagacccaaagcgguaggacuuccuugacucauggcaacaggauguccaagaggaguccugguggggauccaguauugauauuguaguagaagccuaccuugaaccagacuaguaacucuuugaagugagcauuugcaaguaaaucuguguggacaaaaggcucacugugggacacacugugacauauugcagcuucuacaacaauuuuuguuuguuuguuuugcugggagguugcaagggcugaaggcagauacagagggacagggagaugagugggauuggggugcgugaugugaaauucacagacaaccaauaaaaagcuaaagaaaaaaaaagaugcaggagccagcucuguagaaccccuucaugggcucaaauuggggaaguuugaauucaagaauagcugaguacaauaaugaauuacaaccauuugaaggaacugaagcucacgaguaaaugucaagugcuaacugaaaauacaggaguauugggauuggucagucaucauucagcuuccaucauguaggucagaaaggaaguaucaaagaggaccauauauuugagagcaaguucaaugaggagccagaauauuuguaugguuuuaaaaugucuccaauuuaauuguaaaggaaaaauuaguaauugggauauggggccuagcucagugguauagauuauuugccuagguuucacagaucccuagguucaaucccuuggguuauaauaaauaaggaggaagaggagggguugggggauuauuuguuuuuaauuuuuagauuuauuuauuuuacuuuuugugugaguguauugcauauacguaugcacgggcaccaaaugcauaccuggaaucugaagaggucagaagaacugcaguuauggaugguugcaaaccaccauguaggugcuaagaacugaacccaaaucaucuucaagagcagcaaguguucuaacuacugagccaacuuucuagacuugggagggguguauuuauaaaaguuagugcccugcaagacaaagagaaacuggaaaagagcuccuuuaaagaagggguaaggggguaaaugcuuguuaugcaaacaugaaggacugaguuuggaucuccagcaucaacauaaaagcuggaaguggugacauguauguaucacuucaaagauggggaggaaggauauggagacaggacuacccuggagcucaccaagucagugagcuucagguucaaugaaaagacugucucaaaaagaaaguagaaagugaaaaaggaagacagcugcuguagaacucuagcucccacacccacaagcacaaccacaucuacaugcaucccacccacacacagacaagcacacauauauaacacacaaaaacaaaaaaauguaaacauuuuguuauuuuuauauuccauuuacauguguguguguaagaaugugcauguaagugcagaugucauggcaggccagaagaaggaauugguggaguuacagguaagccauuucuugugggugucaugauccaaacuuggguucucugcaagagcauuagguacuauuacccagagaaccaucucuucagccccauaaaacaucuaaguguuaaaagaacuuuucaacuaagcguuauuugaacugcuauaaugggcugcccuaauaauaacgaaaauguuccauucccaggucucaucaaaaaaguugaucauguuggcaugggcuugcagugucagcucuggggagacagacagggagagaaugaggcucacuguccagccaguguagcuaaauaagaaagccccagguccucuugagagaccuugucucagaaaacaagguagacagugccugaggaagaaugacaccaagcugucagcuggccuccauacacacaaagugcacgcacagcuguauguacacaaguaccucugugugugcaugcacguaugcacacgcuuaacguacagugugcugaaggcuaacaugagucaaguaaauaaauggauguuuaauauugccucaaugguaaacuuugcugcuaacaaaauugugguuaaauaguagccugaguaucuaaaaauaagaaaauauauaaggaaaaugucuauugcauauaaaauauuacauaacuacugaagcauacagcuguaaaaucagggagaguggugcaaacuaggaucccaccacuuggagacguggaugugaagauucaaaguucaaggucagucucagcuauuuaguaaauucaugaccacccuggguuauaugugauccuguuucaaaaaaacuaauaaguaaauaaauaaacauaucaauaaguauuaugaaaauacauaaugauguugaaaauauuuauauuauguuaaacaaaaauucugggggucuggagagauggcacagugguuaagagaacuggcuauucuugcagaagauccaaauuugauucccaguacccacauggguaucucauaacuaacugucuauaacuccaguuccagaggaccuugugcccuuuucuggcuuccauggguaccagucauaaaaguaauacacagacauaugcucaggcaaaagaccuagacuaauaagaaagaauaaaaucugaggguguaauaauugcaucuuacuaauauaauauugcuaaaauuugagagauuacaaagauacuguuuccccacaccuuccuguuucucuugcggaacacuauuuuagucuagacaggccucuaacucccuauguauccagacuggcuacaaacuugaaaucuuccuguuuuuacuucucaagccuugcaauuacaggugugcagcacuauaccagacuuguuucuuuuuuaaaaagugcccauuggggcuggagagauguagacccagcuuagaguccuagcacucacauaguggcucacaacaaucuauaauuucagccccagacaaucugaugccauuuucugacaucugcaggcacuaguuauauguauuguacacagacauacaugcagaaaaauauacauauacauaaaauuuaaaaauuuaaaaauauuugaaaagguuaaguuuaugccccccuuuuguacacaugugguacauaggcauuuaugcaggcaaaacccccauacacauaaaauaauaaaauuacauuuuuuccagcuauaaaauggaaagguaugucuauugaaagcugguugcuacuuucugcuaaaaagacaaagacggcauaguuaaaaggaaguguagaucacaacaaaaaugaugggccccucauuuauauuuguguuuguuuguuuguuuuguuuuugcuuuuggagacaggguuucucuguauagcucuggcuguccuggaacucacuuuguagaccaggcuggccucgaacucagaaauccuccuggaugugacaaaccaaugucuuggccauaaaugagucucuuacuucgcugaaccacagagcuucacagucauucagagauuaauuugauguaaaguuaggacuauggagaauuuauuuauuauuuuauuuaccuuuaguuuuacguuuuaaaaaguuauagauuuuaugaauuuuuuucuccauuuuuguuuuuguuuuuauuuuugagacaggguuucucuccauaauccaggcugaccuuaaacucacagaaauccaccugccuguuucuugagugcugggguuaaaauccugaaccccuccacccagugauucuugagaauuauuauaaaacuauauuucauagguuuuuuagaaaccaugagaugaccacauagcaauaaaaucucuauagacuaucaauccuuguuuuugugggcuguuauuaaaagauuuaaaagaauauaaagucuauggguuccuuuuauugaaacauaaauguagugucuuuuaaaguaauuaaauacuagcccuuaauuauuaauauugaaaagagcuauaugaacacuauucuauuuacaauauagauucuacucuuauuguagauuacuguauuaauuauaguuuugguuguugugaagagauacccugaucauggcaacuaucauaaaggagagcauuuaauuggggcugacuuagaguuuugggauuuauuccauuauuaucaugguuggaagcaugaucacacagaggcuggagagauggcugagaguucuaucagcagaucagcagacagcggaaaaagagucaggcacuaagcuugagcaucuaagaccucaaaagcucccucuccacaccccuaguuacacacuucuaccuguccuaauagugccacucccugugggccuaugagguccauuuucauucagaccaccacaauuaccagccaauucuaguugauaaggacuuuaaucucuguucaaaauaugaaaaaauaaaaaagucauugcucuuuuuucaguuuuggcaauugaagcauaguuacuuauuuuaucuucuaggaagauuaauuacuaccauuaaaaaaauaaaggaauuuuggagcuggagagauggcucagugguuaagagcauugguugcacucccagaggucuugaauucaauucccagcacccacaugguguuggcuuacaaccaucuguaaugggaucaggugcccucuucuggugugucugaagacagcgacaguguacucauauacaugaaaugauuuuaaaaaauaagaauucuuaaaaaaaaaaaagaauuuuauaauuagaaauccaaacuaguuauuuuuacuguaacucuuauuaguuggggucugaagcaaaaauucuguuuaggacaauguuaccagaaaauuuucuaagauaaaacuggcuagagaugagggcuaagggcucauaguuaauaccuaauacuuucugugccuaaauuuuuauuuuccaaagauuuucuccuuuugcuaguauguuucagaguuuuggaacagauuugauugcuuucauuauaugagaaucuuaaaaaauacuaaggaguucuugggcuggggugguagcucagagguuaagaacacuugcuauucuuccagaggaccaggguccagcauccagcgcucacaggguggcuuugucacaaccagcuauaacuccagcuggauccaugccuccuucuggccucagcgugaauguaaugcacauacauacauucaggcaaaacacccguacauguaaaauaaaacuaaauaaauuuaaauuuaaaaagauguugcugggcagugguggcacauaccuuuaaucccccaggacuuaggaggcagaggcaggcauaucucugugaggucacggccauccugaucuauagaguaaguuccaggccagugaggacuacacagagaaacucugagucgaaaaagcaggaaacacacacacacacacacacacacacacacacacacacaauucuguaccuacuuaauauacaauuuaaaguagacuuagguucagauaaaguuguggaguuaagaaaagauaaauuucuuucuuccaucugagaucuuacuuucugaggaaggaacaugcuuucucuauugcauaguguccgagucugaaacuguuaacuuuuccuaggcacuguccuuucuucacucaauaucgguccuauuauuagcaugguuuucccuuggucuuaagacaguaguugcagcuaucuauuuaauggggcuuuaucauaaaauacuuguauuaaacuuuaaaauaguaaaaaaugcuguucuauaugcaauaagcgucuaaugagaguuauuagacugagcagccuguucagcaccuguaagacaagcacuuagugaugucauagguacugggaagcagcugagcaacaucuuugaacaugugauauguggcagauagauacucuucucuuauuacucucucuauacuaacauuuuaauuucacccuuucagaaacauuaugaaauagugacuaccauuuucuuaguuuacacggaggacaccaaggcuuagauauauaaaaguaacauaccugaugcucuguaguaacaagugauagagucaagauugaaaucuggguguucugacgccaggauauguuucaucaguauacaaacagugagcacuuuauauuuuguuaugggcuggguuaggggauagauucuuuuuugaaaauaaucauuuccuaaaauucaagaacccugccaugauuuucacuguaacuguauaucccuaagaauucuacauuuucuauauuauuuaauauuuucuuaaaaucaucuaauuaauuaaauuuuuauauauauuuauaaauuuauuuuaagccugugaauguuuugccuguauacauguauguguaucacaugccuguuugauccccugggucuggaguuauaugaauguuauauguggguaaugggaacugaacccagguucuauccaagagcagcaaguauucuuagucauagagcccucuuuccagucaccuacauauauuuuaaaugcuuaucauuguugugaaugaaaagaaauauuguaaagguaacuuuaaaguuuauuuagaaacaaaacaaaagcuguauacacauaaaauaaaauauaucaauuagcuagauauuguuguuuuaaagguugaagcuggcacuuucuguguuaaaaaaaauuggcaaauguuugagagguaaucgguaaacuacuaccaaguugagauuuuucucucaauuagacaagagaaagaaaauauuuaucaggaaggacaugugaguuugaagccagccuggucgacagagcaaguucuagaacagccaggacuacucagagaaacccugucucaaaaaacaagagggguggagggagggaagaaaagaaagaaagaaagaaagaaagaaagaaagaaagaaagaaagaaagaaagaaagaaagaaagaaagaaagaaagaaagaaagaaagaaaaagaaagaaagaaagaaagaaagaaagagaaaggaaggaaggaaggaaggaaggaagaaagaaagaaaauacucauuaauacggucuaugcagcacugaaaaccaaaaguccagucacuuagguaaacuguguuagucugagguauuuuacagucauaggcuuuacucugcuuaauaagaaaaucaguuugugaggcuggagagaugacuuagugguuaagagcacacccugcuuucccagaggacccagacuggguucccagcguccacaggagucaggugacaacugccuguucuuuagugucaggagagacagugccucuggccaccaugggcacuugcacucauaugcacaggcagacacacaugcacaccauuuaaaaaagaaaagcaguuuuuaagugauugaacuuauaucuauaauauuuacuuaucuuguuauacuuuuaagaaaucuuuauguauuuguagauucacaauuuaaaagaaguauauaauuauuaaaauuuuuggaaacuuguuuuuagaacauuuucuugauaucuaguaucgcuauaauuagccuuccuaacuauauaaacaagauaauuaagucaguagagaagcaagcaaaaaacuguucauauauauuuaauucauuaauuaaaccuaauucauucuauugaacuuuggcaguucuuuugugaaugucaggauauaaauguagaauucuuuuauuuuuucacuuacauuauucauuacuuugaaguugggccaaaugaugagaaacaagauugaauugcaucuaaacccagguuuaggaaauaacauuauaauuuuauucuguguuguuaauauuagaaauuauaauaucuggcaacaaaugucuucaucuucacaccaagcuaggaaagaaagcuuacagucaggaagccaguacuggcauggggccacaaguagucuaugaccucaguuuuaguguuucucccuaagggcaugaaauagaaaaugggaaauaaggauggaucaagaugcuuguuaguuuaagagccaaaacaagacauauuuuuauacuuauuaaaagaagaaagaacaaaaaauuaugugcauauuuuaggacaauaauuauuuugaaauaauuaggaauaggccuggagagauaucucagcaguuaagaacacugacuguuuuucuagaaguucugaguucaauucccagcaaccaaguggcuguuuacaaccaucuauaaugggaucucuuggcauucuuguagugagaauuuugcuuucuuuaaaaacacaaaaauauuauaaguaugucuuuuuguuuuaaucccaggugugggauauggggcuguuucaaauuguccacagcagcugacucugauuugccgugugcucuagagugauuuugccagcugcauauaguuucugugagugugugacguuuggaauucuggggaauauacucuaaagaagguauaugaaugcuaaggcccugagaggcaggguuguuguugauuaguugcaguuuguuaaguaguucugugcaaagaagaaauaagaagaaauuagauauccugauggcaaagaucaaacuugccucaaggaacuugauguucuuagccagcaggaaguagucuaccgauaauguagcccccuuucccgucuugucuacuguuaggcguuugaaaggguagaagaaagggguagagaaggauggaagaaagaagaacccacaaaaauaaguccagcuacacauuccacucccuggcccccauagguuuuuaggcauauuguaaugcaaaauucauuguuuucaacuucaaagaccccauaguuaucacaguauuagcacuguuuaaaaguacaaagucucuucagagaccaagagcaaucucuuaaguguaaccccuguaaaaucagaacgaagaagcagauugcauacuccaccguacuguggcgcaaggugugcgucaccauucugacagggaggaaccggagcacagugaggaggaggagcgucuggagcaggacugaagccagccaggcagacuccagacuccgaauccccaugucugaugccacagugcucuucagcuuugcugccugcagcacaccucuuuucucuugggcugguuccauucccuguuagcuuuccuuggcagguaucccaagcuucuggcaucuucaacaucuugggguuuccaaagcaauccaggcuuuaccuucacagcuucaccaaguggcuuucuuuggccuccguguagggacaucucugccacacaccuggccuuagugccuguccuuaguuguggagggauauuucauaaccuuuguucaauccuugacucuaaagccagaacaaugugaccaaagccaccaaguucugcugcuuccuggggcuggaacaugacccccuucuucaaauacauuuucaccacuuucugauuuugaugauuuccuucacugccuaaaccugguuguucuggagcucccuccauagaccagguuggccuugaacucugaaauuucccaugccucucccaauuugagugcugggacuaaaggugugcaacaccacaccugacccuaagcuucccuuuaguuccuuuucacagguuggaagcuuagcugggugggaucuugcccugaagucaucacucccuuuauuccacuuagcaucagacuuuucuuuaauguggucaucuccuugaacacaggacuuagcuccauucuacuuccuggugccccuuuucuccucaaacuguguauuuuauauauuuuuccuugcuuagcuugcuccucuuaauuauagaucuccauaagcagggccacacagucaauacuagguugucuggagauuuuuuucugccaaagcucuuaauccauaacuauucaguuuaaccucaggcagauuuuuuuuggacaggggagaaaguagccacauucuuugccaaaauaucacaagauuggucucuuggccacacacuauuacauugcucugacaccucuugaacugguuccccauggcucaaaucacccucagcaccauugucuucugugcuucuacuuggauggcccaguaagccccacuuagagcagucacagucucagcaguuuacuuaaagggaagauggcucagcaauaagcugucauuuaucacuucuuugaagcuccuauuuuagcaaauaauaauaaaaauacauugauuuuuacauguacacaaaccauuuucugauucugagccauggauaaccugguccacucuaugguggagacauugagacacaaggaaagguagugaaaauagguuuuuacucuucagguuugugcugcuauaugaaaauuuuugaggcuuggaauuauaaccaacagaaauguguuuggcugacaguauggaaauuugaaaauaagucuguccuaugguagaaaaugaaagaacgcaagaaagcauaugagugagaguggaagggucacaugcauccuuuucauaggagacaaaucccuaaacuguauuaacccauuccuaagggugacauucucagacuuggcaacccguuaaaggucccaucuuugagguggauauuaaggucaaauucaaaccauagcaacgcucaguaaaaugucauguaagcaagaagaugucaagugcugaugguaucaauguaucugcauauaguuuugcaguuuuucaguguuuuauaucauuggaaauaaaccacacuguauaaaauugucacuugaauaaaagcaaaaggcccauacccaauuagcuauaugguuucagugcauugucauaugauuagugagcuuuuaucugcuaauuuauaaaagacuacacucagcacugaacaacauuuacuggagaaugucuuguaucauauaauagaaagaaauaaaauguucauaggagauaaguuuaaguugucugccaaguacaaauguaguagguuauuggagacauaagaauauauucuuuuugagacuggagagguggcucagcauuggauauucuuccagaggauccaaguucaagucuuagcacccacaugguggcuuacaacugucuguagcucuagcuccuggaaaucugacacgcucacacagacauaugcaggcaaaacaccagugcacauaaaauaaaaauaaguaucuuuuagaguuuuauuuaaagccacauuuuuguucugucaaugcauauauuuuggguuuggugguacacaccuuuaaucucagcacucagaaggagagacaagaggauaucugucaguuugaggucagccuguuuugcauaaugaguacauagucccugucuccaaaauaaauaaauaaauaaauaaauaaauaaauaaauccagaaauaaaaccgcucugaggccacaagcuugaagucaugugucaaaagugacaacaaauuauugaugaggaagaguaguuacuagaacaugaauaccgcaagucuuacuccucuuuccauucuucaaacacgauaguguagacuggcuagcuuauaaaguuuauuuugacucacagcguuggucuguguucagagggucacauuuagugauggcuuucuugcuggcagaggucuugggguggguaggcaggagaugagagcuugugaaaagacuuagccaaagcagacccacuccucagaugucucuuuaacuccgcugauucauuaauuacuuuaaugaauuuaauuacauucaugaaaccagagccuuaacaacucuuaaagauuuuuaucugguccuaucuccuaaugauaucuuauaauggaaaauaaauuguuguuguuuuuuguuugggguuuaagacaagacagaaccucacucauauguagcacuggcuagccuggagcuuucuggguagaccaggcuggccucaaauuuacaaugaucuaucuuaucugccucugccuguaccaugcuugguuggagagauuaaauuuuaacgugaaauuuggaggugauaaaccacacucaagccaaacguuaacauaaucugaaucuuuuaaaaacauauuaaaucuccuagcuaaauuacaaccaguacuaucauuccuaauuggauaguaaauaaaaugucuuuuaaggugaaaaacuauaacaacaauaacaaaaaaacaaacugcggacuccagucaguuuucugauuugcaucucuaagaaucuccuagggaguggugauggucuuccagggaccuagcacacuuggaagaccauuggaauagagaacacauuuagcuagagcucucaggaguuacuuccaaagccucaucauagaacaagaccaccaagaaaguuaauguauggauacauauaguagaccaacauaaaaucacaucaccauacccaagaagccagcacauucuaaaacuaccccugccauacuuuauaccugacaaauguuuccuguacaaccuuuuuguacuuauaagguaggugaaucaauacaggccucugcugauacaguauuugguagacaagggaaaaaaaggucucccaaaaauauguggacccuuuagugucaucuacaagacggucuagaaaauacaggauuuuugcacuccaucuuuagugcaccaggagggcacggucugaauuauuaucucaguaucauaugacccaaccccaucccaccaugccacugucccuuauauuccucaccuuccuuugucgugccuucccucagaagccuuugugguuguuuuguuuugugcuuuuagcccugcacucuagugauaagucuuuguaaucaggucuacaaacguccuuaggauguuguuacggacuucccauuuucucagcaaccuacuuccucucgugugugugugugugugugugugugugugugugugugugugugugugauucuaggucuguauccaggagaaacagcuucaaauguuugagaaaauuuucucaagaauuuuuguuuauguaacuuguaaggaaauaaaucagcccucuuaauuauucuaccuaauauauuacauuagcuugagcuaauucagcugccuaaauauuugaaagucuaagcacccaagacauuaaaacaguuauauuuucuaaaauaaguuuuguuauucauuaaaaauuauuucaugguaauaaaugggaaaugauuagcuguuugacacaggacaugauacuggaaugacuuucaaguauuaaaauuauuuaauaaugucacaggaacacaguccaugugauuauaaauucuggggacaaauaauuuagcucaacacagauauuuccuagaguaugauuauuauuauucauucugugaugguucuaauucauuaaugugcuucaugauuaacaguucuuugaaaguguuguaauacauugaacauuauucuuucuuuauuccacacagugaaaagaaaaacccagagaguaaaucccaaacucaagaguuuuauuucugagaauugguccuuuguuauauuagucuggggauuuauuagacuuuacagucucuggucugaguaguccuucaauggaugucucgugguagaagagcaaagaauucaguaguuguucaguccacaggaucuggaugucucagcaaagucuaccugcuagagucccagagaauuccuagagagcugcuagucuucagucuacauuggaauaccaaagaaguaaauucuaaucccagcaaaguaauuucucaguaacaggauagaugaacuugccaguggcaaugagggcaagcagaccaaaagcuuuaaaaaacuuucuucuauguccuuuuaagugggcuagcaccagaaguuauagcucagauuuaggguggaccuucccaccucaaaaaauucaaucaagaaaaucccucccagcugugcacagcugcuugaguucuaguuaauuccagauguaggcuagaugacaacaaaaauuagcugucaccuuaguauaaaaugccugugauuugaaaugauuagaaacaaaguuacucauugcagcauuguuacagcaaaacagaaguaaccaaauguacaucaguagagagcagguuacguuacuuugccacaauaguauaaaaaaauuguaugaaguuuuagaauuuauucagauuaaauacagauaagcuucaaggaaauauuaaguacuucagaagaggauauggccaugcauuccuauuuguuucuuuauucuacauacauaaggaaaauuucaaaaauacaaauauauaugcacauguaugugguugugugugugcauuguugagaacuagagauguuaagaagacuucugaauagcucagcauuuuugugucaguguauuguguauucaaauuuaagagacauaaauuuaagaauuauuuugaguaaaacauuuuaagaucuaacauucuagauaauuacaauguuaaaugcuaacaguaucaguacuuuauaaauacugaaauuuguauuacucuauuuuuauuuauauguaugcaauuacuauuuuaaaaaauaaguucuuuuuugaaaaccaugagcucuaaccucugagccaucucucuggccucauuaagugcaaagcuuagcuuuuguaagugugucuacacugucauagagucuccaaaagucgcucugaucuugcagaguugaaacuauacucauaacuccccauuccgugguuccuccacgcccgagaggauuacauucacacuuccuaaucuuagggguuugaccacuauagaaccacauccauagaaaugaaauuguaaauuuauguuccuucuacuuuuauagaagauuuucuuuaucuucauuucagacuuaaaaguaaaguuaaaaagaggggggagaucauaauugaguaacugaaaagcaguaaauaagauaauuuuaggcugggcgugguggcacacaccuuuaaucccagcacuuucuuugacaggcagaggcaggcggauuucugaguucgaggccagccuggucuacagaguccaggacagccagggcuacacagagaaacccugucucgggaaaaaacaaaaaaaaaacaaacaaacaaaaaaaaaccaaccaaacaaaaaaacaaaaaaaaaaaaaccaaaacaaacaaaaaaaaagaagauacuuuuaaaaaguaaaagacuacaggcugauuucuguaaguuccaggccacucuggucuacacaguggguuccaggacagccaaagcuggacagagaaacccugucuugaaaaaaagggggaggggaaugguaaaagacugggcuggagagaugggucaucaauugagaucaccagcugcccuucagaagaucgggguucaguucccagcaccgguaugguggcucacaaccaccucuaacucuaguuugaggaucuaauauccuuuucuaaccgcugagguuccuguauaaaguuggugcacagucauacagucagccauguacucugacacaaaauacauauuuuugaaauuuuaaacuauaaacaaggaaauuaaaaguuaaagagaacaaauacuacauguuuuccuguuuuguuuuacuccuuccuuaugacccuuuucucuuuaauuuucacuuuauucucccuccccucccuguguguguucauuuuucugcgguucuuuuguaaaucaaacauaaaaugucuugacaauuagcaugccauggcuuguuuuuguuuauuguuauuuuuguuuuguguaaucuaagagcuaggucaggauguuuaaccagauaagguaaauuaaaauuggccuuaaguauucaguguuaaauuuuuguugaaaaguaaaaagaaauguaaagucuuccccuacucaauuuuuaaaaacuacuaaacauaaacauuaaucggauugugguuacuguauauguaguauuccaagcauguuaguuaugucaacauuauucauuccauauaaaauguuugugaaaaugcuaagcugugugauauaguuuggaaauauuuuagcagucuuaauuauugucuuagaaauucauuaagcucuuuaauugcuuugauguuuaaauaguaguacuuugcuuuuaugaaaaacacauuccuugaaggaaaaaccuaaaggccuaauuugcuucucugcucagagugguuaaagauuaagcagaggacauaaccacugcuguguuuuauuuaaaccucucccugcugguugcugcacauguaacaauguuguucuuucuuugacacagucccacacaaaagcugaguguaguaaggaagcagacagccugccuccaguaguagcccccgccuggcuccaggauauguaaacagaaacaucccaggcuccagugaggcagaccacgggucccugucuguucuguacucaggaagugcuugccugggaaagcccagccauugcacauaggcauacuuagcaguguuuggguuuggcugaauauuuaacugaggacacuaagagaagaaaaagaggguauauuagggcaaaggaauaagaaauuucauguuauauguauauauaacauaugacauagaaagaaucacuuuaauggcuggagagaugauuuaagagccuauauagacauagguauauguguucucauucucuuugucucucuaucucugucucuuucuccuggccucugggaguaucugcacucauaugcacauacccacucacagacaugaauacauacacauaauuaaaaauaaaacagaaaucuuuuuaaaaggaauuacuuuaaagaaauaaaaaugaguuuuccagucaaaagcuuuuuuuuuuuuuuaauuacacacauaugauuacacauauugcaauauuuuuccuggcagguuuucagugaugucaaguuuuuagacuauaugacauaaccuggaauguuccuaauuugagacauuuaaauaccauauguauguuuuuaaacauguuuaaaagucccuuaauacuuuuuuucacccucucuauuugcgaguuaaugaauuaaagcuccuauuuuuccauuuucaguuauauauuuaaauaccuuuuacucuguggaaagaaauauguaaugcaauaggaaaggagucccccuaccccagccccacccccaccugucaguagugguaccucucauguuacacaauugcuauacugagcuccucucaguuccuagagaugugggugugucuugaaaauaaaauauuuucuguuuuaguggguaugcguagucaccaucccccuuacucuccgacuuagcuacaucuccaucccuaucagugaauucuuaggcaugucuacauguaugauauacaagugggguuaaucuucaugacugguuuugacagcacauuucagauaugaugccagaauaacaggcuauaaaagaagacaauagaugguacuuaaagguuaaaugugggcuggagggaugguucagaggguaagagcacugacugcucuuccaaagguccugaguucaaaucccagcaaccacaugguggcucacagccaucccauaaugagaucugaugcccuuuucuggugugucugaagacagcuaaaguguacuuauauauaauaauaaauaaaucuuugggccggacugagcgaguggaguugaccugagcgagcagagguccuaaaauucaauucccaucaaccaaaugaaggcccauaaccaucuguacagcuacaauuuacucauauacauuaaauaaauaaauacauaaauaaauaaaucuuuaaaaaaauuuaaaucugccaggugugguaguacacaucuuuaauuccaguacccaggguggaggcaaauggaugucuuugagucugaggccagccuggucuacauagugagcucuaggacaguuaguaugacaacaauaacaacaauaauaauauaaaauaacaauuauggugaugauaacaauaauaaagccuauugaaaguaacaaugaagggacaaauaaagauuccuaauuuaaauuucagaaggaaauuaauacccacuaccuauuagaaugcuaacucuaacaugaaaaaaaagaaaagaaaauauuucaagccagcauucaccauggucuuuguucuuugccauuucugucucuuuaaucaucucugucuuaaguaucgcuacucuugcuaccucgguguucuuuuugucuugucuuucauuuaucacguuuuuguuuuguuuugauuauaacagaacauuauugauugguaguuauuuauuauuuuauguguaggaauguuuugccugcauguauguguguguguguaccacacgcaugccuggugcucucagaagccagacgaguguauuggauuucccagaacugaugguuguuuauagacagcugugagccaugugggugcugaaccugaguccucuguaagagcagcaagugaguucaaucauugaauaguauuucuaccucuuacuuacugauguuuaagagaaaauacuaugccccuuguuucuaauuugagaagagccuagauauugucuuuauuuuugcuuaauuuuucugagaaaagucccauucuguagcccaggcuggccucaaacuguauugaugaagguuuucuugaacuccugauuguuuugcuugcaucucccaaaugcuaguauuacugguguguauccacauguuuagcugaaauuuuauuuuuauaaaauaaagugcagugguucuguuuuacuaaagguuucacuuucugaggucuuaguuaaauacaguuaaccuuaacucaaaaaauguuaaauuguaaaaucuagaaaugaacaauucauaaguuuuuaauugugcacaguuuagaguaaugcaauucaauuaacaccauucgacaucauuucuuuuuuuuuuuaaagauuuaucuauuuauuuuauguaugugaguacacuauagcuauacagaugguugugagccuucaugugguuguuaggaauugaauuuuuaggaccucugcuugcucuggucaacgcagcuugcucugguuggccccgcucgcucagucccugcuugcucuggcccaaagauuuauuuauuauuauacgcaaguacacugucgcugucuucaaacacaccagaagagggcgucagaucucauuacggaugguugugagccaccaugugguugcugagauuugaacucaggaccuuuggaagagcagucagugcucuuaaccgcugagccaucucaccagcccauucgacaucacuucaugugagaugucaauagcuauuguucuagcguauucauauggcauguguucuguggugguuugaaugagaguggcuugcauaggcucauauauuugaaugcuugguccccaugaguggagcggauuaggagguguggccuuguuggaggaggugucacuggggguaggcccagucucucucugccugcugucuguagccuguggaucagaauguaaaguucucagcuaccacuucagcaccuugucugauuguuuccugccaugaugaucauggacuaaucuucugaaacuguaagcaaggccucaguuaaaugcuuucuuucauaaguuugccuuaaccauggugucugccacagcauugaaccuugccuuguaggugcuuaauagcugucucaguugucagguugaugguugugguaucacgggugcugaugucauuuuauuuauuuaguaauggucccaaaugauuagaguagugcugacaauuuuaguacucucuguuuuuguaaauuauuuuguuauuacuuaucauugaccucuugcuaugccuaugccuaauuuuuuaaguuacacuuuaucagagauauaagaaaaaaaaaaaaaacccaauacagcaggugccuugaagcaugaaauggcacaguguuuacauacauuccaugcauaccuuuccaaauacuucaaauuaucucuauuucuguaaaaaucaucuuuagauuacuuauaaugauaauacaauuuaaaugcaguauaaauaguucuuauuaccauauugcuuagaaaauaaagaccaaaaacuaagucuauacacaugcaauaugaauaaaucaccauaguucuacuuauguauuacacauguaugacaccuugucaccugaccuugagagagacugaaaaucuguggaugacaggugcugcgcuggacuuccuaaacaucacuuccuucauggcgauccauuguagugguuagugcaugaaaaaccgagguuuugucuuugaaauuuucuugguuucucucaaguauuuuuaguuuaugguuuguuguauauacaaauguggaacccacgaauucggagaagcaguuuggaucaggacuaucagaggcaucuacuaacccuucuguaauguccucauagacagggaaguguacuguauuagucuuguuuugucuuuuuggguguguguauguaugcgugugcgcacacacacagauguggaaugguacugugccuugguauagauguagagaucagaggucauauuuugggaauugguucuuucuuucuaucuaucauaugagcccuggggauugaacucagaucaucaggguugauggaagucacuugacugagccuuagcagccaagggauugauuuuauauauauauaucuuguguuuaaaaaccacaaguuauuuaaucauauauguguugaaauaauguuuccuuuuugaguucaacaaauucuuaaauaaguuauuauuuuauugaguacaaucuuauaacagaaugagcuagguuaaaaauauacuauucgguccuuuaaugauauugugcaaccauuauuucuauguaguuccaaaacauuuucaucaccccacaagggaaauucucuaucuaguaaaaaauaacucccuucucccucuuuucccaugccuagcaacuucuaaccugcuuuuagucucuauggauuuaccuguuucuggauaugaaugaaaucauaaaauacaggaccuuuagcaucucaucuucguagguguauuacauuguuauugauaaguguaugaacauucgcauuucuccuuguagagcacacagugaugcuguggagguuuucguuugaaagccuauuuccaggagguuuucguuugaaagccuauuuccaggucuuuguguauaugccuaggaacaaacuaccaaauguuagauaaauucuaaaaacguucugagaaccuacuaaacuguuuacuacaucuguaccauuucauauucccaucagcaguauguaaguuuuuaguuuuucuauauccuuaacacuuuuuauuuuucuucuuccuuuuuaaucuuuaaaaauaguuacagacaugcuacuaucuuucuguaguaaguugaguuaggguuuaguauuguagugaguugaggcuguuuggaggggggugggggaugguugguugauuggcuuuuuucuuuuucuguguacuggagagggauccagggacuugcaaauguuagacaaacacucuaccacugaguuagaucccuagccaaagaugaguuuccauauacagucuuucccucuauaaauuacuguauguuaaaguauuguuaacuacauuuaucaguauguuaaagucuacugucuaguaauugucuuauaauuuaagaguauuucauggcaucaacauaaucuucuguagaaauacugucaauaccuuuuauuaugcaguugugcaguauuugagauaauucacuggagaaacacugcuauugagguuuaucauuugguauagaauauucaaguuugaccacaaguaagauaauuuuaauguacagucugcuugauuuuaauugacugcaauuaaaauugucaaucaagaugguguaugccuuuaauccuaguacuuacuaggcucagacaggggguucucugauuucaaagucagccugguuuacaaagagagcuugucacagugagguccucugucaaaacaaacaaacaaacaaaacagaaacccaagaaacaaacaaacaaacaaacagaauuacaaguuuaaaauuucaaaauauauuauauuuuauuuugaccgacuguaaagaauguuuaaguaaggauaguguggccuugccacuggucaaauacuaccuauaaaaccuauagugaaaaccaaacauggauuucuuuuuuuuuuaauauuuguuuauucauuuauuacauguaaguacacuguagcugacuucagacacuccagaagagggcgucagauuucauuacagaugguugugagccaccaugugguugcugggauuugaacucaggaccuuuggaagagcagucagugcucuuacccgcugagccaucucaccagccccaaacauauauuucaugggcgaucucauucugcauuaaacucuuuacugauaaguaguuguuuguauuuuguauauacacugcuuggaucuaguuauuuuuuuauagaucuuuaaacauggugacaaguguauccuccaguuuucucucucuguuuaagacauuuucaugcguuucuacuuuucauagaauuauugcaucccuguucuucuccuacuccuagguauaaccuaguuuauggacauccauuuccaagguauuauauagauaagauaccgauaaguauagauaagcuauagauaagaucugacccauagauggagcuaccacauaaauguuuacguguucacaccagccuuauacucuagauacauauguucccauucugcaaguaaauaaauguugguucaugaaugcagacauuuucucaaggucaaauuaauaaguggagggacugagcuucaggcucaauuuagauuuagcugcccacaaagaaauguucuuuucauuaauauuaaugauaucaauacuaaugaucuuaauuaccaucgauugcauagaaguuuaugcucuaguaaacucuuagaugccccucaaguuucauaacagauaugugagguacacagcacuacuuuuuacaaaggaggaaaugaggcacacaaaagucuagcaaccuguugaggucuacugaguacaugguuucaagccaaacaugaagcugggcucagugguguacaccuguagucuuacauuuaggaggcagaggcaagaagauugcagaggccagccucugcuacugucuaguuauuuuucuauugcugugauuagacucaguaaccagacaauuuuuuuaaauauagaguuuauuuggggcuuauaguuucagaggguagaguuuaugaccaucauggugggaagcuuggcagcagacaugcacacauggugcuggagcuaagaacucccaucuugagcuacaaucaugagguggagaaagagacuaggggaaugcuucuaaucuuuugauaccucaaagcuuccccacagggacacaccuccuccaacaaagcuacaacuccuaacccuucccaaguaguuuuccaaccaaggaccaagaauggaaauacgugauccuaugagggucauucucauucaagcuaccacgacuacauggcauauguguguguaugagugcagacacccucaccuucaggcuagagaagaugacagaucauauggagcuggaguuacaggugguggugaacugcgugauguggauucugggaacaggacuugggucuucugaaagagcaauauacacuccuaaaauuacaaguauuuuaaguuuauauaagauaaucuauaugaccaaaucaugccauuuauaacuaucacaaauugauuuuucucuauuuuucacacaagaauauuauugauuugauuauauauuaauacagguuuccuaaaagcuaguuuguugguauuaaauaaaauacuuuucuuuuuuucuuuuagguccaccucauucauuuaaucgagaugaaacgauaaucauugcuuuggcaucaguuucuguguuagcuguuuugauagucgccuuauguuuuggauacagaauguugacagguaaaacaaaauacuacuuuuggucuuaucauuuaguaaacaugccauuuaaucagaauuuauuuucuuuaaguuuuuuuuuuuuuuaacauuuauuuguuuaguuauuguguaaagggaggacggucauacgugaauggaagucagaggauaacuugcaggagucguuuuuuccuucuacuauguggauucuagggaccaaauucaggucaucauguuuggugacauacagcuucaccacuuggugaacugcuugccagccccaugguuucccuuuaaaaaccuccguggaaaauccauguacaaacacacauaguugucuccauuuucagcuucaacaaacauuuucacccaauuuuuacaagaauuuuuuaaaauuuauuuuuauuauugugccugugcuugccuauguguaucauaucugugcuucuuggaggccagaagauggcauugcaucgcuuagagccagaauuaugguggugguuuaggaaucagcacuuauucauacauuuuaguaauucuaccagaauuuucuuaaaaauucaguauuauaauuuuauacuuuuuuuuuuaaagauuuauuuauuuauuuauuauauguaaguacacuguagcugucuucagacacuccagaagagggcgucagaucuuguuacagaugguugugagccaccaugugguugcugggauuugaacucuggaccuuccgaagagcagucgggugcucuuacccacugagccaucucaccagcccaauuuuauacuuuuaaacugagucaucauggaauuaucucacagaauucugcugucaugcuguucauuauuuaucuucaucauuauuauauauuauauauauguauauauauauuauucauuauuagugauuuguuuuaaccccugcugcagcucuucuuaacuguaauauauuuuuaauuaauuuauuuuuauuucauguacauuuguguuuugccugaauguaugucuguguaaguaaggauaucagauccccuaaaacuagaguuugagacaguugugagcugccacauggggcugggacuugaaccugggccucuggaagagaagcuagugcucuugacaccacugagccaucucuccagucccuuaacuguaacuaacauuaagagguuggcguuuucguuuuaagaaggcuguguaucaguaaguguucucacuccucuaggagaccggaaacagggucuucacagcaugaacaugauggaggcggcagcagcagagcccucccuugaccuggauaaccugaagcugcuggagguaaggcugugcuuagguuguugucuguucugcucauuagccacucuccuaauuaguacucguucaucucaggagcuauuuagaaauaagccuuucugagccuggucgugcacaccuguaauuccagcagucgggaagcagaagaaaggauuuccucagguuccaggccaaccuggucugugaagcaaguuuccagccagggcagcauagugagacccugccuuaaaaaaaguggagaaggagaaugucuaaguguguuugaaaugguguguaguuuaagcacugagagaaguaccaacugaaacauggaguuuugcccaggauuuauauuuucccacaguggaguuugaggcaugccucugccuuuucuuucuuucuuucuuucuuucuuucuuucuuucuuucuuucuuucuuucuuucuuucuuucuuucuuucuuucuuucucucucucucuccuuccuuccuuccuuccuuccuuccuuccuuccuuccuuccuucuuuccuucuuuccuucuguccuuuccuucuuuccuucuuuccuuccuucuuuccuucuuuccuucuuucuuccuuuuuuccuuuuguuuuguuuuguuuuguuuuguuuuguuuuguuuuguuuuguuuuguuuugagacaggguuucccuggcuguccuggaacucacuuuguagaccaggcuggccucgaacucagaaaucugccugccucugccuuccaagugcugggauuaaaggcgugcaccaccacgcccaccgccucugccuuucaaaugcuguguuuugauaagacuuuauuucagagggcugucuuuguuuauaaaaauaaugguacaagacuggguauggugacacgccuuugauuccagugcacaggaacagaggcagacucugacuuugacgcuagcuugguuuacauagagaguuuuaggauagccagagcugcauauugagacucuguuuaaaaaaaacaaaacaacagagucuggagagaugaugucucaguggauaagagcacugacugcucuuucagagguccugaguucaauucccagcaaccacaugguggcucacaaccaucuguaaggggaucugaugcccucuuuuggugugucugaagacagcaacaguguacuuacaauaaauaaauaauaaauaaauaacucuuuaaaaacaaaccaaacaaauuaaaaaaaaauaauaauauguuaaacauguauaaagaaaugaugauaccagcugauagugguacacaccuuuaaucccagccccugugaaacagaagcaggcagaucucugucaguaccaggccagccuggucuacagaacaaggcuacacagagaaacacauucucaaaaaaccaaacuagcucacaaagaaaauagugguaaaucaccaaccuguuuuaaugaaaauucccuagaagccaaaaauaaagagaacugguuacauuuugcuauuucuuugugcauugaguaaauuuuuauuccauuauagauaauguguauauuuuacuguggaacccucagacucuugcuaauuucucaugugugaugguuuucaaaaaaagauuuaauuuaauuguaauuguguguguauguuucugcauuucugcaugugguauguacacaugaguacagcugccugugaauacuagaaaggggucuugacgcuccuggagcuggaguuauaggcagcugugagccaucugcagugcaugccgggaaccacacuuagguccucuggaagauuaguaugcuuucauccacugaguaucucucuagcccugcgugguguuuuuuggguuuguuuguuuguuuguuuuuguuuuuuguuuuuuuuguuuuuguuuuuuguuuuuugguguuuuuuuuuuuuggagacaggguuucucugaauagcccuggcuguccuggaacucacuuuguagaccaggcuggccucgaacucagaaauccaccugccucugccuccccagugccuccccacgcccggcuugcgugaugauuuuuguuacuuguuuuuguaagcaguugacuugguuaaacauauacuacaaacgugucuuuugggcagaagcucaacucucaguucaguuaccuagaaucugucucacguggucacugaauuccuugcucugguuucucuuuuggaggcaucuucccucacccuguagaagcucuaguugccacagauuacauccucugguucaaaagaccuuuuacugucauuuguaguuccacuacucaaagcugauuugagucagcuuucaagagaaaacccauagaaaagguuagcucgccauauaugcauucuuuucuucugugccucgaugccuuagacucuaacugcuuuugcuuauauaacaguguaucuaggccuuccuuggguuuacuuuucauuuuguccagaguauuuugcucucaucaauuggaagguuagucagguaggagcuucaucagcuacaccagaugcagaugcuggcugcuuuuugguaaggaauagacugaaagcagagcugcuguauaucauggggaauuguaggggcuuuuguuguuguuguuguuuucauuuuaguaaauuuaauuguucaauuucaaugugaauuaauaacuugccuuuuuaaaaacaaacuuacagcugauuggacggggucgauacggagcaguauauaaagguuccuuggaugagcguccaguugcuguaaaaguauuuucuuuugcaaaccgucagaauuuuauaaaugaaaaaaacauuuacagagugccuuugauggaacaugacaacauugcucgcuucauaguuggagacgagaggcucacugcagacggccgcauggaguauuugcuugugauggaguauuaucccaauguaaguucuuuagaaaaaagauccugccauuuauuuuaucagcacuuuguuugacauucauucuuguguaagcaccuugucucaucagaagcuuauuguaauuugugguugaguacucugaggugaacagguacauacauacagucaucccuuaguguccucaggcaauugcuucuaggacaccuaaaacacgugugcgcacacagacacagacacagacacagacacacacacacacacacacacacacacacacacacagacagaaguucaaguccauuauauaaaauuccauguagcauuuguaugguugcauaucauuuuuugaucauacagugaaaaugccauguuaauaguuauucacuguuauacuguuuauuuaggaaacaaugacaagaaaaauaaugcuauauacagaugcaaagauaaucuuuggguuuuauuuguuuguuuuucuugacuuuauuggagaagaaaccaagaucugaacaugcuaagcaaguacuuuuccacguaguuaccuccccaucccuagauacuuuugauauaguugauugaaaccuagaaugugaaucugcagguauagaggacugacuguagagacuuacaaauauguauucuauuuauaaauuauaacaauauuguuuguaaaauuugguaaaaaauuuuuuuucaaguuaaucugauuguccaaagaaguguuuaaaaggaaauaaucauccauaauuuuaauguuucaaauauuaggauuaauguugcugugaugaaccacuguuaccaaaagcaaauugagcaagaaagagccaacugagaagugcugcauacuggcuugcucaucugcuuucuuguuuugugguggggguuguuguuaucaucucuagauaugauaggccuuuguauguagcucuugcuguccuggaacucacugugcauaccagguuagcaucagauucacagagaugugccugccucugccugagauuaaaggugggggccaaugugguuggcuuuuuuuguuauuguuuguuuguuuguuugcuuugggauguauguggguuuuuauccugcuuuuuuauagaacccaagaccaucagccucuaaucacuaauuaugaaaaugcccuacaaacuuaccuauaggaagacaugacucagaugacuggaguuugggucaguuacauaaaacuagucagcauacucucuucuuuucuuuucaaaaauaccuuaucauuaucauuauaucuucauggaauccuagccuaugcaaauccuuaagaagguugccuaacuugccuuuucuuguugaagcaaauuaguuucaauguuugauaucuuuuuuccuuuauacagggaucucugugcaaauaucugagucuccacacaagugauuggguaagcucuugccgucuggcucauucugugacuagaggacuggcuuaucuucacacagaauuaccacgaggagguaagaugaaugaaauuuuaaucauauuuuagaagaaaaauaauaauuuauacuguuaaaauuugaauauuaacuaauugaaagauccagcaugaagaaacauauuugaauauaacagaaagaaaugcaagauggaucucauuaagaauuugaagacuuucuuucuaaaaguauacuuaaagcuauuuuuagaaaaaauuauuuggagggaguguaucucaaagguagaaugcuuucuaagcauauauaagaccuuugaucccuaauaucauaauaucagacaaaaaaauccuagagguuuuuuuuagaccucuugaaguuuauuugugaaccuuagguuaauucucuucgcuaggcuauauuuuccuuguauuuguuuuaugugaauaaauaacagaguauuaguuuuaauauuacauggaucuuuuauuucauaagcuguaauacucaaauauccuuuuauaaauuaaggcucugcuaccuagagucaaggaaaggaggaaauaacaguggcuuuacuuauacauuuuuuuuccucauauacauaagaaucucaagagagccaagcaugguggcucgugccuuuaaucucagcagucaggagcagcagcuuguagaucugaguuuaaggccagcuuaaguuuacacaacaagguucagguauacuaggacuauauagugagaccuguuuuuaaaaacucucggggccgagugagauggcacauacuuauaguccucacacacacgagggugaagcaggcuugugcacuguaggccaacugggaugccuagugauucugagccauucuuuaagacauagugagaccuggcucccaaaaagaggaggaggaaaccacgagacagaggauugagaugaugggccagugguagagcacuugaugagugugcacgaggugcuuggcuucagucccuaguaacagucaaaaccagagcuuaaagagagugucgaggaggacugguuggcagcauggcucaaggcuccugcaguucuucucugcuguccuucacauguggcuuucauuucacgguuaucccauuguccauugugcauagguagcccggggggggggggggggggggaagagggacaaaggauggaauugucccuuccacuuccagaaguuccuguccugcucauauuaauccacacuuacccacugcagaccagaaaugcacuuguuuuguuuuggcugagugaacugcugcugagacaguguagguuccguuauugagugagaguggauggcagucuuggccugguauucaagcuaucuucuagucccagauggagcuacagucuuccgcagcuguaugcgcgucuguuagaucccuuccuucucacuuuguuucgugugcacugcagcacaggcucccuaaguuagcauggcugugaaaaccgugccucugcgcuuuccugggcuuuuacuucuguaccacaguuugucauucuguaacuugucacugcuccuguagucucccugaccucuuuagugaggagaacuuuaauguauccguuucuuacaucuuuguuccauauuauaauagcauggaucaucuuuucuagcugaugcuucauauauaaauaauuucuucugaauaauuuauuggcucauuuacuugacauccguuccugaguacaagauugaucuguuauugccugcgucagcaacuugugcucuugcuucauuguuuuagcacauuagccuuggacuauuuccuuacuuuuaaauauuauaacuccuuuuggaagcuggcuuaaaacagaauuuaaaauaucuuccuaauuccucuuucaagguuugcaugauucagcaagguuuuaaaucaaauacuggcugaauuuuuuuuuuaaccuaagcaaagcuauuuucccgaaacauuagcuagugaaagcacuggcuucuagaacuuugugucauagcauauguauuugaauuuuugcucuuaccuaauuacuucaaaaauauucccaaguauauuuuucaaaauauuuaaaguauccucucagggguugggggauguucaguguuaaaauacuuccugagcaagcaugaaagccugaguucagcuccuuagaacgcacacaaagaacacccgggcacugcagugaacauguuacuucaguacugaggagcagagucaagaggauugccagccuagcuaaaaugacuucagguucaaggagagacucuaugucaauuuuauuuuaaauuacauuggccucuuuccagcgucuguucacuguuuguuuguuuguuuguuuguuuguuuguuuguuugagauaaggucuuucuauguagcucuagcuuuucuggaacucucuaaguagaccaggcuagacucaaacucaagaguucucccugccucugcuuccaggguacugggaauaaaggugggugccauaugcccuugucucaaauaaaugagugaagaagugauugugggagacgucugaccucugcucuccacacaccugcacagggcacacacacucacauacacacacacucacguacaccauacccaauuuuuauaacuucucucuuuuauuauuguuuuucucucucucucaaauguauaaauacaaccugcuauccagaugcaguguugcaugccuuuaauccuagaaucgggaagcaggugaauaucugugaguuuggggucauccugguguacagaguaaguuccaugacaucuagagcuacauagugagauccugucuuggaagagagagagagagagagagagagagagagagugugugugugugugugugucaguccaugccugaauccauucaguguugcucaugugcauauagggcugacuacuuugaauuagauaauuaggggguuuacucuauaggagaacugauucuuucucaguggucauuaauugccuuuagcucuuuuucuagggguugagaugugagauuuccccauuuuuguuggcauaucaaauugauauugucauuguucagaugauuucauggauguagcuucccuguccuguauaggagaccgucucuuaccaggcguccugguccucuggcucuuguggucuguucaccccuucuugugauguucugagucuaguguagguguuguguuguguguauaucguaucaguuggaguuaaacaccucauggugaguugcuauuuacacuuugaccuguuguggcuuucuguaaugguuuccaucugcugcuuaaaagaaagcaucuuugauagcuacacuuauuuguggguauaaggauaaguauuuagaauguaauuauucugguuuaagaaauuugagccauaguuucucaguugauacuuuuucuaaauaagcuagcuaacuguguguguuuuacucauaacaaauauuccuuuugguauugccuccuuuugugccuuaaaaaugaagagaaagccaagcaugguagcaccaaucuguaacuaaaccacuuugagguagaggcaggacagucaggaguuuagcuauauagagaccauccugauuuacgugaaacccugucugaaaaaacuagccaaccagccuacuaaccaaccaacuacaguaaugaacacaaaacaaaaaaagaaugaaaugaagagaaaaacaagcuuguaagagaauuggaauuguuggauucaguugaaugcuuagugcuuaccagcuauauacguaagaggaaucauuagaaaauggugaugguuugaaacugucggguuuggucuggcuugagucuugcugugucauuuacagcaggcucaaucucaugaucuuccugccucugcauccuaagugcugggauuacagaccugggccuugacauccagcuuucuuuuccccagacccauuuuuuuagaagacaacuaacaggaggaagaagcacuaucuuuuauuuacauguguguggcucccacuaucugcauguuaauuuaaucuccacuagcuccacucacacacuaauaagucuuugaaauuauccaaacagaucauuauaaacccgcaaucucccaccgagauuuaaacagcaggaauguccugguaaagaaugacggcgcguguguuaucagugacuuugguuuauccaugaggcuaacuggaaaucggcuggugcgcccaggggaagaagauaaugcggcuauaagugaggugagccuaaaaacaucacaccagcauacucugaaaucaugacaugcaacaacaguuauccuugugcacugucauuuacugcacuaugugaguuagaaaauuaggaaauaccaaaauacauuguauaaauaaauacccaccuaagguugucaguucauuuugaaauuccagcucauuuaaacagacauuauggagaaguaucuuagaauugauuuuuuguuguuuauuuuaaaagggaacuucauuagauugguuacuguuuguuuugcuguuuuuuuuuuguuaguuguguuuuauuuuuuauuuaauuuaauuaauugauuaauuaauuuuuuugagacagauucucuuuauauaucccauuuggccuugaauuuaucuuucuccucugaggacugagauuuuaggcaagugcuaccagacucugccaggaauugacuuuugaaguaagguugcuaaguuugagauaggacagucuacucucugaauacaauguaacauauucuuucugacccuuuucucugcuuucacaugcauagauguacauauuugcaguuuuuaaaaauauuaugugauguauauauugcuuugcaauuuucucacuguguuugaugguuuuuauuuuacauuauugacuauacuguaaaggugggcaaugaguuaggcaguucacuagagagcagccugcagccucauggaucuuaaaaguuggcacaggaacaauugcuuucuucuuucucaucaacgaguagguuuugcuaaagcaguuaauacuguuuaauuauuaagaaggguaagauugcugaaguauaguauaaaaugggcucagugaccugcuuagggucuaaucguauccuuuauaggaagacauuuuauauaugaccuuugguguaguguuugcccuucagaauauuuugcauucucuuucuuuaaaaugccacuuuuaauugaccagguuggcacaauucgcuauauggcaccagaagugcuagaaggagcugugaaccugagggacugugagucagcucugaagcaaguggacauguaugcgcuuggacucaucuacugggagguguuuaugagguguacagaccucuucccaggugagaacugcuguuagauuuaucaguguuuuauacccucuuucucgcuuacauucaacaauucaauuggauacaauaaucuuuuuuccuuugccaucuuaaaauguaauauucagaauagaaauaucauuaacagaauuaauuagaucagaaaguuuuuugcuaaaaaauuacuccaggggagcuggagagauagcugaacaguuaagaguacuggcuccucuucuagaggucacgaguucaauucccagccaccauaugguagcucacaaccaucuguagugcccucuuuugggugaucacucauauacauacauauaaguaaguaaguacauaaauaaauagcuccagguuuucauugaguuguuucauucugguaagaaguccucagcccucacucccucuggccuucugcacgcacauacacauagcugcacacagacacacauacauaucaauacaauuaaaaauaauaaaaauaaguguuuuaaaaguauauaucuaauauauuagaaguuaauauucuagugaguuaaucaagauauuuuucugaaaauagcaguaauuggcaacugggauuuuggcacacuuuuuguucgauuagguuuuuuucccccauuuuaacauauaguuuuaguuuuagaagaaugucugaauuacuccuuuauuagcauaauauaaucuguaacuugcuuuuauuuuauuuuaucuuuuaaagauuuauauauuuuauguauaugacuacaccauugcucucuucauacaccccagaagagggcaucagaucccucugaugguugugagccaccaugugguucugggauuugaacucaggaccucuggaagagcagucagugcucuuaaagucugagccaucucuccagcccugcuuuuauuuuauuuauuuuauuuuauuuuauuuuauuuuguuauguuuuguuuguuguuuaauaaagggucucacuggauagcccuuaccuacuagugcuguccguguagcccaagccacuuucuaccuugugcaugccccaugucacuuccuccugaguucagcuuucacagucaugcauuccacuccuagagagcuaugcgugugcaugcccguguauauacacaccuaugggaaggcccuggaucucauauuuguauaguaagcacuuuacugaguugggucaucuuuucauaaacuuguuuguuugguuuuuuuguuuguuuguuuguuuuuguuuuuaaaguaccacaacuaaaggaugacuauugcuuuuguucuaaaaaauaauaaauagcaguauuaaugguugggguauggcuuggugguagaguaccugccucuuaagugcaaaagccuuggguuuaaucccccaaaaagggauuaaaagcccucaguuuuguacguauggaggcaauuaagucuuguuuauggaacaguauuuuagaacauacauugcauacauucaugcauacaugcauacauacauacauacauacauacauacauuugccaaaauacuguugugcaaacauguucaggucuccaguacccauguaaaaagcagcagcagcagccuaugacuuuguauacuaauuuuaaaaguaaaauagaaaggauuauaaaagguuagaauucagagguaagauuuuuguuaauuaauagucucagcuuaaugaaaagcauucuagagauggauaauggugauugaugcacagugggaauuguauuuaaugccacagaacuaugcacucaaaacaauuagaauaauagauuucuuuguuuguuuguuuuagguaucauucuacaacaauuuaaaaaaaauaagagaauuacauugggauacuuuuacuauuacuauacaaauaucugagaaaaacaaaggaagaaguuuuuauugaaguuuuagaaaucuugaucuauaauugcuuagaccucuguguuuguacagcacaucauaucaggagcuuguggcagaugagcucuucaugggagacaggaaacagaaauaguccagacaauauuuauauuuccauguggacguccuccuccuggucccacaccacauauuuuaccaccuuccaauaaugucauauaucaugaaucaucaggcucucgugaucuauauacaucuggagaugcccucacagaugccccaaauguuugacucgcugagguacuucuuaauccauucaaguugaugaucaagauucauuaaccaucacaauaccuauaauuuugccauucuaagaagagcacauuaagaacaaauccagagaugaaaucugauucuagagaaguuaucuagaggucuuaaaaauagugagaguagggcuggaaaaauggcucagugguuaagagcaccgacugcucuuccaaagguccugaguucaaaucccagcaaacaugguggcucacaaccauccauaaugagaucugacucccucuucuggagugacugaagacagcuacaguguacuuacauauaaucaaccaaucaaucaaucaaucaaucaaucuuuaaaaaaauaguggaacuuaaaagaaauguuaagucaggagggugauuuaauuguggagauguuugaagaggaauauugauagauaacugaggaaauuauuauuuuauuuuuuaaguuuuaagauuaucuuaguuacuguucuauugcugugaagagauaccacagccaaggcaauucuuuaaaagaaagcauuuaauuggaugcucacccacaguuucagaggcuuaguucauuaucaucauggcagggagcauaguagcagacauuucaggcauggugcuggagaaguaguugggagcuacaucuugauucaugugggaugggcuuuugaaaccucaaaugccgcucccagugaugccuccaacaaagcacacaccuuuugacccuucuaauccuaucaaaguguucaauucccuguugacccagcaucuagagaugaguuuauggagacgagucuuacucaaaccaucacaaugauuuuuacauuuuaugaguauuuuaacuuguuuuuuugagacaguguuucucuguguaguccuggcagaucuggaacuugcucuguagaucagacuggccucaaacucacagauugaccuaccucuaacucccaaaugauaagauuaaaggcgugcaucacccaccacaccuggcuuuaagauaauuuauuaucauuauuauaauuauuauuauuugauuaagaggagcuucuguuaaauaaagaagacagaaacuauaugaaaaagaauaugagaaaaguguuaagaaagcacaagcagaauauaccggguacuuuucaaacccuuuuaaaaguuauguauuuuaauuuuauguauaugaaugacugguuuuuggcugcauguauguuugugcaccacaugaauaccugguaccuaugaaauccaaaacaggguaucagaucaucugaaacuugaauuucagacaguugugaaccgccaugugggucuagugcccuuuucuagccucuguagacaccaggcacacacacacacaagcaagcaaaacccucaagugaauaaaauaaaauauaaaaauaauuuuuaaaaccuaaagaguguuauauaauaauuauaaaauucuuaagauguuuuuguuuauuucaaaaugcaaaauauguuuugaggcugacugaaaacauguaaugaaggcugauucuauaaaauauuuguaaaauaauuaguuagauaucuuagcaugauuaaagaauaauugcuacagcauuuagaugaagggagaaagaaaaagacaagagaaaggaaagaaauagaauaaugucauuugagaugggaaccaaaaaugacucuaaaguagacacacacuuaaccaauccagaggagguaagaggaaaggaaugcuaaaugacagggucaaauauuugaucuuuucucaacagcuugaaagcaaaugagauuauaggacuucccuuuagcaauccagugacuauaaagccuuaagaaaaucuguuaaggguaguaucucccaucaucauaggagauuaacauuuuuacaucugaaguguauuaauaaaguuagcuccaaauaaguaucuauugaaaaacuagauuuugaaguauaaauauuugguagaauuuuuuuggagagagagagagagaaaaaaaaaaccaagcaugcauguacuuguuugugcauacauggguucacguacauguggaggccagaggucaaccuuggguaucauucuucaaaagccauucucauuuuaugaaacaaggucucuuucuguggcuugggcaugcugguucagcugaguuggcuggcuguggagcccuaggaaucugcccaucucugccuccccagugcuaguacauaucacaguggugggcuuuuuagauagauguuagcagccuaacacagggucucaugucugcauggcaaacaguuuacagacuuagccaccucccagccucucuugcuaguuguuaguguuaaaacuugcauuuacacaaaagcacgcacuaauuucuuauaguaaauuuugaaguuagaauuugaaugaucuuaauaaaacaagcagaauuauuaaauuuuaguucugcuaaccuaauguuuugugggagaggaaagcuaauaaauaccugggaaguauauacaccaucaugugcgaggcagaccagcugugcuaguaaaguacugcuugcagguaauuugaauuggaauugguuguguaauaugagguagguuucaaggaucaaagugcuauaagccaacaucuuuaaaucuuuuaguuuugucuuagaguuggauguugauauuaauucgcuuuaaucuuaaaaauaugcagaaaugucaccuguuuuuaaaugcaaugcaguagucuaguaacuugggcuuuguugaauaaauuauaaaaauauacaauuaauuuuuuuaaauuguuaaaauuguuagaaauauugguagaaggcaagaauuaucuugaauuuucaaauaggagcaaaagcuugucauguuuuaugguuuuuuccaucugggucauuauaccuuuuagugcugugcagugagauaaggaacacagacauuacugcuuucugacaggaagauugaaacaugcaagaguuaaaugacuuucccgaggaagagaugaagcccagauuagaaccagaaugcccaaaucaccaucacuucuaaucagucuuguuauuuuagugcauuagagugagugguggugaggcgccaggaggacaguaauucuuuuguguucuuugccaagagucuuguaggccagugguucucaaccuguggguugcaagcgcuucagcaaauuuguaucuccaaaaauauuuauauucuaucuucuguucauaacaguagcacaguuacaguuaugaaguggcagugaaaauacuuuuaugguuggagucaccccagcaugaggaacuauauuaaagaaccccagcauucggaagguugagaaccacuguucugggccuuuggauuuuaugcguuaguccuaaggagucuucuguaugucucuauguguucauuaauauacuuuaucacauuuagugaaaguccacaguguucauugugaucagcuaauugugccuauuagugacauacacauuugucaaauacugagaagguagugaugcuuuacauucuagauuuaaauacuacuuguaagaggaaaacuaagcaaugucauggucauugucauacacauuuuuuauauaggauuaacuuagcucccuaaguuagcucauuugauauagugccguguagcuugcacaagguccugaguucaguccucagcgccacauagcccugcugugcugguguaucucuguaauguaagcuccuaggaaaugacagcaggaggaucuaguucagagccauccuuggcuaucauaaggaauaugaggccagccuggaauacaugagauccuaucuccaaaagcaaaacaaaacugaaaaauugugguauuugauacauucuggcugaacuagaauagagccaauaaccugauaaggcauagugauuauucagucuuuccucuuuaauuugguggcauauuauuguacuaaauccuggcauuuuugacuauuuucuaauaugagguuagaguucaggcguaauuuuaaauacuaaguauuguaauauuucccucauaaauuaaauagcagacaaacucauuuuaaaauaccugucuagucuaagauagaacuaccuaguagaaaacuuacuuaaaaagacaccagaccaggcagcggugauuaaucucaucacuuugaagacagacagaucugugugaauuugugaccagcugggucuacagagugaguucuaucuaggacagccagggcuacacgagaaaccuugucuugaaaaaacagagaacaaaacaaaacaaaagcuguccagggcucuggguuaaaguguguacuuagcauguucauacuuaguaguaaguaauuacuuaguauauacuuagcaaggccuuaaguuugauccucaauacuaaagaauaaguaaaauaucuguauagcauugaagcuauuuuaucaauaaauuuugucucugaaauuugcauuuauucuugaaagguuuugauauauaugauuucuaugcuaugauauauaauaugcuaucuaauucauaugauuugauguuagaaauagcucugcuguucuguccucuaagauaacuagaaauucuaucauucuuuucuaugaauacacaggugaaucuguaccagauuaccagauggcuuuucagacagaaguuggaaaccaucccacauuugaggauaugcagguucuuguguccagagagaagcagagacccaaguucccagaagccuggaaagaaaauagccugguaagaaaaugagggcuucucacuagaacuagaugaggaaaaauggaagccgcccagcuuuggugauucacaucugucccccaccacugggcugagaaaaaagaauuacauguucaaggccagccugggcuucaauauaaaacacugucagagacaagcugggugauguguagaguugaguauauaaccaacuggaucuaggaaguucaauaacauaaaaacaucauaauuguguuuguguaaacauuuccuauacaacaaaauauugagcuuggugucuuaggagccacacacuauauugcuauaagcucuugcaauuugggaaagauuguuuauaaaaaauaccauccaggacuccuugguuccuugucaucuguuuucuccuguucuuuuuagguucuacccagaagcaacauuuuuaaaaucuuauaucuuucucuuacuuuuggauaauuuucuuucuuugcugaaguuccacuuaaguaauuauauuaccauguguguuaggugcuaaacauuauaauccuugcauguuuaagaacauuccaucuugauaucauauaugaguaauaauuaacacaguaaccguuucaaagagugaaaauguccccuggccgccagucuucauaauaaaaauuuggauguaauccacucuuacuccauuuuggggcagggggaguauaugauaggugcacauuugggggucagaggacaauuugguagucaguucuugccuucugccuuguugaggcaagguuccucuuuuuauuucugccacacugcuuacuccagauugccuaguucaugucaguucugucuccaucacccaucucacagcacaagugcuggggcuaugcauacaugacacuuugaauggguuccagugacugaacucagagcccagguugucaugcuugccugaauggugauuuuuaccuaccagccuuucucacacagaccuccauugcuuucugguuuuuuuguuuguuuuuuuuuuuuuuuugguugguugguugguuuuuuuucucucucucucucuuuuuuuuuuuuuuuuuuuuuuuuuuuuccuuuugagauaagauuucggucagcucagacugcccuaaaacccucuacauagcugaggaugacuuuaaaugcacuauccaucugcuucuaccuuucacaucuuggcugacuuuguuacuauuuuagaaguaacaagacaccaugaucaaggcaacuuauaaaacauuuaauugaagguuugcuuaaguuacaaaguguuaguucgugaucaucaugacaggaugcucgugguagcaugcaggcaaauagucagcuaucugagaaagugaggcugagccugaugugagcuuuugaaacccucagugacaacacaccuccuccaucaagggcacaccuccuaacccuucccaaacaguuccacuaguugaggaucuggcauccaacccacaacauugggauuagagaaauguaccaccauacccaguuuuuuguuugcuuguuuguuuguuugaaagcuuauuuugccuuagcaguuuugaaauuucacuugggugaaauuuagcauggaucuuuucacacauuucucccccugaguauugaauagauuuuucagugugaaaauucaggacuuuccucaaucagaaguucuccaguguuucuucuaauauuauuucuuuccuuauauuuuuuugaccuugaauucucaaacuaauauugaaccaucugacacuucaagucugaauuucuuuuuuguauuuuccaucuuuuugguggugaugguggggucugggaaacaggcuacaugagcccauacuaacuacauaacugagcauacuuuggguccccaccuucgugucugaagugugugugucacugugcugacugugugguguuguccucuaacucagucucauuuauguuggcaguccaccaucugagcuaaccagcuuccgucugguuuucaucauugcucagcguuguucaggacuugcucagcuuuacccuuugagucuuuguuaauuucucacuaguacuguuguagcaguucuuucuucaguguauuuuuuuuaauuccuggauggcaggaugguucaucaggccaaggcccuugccaccaagcuugaugacauauuucagucccuggaauccaaaguggacagagaacugacugaugcagguuguucucugacagcuacaugcacaccccagcacaugccauucucccccaguaaaugaaugaaaaaauguuuauuucagcuucugcagucauacuuauauuucuaagaggcuucacauuuccucagugaucucuuuuuaaaggagguaguaauaacuacuucugaagguauucauuacaauuuuauacuuaguacaaauuaauuuucuuaacuauaauuaaagaaaaagcauaaagaaauauaguaauauaaauaauuucacuauauauuuuacuuuccauuuacagauugucuuagucagauagaauauuuuauuguuauaucagagacuagagagucccuguauauuuccauucagauauacugaacuuuaucuuauuguucaucuuuguuaauagauuaaugucaaagcaagcuuguguuucaaaugagauugaaaucuuuaaguauaugguguuauuauuguuauuuauuauuauuauuauuuggcuucauauacacacaauugccuccaauuacagugucugcugugagaacuugggcagcgccuuaagagcccccaguagcagaugggaggauauguuauacuuuaccaggguucuacagagcugcugaccccaugggaaaaugucuaugaaaucccugaaaauuuguuaaaauaaauugcaacugcuuuucaacuucuuuaaauuguuugauuuccccacaacuaagaucuguuuggaguaucuguuuguaacccuacuauugggggauaugcagcacaugcagauuuaccugaaaauuuuguacuucuaauuuagaugaaguugcuaaguaagggauuuguaauacuugguuuacugccaacaaauccauuuaaaccugauaagauacagccaggggugggggugggggggacaguuucacugcaguaacaauacaguacaggaguuagggaggaaguagauaguuuauuaaaaugacuaacaguucguuaauuugcucuuaaaaaugaagagcuauuuaaaauacaguuuauuagcucuuauaauuauuuguacuuuuaaaauuuuaggguagagaaccccauuuaacuuucuuauagagcaugucuaauagcaaugaacucuguagauuugauauaucugggauuaucuuaauuucuucauuauugaaggauaauuuuauuugauauauaauucuuaacaguuguugccuuuuucuuuuaauuuuuuuuuuauuaauguaugagugcucugcugcauauacaucuuccugccugaagagggcaucguauccuccuauagaugguugcgagucaccaugugguugcugagaauucaacucaugaccucuggaagagcaaccagugcucuuaaccacugagccaucucuccagccccugaacaguuguuuucuguuucagugcuuuaaauaugucacaccuaucuggcuuccuugaguuuacuuuguagaccaggcugcucucaaacucacagagauccacuccucugccucccauuggauuaaaaccuugugucaccagacccagugcauuuguaugcacucauuuguaugaggguauuggaacuagaguuacagacaguugugagcugccacguaguugcugggauuugaacccagguacucuggaaaagcagucagugcucuuaacugcugagccauuucucuagaccucuccuuccaucuuuauucgaauucuggugaucaaucuuacaucacccagcuugugcagcaagugacuuugcccucugagucaccucaugcuguuccuuaaaacucacuuuugaagugugauuaguggcuauugacaacaggguugugaauuaacaguagugauguaaauccuaggccuugaagaagcacauucuacucaccauaguuguuugguccuuugaguaguucuucaaagagcuaacuuaaaacuuccuuauuuacuuacucuuuugcuuuuaggaauucuucacuuuucacuuuuuuagaagaauauuuuauuauauuuuuaaaaauauuauuuuggagccuaacaugguggcucacaucuuuaaucccagcacuaggaggcagaggcaggaggaucucagaguucaaugcuagccuccucuucagagugcauuucaggauagccaggguuccacagagaaaccuuaucuggaaacaaaacaaacaaaccaaaaaacuacacacauagaaaaccugauuuucuuugacauauuuuaaauuaaaaaccugaauaucguuuuuaaaaacagcaauugucugguguguauuuugugcuacaggcagugaggucacucaaggaaacaauugaagacugcugggaccaggaugcagaggcucggcucacugcacagugugcugaggagaggauggcugaacucaugaugauaugggagagaaacaagucugugagcccaacggucaacccaaugucaacugcuaugcagaaugaacgguaagguccugagggguuuggugucuaccugaaggugucagcaacugguaccaaauaaaggacaggaauaaauacuggcaagccagcauaauagugugguaacucacacuuauuagugugaaagguuaucauuuuucuuucaguguucccauuuuaaaacgugauuuauuuuuguuauuuuaauuaugugggugugggagcagggaugugcagaugaguuagggugagauaaggucucccagagcuaggauuauauuugugagcucuggugcugugaacugaauucagguccucucaagaaaaacguauguucuuaaacacugagcugucucugugccuuccaguauuuccauucuuauucugaaaauauuaauuuguuaugaauacaagacagaauauguauuuuuauaucuaaagauacaggaaaguuaauuagucuuuauuaccuggucauacuggcauacaccauuagcacuuggaucuccgaguucaaggccaccacagccagagcuacacagagaaacaaugccuugagaaaaacuaauuaauuaauuagucuuuauuaauguaacuugccuuuaaugugaaagguaaaauauuuucauaguuguaaaaaguuugucacuacuucuacauauaugugguauaucuuuuguuguuauuaguggucaucucucuuuuuaagcaaauaaaacugaccuagcugcuguuucacuggacacuaagacuuucagacugccuauccagugcucuuccuuaaaaaaagacucuacuaauacguuuauauuaacauaacccaaaaguggccuuucuacuccacugugaauauuguuuuaugaacauuuaauuuguuagaacuauaauuuugaauccuaaauagaaaggcuuucuaacaaaauuaacuaggcaugguauaguuaaugccugucguuucagagcuugggaggcugaggcaagaggauugccacaaguucaaggccaguuuacacuauauuaugaauuccaggccagucugggcugaggaugaauaccuggucuccaaaguugaaaagccaaaacaucuguauaauuuggcacuuguaaauagaucaucuauauuucuugguucuguauuugggaguaaaaauaacaacuuuauuacuuuauauaauaaauauuuaaaaguuucagaaagacacccaggaaaauauuaccaggguacauguagauaaaaguauacuuuucuugaaauuuuucccuauuuucuauucuccuuuguaagagcaguuuguguuaugugcaguuuacacuauuaauaaauagaaugggcuucagcuauacaccuugcauauggcaaaugaaggagaauagagaccagcuguucuaaauagaacacuuuacaaauauuagaaaaaucuucuguuuccaucgucauucuauauuucuacugcccuacagucuguaaacgaugcauuuauucaucucucaagauucagcugaagggacuagagagauggcucagugguuaagagcccuuguugcucuugcagagaacccuaguucaguucccagaacucacccacauggugacaccuaaacauguguaacuccgauuccaagaguccaacucccuauucuaaccucuacagguaccacacagacacauggugcacacaguaucuacaggcaaauacuuacauacauaaaauaaagccuuaaaggguuaguugaagcuucuacuuuaaauacuugguaauuuuucuugaaugcuaagaaaaaaaccuaugucucucuuuucuuuugacuuuuccccccuuguguucucaccucuacuuggaauggguccucucaccucuagucucuccugaguuuccuuaaaugguaguucauucacuagguauaugcacuguaggcuuuauuuuaucgagccuuaaccucuccauaucuuagcuuuucaugguuguacaacaccaccuucuuuuuuucuuucuuuuuuuuuuuuuuucuuuugguuuuuuugagacaggguuucucuguguaguccuggcuguccuggaacucacuuuguagaccaggcuggccucgaacucagaaauccgccugccucugccucccaagugcugggauuaaaggcgugcaccaccaugcccggcuaacacuaccuucuuaaauguguauuuguuauuuguugauauuauaaauugucauccucugcaauguagcaaucuuuuuuuguagaaccuauuuuccuacagcugcuaagucucuucuguaauauuuuaucuguuaaugucucagucccuuggucaccucagugaaggcuaucccuaaugacuucuguaaugagauuuuaaauaauuauagaguaguuaauaaaugaaaggauaaguauaggcaguccagaacugucgugcccaggagugcugacacuggcuauguacuucaguaacuguagaaccgucccgaaucuugguuucucuaucugagugcuguauucuaccucauguccuagcucuacaacuuacccugauaguggcuucccaugaauaugccacauuguuaguuugcuuuuaaaugagcauguuuuggaaaaaagaaaauuuucuauguucuucuuauuauucagccauuugaaccuaguccauaacauauuuguugagcuauacguuuggaucuaguauuacaaaaauacaaaauaaauacaucccaugguuccucuaguuacaaaacuaucuguuuguacacauauacaguucauuaaaaauguacugguuuuuguugguuauaaaauuauaggugagauuuuuuaaauuaacucuuuuauauauuuuuucuuacauuuugcuuuuguucugccaaggccagaagaugauauuggaucugcagggacuggaauuacaggcaucugugagcugucaugugggugcugggaaucaaagaguagcugauccacuuaacaacugagucaucccuccagccccaaaguuaacucuuguaaaacaaaacaaugagcacccauaaaaguucuauucuggaaccacagagaguuucacagaaucuuauagacuguauuaaaaaaauaccucauaaaguuuguauuuaccaagcugguaauaauuaucaggauuuugaaguaaucucuuaaaaauuaguucagaguaaaauaggacugacagucugagucugauuccugagacccacacuuuggaaaagagcaaacucccaggaguagccucugacuuccaugcaugccccauauauauuaaauaaaugagugcaauaaaaagaauguaaagcacaaaauaaaagcagugggacuuuggaaucagugguguuugcuugggauagacaguuuguugucaguuuguauucucaaugucauacguuuuucucucucuucaagcaaccugucacauaauaggcgugugccaaaaaucgggccuuacccagauuauuccucuuccucauauauugaagacucuauccaucauacugacagcauugugaagaauauuuccucugagcauucgauguccagcacaccauugacaauaggagaaaagaaucgaaauucaauuaauuaugaacgacagcaagcacaagcucgaaucccuagcccagaaacaagcgucacaagccuguccacaaacacaaccaccacaaacaccaccggccucacuccaaguacuggcaugaccacuauaucugagaugccauacccagaugagacacauuugcacgccacaaauguugcacagucaaucgggccaaccccugucugcuuacagcugacagaagaagacuuggagacuaauaagcuagauccaaaagaaguugauaagaaccucaaggaaagcucugaugagaaucucauggagcauucucugaagcaguucagugggccagacccauugagcaguaccaguucuagcuugcuuuauccacucauaaagcucgcaguggaagugacuggacaacaggacuucacacaggcugcaaaugggcaagcauguuuaauuccugauguuccaccugcucagaucuauccucucccuaagcaacagaaccuuccuaagagaccuacuaguuugccuuugaacaccaaaaauucaacaaaagaaccccggcuaaaauuuggcaacaagcacaaaucaaacuugaaacaaguagaaacuggaguugccaagaugaauacaaucaaugcagcagagccucauguggugacaguaacuaugaaugguguggcagguagaagccacaauguuaauucccaugcugccacaacccaguaugccaauggcgcagugccagcuggccaggcagccaacauaguggcacauaggucccaagaaaugcugcagaaucaauuuauuggugaggauaccaggcugaauaucaauuccaguccugaugagcaugaaccuuuacugagacgagagcaacaggcuggccaugaugaagggguucuggaucguuugguagauaggagggaacggccauuagaagguggccgaacaaauuccaauaacaacaacagcaauccauguucagaacaagauauccuuacacaagguguuacaagcacagcugcagauccugggccaucaaagcccagaagagcacagaggcccaauucucuggaucuuucagccacaaauauccuggauggcagcaguauacagaguaaguggagggguuaugcaguacccuuugggacaguuaaauaaaauagaaucauguugcauuuucaacuagugacucuuuaccuuuauuacuuccagagacaacgugacuggaccuuggaaguaauaagaugauuguuguuuucuuucuuucucccucgaccccccuuuucucuuuggucagugacaguuugaaaagcuaguaccacaaguagaagaauuaccaaauguaaucuguguucugcuugauggcuuuucucugugugguucauaucugcugugacagaugaaauuaaaucaguauucaguagugucacggcacaaguagugacaucacaucauguuuacuucugaaauauuugcuacacauguuaauauguuaaaucuauguuuaguuuuuaaccuuaguaagucuuuguuugguguguguguguuugagauaaagggucucuaaguccuggcuggccuggaacuugcuauaguccaggcuggucuuaaacucaugaagugcugagauuaggagugugccagcacacccagaucuuaguaaaucauagaagucaagggacuucuuuuauguguuuuaugcuuucuuaaacuaaagaaugggcugaaaaaaggucucaggauagcaacuaucuaccccuugccuagagguguagcucagaggcagaacaccugccugaaacauacaagacucagauuuuggucucuagaaccacaaagaaaaccuggcccuuugcuuaagugauuuauauggcaagccaguugacacacccuuuuugcuccuguaaccauaaagcaucuuuucaaguaugaaaacagagaauuaaugggaaaauggucaucccaacaaaacuauuacauguuagaggccuuuugauuugguucacuuuggacauuuuuuguuuugcuuugucuuuuuugagacaaggacucauucuguaacucacaguggccaaggcuggacuugaauuuaauauccuucugccccugauuccuaggaacuuggauuccaggagugcaucacccacccacugcuagccccacugucagcccugcugucagcauuaagucaaaugauauguguuuuuaacaaguuggaaucuacaccagagcaaaagaauuugagaauacaauuaauaauuuugaauuuucuuaguucuugugaguuuuaauuauuuuuuagauaagacucaaaacugaguugguugaauuuugcuuagaaaaacauugccuagcuugaucacauauuucaagaaguguccuucauuggguucuaugcugacuugaccuguuugugaaauuuagcccuuuuacuuucccauccagcuucguuugguuugguuuugguaaaggguuuuauauagcucaggcaggccuugugcaguagcugugugguggaggagcaucuugagccuugauccuccugccucuacuuccggggugcugggauuaccauaugcaccaggacuggcacucuagugguucugggcuggagcuuaggacccuuugcauucuaggcaagcacuccaccagcuacaucauauacccagcaaauuccuuuacuuuuaaauauuuuccuuuuacacagcucauuuccuauacuuuuguuuccaguaggugagucaacacaagauggcaaaucaggaucaggugaaaagaucaagagacgugugaaaacuccauacucucuuaagcgguggcgcccguccaccugggucaucuccaccgagccgcuggacugugaggucaacaacaauggcagugacagggcaguccauucuaaaucuagcacugcuguguaccuugcagagggaggcacugccacgaccacagugucuaaagauauaggaaugaauugucugugagauguuuucaagcuuauggagugaaauuauuuuuuugcaucauuuaaacaugcagaagacauuuaaaaaaaaaacugcuuuaaccuccugucagcaccccuucccaccccugcagcaaggacuugcuuuaaauagauuucagcuaugcagaaaauuuuagcuuaugcuuccauaauuuuuaauuuuguuuuuuaaguuuugcacuuuuguuuagucuugcuaaaguuauauuugucuguuaugaccacauuauaugugugcuuaucaaaaguggucucaaaauauuuuuuuaagaaaaaagcaaaaacaauggauugcugauaaucaguuuggaccauuuucuaaaggucauuaaaacagaagcaaauucagacagguuugacugcaauggugucugguauccauguuuuauuucugggcacaagcuaguuauguguuaacguguuuugaccauaaucuguuggacauucuuuucucguguauuuuauuugaaugugcaauagucuauagaccacaaagaagcuugcuuaccugcucucuccuaacagggcacacauucuuccauuguugaaacauuuuuccucauucuuugauaauaugaacauugucuagcuuucuccucauggagauacauagacgcuguccaaagggcuccacaaaggacuuaucaaaaccuuuuuugaaaugccuuugucuucuaaccuuccaaaugcuacuauuguuuccuuccaggcauuuuaauaagcauaucugguucugauuuuggaaguucauaagagagcauagaacaaaacagaagaaagcaaauauuagccuuuuccauuuuauuuuucuauguauaugucacgucuguauucauuauuuaagaaauauuuuuuauuagaaaauguauagagcugaaccuacauggaauuuuuaaguaaguagcugggcaaggugacuaguauaguaacuuucauucucugaccaucacaaauuaaauuacauuuucuauuuauaauaacuucagaaguaagugauaguugauuugaaucuuuaauacguaugguucguuauuucccagcacagccugacaguucugugugaaaagaacgaucccuccccccgugaccuaaaauacuauggaaagcucauccucccagcaugccgauuccuguggaauaaaggcuugcugcaaacuugccaccagugcgcagaccaggauugacccucugucuuuccuaaguuuauuucuucacuaauccuggcuuuguaguguccccuucugccaguuucauguguucuuugacugcgagcagcauucacuguguguguuguaguagagcauacuucuggugaugaugcaccgugacguugcugucacguagcuucuggugcugcuguaccuugauguugcugucaugcggcuuuugcuucuuuugaaacuaaugaucucugaaacaacagucucugugucuuuuaauaaagacuuucuaucaaaaauugaggaguuuucccucaacauugcuucuuaucaguuugcagacaaauuguuaccauguguuuucagauucucagaauccuuaauauccguuaucugauuacguuuucaaauuuagcaggaagauaaaaaguuaagugcaaaucuccaaauuccugauuuugguucuucugucuugaacaccguuuccuugucuauaauccucucuccuucuguuuaacucauacacgagcuuccuucacuuaccgucugcugugcucugacgucacagcauuuaccguuuggucagcugggaugcugacuggagcucaguucuuaggauuaaguuuaucucacuugugcccaggaucccuuucucaccuuuggguuucauuggcccucuuaugguucagagucuuaauauauauuuuugucuucuaacauucaguuuuuuuucuuucuaauuaguuacuguccuuuguauauuuaacaaauaauuuguaucuuucacuuauuucuuuuguccaaauggcuuucaaaugcauuuuagaauuuuaauuuucaguuguaggacaacuuuaaaauaaguuauauuccucccaucucccaauuugaaauauuaagaguaaaugaaucuuugagguccaaaagaucuuuuccugucagaaaaauuguccuacauucugauacaguuuguauuaggaccagucaauugugaauuuuccaagucuuuuaauguuuauuaacagaaugcuuuaaaaaugaauaugccagauaaaagaaaucuguaguuucccaucucauuaaaauauauauaaaacaaauaauuccucgaacugcuugaagaguaggaaagguaguaaguauaggucauuuuaacaaauuuugaagucuauaauacacagcaugcagaaaucccuuuaauaacuuaaauuacuaguuagauuuauuuaaucugauucuugaagcuaaaauggaauuuaccacaaaauuucacacgcacaaauuaauuuuaggcuuuuugaauaaaagccauucaauuuaaaaagauuucucuggacaauaauauaaucuuaaaaauaucauaauaggacaucagaguaugauguuuauuguggggcuggagagauggcauaacaauaacagugcuuccuguccucacgagaacccaaguucaguucccagcagcuacauggcagcucacaacuuccauaggauccagugacaugcauguaacaccccacccccaacacacacacacacauaacuauaaaugacagaggagaucuuaaaguacuaguuauauaccagagcucaguaauggaaagaaugugguuugaauuauguauggaauaaaauuauuuaaauaaaaauccuaaauaauuuaaauguauaauuuaaaaaacauggcuacuauacaaguuugugaagaccucugcugaaaacuggcauuacauacacuuauuuuuucauccucagagcaaccauauuguaauauucauauuuugcaaaugagggaauaaaaauuaauaggaaauuugucuuaaguuucauacccagccacaccugggaguucacucuaggucuguaucuccaaaugucuuuuaugcacaacacacgguccacuuucuuuaugaacugaugugcaguguacugacauguacucuagcagaccuggguuugaguguaagccaaaccagguaccuaaugaucuuaaguuagguaaauaaagguccauaaucacaaacaauuccuaacucaauacagaauucagccuacaucguuuuaccugccuccuucuauucuuacauugcagaacgaaggcuaaguaaguguuaaaagacacgugaagggagcugagggagcagggcuccuuagugugaucccauccaucccucucuugggaaaaagaguugcaugcaagcuuacagucuucuuaauccuuugacuccaucuuuaaaauuucagcuuuaccaaugucaaaaaaauuguuaauccagagaacuaaauaaucuguagaaagaauacaaggcuaauacucuuuuuauaaagcaggcugguauugcuuccauauguguguaugcuuguuccagaaccuguuuguugguucugaaugagaacguacggagcacucaaaucagugggaauuacaauuuuucuuuuuugaaaaaagacacuuuuuaaaaaauuuuauuuauuuaauguaugagugcucugcugcauauacaucugccugccugaagaaggcaucauaucccccuauagaugguugugagccaccaugugguugaugggaagagcagccuguguucuuaaucucugagccaucucaccagcccggaauuacaaauuuuauuuaaaauauuuccaaguuugguuucugaaucucagaggaacaccuguuaugguaucacacugcacuuuuacucuguuagucauuuaaaauaggaaaaagaaaauaaacaucagcuuccucuuaaucauaaucauguucauggacauaaauauuucauugcaagucacucacuucuagaauuugauguuacgucauaucacauuuuauaaaccuauguuaagcuuauguauauguuauuacaugacuauccagauuuuugaaaauauauaauuacauuauuuccuuaacuccuuaaaauauucugcacacauucuaauucuacuguucuagaucagucagucauucuaggaaguguguaacaccccucauaggcccuaguagucucucuuagucuauaauguuaauagucacacccuuaccuagcaguggguugugugcauuguggguuuuuuuuuuuuuucagauuaugagcuaugcaaacuucauccaaaaacuaccuuacaugaucccuuccuaacugugcucauugauuauaucagucuagccgguuacuuucugagcuacugaacaaaggcuauuaucaaaaaaggcuuuucuguaaguguccacauuaacccagaggaaaucuccaagugcccaaagaggugguaacaccuaccuguuccucucuuuaaguuucucaugguuuauagagccugucccuuuacuaucuggccugcagucauaugccaggaaaguuuucuccaugccuauucugucucucuuguuugaucuaaggucuguuucucauaccuaguagggagaagagauggucauccuaucuagcacucuucagucagcuucaggcuucucaacaccagaucaccagaucaaaguguuccacuuccuucagguuuuuuucuuccuaaaucuauuuuaauuacuuuauuuauauuuaaagcacuaaaauucuauguuauauucaaauuaauuacuccaguuaauuuauagcauaguaguuugauagaauugagaauaaagauguuaccauugaauuuaaucaccagaccaccugaaaaucagcaccuaauuuuuguauuaucuaacauucuucuauuaaaguauguuuuaugauuuuuauaucuauacagauauaacuaaaaagccaugcauacauaauugucuauuuuuuuuccacuaaacucugaccuauguuacaguguaguauuaguauuauauguuuggguauuaugauugagccacaacaaauauuauacauuuuucuuuaucaaauacuauauuaaacacuaaaugcaaaacuaauuuucaaaagcagacccuacaaaaaucagguauucauggauguuuuuguauuuuuguagaccacuuuugaaaugcuuaucauuguuuuugcagaauagacuggacuaaaacaguuuucauuuuaccuuuucagugauuaaagcuagguauuugcauagaacggaaauccuuaaaauuuuaucccauggcauaugaauuuugagaagcuauacuuuauguuaagauuaugccccgaauaaaucuauuaagucuuuuuaaauuuuucgauguuguuuuuacugaugucugugguguuucuagugagcauugcaaacacacacauuuacuuguaaaauggaguuugcagcccacauuaaaaucuggagcagaaucuuagaacuauauuacuucauucagaaugucuaguuuguaacugaauuuaaaaagaaaauugacuguacuugaauuuaccacuugacuauucuuuguuuuuaaaaugcuuuucccccauuuaauuuguauuuuaaauucuagaaacaucuucaugguuuggaaucacuuuuagacauaguauuacuuaaaaacucagggccccuuucaucuguuuguacacugaaagaguucaguugcuaacaaacaagcaauuagaucuaguugaauacuuaaaguauuuguugcauaguaauguuucaucauauuauuugacuuaauucacaucaacaugauguuugauuucauuaaucauaaaacuugcccaguucuguaauuacugaauagaaggaaugacucaacuaauuggccacuuguuacagcagauuuaagccuuggaguugaagcacuggcuuacacacuuucuguucuugguucuguggauauacaugauggggcaaauauuucauucuguuuguuuuuaauaacaagauuaggaaagguaauucugagauagaauuuucuuaugggguaauuagcauuauaagacuuuauaaaagugagcugauggcucuagcuuuggugacagcuuugauggcuuugagaaggugagcuauggugaccagcuuuucacauugucagagccaaacaguuguucuuugagucaacaaacucaaguucuaauuggucugcuguauauuuaaaucuuagcagugaguuuuuuguaaccagucucuugucucaggcucucugccuuguuaucagucuuaagcauauaaaagaaacauuuguaaagauguauaagaguaagaaaacuaaugacuaaaaaaugcaauucaaagcaauuaaguuucaauuuaauauugaguugcuucacuucuguggcuuuuuuuucccugguaacauauauuuauuuaagcaauguuguaugccuugucuucauuucuauagagauuguauuguauguguuuguguaagcuggaaucauccuuaauuuucuguugcuaauuuuucaaaugaauuuacaugaauaacuguaaaauacacuaacucuuaggguguuauagcugaaacacggagauguguagcugccaugcuuuuucugaauggacaggagaaacauaagcuaccaaguauucauuucugagggugcuuuguagggaaagaaaggcuggcacuuccucagaacccucugucuuguuaacggguaucuuuuguugguguguuuugcucuuacauuacagauagaauaucgugugugagcugaugaauaauuacuuucaguuauuuugcuuuuguauaagccaucugagaccuugcuaugcuguauaaguugugugacggagcagugugaguaugaaauaaagcagaucacuuuccuuuuguauuaucuauggaugccacuaugaacgcugacauuaagccacucaagaguuuucuaugaauaaguguaaguaaaugcuuugauauauauaaaccuaaauaaaagauuguauugagacagagacauuggcaaaggaaguuuuaaggcaguucuuuagguguaaaaggcuugcuguaaaauggugcguuauuccacuuauuaaagaucauauuaaugacaacaguaaguguauuuuugauuucaugaaaucuucagaaauuguuacugcuaauaugauauuguacagacuuugcaauagagucagcacacacuaucucuaacaugacucuuauaacagugugauacuaaaaaaaaggucaacugagauuagaauaauagcugcugcuuccuagcuacuacaauacaccaaacaccauguuacucauuuuauacucaguugacaguuuuuaccacugccuuagaaacguguucucugucuuuuauaagggaaggaauagaaggucaggaaauuuaaauacuuucuccaagccacagaccugguaaguguauaagauccugguaauguauuuuauacuuugcuuugaacuacagcuuuuaaauuuugcuuguggcaaggaaaauucauaaacagauaaaaugugcucagugguuauaguggccaagaccaaauuaaagugacugaagguacccaaagcugucugggcucaccuccugcucaccugcuacgauguggauguggugccuacgcugcugaguaauguuuuugguuagauccuugugguuuaggagguuucuucuuucuccuacagugucuuucuacguugcccugcuuucugccucuggaguagcugguucugcgagcuucuacuaccauaacagcuugaacacuugcuuaaaauagaauguguguuucaucuguguagaugaauucgcuguguugacuagguaucccacaguagaacccuuuaucaguauucagggcaagcacauucagggugugcuuugacccagccacugccgggugcugaagaaacaaacacggccugcucccauaggcucuguugucaucuuaagugauauuuuaggggucagagagguagagugucuuucuuccuuuugacucuaguccgauacacauguuaacaggucacuacugcgguucucugcagagccuucugcauaguauuuaagaugacaaaugcauuuccuuagaggaagugugauaacuugugaaaagcauguaauaaugacccauugcaccuuuuuaaaaguuuuucacuuacuuuuauuuuaugugaauugguguuuugcucacauguaugucuguauaaggguguuagauccucuggaacuggaguuagagacaguucccaaaugggugcugggcauagaaccuggguccuguggaagagcccccagugcucagaacugcugagccaucucucaaccccuacccccucgaaccuuuuaaugacuuaccaaaaguaaaauuauuuucauuuauuccuaucuggucugucucccaaguuuauauuccucucugcaaagagcuaccuucagccagugauuaaucuuuguucuauaaugguuuuuuuagauuaaagaccaaaucuuacaugcauu

SEQ ID NO: 177 - RNA, 72369 nt, Mus musculus
cuauuguugaugaggagccgcggcggcggcugcaucaccucgucggugcccgucgcugcccgcgcgcccccugguccugaagucaggcuacgucacccgcuggcucaggccuucccucgggccccgagcagccgguccccgccgcccagcacccccggccgccgucucuggggcggggggaccaugucccagcgggugaggcgcaaugggucucccacgcccgccggcgcccucgcggguggcgcggucggcccgcccgggggcccugggagccgccugcagcccaugagggcgacggugccguuccagcugaagcagcagcagcaacauggcagccccacgcggggcggcggcggcggcggcaacaacggaggcaacggaggcgccucaggccccucgggcggcggcggcaguggcggcccgcgcaccgccucacgcagcaccagccccacgcgcggcggcggcggcagcgcggcggcgcguaccagccccacgguggccacgcagacgggagcguccgugacguccacgcgcgguaccagccccacgcgcggcacggcgccuggggcccgaagcaguccuccgcgcccgcagccgccaccgccccugcugggcaccgugucgucgcccaguucgucgcccacccaccuguggccgagcgaggugauugcggccccacccuccgcccgcguccgccaccggaggagguccccagagcagggccgacccucggcggagaagaggagccccagcgccccggugugcaaagcagguacguggaggacagggguccugugccgccgaguggggacugcagcgcuccgguggggcggggcggggcggggcggggcgugcgguccgccaccccugcgucuugcccgugcgggucuccgccguggaggugcggccgcuaaccuugggccugggcucaauuuguggaaaucauaaacccugggguuuggccuugcgucgcuacugcuggggcugguccugucacuuuuggugacgcgguuaaugcuugcaaauagcacuugugugcugcuuaguguuucuguuccacaaaacaguuucggaucuggaggacugaaugcaucagcaaaggcggauuuggaucauugaagaguugugaagcugggagcaguuuuugcauuucguaagacuuaaugaguagcaagaagggagaaguuaagcaagauugcuuuggggugugugcauaggucuauguauguguuuacacauauacguaaaugguagauagcuagccugagggucugaguguguuucugagauacugguuuuauuucucuuagacuuauucuuugcuucccgcacccccccccccccaacacucucacuaccgcuggcugaccuggaacuugcaguguagaccaggcuggccuugaucugccugccucugccuuccuagugcugggauuaaaggccugcccauuuuguuuugcuuugguuuuuuauguuuauuuuuuauuuuuuguuugcguuuugaaacaggcucccuguagccucaucuggucuguaacucaccauguagauagguuagccucaccaacugccucugccuucugagugcuggagucaaaagcaugcuacuuugccaggcuacaaaaugcuuuuaaaagauguuaagaggauucccucccuucaauaaugggcaagugguuuucauacacgaccucauuuuagcuuucauauuuuccuuuagauggguuaagaacaaguggugacaggugagcuuugacucugcuuguaugccacagagaacaagucuucaaauuagaucaagggagcaacuucuaauguauaagagaacgucugagagauacauugcacaccaaaauuacaugcaugcuggacaagauuucugcaguuugccauugaguuucuggagcuaggauagugcaucuggugucugguagaugagcugcuuaagugggcaguagacaaggaaggagacugggccccucaaucugauaacagaauuuuaaagaguugauuugcaacacacccugaggagaacuugauuaggguaaacagucaaaugugaaggaggcuuuauuuccggggacauugggcuccuugugugcucauucauauuuuccaaaggcacccccucccccacuccccacccuccaaaaccagaaaaaaacggaguaguuacucuuaaacuaggugugagggauacugcuuguugguaggucucucagucuuacucaaguguaaaugucugauggcuuuuuuuucuuuuuucaagacugggguuucucuguauagcccugcuggcuguccuggaacucacucuguagaccaggcuggccucgaacucagaaauccgccugccucugccucccaagugcugggauuaaagggccaccacuggccgaugucugaugucuucuuuuuggaauauauucuuguuucacguuaguuagguccauacaaagugggggaaguguuuucaguagcauagacugcuaugauuaaaucauuccauguuuuauauggccaaaucuagaaagagacauuguaauuacugcgccccuuuuugauuaaagggagaugaccaguuugcaggcuugaugaaaugugaaaguucuuacuuggaaacaaaggugcuucuugaugcaguucuggaacccucaugugacucagaugccugggcucaucuucaggcugcuagcuucuucuagaugucucauggggugaacagaguccagccuucaccagggcuucauuauuacagagucccuaugugggagaucucaggaucucuagcugguugauuauuucucugggcuuugaacuaauuacugagugauccaaaauaucauucucuugauucugauaaagucaccacacacuuguccauggcagcuauuuaaaugucuaacuucagugccugccaggggccuauuugcguaagcugugcuuucagaaaguaacucagcaccaggguuaguuguagaguugacuuugugcucucucucuuuuccguugccuuacuuagaugagaaguggagaggccgcauaagagcaguuagaauaggcucuggguaguuacugggcucaaugcccagaugcaguuacucgugagucaugugguauggauagaguccgugguuauaugggauuguuuauuuuuacauuguguauguuguaugcacauuuguugguacuuacaugcuagggucacauaugagaugucacuagauggcaaucugcuggagucuguccuccuuuuuagucuuuggguccagaggacuguuaggucaucgggaguggugacagacaccuuuaccugcugagcugucucaacaguuuuaguuuuauuuaaaaaguuuuaauuacauuuucuauuccucccucccucccuuucucugugugcguccaugcgugccugaaucggcaugggugccaggguucauuccuggagguugggacaguccuucagagcugaugcuugcucuuuguucacuucgagggucccaggaaucaaacucacauuguuaggcuugguggcagucauuuuuaccugcugagccaucuuuggccccuuuuauuuuuuaaagaaauauuuauuuauuuauuuauuuauuuuuuuauuguucuuuuuuuuuuuuuuaauauguaaguacacuguagcugucuucagacacuccagaagaaggagucagaucucauugugagugguugugagccaccauguggcugcugggaucugaacuccggaccuucggaagagcagucgggcgcucucacccacugagccaucccaccagcccagaaauauuuauuuuauguagaugaauacacuguagccaucucagacacaccagaagagggcaucagaccccauuacagaugguugugagccaccaugugguugcugggaauugaacucaggaccucuggaagucagugcuccuaauuacugagccaucucuccagccccccuuccuuuuauuuuuaauuaacucauaauuuaucuuuaugagacauaguuuguuucuuauacauuaauaccucauaaaaugauuguuugccuacuugauuuaucuaucauuucauacuaaguauugugauauauuuaagauuuauuuuuaaguacacauguaugcacacauacaugugugccauggcacugcagagaucaaaagacaguuuuuaugaauagggucuuugcuuucacugugcugauucuagggauugaacucaggucaucagguuugccagcaagcagcucuuucuucccucugagccaucuugcuggaauuaaauuuauuuauuuuuuuucaguugucugauguguaauucaacagauucuuguauaguugagggguuaaagcuacugauuugcugaaaaucuccauaauguuugauuccuccuaaaauuaacuacuaaaaaaauagccugaaguuauuagaagucuuacuagaaaucgaaacauucagcuugacauauccuuuguucauuacauauauuauauauggugaaaaaaauucaugagaacuuagaugacuuuuuacugccaucaggaguguaccacucacucugguggaggugaucacgucauuguggucuggaaacuuaaccucacugccacagcaacagaagguggcugcugugcuguguuacagcagugcaguuaugcuacaguuaauuguguaguuaugguuuaauacugcauccucacuguuauuuacacuucucuugagaauagagccaggcgugguguuugcauguguaggguuugacaaauguugacuuuuuauaauagguuuauguguguuuuauaauagugauaaaacagacuauuaucacuugcaggcaguagugaaacaggauacacauauuuuaugcauccaugauagaagcuaucauauaaacuauugugauauuucuagacuaugugguaguucugugagcuuuuucaauuuguugcaaucuccaccaaaauccuuguguaaauggaccugcacaguucagaccuggguuuaaugucaacuaauagcuacauuauuaguagcuauugccaccugcauaccuuguccuaugaaucucugccaucuggcuguuccuuacuuguguccuuuguaauaaguugauaauauguguaaauaaguuauuuuuaugaguucuguaauccauucuacaauauuaccaaaccuuagaagugcucaugggaaccugugaucuguagcugguuggucagaagggcaggugguccaggacuuggaacuaguaucugaagagcaggcagucuccugaggucaaauuugaaugugacaugcuccugauaagguagagcuccagcuguuagcuguggugcuauuaucuguaagguuguuaaaacuuuaggaggaagggucuagauggaggaagaagguuaccuugagugaauccuuuguuacaucuuacccugaccccuucccacauuucauuuccacuacuugcuggcugccaugauaggaaauuguaugcucugucauguccuccuugccauaauggauugacaucucugaaacuaggaguuagaacaaaucuuuccuuaaguuauucugucagguauuuuugcuauagggauaggaaaagaugcugcuaaauaacucaggguaguuagaaucagaauuagauuguuaaauuucgaucugguaaacagagaauugccugguucuugaaaacaccccaggguacuuguuaaaaaaauucugcuuccaggucuaauuuuaggcuuugaaaguuccuucuacuguuguuacuauacucuaaacaguaguuccuuacuuguauagaagccuucaaagcaugguuuggaaacuugauaggaaaaaaacaaaucaauuuaguacaugugugauuuuuguggaguggcuaauauguugauagaaagaugugaauucuuuucauuguaugucuuauguaaauuugacuauuaauuggggugggaaauugccaagaaaaguaguaagagauguacuuccuuuaaaaguauauauuuaaaauuauaugugugccuacacgaaucacaugagguaguaugucuguggaggccaggagaagauguuggauccccuggaguuggagccacauguggucauggguagucuggugugggugcugggaauacuucuggaacagugauauucacuucacccugagccaucuuucuagcccuaagagacacacacacacuucuuugaagcaguaggcagacucagaaaguaggacaccaaaacuccauauuuucauauccguuucuuaguaccuucugagguagaacucagaaaauucaguguuucucuaacauugaaggacaguugcugauuucacaguuccuuuuuuuuaaagauuuauuuauuuauuauauauaaguacacuguagcuaucuucaaacacacuagaagagggcaucagaucucacuacagaugguugugagccaccauucggaggcugggauuugaacugaggaccuuuggaagagcagucagugcucuuaacugcugagccaucucuccugauuucacacuuuaaggggaaucuuuuuggcuugugguauauauuuuuacaauugaggaugaaguauuguaaaacauaauaguucuacacuuuggcucauauaauuuucacuuaaguucaguucugcauauuugauugaacuuuuuaaguuuguauuguauuguuuguuuguauugcauaauuacuauguaauauaaagauguaaaaacaaaacaaaacuaaaacccuuuacaaauaacaguuuuaaaaaaaauacagugcuccagagauucaaauuaaccaggcaagacaggagcaugaaagaagcauguacuaugauugcucuuaagagugaaugauuccacaggucgguauagaccuucucucagagaagguucugucugacugugguuggaaagggaagaaccaaacagucaguugucuuacaggagugacagacaauacaugccauguuuacuuguguauuauuuaaaauacacaaccuaggggauauuagacuaggaaaagaguagaagggcacccuucagaauggcccuguguagagagaguagugugaacuaugucagugugaauuaaaaugaaucagaauauauucccuaguuaaaagcauuuguucuggagccagucugcugugguucacauucugccauugacauucacugacuagcucuuuaacuuaggcagauucacuaccugcaaaaaggaguacuucauaauacuuaacuguagaggauugucacaaggauauacaguccuuguaucuggguguagauacccuuauucccagcaaucaugagguagaggauagcagaacucugugaguucagguuaggcuggucuacaaagggcauuccaaggcuacuuagacccaucucuaaaaaacaagcuaaaaaauuuucuuguaaacugacuacaggguauagguguuuuucaguguuagguauuucuggauuauuuuugccaucuuccugaggcaaguuuaaaaaaguuuuuuuuuaaagauuuauuuauuguuauagcuaguuacacuguagcugucugcagaugcaccagaagagggugucagaucucauuccggugguugugagccaccaugugguugcugggauuugaacucaggaccuucggaagagcagucagugcuuuuaccugcugagccuucucaccagcccccugaggcaaguuuaauguacuauuuguuguauuuauguucuuagacuaagguaugggauauuuuguagguuuaggaugaaugaaguagaaauugagauagaagaaucuagaagguaggaauugcaaagggauugaacaccugaguugagauguggugggaauggcacucaucaaucuuuuggugugguauaaugcauuggguguagggauugagaaaaggaguugaagaugguaguuggauuaguucuacuaaaugcuggacaguggggaaguaaauuuggaguagaauagcucaacucaacucccagacauauuuugugcccuuaggaaagcuauguaauuuucuaauauuguggcuaauaauacuuuuagaacucauggaugaaguuugaaaaugagguaagaaauugggacuugcucauauuccuucagaaugcacccauuaaacacuuugugcuagguguuugcagaucgacacagcugaaaggucugagcacuggaacggauaagaugauggagaagaugauaggaauagaagucugggagaaagcaagcauguuagguucuuugguuuuguuucuugugacaggauuucacuagguagccuggcuugcccuucgaucaucagccucggcuuccugagugcuggagaauugcaggugugcaugaucguguccggcuggagaacuagcacuuuaaagacaaaacagccagagaggaauucucagaacuccguagguugagaagauuacuauugagaaaaguaaaaagaagcuuguguguaagggagacaguguuaaagauguuuuagaugcuguggagagaacaaugagccugaguuggcagaauaagcauauaggucaggugaugucugagaguaguuugacuaucagaucaagguagugaguaauggaagagaguauuguuaguuuucuugacauuguaucaaaauacuacagcaucuuaagaaaggaagguuuuuuguuuguuuguuuguuuguuuguggugguuugugcucccuucuuuugguucacaguuugagggugugaucccuugugguggggaaauguuaugaucucaggaguaugaggaagguggucacauugaguguguaucaggaaauacaaagauagaaagaaggaaacacagaaagacagagacccagacagugacugacaggcaaccccuuuaucccuuuuauucaguucaggaucccaaccuguagagugacgcuaccugcccuuauauuuagauagggucacucuaccucaguuaacugggucuagaaacuccucguagacaugcccagagguuuauuuucugggugauucugagccaaguugacaguacugucacagguccaccccucagcuuucuguccaaauaccaauuuuaagccauaauccucacacaucuuguuccauagguucauggccaugucauaauguaaaaugcauucgguuugacuuccagagugucuauauucuuccaaaagauggaacuguuuguucaaaaguauuaagugcaaagccucuucagacaccugggagucucuuaacugagccccuuauagcaucaaaaaauaaguuauauucuuaaguauauaaugauagaagguaaucauuccuguuccaaaauggaggaauggugacguagcaaggaacaauugaaccaaagcaauaccaaacacaaacaucacaaaacuugaagcagggcaaacagaguuguguagcucccaugucuggccucuggggcacuuuuagcucugccauuuguagcauacagaaccuuucuugggcuggcuccauugcacccaagcuacuuuucucgauggacaucuaguggucccaguauuuucacauuaguaggucucaagaccauuauaacuuagguuuacugucagaaccuaaccuccuugcagggucuucagucuugcugcacauugucuggccuuagugauucuuugggacuuuaaagcaagauuccauuauccccacacucuuaacccuauaaaugucuucaaaggcacugugaucauggugcugugagcugugcuugacccacauugcauuagcuuuugucugucuuccaggcugacuuugggaaagacuucacuaggaaggggaccagagucaggauuaucaugaaccaccccugucuuuuugucguuuuuccuguauuagucgcuugcugcugagacaagauaccuagcaaaaccaauuuauggguggauuuguuuugucucacaguuugaggauacucaguccauuauuguugagaaaugauggaggcaggaaugugaggugaauggucacauugggccugcuuuaaggaaagagaaacagauaggugcuggucuuauuugcuuuuuauuuuuauucaguccaagacugcaacccauggaaugguguggcugacaguuaggguguuuucccaccccaguugacccaaucuagacucugccucauagacaggagccucaugcaguggcuugucuccuaggugauuuuagauucuguuagguuaacagugaguauuaaccauuauaaauuguucugaugucagugaaaggaagcaagcugaacaaagcauugugcuaggguccauuuauuacacgaugaagaaaauuucagcaugguguuugguuuacuaaauguauucacaggaaauagugcaggucauagaaaguagacauaguacauagagucuggaagucucaaaccauuaacaaaucuuauuuacugaggaggggaaaugggugugguucaagaugacagagcaauagaagggaaggaaguugagaaaggcagcaacuuucugucuuuaaaauaguuuaaaauacuuggagaaaaaaauagcauguuugucuuucuuguuuuuuuaagacaggauuucucuguguaguccuggcuguccuggaacucauucugcagaccaggcugcccucaagauccaccugcuucugcuuccugagugguggaauuaaaggugugcaccaccacugcuuggcagcaugcuugucuuaauucuacauuuaaauucaaucuuuuaaaucagaguaccugcaaguaauugaaauuacaaauagcacuauacuuguaaucaaauaacacuucuauuuuuuuuuuucacuccugccgccccuagaaaagauaauuucuuaauguuuaauguucauaauguguaaauaauguguuuugaucaaaucuaccucacauuuccucuuuugggggcuuccuuuuggcacuuauuuauuggugccuuuagaagaucuuucccucaguuuuaugcauuguaaugacuuaauucuacagaaaaugcagacuuaccaguaguuaguauuaauguuuaaauucugaauaugcagguacuauuuguaucaaaaucuuguggugcguuauaguugcauuuccuuccuuugagaauuuuuuauguuccuugaguugaagauugcuuuguuuguugucuuuauuuuauguguacuuaacgugaauuuauucugaaaucuuugaaaguaaaaacuuucaaauauuuuaaaauauaucagguuuccacccaucucagucacuguucucuugcugcaaagugacaugaccgagacaauucauauaaaagaaagcauuuaauuguggggccuugcuuauaguuucagagccuuagaccguuaucaucuuggcagaagcauggcagcagucaggcaugguucuggaaaaguagcugagaguuacauccugauuugggggggcgggggcaggagagggagggagggaaagagggagggcaggagggagacagagagacagagacagacaaagagaugacacugggccuggcauggacuuuugaaaccucaaaguccaccuucaaugacacucuuccuccaacaaaagccauaccuacuccuucaaggccacaccuucuaacccuuaucguaagugccacucccugaugacaaaacauucaaauguaugagccuguggaguccauucuuauucagaccauagcauaccacucuuucauucucauguucuaaacuggccuguggaucucuaggcuaugauauaguuguuauccuggaacuuuccugagaauucuuucuguauugucuguugggauacucuuaauuuuggugaauacugcaaucacuggugugcaccaccacucaugguuuaugcauugauggggaucaaacucagggcuuugugcaugcuagguaaguacucugucgacugagcuacacuccaaacccucuaauauucuuucacauuaaaguacuguucauucguugagcuaaaucuccuugaaguuuuuuuauuagaaguaugauuuuuuaaaaaaaauauuuauuuauuauuauacauaaguucacuguaacugacgucagacacaccagaagagggugucagaucucaucacuggugguugugagccaccaugugguugcugggauuugaacucaggaccuuuggaagaacagugagugcucuuacccgcugagccaucucaccaggccggaaguaugauauuuuuaauuggucugcuucuauuugugagcuucaaguaauaauuuuuuugggaggagaaauaaaaugaaguauuuuuggaacccucaacuucaaagagcuaacucuguuauugugcaguuuaauguacuuaucaaaaugucucccuuuaucucauuucucuccucuuccacucuccuccuucuuuugcauuuacaugaauauauaaaguuuguaaguaguaaauauaagcguuuacugcuguuugauuuccagaucaugucguagaaauccaguugaccauuguuuuuguaauucuggggugauuguguauuuauauagacaagacugccacauaaguuuauuacagaccaaaggugauagugaacauuuacaucauuuucagccuguuuuuuaguuacagagaaauuaguuucgguguaauauuuucuuauauaucaucauacagaugguugugaaccaccgugugguugcugagaauugaacucaggaccucuggaagagcaguaagugcucuuaaccucugagccaucucuccagcccccaagacaacucuuauaaaggaaaacauuuaacuggggcuggcuuacagcuucagagguuagucuuacucucuucauggugggaagcaugacaguauccagacagacagggugcuggagaaggagccaagaguucuacaucuugauccacaggcagcaaggaggagauuggauauauuucauacuggguguagcuugagcauuuaagaccucaaggcccugccuucccagugacacacuuccucuaauaaggccagaccuuuaauaaggccacaacccccaauagugccacucccuauggucaagcauucaaauacaugaaucugugggggccaaaccuauccaaaccaccacagggugguagcuguacuggucagcaugccaguucucccuuauccauaccaccagggugagcucuucagcacugcucuggcucugccacccaaugcugccauugcaggaggcagggucagcucuccuguucuuauaccccuggggcuggcucacccccacccaugccuucagagccagcuccacucuguugccaagucaaaauucagggcucacuuuucccaagugcugcagcuggugaggggcaggaccagcucacccucucuccugaccuuggagucaccucuccucuuguccugggagguugagggcggagggcauaucccucaaccccaggccaucucauagcguaggaguggcaggguugggucucccucgcucuuacccucaggcugacucaccuguguucucuccacacaugaggagcagggagggcaucacccaagucaccucaaggcagagagugguggggcagcucucuugcccucagggacaguacacuugcacccccaccaugagggucagcucuguugugcuguccaggcccagaugcagggccugcuuucccaagugcuguugauggugaggggcagggcuaauucuaccacgcuuauuaugcuguggacagcuuucccaacugcuggauucagcucuccuacacucuugcccuagggcuggccuacucacaucuuugccaccagggccagcuccacuuuacugccuggggaaggcucaggacuugcuuucccuagugcucuauaggugagagguguugccagcucuccagagcccugcagucagugaaggacagcuccaauucugcacgggcgugucugucccauccaagaacaucccuauguuuuccaguaguaacaugagccaugaacauugacagugacuguagcauggccuucagcagcagcuuagacugggaccucaucauagcccccaagugacaggggacugcuauuuucuacccuugaguuugcagauccauuuuucuuuauaauguucacacugcuccacuucucuucaucuguccaucgcaugcuugcacauuguaguugcucccacagcuggcaggcccugggugacauccuuagucacauugcauggcaugguggcaggugggugccuguguuccugugcuagagggcaggucuguggauggcaugguggucugcaggucucuugccuuccuuuugccucucuguccuucauggugguagguggggcucugugugucuaugacuugccuaugccgugggguaaagggcaggucugugagcaucuuuccugaucagcaccauauggcauagcagaaaacaagucuguuuuccuccuccuuggcugcacugccugauuuuauguguucuaggcauaaaauaccuuuggcuacuaagccaagguaggguaaacagaggacugccaucugcucugccccugacugauagaagcauaccaccuccaacaagguguucucuuugcccauugccacuggguauacacacauacaaaugcauauguaauacaaaugagguauuuuucuuucugaaucuggcuuacuuuguuuaacauccuuuucugcaguucagucuuauuuucugaauguuauaauuucauucuuccuuauagcuggaugaaauuccacuuugcauauauacuacaucuuuaucuauucaucuggugaugauaauuucuuagauaucuugaauauuguagcaaaaaacaaggaugugcauauaucucugugguagcugguuuaccacccuuuggcuagcaguuuuggaguuucaaggcuuauauuaaaggcuuauugguuguuguuguuuugucuuucuucauuuguauuacguauguauacguauguguguacaucuaguggcaaugggcaaauuacaccuuguuggacguggugugcuucuauccauguccuuucaccuaauggguccuagaaucaaacucagguucucaugcaaauaugacccacugugagcuaucucacuaaagucuucucucucucuuaaaauauauauucauuuaauauauaaguacacuguuguugucuucagauacaccagaagagagcucugaucccguuaaagaugauugugagccaccgugugguugcuaggaauggaacucaggaccugugggagcgcaguuagugcucuuuacagcugagcugucucuccagcccugaagucuuuucuuaauuguaaaagaugcuuugccaaaugugaguaguauguaguaaguguuagcuuacacuuaccaucacagccccucauggaaggaagucacagcaggcaccuggaggcaggaacugaagcagaagccguggaagggaggguuguuacugcuuuuuucauuauggcuugcucagucugcuuuguuaaacaucccaggaccaccugcccaggauggccauacucacauugggcugaauuucagcaucacuaauuuagaaaaugggauacaagccugccuacaggcagauuuuauggaggcauuuucucaacugagguuccuuuucccaaaugauucuagcuugugucaaguugaccuaaaucuagucagugcauucacuaucuacaucauucacagagguaaacuacauguaaacuucaucuaggauaaaaacauguaagaaaugucauuuuaaaagacguuuuguuguccuuuaauccagcacucagggggcaggaggaucucugaauuugaggccagccuacagaaugaguucuaggauaucuaggacuacacagagaaccccuuugucaaaaaaagagaaagaaaagaaaaaaaaaagaaaaaccaagggagggaagacacauacacacacacacacacacacacacacacagagagagagagagagagagagagagagagagagagauuuugauaaauugacuucuugguucauuggcugauuaaugauaguucucuuccuucaugaggauuuauuuuacaaaacacuuuugaguggccggagagguaccccaguggugaagaucacuucuggcucuuccuagaugaccccagcgcacccauaauaaauggcucacaaccacuuguaauuccagcuccaaguauucaauacucucuucuggcccccuucaggaaccuguacacacacggcauauauucacacagacaaacuuguauacacauauguauaaguaaauauuuugaaauauaaguaaauauaguaauauauauacauaguaauauaaguaaauauaaaaauauaaguaaauauuuugaaagugauauacaggacaguagauucugaaaguuuuauuuucuuuaucagcaaagaaagagaaaggaaaaggacaauauaauuggauguaugcuucuaaauuagguucucauuucauaaaugaaaaugccugggaccagagaacugaguaagaauuuaguauuucacaggacuggagagauggcucagugaguaaagguaguugcuguuuagucuguugaucugaguucaaccucuaggaccacaugguggaaagagagagcuaacuccuucaaggaggucuucugaccuccucaugugcucugugauauguggguguguacacagguagugcacauguacagauacuuugauuuucuuuuuuuaagucuuauauagcuuuggcuaccuuaaaacuuccuauguagaccaggcuggccuugaacuaaaucauagagaucugccuaccacugcuucccaaguucugaaauuaaaggcauauagcaacaugcccagcucaauuuaugucuuauuuugaggaccauuucaaaacaaucuuagaguauuauaugauaaaauucauccauuauacuccuauuacaaauagguaucauauuaagcugauaguuuuaagacacacaaaaauagaacacuauaguguauagaauuccuucuugauuuuguuucugguugaaguauagugauuaguacagugauaaaucaaagggcagaaugaucuggaaaaguugcuagacuuuguuggaaaauagggacuguuagauaaaacuauuuuucccgcccuuuaagucuacaucuguguuugguaaacucugaugccgaguuggaaauuucagaacagccagccuuaaaaaacauaaagcacugguugcuugccuuugauuccagcaucugggaggcaggcccaggcagauuucugaguucaaggccaaccugaguaaguucugggauguugagggcuaugcagggaaacucugccuuaaggaaggaaagaaagaaagaaagaaagaaagaaaggaaggaaggaaggaaggaagguuaaaaaaaaauccacaaaaaacuggugugguagagcacaccuuuaaucccagcacucaggagccacaggcaggaggaucuccauguguuccaggccagccuggucuauagaguaaguuccaggacagcuagggccacagagaaaaaucaugucucaaaaccucaaaccagugcugguucuagcacaggaaugugggggugcccuuuagucuuuaaaaaaaaaaaguacaugcuuuucuguaucagucauguaauucauauggguguagugccacauguguaugaaucugaauuguccuguuuuauccucaggaaauacauuuaaauacuaaaguugaaaauaagcaaaaggauaaaguuugcugcuaaugcauguguuugugggauuaaagcacaagauguuuuccucuuaaauucuauaguuuguuuuuucuggaagcuauucuauuaauugacucaaacuugaauuauaaaaaauuauuuuuggagguauuuuggcaaagauggaacauaacuaagaaaaaauguucuuuauauuguuuuagauggacuuuuuaggcaugucauugugaaaguauuuccuuaaaccauucuucagaaagaaaaaaauuaacuagaugaacauugcuuuuuuacuuguucuggagagggcaggguguguguuggugucuagcucuggagcucaggcuguccuugaccuuaggauuuuuguaccucucaagugaagggaucacaagugcuuuguguggauucccuucucauaaaaucucuauccaugagugcuuuaaugggccaaaagccagaacaguaguaaaggaaauugccucauggcuuguuugacucuuuuuguuguugguuguuggccaacaugguggucuuccagaucuaugguuguaaaugccaguccagccuuuauuuuuuuauuuuuuuagauuuauuuauuauuauauguaaguacacuguagcugucuucagacaccccagaagagggcguuagaucucauuauggaugguugugagccaccaugugauuucugggauuugaacucggaccuucagaagagcagcagugaucuuaaccacuaagccaucucuccagccccagcccacccuuuaaacucaguagaaugauaguaggauugaagaaucucugaauaucuaagaauugguagauuggaugacaaggauaaaaugcuuucuaggacacuuuuuuuuucuuuuuuuuuuuucaggacacuuuuacugaaugauucauucauguguguuucuauuggcuucauucugaacuacucuaaaucugaguauuuacuaggugccuguuaaacaauugguguuguuagauccacuuuuguugucgggggaacauuauaaucaaauaagaaaaccccucucuucucuaguuuuuaauccaggaacucuucccagaagagaugguugcagacaauuguagacugguguuucuaucugugagguccaccaagcacaagguuucuuuuuaacuguuucuagccagaacacuuccaggaaaggacuguguuagauugugagcccagaaucaaauuguauaccuagaaggaugaaguguuauuaguaacuaagccugaugcuguacucacccaguucagggguaagagcuuguuaccagacgaugggaagaacuuuagaaaguguaugcgugggcugauuccuuauauuaaagcuuucaaggggguuuggugaagaaguucucucccucugacauuuuuccuuuuguucuagcauagagcaggagaguuucuuuuuagaaguuacagcuucuaucucaguguacuccuggcugcaaauuuaagcuugcuuaagcucuuucccucaaccaaacuaugguauuuuaaaaacugucucugccauaucuacugcucuuuuucuguagacuugagugagagcagagagcaauaacuaugacacagccugaauucuauccugucuugaaauuucuucugccuaacauacaacaaaauauaaaaugaaaauaaacauacaguuuaucuagggcuaaacaaguacccuauaauuuccaacaucuauggggggggggacucuuagaauaugucaccugaagauaaagaaggguauacuguaaguuuggauagugauuuguacaugugugaguggaugcauggaaguguggggguguguggaaacuagaggacaaccucaggugucuauuaccaccuuuuucuuuucuuuuuuuuuuuuuuuuuuuuuugugacugggccaggacaggggaugaauugcucucuguccugauagguuugguggcugaccaguuuaaccucugggaucuacauuucuccccuauccuggugcuaggauuacaguugccacccacauccagcaguguuacauagguagauccuuguugcaaggaucugagcucucucaucagcccuauaaaaaucacauuuuuagcugggcauuguaauacaugcuuuuaacuccaguacaggagguuaaggcagggaaggucaguguaggcaauauaacuagguucauucaagguuagcuugacaugagucugccucaaacuaaacaaaaagauacaaagacauuucuucuuccuuaguugagaguguacaauuuuauugguagaugaauugcaaauaguaaaaggcaguuguuuuacuaccaacuugacacagccuagagucaucugagaagggagucugaauugaaggaucauauuggacugucagcaugucuguagcuuuggucauuaauugaccuaggaaggccuaguccauuguggguggcaccauucccugagcugagcaugggauauguucuuuagugcaacuuuuauguggcuugucuuaggguuucccauugcugugaagaaauaccaugaccaaggcaauucuuauaaaggaaaacauuuaauuggggcugccuuaccguuucagagguuuaguucauuaucauagcgggaagcauggcagcaugcaggcagacaugcuggaggagcugagaguucugaaucugauuugaaggccaccaagagagccuggugcccucaggcagcuaggaauaagcucuuuucuacaauggcuagagcauaggaggagaccuccaaagcccaugcccacaaugacacacuuccuaauaguaccacucguuaugggccuagcauauucaaaccaccauaugaccauaagaucaaaucuuauauuuaagugaaauuuuguucugcuuaaaauaaaaacauacuuauauuuguguaaacugugaagauguauaguugugguuucuaugaagauucuacaaugaaaauaauacggcauuuuaauguaaauagaaaauuauauuaaguauaaauuucugcuugaaaaauuuuauuucccugccaccaugcaacauggcaaauuacuaaaguaauaggaaaaguguuaaaaagucugaaaaggaugugauaguaaauauuuugaaauuguaacucauuuauagucuuuauaacuuaugccauagauguuacauaaguaagugcaugugacuauagcugccucuagcuugcugugcagcuaaggcugagcuugaacuccugauccccuugccucugcucccaagugcuggaaguacaggcaugagccacucugccuggucuguaccagagcgcucagguguagaugacugcagaguuagcauuuuguacagaaagugggaacuguauacucuccuuuuugugacaugaucacauaaaauaaaaugguaaaauaacgcaaaauaauaggcuaaagugacaaaagagaucuuuuucuucaaggauuuaaaaggccaggaugaguugaguauguuguacaagugcuugagugugcacaagaagagaugccuauagagaguuggcaaaaauuucuuugaaaugauacuuaaauuuaagaguacauacauaggguuuugucacugaugaaauaaaggagagaaaggaaaaguacaauauaaucauuccuuucugugcaugauuauauugcucauauuuuuauuucuuuggugcucuuuucugccucuagcccuuuguaugugcuuugcuagaaccccucccccacccaaccagcucaugucaguuuuucaggucucagcuuugacuuuacuuaagccucgacuugguuguuguuuggaacccaccuauuacaucauaguauacauauacaaucugauguauguuucaaaucauuuuuaaauuuuagaggauuuaaagauguuaaauguaugugugcacaugcauaugcuugcacaugagaguucaugcuugccucagcacaugugugaagguuagaggacaacuugaaguagucauuucucuccaccagguggguccugaggaacaaacacagguuaucaagcauuguagcagauaccuuuacccacugaaccaucuuauaagcucuuuauguuuuaaaauaaaauuuauuucucugugugcgcacauuuggucauacauguaccuuuggggacauugcagauacaguuggaacauucacauucaaaggcauuuuaugaccuuuaauuaauuaauuaauuaauuaauuaauucugagacaggguauuucuguccccggguauccuggaacucuguagacaaggcuggccuugaauucagagauccuauuuccuuugcuuacugagugcugagauuaaaggcacacucuauaccuagcugaacuuaaaaaaaaaaaagaaucaauaagauauaauauacuguguauaaaauuauacacuugcauguauguguuuguacauguuuguguggaugcacauguauagcugugcacaugugggggacaaaggacauuucuuguuugugcucagaaaugccauccagcuuagucuacagcucacuaauugugccuguuaaccauccucuugucucuuccuccgccuccgcaguaguuggauugcaagcugugccacuguguucagcauuuuuacaugggugccugggaucaaacuuagguucucaugccuguauggaaggcacguuuuccaccugaacuaucuuuucaucccaaguuaaacacauuugaguuaaguugggaguuuguuuuuuuaauguagagugacuucuuugggauaaauuguauuuauuuuaacugcccacuuucuauuauugugugagugcuguuaggaauuguaccuuauucugugaugcaagguuuguuugugaaagucagagcuuccauaugacuauggcuagucuugcuggccagcuugcuccaggauucugucuucaccuucugagcuggaauuacagguggguggccaugcccucuuggcauuuauauggcuuuuucgggaugccaacucauuuauuuucuuccuuuccuuuccuuuccuuuccuuuccuuuccuuuccuuuccuuuccuuuccuuuccuuuccuuuccuuucuuuucuuuucuuuucuuuucuuucaagacaggguuucuuuuuguagcccuggcuguguagaccaggcuggucucgaacucagaaauuuaccuugccucugccucccaagugcugggauuaaaggugugcgccaccacacccagcccaacucauuuucuugcuugcauaguaaacaccuuaaccaccaggcugucuccgcagucccuguuuuacuuuuuuuuuuuuuuuuaaugugaggaaggaaaggguuuauuuuagcucauuauuugaugguacaggcaugggaaucaugggaucgggaacaugagguggcugaugacagugcauccacaaccaggaagcagagagaaagagagagagagagagagagagagagaugaauggauguaccgcuuaaucuuugcccuuucuucaguuggaccuguuuuacuuuuugagaugcaaauuuaauagagcaaccuuuuuguuuuugcucaaauucuguucucuauguaaguaucacaauugacuacauguuaaauguauaagaaagagguagcaggagaugacagggaguuauauauguagucuaguauuugaaauuacuuuuuguauguuauggcagagagagauaauucuaauuuucauuuauuuuuaaaagauuuuuacugcuuauuuguuuguaugcauaugcauguuucuguaggugcccucacaggguauugaaacccccuggagcuggacagcugcccaauuugggugcugggaacugagcucuaguccugaaagagcaacaugucccuuaacuguaaguugucucuuaucuaugggcauggagggggcaggccaugccgcauuguuucauguggagaucaaaagacaacuuuggaaucuguucucucuguggauugcagggaucacacagguugucaguugugugcagcaaaugccucugagcaaucuccccaaccacuguaugugguggaccaaccugcucuaccuaguuaguuccaagcuagccugggccacaaaaugagacucuuuguuucaaacaaaaucuaaaaagaauccaaaaaauucagaagaaagguccacuguaguaacacacccucuuuuuauagaagaggacacugcaagagcagauagaaaccacaaauucaaagccaagaacuugcauucaguauuaaacagcucaagggauuucuuuccuuuguuuuauuuuguuuuucuguuucuucccucuuccuuaauucuuuuuuguuauuauuuuugagacaggucuauuauguaaccuacauuagcuuugaguucauuccucuugguaugcccugcugugccuaggcagcucagggauuuuaauucaguuuggugacagccuauguuuucacugcuacugccuguuuguagguguaccaguggguaagguaggcaggguagucccuggcaaaauuggacagggucagaugcuguauuaagauaaaucuuuuuuuuuuuuuaaagaugaauauguuaguuaucuguaggcauuccacaguauuuggauauuuuguaaaauauugcauaugauaaauacauauuaguuuguaagaaaaaagugaaaacuuuuggaaaagcagccaaugcuguuaaccacugaacuaucucugcagccuuggaaacuacaacuuguugauugugaugguugcaggaaucaguguguuuagugguguuuaauaauaguucaggcuucauuucucagcuggaucagucuucaguuacuuuugcuucuuuuugguuucuccucuuugucaguccuuuucagauguuaacuugucccaagugccuucuguaccaugugugucagugacagccccaugcagagugcuucucccuucccugugcugcaguguuauguguuagcacuggcauguuuguugccuuuugugucucauugucuguuacaacagaagcuuuccuuuauuucuguaucuguagaaaaugaucagugaaugaaugccauugaaauuaggcaacccugaaggcucauuugggaagcuugguccagaauugauuguugcucaucucuuuugcuauauauauaaggcaagcagaaagucacauagaaagcagaagacagaauugaagcuaaggauguggauauuaacaugcauaguaucaugaguguauugguugccaaacuauaaaagugccuuuugaaauauuaacuuucaguuuuauugaaauugccagccagugguggugcucaucuuuaaucccacccaacacuuggaaggcagaggcagguggaucuuuugaguuccaggacagacaggacuccauaaagaaacucugucucaaaaacaaaacaaaaaauuuuguugaaauugugcauacguuuuuacauuuuuuauuuuguuccuuuacuaucauucuuugaaaauugauguuaacacacaggugguuuuguuuuuguuguuguuguuuugugcuaauggaucuauuaauauuguguguguguuuuaaguuuuauuuuuaauucuuugcaaaacaacacagaaagaggccuuggcauguaugaacuagaguagcaugcacuuuguuauauuugccugaagcuguacaugcuagagggcuaagucaauacuucauuauaaaacauuucuuuuccucuaugugcuuuacguuuuaauugaaugagaaaagcguugcuaaugccuuaguacagugauaaauuaaggucuaguuauucuaggugugguggugcacgcacccugauaaucucuucuauggcagagggaggaggaucaugaguucaaggcuagccuggacuacauagcaccuagggagcuagcaccaguuuaaaaggucaaguuggugccaaucgcagcacuugggagacuaaggauggaggaaugcagcaaauucaggguaaaaccuggucuauaauuccagacuagucagggcugcauaguuagucagaaaacuaagccaaacauuaaaagggcuggaggguuggggggacuggccuuucuaguuuuuguuuguuuguuuguuuguuuguuuguuuguuuuuugagacaggguuucuccgacuguccuggaacuuacuuuguaaaccaggcuggccuugaacucagaaaucugccugccucugccuccccagugaugggauuaaaggcgugcgccaccacgcccggcuuugauuauuuuuuuuuaaagcuuuuacuucauuuuuuuuuucuccuuauaagcaaccuuaaaaguauuauaucuagcuucuuuuucuuuucccuucagacuuucuguccaguaugguuucuaucuggucaugacuuuacuuacauuuaucuugaaguauagugcuuccuauguuguagguauuucuccuuauuuauuuguauauacacacauauguacacauacauauguggaaugucuucucugagaauuuuauacauguaauguaccuugaucauauucaucucaacuaugcuguguccagaagacagcauuucacaguauucuucccuguuuuuucugucccgucuuccagcauguucuaggaucauuuugugugugugugugagugugagugugugugugagagagagagagacacagagagagagagagagagagagagacagacagacagacagacacagacaggaauucucuccgauggagcagaccucaaauccaguucaaaagugguuggcuacccccauaaucuucauguuacucuugugccauggguucaucuugcauucaagguuugcugguggauaaaauauaucaucuuuuuuuuuuuucuguuuaaucaucauagcaacucagcaaagagguaguuugggagggaauaugggaggaauaacuaauacuaaggacuauuugagggauuauaugggaaccugcuacucuagaagcuuacauuucauaaauauaaaauguaaguugaguugggagacagugccccagcaugacaucuuagaccuaaugaaacauccaguaccaggaauggauuauauguagcugagucuucagccaaaggggccccauggaaacucccagacaucgcagauaauaggcaaggcucucuacaaauugaugguaauuacccuauugcugaagccaaaacuucucauucaacacagagaagucaggcugguuccuaacuagacguuucacugcuacuaaguagccuucaugguacuagagguaaucuguguacuaccagaggagcaaggucaucagcucagcuucaaacucugugaccucagcucucaucugccugggagauauucugguacaguaguaggagugcaguacaaacacuguggguuuaaccauccgcucugauugaguuuaaggaccacuccuugagguggaacucaugacugacagugcuagggugaccaagaaccugagacuagauagaucgugggccuagaggaaaagcaaaaacuaucugcucugcugaaggaacacaguaauaaauugacuccuaacaacacuguuaugcccauauaucggugcuugcucagccaucaccaaagaagcugcuucuugcaaaacauuggaauuaacucagagacccacaacuggacaguguggagagaguaagaggacuuggagcacucaauccuaaaaggaaugucuuuacccaaccccucgccuuagggcucagggaucuauucggaagaagaaauggaaagacuguaagagccagagaugaugggugacuccauggaaacaguaucuuucagacacaacaggcccuaugcacauuugaauuagagaauggcagcauguauuggcuagguccaagugcuaggagggagaaccaagaagcuagcuagcugcaauugauacucacuugcaaaggaaaaaaguaguuuucuacaguuggauaucacugaguauauuagauauuagccacucuucaggauaggucccaugccugggaaauaaacucaaugguauuuuuguagacuuuuugucucauacugcuuugggauuuuuguuuugucuugauggucuuuuugcuuguauguuuuguuuuuuugucacccaucuucaacccccccccccccauaccuucauacaggguuucucucuguagcccuagcuguccuggaauuuacucuuguagaccaggcugucccccagacucagggauuugccugccucugccucuccagugcugggauuauaggugugcaccaccagcacccagcuugguuucuguuuuuguguguuucuuguuuuuguuuuuguuuguuuguuucuuuuuuaaagagggcuaaaaggggguaugguggcauugaguagguggggaagaucugggaggagcuggugcagggaaaaaacaugaucagacuauguuguuugaaagauguuuuuaauuaaacauuguguguugagggaggggcagucagaguuaucagacagcuucagggagucuguucuucucccuguggguucuagggaucuaaccccugucaucagguuucacagcaaguuaagccaccucugcuugucccucagagacuuguuuuccugccuagggauauugccaccuauagaaugcuagacccucccacaucagucaucaaucaggacaguaauguagagacaugcccgcaggccagucugacuguagaacauuuuuuuuguuuuuuuuuuuguuuuuuguuuuguugauacuacuuuauauaguccuaucuguccuggaacuugcuauguagaccaggcuggccuuauagucaugagauuccccugccucugccucauaagugcuggaauuaauggcauguacaaacaugccuggauugaagcacuucugaauugagauuccaacuuuuguggugacuuuagguugugucaagcugacaaaaacuaaggcaugauguaaucucuuaauugaagguauuauugugauauuuaaaugaagcaguguguggaaaacaauuagacaaugccuaguaagugcuaguugccuaguguucauuguagucagcuaucuguuuugcucuuuauucuauuguucuugauuccuagaaaacuacaaugacuaaaguaauuacugaagagaaagauuuguuucuaguuuuggaugaccaaucauaagucaguugaauuugaauuaugaguacuuggacaugaaaauucuuuugucucuggcuaugguggugaaauugucucuuuuauguaaacaaaaaacggaacaaaggauagcaagcagccauuuguggguguacaagacaguguauugcagagaaaaguagaacacacucagauaugagagagggcagguuuaaaaagauugcuagggaagaaaacugaagggaugagcgaggcagugauacuuaggcgagaguggccauagaaaccuuugcaccaguccacguccuggguaagcuuuuuguauuguuuuuuaaagauuuggaacauaccgauuuucugaggagugaugagucagcuguuuucagauaacaacaacagaaccuguaggaaugugauuccugagaggaguggagccaguaguaaggugagcucugauuacugugggugucuuccagaacauacauucagacuucagugcuuucagggugucucaggacauaguaccugauuagauugaucagauggaaauaagcuugaaggagguugcaguggcuggaucagguuucacagaagagggaguuacauaaaaaugacacucuuagagucucuuaguguuugcuaaaggaguuuauguagaacucguguaccaaggaacucccaugagacuggacaaggaaugacccaagagaccucugaguugaguaauuuuccaaagcuagguguuguuuaaacacugaccagacagagugcuauugugaucauccauauguuuaguagagucucuagaaggacgacugccuucauaguaagguuaaauucuagagaagagguuauucccauuuuuucuuaagauaaggucaaaacaaucuuuaaaagaucaagcugaucuacagauuuuguaacugacuuucaaaauaaaucccaacaaucucaagaacauuguguguuuggaaucuaauaaaguaauuuauugaaugcaggacuaugugaacugcgaugaagagaugguagguagaaucaaaggaauaacaaaugauguaacuggacagguuuuauuuaguugugugugcauguuugagagagaauacacucaugcgcaugcgcacacacacauguggauaugagaguguaugugggcauauguguggaguuccaaggacaacuuuguggagacugauuuaaaaaaaaaaaaaucugcaaacuuuacagcauagucuuagaaacuaccuaaaauauaaagacucugggcauguacaccugcaugccagaagaggcaucagaguucauuauagaugguugugagccaccaugugguugauaggaauugauuucaggaccucugaaagagcgaccagugcucuuaauaaccacugggccaccucuccagccccgacaugacacuuuuauucuguugaaucaaaacaauggacuggggcccucccauaucaaucacuaaguaagaaagugcccuacagcuggaucuuuugaaggcauuuucucaguugaggcucccuccuugucagugacuaauuugugugaaguugacauaaaauuagccagcacauuacuuaauaauauagaugcuuauaugaaaaagggauauucaaauucauggaauuuugaaauguaauaauuaaauauauuacuauuuuuacuugguguggcaggggacugucugccagagggugcagguggucagagggcaacuuacaguggucaguucucuccguccaucaugugggucccaggaaucaaacucugguugucgaguuugcuggcaagugcuuuuaaucugcugagccuucucuccagacauucuuguuuaacaggguuggaggguuuucuuuggggguaacacuuugcuuuauuuuguuucagaguucuguaucaguagaucaguuuuacagugcucaccucaucuaggaugcgauuuugcuauagcuuccauauugguuacuuuccaaguuguuuuaugaagugcaugaaagaaggaaagcaggauuuauauagcacacagccugagggcaugccguccauuguggcugaagggcggguugguggcagcagacauguggcugcagagcuugcacguuaucuaggcagaucaagaaguagacacaagccaaaaacaggcaggaauguaaacuuagggccuggcccccagugacccagcuuccuccaguuaggccuuucccacaaccucccagggcagcauaaggagccuguggggacauuuugcauuuugacaucuuugaauacgguguucuguccagauguuaugcagaguguaacuuugucacugugagugacaaaacacugagcagcacugugaagcuaugagagugccacauaaggucuuuguugcauacgcuuauuaacauugccuucauagcacagaaguugccaggcauaauauguaaaugucuguguuacaacaaaacuuuauuuaugggugauaaaauuugaauuuuauguaauuuuucuauauuuaagaauaaguugauucuuuuucuaaccacuuaaaaauauacaugcaaauuaguaggguaaggaccagauuuggcccauagccuguagcuucccuaaacuuagguauaaaauaugaaaaaaaaaaucucaaaaccuaauaguaauuuuuauaucuuuucaucauuuuauuuaaaaaacacaguacuuagauaccaaaaacaaacaagcaagcaaaaaaccaccaggcuugggaggcagaggacagccuggucuauggaguuaguucuaggauagccagggcuacagagaaacccugucuacggaaaaaaacaaaaacauaaacagaagucacaugaauggugcuaaaggguacugaguuuuauuuuggcuuggucuguuuuauuaacaacuaaaauguaaacaaugauuuaguuauuagcuagaauucugggauuuacacuacuguagguuucuuuagaaugaacaguuucuucuguguguacagugcaugcauuuguacauguuuaagagagcauguguacaugaauguggaggccagagguugacagugggugucuucaagaaaaaaaccuuucuggguaccaggaaaauaaccaauucuguacaaaauugcugggcucauccccuagagauuuuuacuuagggguccaggaauagauuuagggugggguccaggaauguucacugguagaaaagaaccccaagaaaccuggauucaaauuuuaauauaacagcaagcagcaagucacugucucuucuccaucaacccuacaccuaccaugcuccuguuuuacaaauuagaauaccuauuuaauugaugcuaaauaagugauaacauaaaugugaagaagggauauuaaugauuaaauuagggcuggauuucuguuaucccuuugauacucuugauugcuuuguauuuccauauaaaauagaucuucuuucauucuugucuuuucccucuuuuaauaguaaaugucuuccuucuguaacucuccucccauuaacaccugucucucaagugugcccuguucauucuuaggaaccgccuucuucuccuugcucuggcugguucucauggaaguacugagucccuucaguuugcuuauggggaguucuugcacuugugauucugacgaaacccuguuuugggucaaagcauggacaaggcaauuuuaggaaauaaaaagcagcugaguucuuggggccaacaagcacuaggggaaauuuaccagggaguagaaguuugaagcugaauauuggcauauacuugcucuguguucagagauggugccaagaguuaaacauuccuggcugaauccuaugcuuuuguguuuguuuguuuuuauuucaguuacccugaucuuaauucucccauugucaucuccuauuuuggguugauuuuguuuuuaaggucuccaaauuaguaguuacuguuguguuguuacaguaaaugccugcuuacacuagcuuacugcuuguuuuacuuugcuucuuagacuguuugguucaguuuccuccuuucugugguauuuuucuuaaaaaauaauugucagauauugucuuugguuguuaagucaucuuugucugauucucaguguuucacccuuuguagguguucauuuaccacaacagauguuuugagacaacuuuagggagucauuuucccuuuccaccauguggcuggguucuggggauugaguagguugccagacuugguagcaaaugacuuuuuacuugcugagcuaccaugcuggcccacgguaucuuaacugucaggcucauucugaagacuaucuuuuaucuguucuggaagacaaucaucacuuugaacaugguuuucuugccaaauuuacauugcauacauguugcaguaaauaucucauuaguuccuucuuccuuuucuuaaguuugguuuguauuuuauuuaauguuugugucaccuuuguuuguuuguuuguuuguuuguuuguuuguuuguuuugagacaggcuuucucaguauagcccuggcuguccucuguagaccaggcuggccucgaacucagaaauccaccugccucugccgccugaaugcugggauuaaaggugugaaccaccacgccuggcuuuugugucaccuuuuugaguaauuucucuuauuuaaaaaaauuuuaauuucucaguucacuaauucauucucauaaacuuucccccuuguuuguuuguuuucagaauggaccuuacuauauagucuuuucuggccuauaaguugauguguuguagacuaguuuggccuuaaacucacagauccucugccucagcccaccaggugauaggauuaaaagcgugugccaucacuuguagcccacaaauucuuuuaagcauuauuuaaugucuaauguauguacugggcuuuguuuuuauuucugugguuguaacagaucaaagccagggccucaugcaugcuaggucugugcuuuagcuacuauugagcugaauuuccaaucccagaggucccuuuaaaaacuuuacuuauuacuacuauacauacauuguaugauagcuauguauaggacacauaugucacagcuuguguauguggagagauccaaagaccacuuuguagagucaguucuauccuucaucuuuuugugaucugggaauuggacucaagucaucaggccuuaucaacaagugcuuuuagcuguuaaaacauuucacugggaacuggggaagcuaccagcaaaucacggaugccaggaaaacaagaugcucccaggacccaacagagaugagauuagcugaaaugcccaacaaaggagagggagaaccuacagagaccauauccagagguuaggcaagguugggggauggggccacccacucaucuccaaauuuuuaacccagaaugguuccugucugaaggaaauacaaggacaaaguguagagcagagacugaaggaaaggccauccagauacuuccccaccuggggaucuaucccauguauagacaccaaacccagacacuauuguggaugcuaagaagugcuugcugacaggagccuguuauagcugucuccugagaggcucugccugagccagacaaauacagagauagauacucagauguucgcagccaagcaaccauucgacugagcauggggucaccaauggaggagaaaaaacugaaggagcugaaggggcuugcaaccccauaagaagaauaacaauaucaaccaaccagacacccccccccccagaggucccagggacuaauacaccaacuaaagaguauauacauggagugacccauggguccagccaucuauguaguggaggauggccuaauugggcaucaaugggaggggaggcccuugguccuuugaaggcuugaugcuccaguguagggggaaugcuagggcggagagucgggauugggugggugggggagcacccucauagaagcagggggagggaggugaugggggggcggggggaaccaggaaagaagauaacauuugaaauguaaauacauaaaauauccaauuaaaaaaauaaagacagugcuaucaaauuagaguggauguaagcacaugaaaaaaaaaaaaaccauaccacuguuaggguguuguuugcccagacucuugcgcgcgcucaacuggccaggaagaacgaugcugcaacaggauccuucugcacacguuuauugggagagcuugauuguagaggcgaaaagacucugagcccagaacuggugcugcuuuuauaggccuaggagaggcgugucuuacacccggauugguuaugcacuaugccucauuugcauguuccucaucugauuggcuacucucucucucaguaccucacagagccucauuaucauaccucauuugcaugucucacaucugauugguuacucucucaguaccucacagagccucauuaucauaccucauuugcaugucucacaucugauugguuauacucucaguaccuuacagaaccucauuaucaugcccgggccaggcagugucuuugcaaaaaacuuuacugcauauguacacauugguuguuuguccaaacuuaugcgugguggccagcaguagucagugccacucugcaacggcacauguggcuucccacaccagaccucucucagucaggaacuguauuuucuaagggucuuuauuaguugucuucuuagagucagacuuaagaguaugcauagcuaguugcuaaggcugaagccuaaagguucugaacuaacaguauuugcuuuauuuauuuauuuauuuauuuauuuaguuuuuuugagacaggguuucucuguguagcccuggcuguccuggcacucacucuguagaccaggcuggccucgaacucagaaauccgccugccucugccuccuaagugcugggauuaaaggcgugcgccaccaugcccggccaguuuauuuuaaauauacuacauaugaaaugauaguauuuagcccuuuggaaucaacugugaguuguguuaucaauaccuguucuucuauuuuuguggucaguguuuuagauugggucugggcuuuguuuauugccuuguucuuacuuguuuguuuuugcauauuuaaguugaagaacuucuauaaagcuuaaaauuuuuuuacaugaacacuuuugcuuuauaccuaggugacaaaacacacccgccuuccucaagcuccuccagcauuauccgacgcacaucuucccuggauacccucgcagcuccauaccuugcugggcacuggccccgagacauucgugggcaagccgcacccugcaugagggacaaggccacacagguagguuucucuuacuuguucuucucugaagcauugagugcacaccagaauuuccuccgaagcuuuugagaaguacagguuuccaggccuaccuuccagauauuugucuggauuuguuuggccugggagcaugaauuucuaaaaguucucaaaaguaacucccauagaaauauauaauugcgaacauacuuccccuuauuuauuccuuagaaguuagauuacauucucacaauauuuucaugucuggaauuuagacucaaaaauuuguaguagaggauuauucugcauaccauuuauuuuugugcccccaaaaccuuuauauuuugggagagcuauauuacauuguugauuuugugugugugugugugcucacauaucugcaugcuuauacuguagagugcuugagugcauauagaaauuagagcacaacuuugugaagucaauucucacuuuccaacuuuacaugaauucuagggauuaaacauaggucagcagugcgcuaucauacacuacuaagcccauuuacuggcuccauugcuaauagauuccauaaauguaaacaucucaacaaaugguagucugaaagugaaguuucauacuuuuacaucuaucaaauugacuaauuaagaggaugcuagaauguuaacauauaauaauuuauaaauuuauaguuaaagaguugaaguccagcuagagguggugacaugugcuuuuaaucuuagcacuugggaggcagaggcagggagagcucugaggccagccuggucuacagagugagcucuaggaaagccagggcuacacagagaaacccugucuugggaaaacaaacaaacaaacauugaaguccaauauuguacaagcaguucaugauugcaugcuaguuuggaguuucuuuuuauaguauuaccacauuguaauuaauuagacauuuguacaaucauuuacccauuguuuuucauacuuacuagacagugaaucccaguaaggugaagcugugucuggcucacuguugcuguuuucucaggaacagcaaccguauaccugaguaguaagugcuugaggagauuuugaggagcauuugcaaagccguggaucagcagcacaguauugcacucuugguaauggagaaugaaaggcugcaaagacuucuaguacuguuugcaguuaaguuuuugcauugaaaaauuguaauuacaaacuaaauucgacauagaggacuuacuccaagaaaugucaucuuauugguuaggauagaauagacagacaggccugaaaacauaaagccuggccugggcacuucaggagggccaccugguaccccugcaagauggcugugccuguguuuaaaguaccucauuggaccugaagaugcuggagcauccaaacagaccauggcuuuuguaaauaggcaaugcugaagcccauugugauaaccacauccaaaaggcuuuuccaucuagggagccaggccuggguauguuauaggaagauucugguguccccaugacucuggaaacguuguugaacugaugaauaaaauaagaguaaaccucugaagaacugggugaugggaguugugagcccaacccugucuacagucuccuguggguucucuaauuuuaguuuuugguuuugguuuuuguuuucuuuuuaucuuaauggaagccauguauuuuuuuuuaaacaauuuuuuuauuagauauuuucuucauuuacaauucaaaugcuauccugaaagucccuuauacccuccccucgcccugcuccccaacccacccacucccgcuuccuggccuggcauuccccuguauugggggguauauaaucuuugcaagacccagggccucuccucccaaugaugggaagccauguucuauuaaucauguuccuugauugaaugucacccaagaugucucccagaacaguggcaccaccucugagccugcauucucuucacuaucccagaaguuacaugccagcaccauucugccuguucacaucccaugacccccaccacuuggaauauguguugaaaaugccuccgccccuuuaucugucauauaaaucauuauaccagaauuauacuugccugugugaucuauauaguagcugcaagaucuaaguuacauaaagggaaguuccauuacuucacaucacaguguagauagaagaaagauuuacauuucccuauauuguuaucuguagaagucuuuuguuuaaaguccagcaacuuuaagauauuuugagccuuuuuauaauaaaaugauucuccugaauauucaucagcauauuucuagauaccuguaaauuggaauguacucuucagugcucaagcccugaaaucuuugacacuaugaaaacaccugcaugccacccagugcuagucaauggaagaauucauguaucaauuuugcuauguuuuuauaauguguugcuucuuuauuaauuuguuuagaacuucaaagaguuuuuaaguccaauccuguaaaggauuggacuugagcuuuucuucauaaccagacaguuggaaaccaguucccaggaugccacacuguaugccccaucuccaaaauaaguuacucuuuuuuuuuguuuguuuuccaagacaguuucucuguguagccuuggcuguccuggaauucuguagaccaggcuagccucaaauaucaacucagauauccugccugugccugccucccaggaaaucugggacuaaaguccugcaucacuaaaccugcuuaaaauaauuuuauucuuaaaaaaauuaauuuuauucuuguuauuugauauccuaaacuuucuuuuagauuuuauuuaaaauuuccuaugauggugaauuguaaauaucccaacaugaaagguuuuguuuuuuuuuuuuguuuguuuguuuuguuuuuucaccauuagguggacugaauuuaaccacaaccaucuucuggggaagaauugagaaaaagcagucucuuuaauccauauuuugagccaucuucaauuacuuguugcagcagugccuauguuacuaaaucuguuuaguuugagguuuagaguccugggaccagcacuaauuacccucaccaccaaauacaucuaagcuucucugccagucucuggauuugaccuuaaugucugguccugacuugucauuguuguugucuaguaaaaaauucacaaaaagcugaaaauuugucacuucuuguuuagaaacuggaacuguaaauagcaaucaagcuuucuguugggagagccgguacaauagaaagcagauagauggugauuguuagaugcugcacuccauguuggcccaaccucuucuccacauguuccacugggccaguucagaauuuacaaauaaccuuauuaguaaaagaaauaaaauacagcuuaacacugauuauaaucaacugaugcuaagauacugaugaguaguuuaugauuguuaaaauaugcuagagaaauggcucggugcuugggagcacuguucaugcagaggacugggguuuauuucccagcacaauaugguggcucacaacaauccauaaacacauacaagauacauauauagacuugcaggcaaaacacucauaacacauaaaauaauaaaaucuuuaaaaauuuaaaacaguuuuaccagcucuaauuuuuuuguagcauauauuauuuaauagaaaaagucuggugugcuguuguuaaauacuuuuuguuaaaauaacuuuuuucccuucuacaauagaccgagagugcaugggcugaagaauaugaaaagaagaaagggucucauaagcgcucaucauccuggggcagcacagaacagcuuaaagaggucagcaaaauguucuauggaagcagaaguuuggcuuucccaauuugcuaguuccuuaaaguugugggcugcaaaugucauuuuccuggugcagggggaggguauuuaugugugcaugcauaucugugugaggauaugugugccuucaugaaagugugaaaagcagagggugaugucagggguuggcuacuuuuaccuuuuugagauaaggucucugaacuuaccgauguuuuaguugugcugacugaccagugagccuuagagauccaucugucuuuuuuccaccuccuguuaaucccacugaaugacaguaaacaccaucaccuaaauuauuuggucaaauuaggcaagccuuauuuucuguccagugggguuaucucucugaaaugggguuugaaauacuuuugaaaauaaaagcauugaacuuuuagagggcuuuccuggaauugagggauuuucugaggaaucuugguuauguaggaacuuagcugaacauuuuaaaauuauuuggcagaacaucuuaucaggguacaugcaagguaugaguuaauucuguaggguagagagcaugucaacuugaauuuugcagcaaacagaaauaaacuuguucuguccuuauaaaaaaauaguuugcauccauaaguuggaguccagcugguccaucacuccaagcacaaggacaguagaugaacaugggaauuggagaccugaacucaacuguuagugcuugugcagcaagcccuuuaccacuaacagcuuuaguguaccuuccccccauuuacuugagaaauagcaacagaaaagguuacuauguuaauuugggggaaaaaaaagguuugaagucagauauuaguguauaccuauaaucucaguagucagggaauugaggcaggaggauuggauugcugaguuuugagccugcugaaccacguccccucccucaaaagaaaaaaaaaauauuugaacagaaaaugugcauauauuaaccugaugaugcaaggcuugcuuuaaauagaguuuguaugcaucucaaaauauauacagacaucagacuuauaaaauuagugggauuaagaaacuggcauuuuucaaucccacuaaaaucagggacuagacaaggcuguucacucucgcccuaccuauucaacauuguacuugaaguccuagccagagcaauuagacaacaaaaggagaucaaggggauacaaauugaaaaggaagaagucaaaauaucacuuuuugcagaugauaugauaguauauauaagugacccuaaaaauuccaccagagaacuccuaagccugauaaacagcuucaaugaaguagcuggauauaaaauuaacucaaacaagucaauggccuuucuguacacaaaggauaaacaagcugagaaagaaauuagggaaacaacacccuucucaauagucacaaauaauauaaaauaccuuggcgugacucuaaggaagugaaagaucuguaagauaagaacuucaagucucuaaagaaagaaauuaaagaagaucucagaaguuggaaagaucucccaugcucauggauuggcaggaucaacauuauaaaaauggcuaucuugccaaaagcaaucuacagauuuaaugcaauccccaucaaaauuccaacucaauucuucaacgaauuagaaagggcaaucggcagauucaucuggaauaacaaaaaaccuaggauagcaaaaacucuucucaaggauaaaagaaccucugguggaaucaccaugccggaccuaaaacuguacuacagagcaagugugaucaaaacugcaugguacugguauagugacagacaaguagaccaauggaacagaauugaagacccagagaugaauccacacaccuauggucacuugaucuuugacaagggagcuaaaaccauccaguggaaaaaagacagcauuuucaacaaauggugcuggcacaacuggcgguuaucauguagaagaaugcgaauugauccauuucuaucuccuuguacuaaggucaaaucuaaguggauuaaggaacuccacauagaaccagagacacugaaacuuauagagaagaaaguagggaaaagccucgaagacauggguacaggggaaaaauuccugaauggaacagcaauggcuuuugcuguaagaucgagaaucgauaaaugggaccucauaaaauugcaaagcuucugcaaagcaaaagacaccuucaauaagacaaaaaggccaccaacagguugggaaaggaucuuuaccuaucccaaaucggauaggggacuaauauccaauauauauaaagaacucaagaagguggacuccagaaaaucaaauaaccccauuaaaaaauggggcucagagcugaacaaagaauucucaccugaggaauaccgaauggcugagaagcaccugaaaaaauguucaacauccuuaaucaucagggaaaugcaaaucaaaacaacccugagauuccacuucacuccagucagaauggcuaagaucaaaaacucaggugacagcagaugcuggcgaggauguggagaaaggggaacacuccuccauuguuggugggauugcaagcuuguacaaccacucuggaaaucagucuggugguuccucagaaaauuggacauaguacuaccagaggauccagcaauaccucuccugggcauauauccagaagauaucccaaccgguaagaaggacacaugcuccacuauguucauagcagccuuauuuauaauagccagaagcuggaaagaacccagaugccccucaacagaggaauggauacagaaaaugugguacauuuacacaauggaauacuacucagcuauuaaaaaaaugaauuuaugaaauuccuaggcaaauggauggaccuggagggcaucauccugagugagguaacccaaucacaaaggaacucacacaauauguacucacugauaaguggauauuagcccagaaacuuaggauacccaagauauaagauacaacuugcuaaacgcaugaaauucaagaagaaggaagaccaaaguguggacacuuuacccuuuccuagaaaugggaacaaaacacccauggaaggaguuacagagacaaaauuuggagcugugacaaaaagauggaccaucuagugauugccauaugcagggauccaucccauaaucagcuuccaaacgcugacaccauugcacacacuagcaaaauuuugcugaaaggacccagauauagcucucucuugugagacuaugccggggccuagcaaauacagaaguggaugaucacagucagcuauuggaugggucacacggcccccaaugcaggagcuagagauauuacccaaggagcuaaagggaacugcaacccuauagguggaacaacaauaugaacuaaccaguaccccggagcucuugucucuaccugcauaugcaucaaaagauggccuagucggacaucacugcaaagagaggcccauuggacuugcaaacuuuauaugccccaguacaggggaacgccagggccaaaaagggggaguggguggguaggggauugggggggguggauaugggggaccuuugggauaguauugaaaauguaaacgaggaaaauaccuaauuaaaaaaaauuuuuuuuuaauuaaaaaaaaagaaacuggcauuuuucugcauaugauaguguuuuugaaauuuaguaacuugauuucggauagcuuuguguuauuguuuucuguguauaugauuaauaucauuucaguuuacacauaauagaaguaaaagagaaaaauucagucaaaggagaauaauaagauagccauuaaaauuggauuuguagcuaggcauguuggcacaugccuuugaucccagcacuugggaauaggaugcagaugaccaagaguugggggcuaacuuugaugugugguuugauugaaugucuccuauauuucaauauuuugucugaguugguggcacugcugggggauagguuuaaaagguguggccuugcuggagaaaguaugucccuggggaugggcuuugagguuuacaagucaugugucauucccaguuugcucucugcuucaugcuuguaauaaaagaugcaaguuuucagcuucuuguucuagccacuauuuugcuccacaaucugauaggauagaauugcagcaagggguaagauggcagaccugugccaagcugugcccuugagaaaaacaucuacuguaagagguuuauugggggaagggagaacuaaaggcuguuccagaguggggacaugauggagagauagaggcagacgggaggggggggcaggacacauacacauacauacacaucgagaucugagguagcuggaggcccuuuuaugcacagcagacaccuggcguuaucuggugguggcagguggugacauuugcugcugcuaggucccugagagcaggccagugggaacaccuauuugcuaacagcaucauggccacuaucccucuauaacugcaagcccaaacaaacuucuuccuuuuguauuaucuugacucaugauauuuaaucacaguaauaauacaaaaguagcugauauacuuggcuaaugggauccuggcucagaaaacagcaaacuguauucgauacuuaaagauuuuauuuuaaguguauuuuauggcuugguguucuuguaguuuccuuccuguugcugugauaaaacauuuugaccaaaagcaacuugaugagaagagauuuuauuugcuuaaggugagagagagaaggaggggagggagaggaugaauaucucauuucaucaaaacagagacagcagaguggaguaagccuauaaaagcucaaagccugucccccaugcgaugcaccuucugcaggaaggcuuaccuccagaagguuccauaacuucccuaaaacagcaucaccaacuuaggaccaaguguucaaauacaugagccuuuggaagauauuucucauucagauauacacacucggcuugauuuguaaauaucauuuuaauuuuugcauuuguaaaggcaacaagagauuuaguuauuucuaagcauaauuuaaauacugaaaacuguuuaauacuugagaaaccucaagauuaacaucaauguucaauguacuucuguuuuucuuuagauccauacauauaugugcauaaaaauauugagcaauuagauuuuauaguaugguuuaaaauuucagaguauuacaggugaguucauugguucuuauuaagcaagaauauguuuuuguuuagugugaaaaacacuguuucugcccauucuuccuuucagauugcaaaauuacgccagcaacugcagagaagcaaacacagcagucgucaccaccgagauaaagaaaggcagucuccauuccauggcaaccaugcagcuauuaaccagagccagguaaggaaagagauugcuucucuucuagguuguuuguaaucauuuagguuagaauauccaaaaccauguaugaaacagugguuuaacucauaaaucacagccuuuuucccucccuuaaaucuacaaaauaguuucaucugggagguguauccuguuaacaguuuaaaaguaguuucauuuauuugcuuugggaaucuuuuuuccagauagggucucuuuccagagccuaggcugucuugggauucacuauguagagcacgaugaacucacagacacccacuuucuguguuuauuccccaucguguuuuuacuccaggucacuucagaguuaagaucaaauuuuaucaaauuacaugguacauuguaggaguugauaagguuuugaagugauuuuugaauaccaguuuauuaaugugagaauuuuuagcuagguauacugacagaaggcuguuaucuguauuaggaggcugagacaggagaguuauuuguagcaagagcuuucucaaaccuaagugggccaggcauugugaugcuuacuuuuagcccuagcucucuggaggcaaagaaaagauaaauacaaucaacaguuugcuuucaacacagaauccaccuaccugugucuccugaguucugggauuaaaggagugugucacuacaccuaguuuauacucagcaauuuuuaaauugaaaaguuauucacaauauuguuccuuaaaaauugaauuuuccuuuuuuuuuuuuuuuuuuuuuuuuuuuugagacaagguuucucuugaguagccuuggaacucacucuguuaccaggcuggccuugaacuuauagagaucaaccugccugugccucccaaaugcugggacuacaggugugugccaccaccacccagcugcaauugaauuuucuuaauaaaaauuacuaagcuuaagucuugugaguugucuaggaggguagcaugccucccaagccugagcucagguucagaacucacaugguagaagagaaccaguucuccuaaguuguucucugaucuucacacguguguguauacacacacacacacacacacacacacacacacacacacacacgaauacacauguuuaaaaaaaaaaaaaaaggaggagguuggcugugccuuuauucccagcacucaggaggcggaggcaagaagaucucugauuuggagaaucacuccuacccucauucccaccccacucccuccaaaaaagaaaauuuaucuaucuugaaucuuuauauuugauaacuaaccccaaaucagacacguaugcaucuugacuguuacaucagucauauugauguuuauuugagacucucagagcauauuaaguuauugauaugauguugcuuagguagguccucucuugaguggaaaaaaaagcacauuaucaagacuaaacaucgaauaguuuauuaauacuuaccaucugaugguauuguaggaaaaguagcaauaaagaaauaaucucauguccccaucaaaucuuauuuuugagggauguaaguaacuaguuaauucuaauaauguacaguaaauauguugauagaaagaguucacagugcagggauacuucucuuugaacugaggacgagccauccagaaaggguucucagagaaaauguuaucugguugaucccugaaauauaguuggaguuagcccaacaacagauaaagucauggcuccaguaggguggcaguacaagauuaggagauaaauagcagacagaccuugaagucuucacagacuuguuguaauacacugugucuucaucuuaguuguacaaaagaacauuaauuuuuuaauguuggaaaugagacucaugaucccaaaugcauuuuauaguguucacuguaggcuuagaaugaauuuaguagaggacaaauaauacaauccaggaaucauuuacagaguuagaauugugaguaaggagucagaguugaccuggaauacuguagagaccuaacacuggugagaagguaguacuaguuggagucuuuugaacugccuaggauaaguaaccgacugacauuuaggaaguggaacugcugaacugcuuacuaaaugacacgcauuccccucgggauuuguguuauuauuggcaauuaaucuucauauuguaauuuaauauuauuaacucccacuuaauaggaaguugagacccugagaggucaguuaucuuaaaggucauaugagacaggcuuggcgucucaccuagacauucugacaugagucucuguguuuucacacuuugcuaacugaugauggcugccaaaauacaguaaugauggagagaugaauaaagacuggggccauuuuagucuuugaaguacaauuuuaaaaauuuaucugaaaguacauacuaaaguagaaacaggguccuaaauaaggucaacauuuuagauuugugcugugccuccucuucaucagagaagccucugacugcagugugcagcagcuaaugcagaccagaaccgccagugcacugagauuagcagagcucagccuucaacaagacagcuuugagccucuaaggcucaaggaacauucuggaagagggacuggagagaguagaagaaucaggguaaugucuacuugaagauaaccuccaggcaugauagauucugggcuucugaacucacugcacuggcuaucugcaugaagcccacaugaggcuggacucaucaacauuucauuaugcagugguggaggagccuaugaagcaaagcccgcaccucacugagggacuauuggcaacugaugguuguuggaggaagagguagcauuucuugaguggugcagccaccugauaaguugcuuuugcuuaaguguauaaccugucacuuaugcuaaagcaaaaaaacaaauuacuguaggucacauagaaaagaagacgugggcuuagggaggggacguguuggguagaaguguuuuagcagggaaagggguagauaagagaggagaaaauaggguguugauggggggugaaacugcuaaaauuauauaaauguaugaaauugucaaaaauaaaaaaauacuuugggggaggucggaugcaaaucaaaaugaauagaagaccuacaaaagcuacaacugaaauugauuagaagaaacaggccucagugugaugcucgauuaagcugggggcuuccaggauaggaucacacacacacacacacacacacacacacgaaaaaguauauaaauugacauuugagguuguuuuauuaucucuuagcaaugaaaggacaguuguuaauuauagucucuaguuaacagauuuuuuuuuuuuuuuauauuaaguucugaaugguuuuccucacaagcucauuuuuuguuguucugucucugggaguugaaggagcacuguugguggggagaaugacucuugcuaaguuucuuagaugugaaguuuucacguccuugguuuucagaagugauaagguccucaggugcuuuaggauaauauuccuucagagucuggguaggaagugcagcagccaauuucauaauugucugagugcugcacagaugucagagaguagaacgccagcuuuucacaaccacaagaacugauuuccaaggugagaguuaaaagccauacaguuguucucuggcugccauuacagccuuaagcaaaaacguucuucccaaggauccccuuauuucuuugggcuaaugacacaguaguuugaggauggagagacagugagauuagaaaaaaacaaacauuucuucugagaaaugaggauugcuggcugcacuggagucugugugccaguccaucagggcugcugugcaauuuuuuaggguuagaaaugaaacuauguacugcugugauacaugugaccaaggauagcgguaauguaggcacgcugaagagaagaugagccagaugagaaagaacauaguuuaucacccauugaaagucaauaauggugacggaccaugaagccucaagguggcauggagauccccaagugaacccucacugugugccuucugucauggcuguugcaaggagcaguuuucaccugccuuugguuuuauuuuuuugaacagacuuuuucaacauccuuauugucuaucaaagcaagucuuuauuuccccuuuguuuuguuuuguuuugguuuguuuuuguuuuugagacaauguuucauucuauaguaugggcuggccuagaaauuacugugcaugaccucaaauauaggcacauuccuccuugcucggccucuugagugguagaauuaguggucuuagccaccacucucagcucaaggcagaguuuuuuccuuuuuguauuugaugcuuggcaucuuagauccuugcugaggaaccugccucuuccaagauuagccaguucucucaaucacaucaaaaugaaccaauaugaaacacauaccucaaccagcucuucuuaaacuuuuucacaugauauguuuugaucauauucuuuccccuccccccagugccuuccaguccacccaauuucauguucucuuucucucucaaacaaauaagcaaccccccccccaaaaaaaaaaaaaacaaacccacaagaggccuuuuuguguugggcaacuacuccugagcaugggaccuguccuagauuauguuugaaauaccuaguaucacuccauuccagguagguuuuuacccuucagaaauuucacuuucuuagcucuacuugucuaacuucugguagacaaccuuaccaugcuucagacucaucugucugaucccauucucauccccaugcugugaagcagacauucauguuagguguugauguagauacuguaaaaguaacuuuauuuuucuauacuaauagucaucuccaaggcuugcugccucagucugcuaaacuuggccuaauucuggaagcuuccuacaauguaaucuaggccuagaauguuuucagccucugagacuuauucugaauaagcucaccccuuccgaauuuucucugcgcucuggcuggcugauuuaacucaguuguucugacucaaaacuccuccccaagcugccugauucaaucugguuucucucagcuucuccugaauugcucugcuuggccucauacuaacucuggaaaucuguucuaaucuggcuccuucucuggcucauucugccuucaccugugucuaguuuguucucucuguacgauuguucugguaaaacugccucugucucccuccuugugcugcucuacucucccucucaacucuacugcacugcucuccgagaacucuauguuccuguacuguacccucuuccuccugugcugucugccucucccuuaaguagcuucccuuucaucucucuucucaugagaguuggacauaucccauucugucaaaucuuucucugauucaucacuuuaugccacucaauuagucaucacuuucaaacaugggugcuuccuucuacaaacuaaccuuaccuucauuguugggauuaaagauguguacuaaaggcaugcuuguauuccagccugaaggaugaaagguauguauuaaagucugccacagccacacccuaacuagaaacagguucaaaguuacuauuggccauguuuucugauauucugauucuuuccgaaccauuccaccaacagagguccaagcauuuaaauauauguacguugggggguuguguucauucaacccaccacauuccaaaugucacguggguauauagagaaugacauggugcugucugauuaaaagcuuuaagugggccagaauuuacugaaguguuuacucugaggagagagauugggaaaacaguaagcauuuuauauuuuuuccaaaguacagaucugaugagagaaauauuuuaaacuuucuuagaugugaggaauucucagcuaaucugauaaccuacuuacauuuguguauaccgauuuauauuuagaauucacauuauuggagaaaccacuuuugauccaggaaaacaaauucucguuauuuaauucccuaaaagggguguaguaggaggggggugccagaauuuaaaaagaaagaaaaaaauuccuuaaaguaaaauaccuugaaauaaaagauuauuuuuauucucuucagauguuuguuagaauguaguuuauaugaggagugaaauaaaggacuaauuccucauguuaucuucaguaguuauguggggaauugcaggcuggucuccaguugagcugaggucugaaccccgagaauggugauaauucaccuucaugauaugguaggugaucccuuaugcuccuggaacucuggccccuccccccacaagagaagcauggucaguagucacuuaggcaauggcccaagcuuuugaccuucaggcuaaacuccccaguuaccuagcaaaagugaagaccauaaaaagggcuguucggccccaccuugcucucuuacucucuuacuugucucucuuguuucuuaccccucagucucccuaccccuuuacccccugccuuucuauaauaaagcucuuaaaccauagagagucucugcccaucaaggcugugcgcacucucgcaggucuugggaaccucuucccucaucccucucuucuauaacccugcuggcuuuagcaaaguagcuccgggguucccagguaggguuaccccuggccacccccugaagagugggauagaggaaugcccacccagggaugaguggagguaguuagcagcccucucacaccugacagaccagagaauagggaaaacucugacggggcgugggccuuuucccuucccccucuuccccagggccccuuuuuuaguucccacauaguuacauuagguuuaacuaagaaguccuucucagguugcugggugaguucauuuguuuuaaccuccuggugacagcuaguuaaguuauaguuaaguuaaagugcugguuaaaaccgcuuacccagaggagaggugcacgggccuuaugagaaugacuugcucucacuccuuucuucucuguuuuuuuuuuuuuuccccuuuguuugagacauuagauuuuugauaaauaguugcuucuaaggagauauuaagaaaaucuuuuugucuuagucaggguuucuauuccugcacaaacaucaugaccaagaucaaguuggggaggaaaggguuuauucagcuuacaccuccaaacugcuguucaucaccaaggaagucaggacuggaacucaagcaggucagaaagcaggagcugaugcagaggccauggagggauguuacuuacuggcuugcuucccuggcuugcucagccugcucucuuauagaaccaagacuaccagcuuagagaugguaccacccacaaggggcccuucccccuugauuacuaauugagaaaaugccuuacaguuggaucucauggaggcauuuccccaacugaagcuccuuucucugugauaacucgagcugugucaaguugacacaaaacuagccaguacacuuuuuaacaucuuucccugcuuugcugauaggaaaucucagcaaauccaaauuggggaggcagcugcuccccugccagggcccugugugccuuucuuaccauggcagcugaggacgacucucugcuuucuuuacagacaagcuuacuaauguguucucaugcuguggcacauuaccucccccuuacaggcucuuuuucccugcgucuguaauuuagcaguuguaaagcaaaggaguacuuggaagccugaaaacccagcacaaggccuuguuuuuguuguaugacaauuugaagaaauuagcaggaggaggacacaauugguuuagaacuguuaaucuaaacaaacuaguaaguuuacuauguguccugaguguuugagauugcuguuagccuucuguguuacguuucucugucaccucguuacacaugagaugaucggucauaggaaagcugacugcaucucaagaugucugugugcuucacugcaggccagugagucauugguuuccuuucucucuaucauuucaguuguuuccucuccagucuuuguuuuaccguccaugaguccucagaagcaaagcagcauuagcuuuguccuuccccuaccuuguuccuaaagugccuauaguuuuuacagcuuuauuuggggcuggaaagauggcucagugguuaagaguacuugcuguccuuccagaggauccgaagucaguuccuuaacauccauaucaggugacucauaacucccuguaacuccagcuccaaaggauaugacaccucucugaacucuggugucugcacucacaguggaccauacacauaauuuuacaaauuauaaaacuaaauuaaaaaaaaaaaccgaacaacuuuugcuugaucuuauguuggaacuuuacaucuguugggaagaaaguaggguaguaaaguagauaaaaacucucuaggaguuaguggaaguccuuaggaauccuaagauaaacaguagguagccagcuccagugacuagcuuucauccugccucauugcaguuacaaauaggacccgaguucagugacaaggcuagagacauggcucagugguuaagagcaucugcaggcacacacucacauaaacagacaugcacaaauaaauaaauaucucucugaagaauaaggaaaugagggccggggagggagguugagguugagguaggagaguagagaaggcaagcaaugaagagaggaaugaauagaaagguagcauaggcucuguucuugucaaugagaggaugucaccuacaagucuuccaucuauggaugaaagguauggugacauaggcuucuagucuuagcacucaagaugcuuaacaaggagugucaugaacuuuacuccugcuugaguuaacccuguccgguuggugcuccuucccccuuucccccccaaaaaagacauaacccaauaccagaaacaacaaaaacccacuugucggacauaacuguuagauauuugggggcuggagacaugucucagugguuaacagcacugccugaucuuccagaggaacuagguucagcucccagaacccaaauggcaguuuucagcuguugacuccaauuccugaugcccucuucuggccuguguggacucugcauguacgugcaccacauacaugcagacaaaauacacaaacgcauaaaaaaaaaagaaauaacacauuuuaaaaaauuaaaauuaaaaacaaauaauauuggagaagcuuggggguaugugaaaagaugugugaacaaagggguuaaaauuagagucucuccagccccgucuuuccuuucugcucuuccagagguccugaguucaauucccagcaacuacaugguggcucacaaccaucuguaaugggauccgaugcccuuuucugguguuucugaagacauugacaguguacucagauaaaauaaauaaaucuuuaaaaaagagagaaucauaaggacauacuuuuaaaaagaauuaggaaagacuaguuaagaaacaguguguccauuaugggcagaauaggggccaggggugauuaccuccuuucaaaaccaugaaugagaauacugagcuguuccuuacaugugaaggaagcuaccugcccaggagguaggaugcugagcccugccuugggagugagagcuguacacuaacaacagccaggagcugcuugaaagucaauucccuuuggcuucuuucucacagauuuccuguuucuucccaaggauacuuguacuguguuugcuguguuuuuguuuugcuuguuuguuuauguuaaagaugagcagaaguaaaagaagaaauaaagcuucauucuaaguuugagucagacgguaaaauuacccauugaguuuuaaagcuggagcucagugccugcagauacgugagcuuuuguuucucugccaccucuuccaggugaaugaaugagguagccauagaucucagaccauugcuauuagcagauacccucauaagaccuguuuuguauuuuauuuugagcaucuuguuaggaggacaguuaauauuauauaauuauuuaaucugucacuuuaaaaaaguaauacugugacaaugaaaacacuuuggguaagagaaaaucaaagauggauuuccaaaaagaaaaaaaccaaacaaacacauuuuauauuuuuguuuucagaggugaacauauuaaguauguauguagugguauucauacaaugacuauuacaggaaaguuaucugcaguuaugcgguggguucuaccuuaugaauccugucugucuguugaacuccauugucaggcuuggugacaggcaccuugcucagccaccucacuggccuugugaaagcauaucugagguugcuguucuuggguucucuuagugaccucuaguuugugacagcuguugguacauuucugagucagucuugacugucgggcuuugagcucuaaacuacauuucauauaaccuaagaugcagauucgguugcucucaaguuguugaaguccuuuggauuuguuuuugggcuaugccaccuugaaaacuccucucccucuucaccucuuaaggcuccugcuccaaagagcacgcucguucccgcuggccccaucaccaagucgucugguucucgguuccggaacaguguggaagggcugaaucaggagauugagaucauaauuaaagagacgggggagaaggaagaacagcugauuguaaguagccuccacccucagugcaggcuugcugugaacuccagagcucugaggagucacauucgguuggcuguauuuacauuucuuacugagagaaugaaaauuugacuuuuuuaaauaaaugaaaauaaaagccuuugaccgugaaagggauugaagaauuuuaacuucuguucauuucacagaaugaaugggcccaaccuuaguucagguccucuagcagaaacugguuuucauuuguagcaaauaccucauuuugcuuuaacucccuacaacaaguuggaguuaguuccguggaggguggggcaguuagaacagcaaauuguuucuaaggggugucugccccccacuuuuguaggcugcuugguuugacuugacucgcaucugcaugaaaaaugaguuuuguggcccagaguacuuuuacucagcaguuguucuugagugcugugggggguuaguuuggagaaagccccuacaggugugugggauuuucucccuggaggugaaggcagcugggugugguggcuggccuguacucccagucauuccacagcuccuccaguuugaggcuggcuuauauaacugaaauccuuucucaaacaaacaaaagacaaaacuugguuuagcuuuaaaaauauacaacucucccaucccuguucuccauucuauaaaauggaguaugcuuuuccugacuaauuaaagcuaagucagucaaaguuguagagggagcuggcuugucugcugugugagccacacaagcuuucauaaaugucuccuugauuucacccucuaauuagaucugcugugauuaaccuuucacucacaggaaggguucuuugaaaaaaacaacuuagaagaagaaugggcaagaaggcccaggaaugaagggccuccugugucacugguuagcaccuuugcucucuuagggaccuguggcucaccaagcuucuccuuuacugugacaauccuuuguauacuuuuagaaauaacaguacaugauauuuagggggcaguacauuuagucagcagauguugacccuccagugugccgugcccugagaagacaaauccuucccagaaagugcugcucacugagguuaggugugggugucaguaaugagcaacaggaaggcccagggauaguagaagauggaugcuugcuuguuuuugaaaugggguuuugcaauauagcccagcugcucuagaaaucagaauccuccuguuucggccucccaagugcuaggaguacagauuuguggcaccaugccaagcuuagaauuugauuugugagauucuggccacagagcaauguggacacuggauagauauacugcuaguaaauuucagaaucagugguauaaacaucuauuuuuaaaauuuuguaacagccacaagauauuccagauggucaucgugcgccuccgccccucgcacagagaagcagcagcacacgaagcauugacacacagaccccugggggugcagacaagggaagcaacaacagcagccgcucucagucuguguccccaacauccuuccucaccaucucuaaugaaggcagugaggagagccccuguucagcugaugaucugcuugcggaucccagagauaaagguacgguaggucggagcuucguccagagcuaauggcauaccuccuguuugaucuuuuguccugaucuuuucccugggaucccacauguuggaggaaugagggagggcaccgggucagaacaacuggagcacagugcagcuuugccaaggggcucugauggugcuugaguuaaguggguguguaggcuuuuguuuguauuuuuuauuuuccagcauuugugguggauauagcuaccuuaugagugacuaaugcagugguucucaacuuuccuaaugcucuaacccuauaaaacaguuccucaugcuguagucaggcccaaccaugaaauuaucuacuucacaacugagugcuaaccauaauguaaaguuuuuggagauacagguuugccaaaaaguucugaguuucacaggcugagaagcacuggacuaacugaauauuuuccugaaaaguacuuuguuuuaaaucauuuuccccauugggaauuuauugccuuaauaauucuuaaugaaaugugaagccuucaacuuaaugcuguugaggauacuucuaacaaggauuaacuugauuuaucucaaaucuaaaugaguguucaaagcaaagucaagauuggggguaguaaggcugaagguaguccagugguuaagagaacuuguuaaucuugcagaggaccaugauucaguucccaguaccaacccacauccaucuauaauucuagauguaggggacucuucugguuucuacagguucuucauauaugucagugcacauacaaaugggcacacacauacacgugauaaauuuucaaaacaaauuuuuaaagguuggaguuacauacaauaagaacuagccuaaauauuccaaauauuaaguauaaaaucuuaccuuugaaaagaaauaugauuauuuuuaugggccuauaucagaguaauacauucuguuagcuuaaucauaguuuuuauauguacuugaaaacaaugauguaacagcugucuguaaguuguccagcucaguucagaagaaguguauugagagccucuugcaugccauucugacuggcugccucucccagguaccucagcauuugaaucuggcaacagcagaacuuugacuuagggcuuaguuaauuauuaguuauuucccugaaauaacaauacauaaguauaugaaagagauguaccaaucaaaugugagcugaugguaaaucacagauugcuguguuuguguccuccacccaugcagaagagcaggcacaguagggugugucuauagccccugcacuggagggacuaaccugccucccaagcacgccaacauggcaagcuucagguccugaagugagagauccugucucaaaugaggcaggauaguucggcaaguaaaagcucuuaccacgcaagacuugacaaccgaaguucaaacucagagucacacugaaagagaaccaacuccacacagguguccucuguuuucaugugugugcuguggcacacacaccuacacacuaauaauaaguaaagcuauuuaaaaaaaauaaucccaaagccgggcaugguggcgcacgccuuuaaucccagcacuugggaggcagaggcagguggauuucugaguucgaggccagccuggucuacagagugaguuccaggauagccagggcuguacagagaaacccugucucaaaaaaaccaaaaaaaaaaaaaaaaaaaaaaaaaaaaaaaucccagcacugcaaaugcaggcugaucugugaauccaaggccagucaaggcugcagagcuagauccugucucaaaacacuuuucaaaggaagguggugcucaguaaugggagacauuugacacccucuggccuccaccuauguaugcuugggugugagcacacgcaccauauacacccaauuuaagauaaaaauaaaucuugaagccaagaagaugacugaauggguaaaacaccuaguauacaagcaugaggaccugagccucagucccagguauccauguugauguccguacauacccacagaugcacucagagaauucagucuugcugacucuucuacugaggauaauuuauagcauccccagagguuuugugaguugauuggcauucaggguguauaauugucagugcugaaaaugcugcuuugcauaaguguauaauaaacaacaguggaauauuguauagggccauuguugaaguucuguccuaaucucaaaccaaagucauguaaugauauuuuuaaacugaaacuuaauucaaaaauacaggcaucaauauuaaaaaucuaauacuuaaauaccacacaaagaauuuuaagaaaaugucuaaggcaucuuucuuuuucacauuuaaauugugugugugcgcguguuuuuaauauauaucauuucaugugcuuugguguuuugacugcauguaugucuguaugaggguaucauauauagugaaccguaguuacaaacaguugugagcugccauaugggugcugagaauuuuuuuaaggauuauuuauuuauuaauuuacaauguucucccugcguauaugccugcaggccagaagagggcaucagaucccauuacagaugguuaugagccaccauguguuugcugggaauugaacucaggacuucuggaaggauagccagggcucuuaaccucugagccaucucuccagucccccgggugcugggaauugaaccaagguccucuagaagagcagccagugagugcucuuaacugcugagcucucucccuagcaccgauuauguuuuuauaagauuagaaagcuguguguacaguaaaaacucuguaguucauaauuuacgaucuugaguccaagcuuaaggauuucaggaacccuguguucauguggugugauagugugcgguguagagcacaugcucugcucagagcccagcaugcagugaaagugcacugugcagcuauggugccagggcuuccuuggguguuugauuuuugcuuugucuucgguuguucuacauaagaaaucuuucauucuugccagcuuuuuuguaacccacaaucaauuaugggacaccauauggguccauaguugaggaaggugagcauuaaagcaggcugugaugguauauaccuauaaccccagcacuugauggaggagaaggaucacucaugaucaucuuuggccagucugggcuauguaaagcccugucucaagaaacaaaacaaaaaacagguuggguuuuaaacuacauuuguagacuguugguaauuggacuucuaaaaaaaaauuguuagauucuagguuggauugaaaauagcugucaaaaauugccccuuggcuuucucaucccaucagcucuaccuuuuuguaugaauuccauaauuuuuuuuccugguacuuuugauuuuuagaaaggaaugacugaugacuucugugaauuccuuuuauuaaaaaauagggucauagcaccacuuuuguuaagaaauuuauaguuuagagacagauugaaaauuuuagaacaguuacauaacauaccaagaaauuuaaauuacuguaguaugaacugaguaaaucaacacuggaccugacugucagaguaaugaaauggucccucccucugauagggugcauuuggaaaauguuuugaaacuuuugagguaaguuuauagagaguuuuggaaaaaugguagaauuuauuucuuguugguuauggaagcuuguggucagaaggaaguguugauauguauagcagcuuugaccuaaagcagagaccaagcagaggagcagcaagaagacacuggcagagauacagggcaggccaagggucaauagcaagcagccagugaagaacuguuucagauacaugugcuggggaaaauacaugcugagaguauuugcugaguauauagauacaagguagccagauuggugugugugcagucugaggagucagugcuccaggacucaguagauacuuguaaguagaaaagaaacaaaacugauaauuuauucuuacauuuacaugcaaguuuaauucuuuuuuuuuaagccagcaaugucuuaguuguugggguguuaaugaagaaagcacgcugccugucuuugaguacuucucugcagaaguucaagaauauugauuauaguguuuugaugcauuuuauaauaguguuuugaugucauuucuuacagagaauggaaacaauucuccuuugccaaaauaugcaaccucaccaaaaccuaauaacaguuacauguuuaaaagggaaccuccagagggcugugaaagggucaaagucuuugaggaaugcucguaaguaccccacauaaacacacuuuuuacauuagaauuuucaaauaacuugaaaggguagugcagugauuacuugcguaucucccacugaaauucacaauuauuaguuuuuccaguguuugcugaaaauagcccuggaauuccaacaaacuauguauuauuaucuuacuccagaaugauacuuaauguccacuaacauccaauuauucucauuucuucagcugucccaauuaaaaaaugugugugugugugugugugugugugugugagagagagagagagagagagagagagagagagagagagagagagagagcgcucgcauauguauugucggagaucaaaggauaauuuguaggaguggaaguucucucugaccauguggguccugagggcgagcucagguugcuagcuugguuaagccaucugccuagccuccuagagcauauucuauggcuguugucgcaucugaagucagccagguuuacaaaggagaugcagcaucuguuuacuuaaggugaaguacauauuuacccagagugguucuuuuuucagagaccugauaauccucagguuuuguucucuuuuuuuggucuccagugauuucauauuucaaaaauuccaguauacuuuaggcucagccauacuacuuugagaagauaauuuaagaagugguagauuuagucugugugguaccaagggaauugaccccaggacuuccuucacacaugcuacauaaacacucuaccuacgggcuguucuuccaauuccuagaagcagaauuuuucuuauuuuuauuaauuauuuuuuauguauaugaguguuauuucuucaccacuugggugucaggugcccauagaggccagagggaaaagaguggauccuguggggcuggaguuucagaaaguugugagccagcacauggguauugguagguaauaacagccauucuucauaauggcuuagccacucagcccccaaccagcagaauuuuaaacuagcaacucuuguuauuuuacuccuuauuuccaguuucuugugucugauuuaaagcucaaauuuugcuuagaaagaauguaggguuuucauuaacagugucuccuuguuuuguaagugauggcuucaggauuauaaguauauaugagggcgugcaaaguagugaugaacauuggaauaugaugauaguauuuagaccuuaaccuuagauagcaagucuaagaaccucccuuccacccccaaccccgacucuugauguuuuuguugcacuggggaucaagcccaggucuugaguaugucuggcaagccgucuaccacugagcuuugccucuggccccuuuuugcuucccauccccuacccuacacccccccccccccccgccaccaccucuuucuuugagaccuggucucacuguguagcuccugcuggcuuugaacucacagaaauccaucugccucugccucucccaaugcuggaguuaaagguguacaccaccacacaccaugcauuuguuguuguuguuuuucuuacugugaaaccugaaauauaguccaucuuccauuucauuuaguuugucuuuaucuuuucaugaacaucuuggagugagcugaaacaugcuuccuuugguuucuguccaacagacccuccuguugaugauuuaaguucugaguaacccugcugcacaaagcauguggucucugaauggguguagcuucuacacuagaaaacacaggcaguugguaccugucuauuucuauauaacaauuggaacccguuuuagcaauuuguuguagagguuuuuuuuuguuuguuuuguuuuuaccaugucaacuaugaauuuaacugauggcugcugaggaccagagcuuuuccagauuuguuauuggccucugcaucauagucaccugggaauuuaccaaaauuguagcuucuaccgaccccaggucuaaugaaucaguguauggagauaggaugaguuauaaaucuuuaccaaguuccuuagaugauuuuaugcucaacuugaaaaauacuggcuuagaccuugucuugguuacuguuacauugcuguaaagagacaccaugaccuaaagcauuaaaugaggggcuggcuuacaguuccagauguuuaguccauuaucauuguaguguagaguaugguggcccacacagaccuagaacaguagcugagagcuacauccugaucuacagaccaagagagagacagagagaaacacugaacuggguaugggguuuugaaauaucaaagcccccacccccagugucugucccaacaggccacaacuccuaauuccuuguaauccugucagaguuccagucuuugaugacuacauauucaaauauaugagccuggggaaccauucuuacucagaccaucacagaccuuuucuuuuaaaguggggucauuguaaaaacucaauugggcuaaauguggcaucuuuuuuuuuuuuuuuuuaaagauugaucucuguuugucugucugucugucuaucuaucuaucuaucuaucuaucuaguguaugugaauauacuaucgcugucuucagacacaccagaagagggcaucagaucccauuacagauuguuguaggccaccaugugguuucugggaauugaacucaguaccucuggaagagcaguuuuuugaccucugagccaucucuccagccccuaaaugcaccauuuuugaguugaccucuuauuuuauuuauugacaguuauguuuaagugcauacagaugguuguguuucucuuuaaagaggauuuuuaauauuugauauauggguuagugucugucauguccucuguuaaguuggagagaucacucaggacucugugucaguuaugcccaucacacuguauucuuggggguagggugaucaauaucggucaaagaaauaaggucaguucaaacaguuacgugguuuuuuuuuuuuuuuuuuuugcuugcuuggucauucuuauuguaaaaguaccaacaauuguucucucagugucuucugauaauucagagugauauaugagauucuugaaggauacucuggaaggaucuuuagcuucugaauuuucaugaguucuuuuuaaaaauuuuuuuauuuuacuuuugagauaauauaucauuuucccccuucccuucccuuccuccaaauacucccauauaucucuccuuuaauuuauauauuccugaauacaaccugcucagugaauguauaccugucuauauguaugcuuucaaggcugaccauuugaugucggauaaccagucugugagcucuucccuguagaagaugauuuuuccugcucugagcauccuuaguugccuagacgucuuauggucuccccgugcacuuaagcaugcuugcuggugucaucuuuguucagaucaugccuagacaguaauguauguacccagaagcaguacacaaggccauguaguaguaaccuccacacuaaucgauuauggcuacauuaauuuacuuccucaccauuccucuguagucaugcagggucuagucucuuggucagcauuguuuguuuucuugagaaugagcauucugacuagagucaaauagaaucucaguguauuuuugauuaccauuuccaugauggcuuuuacauuucugucauuuaaaaaaugcuccucagcacugccccuccccuuucaaguccccuucuucuucuucuucuuuuuuuuuuuacuuuuuguaguguggaaaugcaagcuucauucugggagccauauaucuuaagccauuuauuucuuuuaaaccagacacagcacaaauaucccuagccuugucaaauaauuuuaaauaaggugacaucaggcaaauaaauuaaugacaaaccuaguccuuugugauagggauauagcuuaguaggaugcuugccaagugugaaggaagcccuggguguaagucucaguaccccgcaagacaggcaugguaagccacgucuguaaucccaguacucagugggagcagaaagaucagaaguucaagguuaaaaaaaagucuuuauuuagauggagguauaaaaacuuaacaucucuaauaaaccugucuucagauuuaaacauuauuuuauuauagagagguuaacauugacuuucuuauaagugagagucuagaaaaaauugaguaugauucuuuucauaaaacacccagaaacauuugugagagauacugccaguacuugaccuguucuucccauugauuuaaauaaacgcuguuuuccucuguucuuugccuguacugcagucuuugggguguucagugccaguggagucugaacccagcaucguuaggaacacacacauuguuggagccccgucaccaagucuguuauuuacuucuuuaaagcuggcucacagguuugaggagaccuuccuuuuuucagauucuuggcucuaucacagguuagcucucccccauguugcaucuaaaccuuuacaaaccuuaauuuaccauguuugucagacucuccugcaggucaccugugcuagguacagucuuucagucaagauauggguucccuugucuaaguaacauuuuaaacccauaaaucauaucagauuauaaaggaaacugauuauauugaaauggguuugucuguagagccuccccucccaagaacucuuuagugucgugucugcucguagagagauugaacuuuguucuuagaaucuccugcagcuuggcacacugacaucuuuacugaacucaguugucuuugggagagaugugaaugaccaaugauugauucuauauacacagugugcaaacaugcaggugcaugggugagugugccacaguguguguggagaccagaggacagcuagggaaguuggcucuccucugucauuuggauucuaggaguugaacucaacuuccaagcuuggcaacaaucaccuauauccaucuugcagaggaaaacaauauuuuuaucaucugauaacaggguuuuuuuuuuuuuucaucgaaguugucuucucaccuugauuuuauuuuaauuuugugacauuacuauguuauuuguaauuuuuaaauuuucauggaauaccacuaagaacaaaaauguuuugggauaguuuuggaagguuuuggcaacagggaagaaguuugcuuuggaaaaaacuuugaagacuaaauuacaacuuggugguuaaaauuccuggguggguucuauaaggaacagaaucagcucaggaccccaagaccaaguucucagcaauuuuaguuugccccagagaagacagagaguagagaauaagagacagaagauagaggacgagggagagaggaagggaacaagagggagaaggggugguuguccuagaggaaaaggacugucucuggagagagaggggacagcaguuuacacaaguucaagggaaaccccaaaguaggaugagaaauuucuuuuuaauugagcauauuaauuaagugagccaaaggaggcuuuugcuugcugcaccuugauagucagcuucaggaggaggaaguggccaaauaagggaaagaccuggguggcuagcuuuaggaauauacucucaacgguggaaaaugggcuagaaaggcaaggccugccaaaccaugcucaauacacuggagcuggccaaagucugcucagguuccauucccuccaucacagaaaaacuaaagcaacccaacaagcuuuccauuauuuugcuuucacauuuaccuuucauuucucugaaaaucucuauaauugauguagaaauuuuuacuuauacuagauaaaacuggauguggaagugcauguuuuaguuuaagcugggugcuguagaggcagaggcaguggaucuccgugaguucaaagucagccugguguacauagcaagcucaggacagccacggcugaauaguaagaaccuuucuugaacaaaacaaaacauagcaaaaaaagaaaacaaaacccaaaacaaacaaguaaagaauacaugaaaagaaagccuuugcuuaucagggcauaguccuguaggguggaauuuagcaaaaacagaaccagacgauuuauauaguccauuguuuugucuucucccuucauaaaaaaucauguuggaaacauauuugucucuaugcauguggauuuucuuuugcuuuaggauauccauauuccuauuggcuaucuuagauccuauuaaaugaaguggugucagccugaccucugcuuagugacagggcccucgaagggagugccugacaacacugagucagauaucugguaauauuuagguccuuugagguuggcauuucugacagauucaguuguccuuauauaucuuuuauugacuuauuuucucuaaugauaaguuuauuuccaguauugagugacuuaacaagaguggguugucuguuuuguaugcaggccaaaacaacuucaugagauuccagccuuuuacuguccugacaaaaacaaggugaauuucauuccuaaaaguggcucugcuuucugccucgugaguauccucaaaccacuucucccuacaccagaucuuacucucaagggcucuggucacagccugaccgucaccacuggcaugaccaccacuuugcuccagcccaucucuauggccucccugucuacaaacacagagcaagagcggguaucucgaggaaccaguacaguccugccauccgccucccuccaugcaccaccagaacccauugaggaagcugaaggauagggcucagcucaagcaaugggugcugggagcuaagaacccugcagaucacgugacugugguaucaugugguauccuguccucccgguuggcugugaagugcuuuggcuuuccagugaggugugacagcaaggcuccuggaagaacuagugguccucugaguguucugcccugcgcaugaaggccacagacgugcuucaccugcuuggccuugaagcacuagcugaaaccugaaaggucucuucuuuacuuuuggaggaacaaaaaucacauuuucauuuguuucaaauuagacuuguuuaaaaacaaaauacaaaaccggaucccugcaaacaugauuucugaagggagaugugaucgaugcugcaagaaaaucaucuuuuauaugaaaacgacuauuuuauaauaccaaugucacauuuucugaaaguaacaaacaagauguuccaaugauccuuugguggccucuguuucuuguuuccuuuuucuagauauugcuuuucucggcuguuuucagcuuugggaccaaagggauuguugacauuuccccagcaaugucaaucucaugacuguucuucucccaaguaagaauugauagguaaugcauugaaccaaguauauauaaaaagauaaaaagcaauauuuguacauuaugugauuuauguuuuuuugaugucaacaguuugugauuugagugaaguauuuguaaacugcuguuuucugcacuauuccuguucacacuucaucguguggucagucagugugaagacagguugcuuuaacagucagugagccaaaagaaacucucaaguguggauuguuagcuaggaguauggagcucucuggucuucugugagcugugugucccgugauugcccuuccucgccgcugucagucugacuuugaucaucacuguaucauauagccccaagagacccugaaaaggcugugcauggauccccccucugcuuccguggugguguugucuuguggauuuggucaggguuaguaguuugccaggagugugauccuuugaguagcaaucgggagcugcagaaucuugagaacugacuuuuucuucauguguuggcgcugugauuugcuacuuacagauuuugcuaguuucuucuccaacauuccacacacugggggaaagagaagaggauuagagcuuagaaaacagguaccuuuggaacgucuauacaguuuuggauucgagcucaucugauaaccauugccaguaucacaugacaguauuuaauuucuaggugugugauaauaaaauuaaggagcugcucuuuagaaaugaauuccaucaguguugguaaacauuguuuuaauauauucuaacuuaugcugcuguguacaacagguagauggcaaacccugcaugagagggccacaauuuugaaggcgaauuccauccacugguccagucauuccaucaugagaaaccaagagguagcaguacaucuuggcaagcuguuugucaccuuagaaugccuagacaguuuaaaaugggcucugcuuaauuuuaaggaaggauauuuagguuaauuggauaaauucagacaucuaaguaaaauccaucaguuuuugguuggaaaaacugauacauuuugguacuuuuuuuuacccaaaucuuaacuuccugggaacuaguaaagcauagcuccuuagucaguaaaagccucggguuuuggaguguaggcuuuuugguuggugguuggguuuuguuucucaguuuaggguuuuuuuguaccuugauuuuucgccuugucaggccuuuugacuuuaccauuuuaccaauaucagaaguacagaagaaaggcagcuggcagucuguugaguugaucugaagggagaaggagacauuuaaaagcaaggguucuuguuuuguuuguuuuugagauggcuuuuauuauguagaccaggcuggccuggcacucagaugccccucccaagugcugggauuaagggcaugugccaccacaccaugcuugucuucuuuuuaauucuguggguuuuccccacuugaaugcuguuaauugauguucuuuuuccuuuaucuuauaccaucucaucucucgauuuacaaauagaguuuacucuguaauagauuuuucccuuuucuguuauacuuguuuggcagauugacaccucugccuuuacaucuauccuugaaguaacagagagggacagguuucaggucagcaucugcuccuagaaguagaacuuuaguuugagguuugguuggaagaagauugugaauuugcaaauaaaugaauuauaaggugaccaaacauuccugagaucuaaagaaaaacaaaaaaggucuauguccaaaaagaaaacugccugggccaaagggcuaauuuuuaagcauaugagcuuuauugcagucuuaacauauauuaaccguagauccaccuagcuguuuuauuuaacucuuaauucccaggggcuugguuuuaaaagugggucuacucuuaguagagugggcaugauuacauugacaagccacacuccauaauuagguuauucuguagaaacuguacagcgguagaguaguuucaaugcaaauacaguuuuuuuccagugcuggggaucaaacccagggccucaugcaugcugagcaagugcugugucgcuggcuuauuuccccagcuccuaauuuaaaacuuuaauuaaaaaaauuuuguuccauugcaguaaaaguggguggcauguauuuuuuggcuaagggugcuguucccugguuccuggcccaucuuaguuauacuugacccucaagcaguuuccucccugcagugauuauugcuucugacacgguaagucuguuacuuaucacugguuuaugggcaguuguguuuaaaaaacuaguaguuuugcuuucuuugguuaaauaugguaugaaugucaauuuuuuuuccuauaccagauccuucauuuuguuuacaguguuucuuacuuagaccuaggaccauaaccaaaucugccucucuauagauacuguugcuaauuggaguguaucuggcaacagagaaaggcugcuuuuuauuuuuauuuuuuaauguuuugauuaaagaaacaguuagcuuuuccuaggagaaggucuaaacacaguggccccauggagagcuuucucugucugggauugaacugagauccugagguuuucuuuuaggaaacuaaaguaaacuugccauuacuaaauuuguaaaguugagauucacuccuuaaugcugguguggggggugucaaacuggaccaauggaaaugcuggauuugcuaaauaaagccaagaugcauagcccugcacuuuaagguuucugguugcucugccuucauuagugacccugcagaguggcucugaacaguacuuuguuuauacaguccuguuggagauauauaauuuauguuuuuuaaacagugcaucuuugucucuguugauguaaauuuuuuaaugcaauuuuuuaaaguuacaacaaaauucucccccaaaaacagcauuuccagugaugauaaguauuguuguggacugugucccugaaccugagcacuuacugcuuugucacagggaauagaacuuccuauguucaaauaaagucuguuguucuugagu

SEQ ID NO: 178 - RNA, 4274 nt, Mus musculus
cuuuggggguaacacuuugcuuuauuuuguuucagaguucuguaucaguagaucaguuuuacagugcucaccucaucuaggaugcgauuuugcuauagcuuccauauugguuacuuuccaaguuguuuuaugaagugcaugaaagaaggaaagcaggauuuauauagcacacagccugagggcaugccguccauuguggcugaagggcggguugguggcagcagacauguggcugcagagcuugcacguuaucuaggcagaucaagaaguagacacaagccaaaaacaggcaggaauguaaacuuagggccuggcccccagugacccagcuuccuccaguuaggccuuucccacaaccucccagggcagcauaaggagccuguggggacauuuugcauuuugacaucuuugaauacgguguucuguccagauguuaugcagaguguaacuuugucacugugagugacaaaacacugagcagcacugugaagcuaugagagugccacauaaggucuuuguugcauacgcuuauuaacauugccuucauagcacagaaguugccaggcauaauauguaaaugucuguguuacaacaaaacuuuauuuaugggugauaaaauuugaauuuuauguaauuuuucuauauuuaagaauaaguugauucuuuuucuaaccacuuaaaaauauacaugcaaauuaguaggguaaggaccagauuuggcccauagccuguagcuucccuaaacuuagguauaaaauaugaaaaaaaaaaucucaaaaccuaauaguaauuuuuauaucuuuucaucauuuuauuuaaaaaacacaguacuuagauaccaaaaacaaacaagcaagcaaaaaaccaccaggcuugggaggcagaggacagccuggucuauggaguuaguucuaggauagccagggcuacagagaaacccugucuacggaaaaaaacaaaaacauaaacagaagucacaugaauggugcuaaaggguacugaguuuuauuuuggcuuggucuguuuuauuaacaacuaaaauguaaacaaugauuuaguuauuagcuagaauucugggauuuacacuacuguagguuucuuuagaaugaacaguuucuucuguguguacagugcaugcauuuguacauguuuaagagagcauguguacaugaauguggaggccagagguugacagugggugucuucaagaaaaaaaccuuucuggguaccaggaaaauaaccaauucuguacaaaauugcugggcucauccccuagagauuuuuacuuagggguccaggaauagauuuagggugggguccaggaauguucacugguagaaaagaaccccaagaaaccuggauucaaauuuuaauauaacagcaagcagcaagucacugucucuucuccaucaacccuacaccuaccaugcuccuguuuuacaaauuagaauaccuauuuaauugaugcuaaauaagugauaacauaaaugugaagaagggauauuaaugauuaaauuagggcuggauuucuguuaucccuuugauacucuugauugcuuuguauuuccauauaaaauagaucuucuuucauucuugucuuuucccucuuuuaauaguaaaugucuuccuucuguaacucuccucccauuaacaccugucucucaagugugcccuguucauucuuaggaaccgccuucuucuccuugcucuggcugguucucauggaaguacugagucccuucaguuugcuuauggggaguucuugcacuugugauucugacgaaacccuguuuugggucaaagcauggacaaggcaauuuuaggaaauaaaaagcagcugaguucuuggggccaacaagcacuaggggaaauuuaccagggaguagaaguuugaagcugaauauuggcauauacuugcucuguguucagagauggugccaagaguuaaacauuccuggcugaauccuaugcuuuuguguuuguuuguuuuuauuucaguuacccugaucuuaauucucccauugucaucuccuauuuuggguugauuuuguuuuuaaggucuccaaauuaguaguuacuguuguguuguuacaguaaaugccugcuuacacuagcuuacugcuuguuuuacuuugcuucuuagacuguuugguucaguuuccuccuuucugugguauuuuucuuaaaaaauaauugucagauauugucuuugguuguuaagucaucuuugucugauucucaguguuucacccuuuguagguguucauuuaccacaacagauguuuugagacaacuuuagggagucauuuucccuuuccaccauguggcuggguucuggggauugaguagguugccagacuugguagcaaaugacuuuuuacuugcugagcuaccaugcuggcccacgguaucuuaacugucaggcucauucugaagacuaucuuuuaucuguucuggaagacaaucaucacuuugaacaugguuuucuugccaaauuuacauugcauacauguugcaguaaauaucucauuaguuccuucuuccuuuucuuaaguuugguuuguauuuuauuuaauguuugugucaccuuuguuuguuuguuuguuuguuuguuuguuuguuuguuuugagacaggcuuucucaguauagcccuggcuguccucuguagaccaggcuggccucgaacucagaaauccaccugccucugccgccugaaugcugggauuaaaggugugaaccaccacgccuggcuuuugugucaccuuuuugaguaauuucucuuauuuaaaaaaauuuuaauuucucaguucacuaauucauucucauaaacuuucccccuuguuuguuuguuuucagaauggaccuuacuauauagucuuuucuggccuauaaguugauguguuguagacuaguuuggccuuaaacucacagauccucugccucagcccaccaggugauaggauuaaaagcgugugccaucacuuguagcccacaaauucuuuuaagcauuauuuaaugucuaauguauguacugggcuuuguuuuuauuucugugguuguaacagaucaaagccagggccucaugcaugcuaggucugugcuuuagcuacuauugagcugaauuuccaaucccagaggucccuuuaaaaacuuuacuuauuacuacuauacauacauuguaugauagcuauguauaggacacauaugucacagcuuguguauguggagagauccaaagaccacuuuguagagucaguucuauccuucaucuuuuugugaucugggaauuggacucaagucaucaggccuuaucaacaagugcuuuuagcuguuaaaacauuucacugggaacuggggaagcuaccagcaaaucacggaugccaggaaaacaagaugcucccaggacccaacagagaugagauuagcugaaaugcccaacaaaggagagggagaaccuacagagaccauauccagagguuaggcaagguugggggauggggccacccacucaucuccaaauuuuuaacccagaaugguuccugucugaaggaaauacaaggacaaaguguagagcagagacugaaggaaaggccauccagauacuuccccaccuggggaucuaucccauguauagacaccaaacccagacacuauuguggaugcuaagaagugcuugcugacaggagccuguuauagcugucuccugagaggcucugccugagccagacaaauacagagauagauacucagauguucgcagccaagcaaccauucgacugagcauggggucaccaauggaggagaaaaaacugaaggagcugaaggggcuugcaaccccauaagaagaauaacaauaucaaccaaccagacacccccccccccagaggucccagggacuaauacaccaacuaaagaguauauacauggagugacccauggguccagccaucuauguaguggaggauggccuaauugggcaucaaugggaggggaggcccuugguccuuugaaggcuugaugcuccaguguagggggaaugcuagggcggagagucgggauugggugggugggggagcacccucauagaagcagggggagggaggugaugggggggcggggggaaccaggaaagaagauaacauuugaaauguaaauacauaaaauauccaauuaaaaaaauaaagacagugcuaucaaauuagaguggauguaagcacaugaaaaaaaaaaaaaccauaccacuguuaggguguuguuugcccagacucuugcg

SEQ ID NO: 179 - RNA, 3330 nt, Mus musculus
uuuuuuuuuuuuuuuuuuuuugaggcaggguuucucuguccugaaacucacuuuguagacaaggcuggccuugaacucagaaaucugccugccucugccucccaagugcugggauuaaaaacgugcgccaccacugcccugcuuauuuuguauauuuuuaaguucuucuaaaaacuuaauucuaagguagaaacagacucuuuagucuaaguucacauauccccucaucauuuucccaucagugggugguuauaguggugccaaugucaaagguggcuccucuucagaaucugcaagggauauuuguuguucgccuucccacaucuagaauguuaauuuaauuuaugcuccuuguuauaguugaugaacauaauucacgguuuguaguuucacugcucccauuuuaauguuaaaauacuguauuuacuuuuuaaaaugacuucggucuuuaugaaauuugucuucuuaauucugauaaauccucucacucugccuauaauuuuggaaauugucagcaucguuagagcauuagggauuacuuuugcucaucaggaauuuacauuuuuguauucacagacaaaauagaauuaauaggaaacccuaagaaaacauacucauuuacaucugauguauucauaagucaauaaaagugagcucaucuauaaucacuacuuaauuacauauguaguaaauauuauauacuucaguuaaaguaauacacauuauccauucaauauguguuguguugaacagagaagucuuuauuuuauuuuuuguuuaauuguguuccccguuacgaugaccucugaaucuuagaaguucaagguaggaaagcaccagagguacugagugccccuaguagaguucuuugaaguagcccagucaccuuauaaaacuuaaaaguauuuuuaucccaguguuugccagucugaucuggguggccaguggcucuguaucacucauacuucucaugcuuuucuguauucaucuccaugggaacuaugaaauaacaauccuuacggaaggacuccaucugauccuugcccuuuuaauggcugauuucucuuuuucuacugacgucagucuucucccuucuguaaguaaaauuagguaugcauguuaaggaaguuuuguagucaguaaaugcaucuuauuuucauuagcuuauuucauaacucagggaacaacacacuugaaaggucaauaguuacaaaaccaacaugacuuuuuguaacucacuucuccaccuaacuauauuugauugcuuagguaacagcaacaaaaacccccagagucuuaauuucagauuguucuagauaggcaaauuauacagcucugugcacacuaaaagugaucuugcaguuacauugcuucguguggaugguuugugagugacugaauugcagacucacauuucaccagcugucauuagcuuccauuuaaagguuuucuauguaagauaaaacuacaguucaaccauccuaauuuauaccugugcguuuaagguucuugucgauuaaccucugcugugguauggccauccuuagcauuuaguccucauauccucuggucagauggcauaacuguaggugcagugacagccucucaauuagacacugggaaauuguacauauuuaaaagugacuuaccgaaaauuucuguuuuuuuggguauagguauauuuguuuuauagauuguucuggccguuuaaaguuauuuuaugauuuuaauaaaauguuauuuuaguuguucuucccuucucuuuaucacucuucaaacauuaugccugagagaccuuuuaaaaaauauuuuuaauuuaugugugugaaagugugugugugucuguuugucugucugucuguccuuauauaugucugccacuuuuguauguauucuuauagaggccaggagaugguuggugucuguuacagguaauugugagucaccuguugugggugcuggaaacugaacucugguccucaacaagaccacuacagucagucuuuuccuuuccccaucugcaaagcagaacuguacucuugaucaagaggaugugauaaacacaaaaguacagcaagcacacugggaggaagugcacucugaagagcaagcacacugggaggaauuggacucugaagagaaaguacagugagaggaagugcacugggaggaaguggacucugaagagcaagcacacugggaggaagugcacucugaagagaaaguacagugagaggaaguacacucugaagaggaagcacacugggaggaagugcaugcugaagagcaagcacacugggaggaagugcacucugaagagcaagcacacugggaggaagugcacucugaagaggaagaacacuauggcaggaagugcucuuauaagagcaagcacacccuugcuuuucuaagcaacuuguagcagaaagugcacauaguuuuuauucuaaggcaaguggugucucuaucuucucuccauugacuagggccacugacaaucuuuaacaauuggcagauuuucaaggaauuguacaaaggaagugauggaaugcagaaaaucgucauuuuccgucuuaaccacugagcuucgccagccucuguuccugcuuuccuguaaggaaauagaauaacucucuagcuuucaagucuuaagggugacugucuuauucaucguauucauuauaauuuuauguccccuaguuuuaugcuucuagguugauuuauucuccagaacaaauacuuuugaaaggaguauucuuuucucguaccuugugagaaacccuugcuauagauuagugcucuguggaauugugcauggacugcaguuuuguguuccauaacagaauaguggaacuuuguucacuaguuuagaauacuuugugacaauucagcacccauacuuuuacauuaggaguauaaauagcugccuucauaaguggcauaauauagggucauguaaaaauauaacagcauauugcaggccugcauuuuaauuguguuugaagaaugugcuaaaguuagagagcugagcaguccucuuguaaaauaugaaagugcacuggggccuccucugucuuagcugguauuacuuuguuuuuaaggauauauauuucauuugaaauuauaaaaguucuuuuuaucugcaaguuuuauuaaaacauuacuuuaaaauuauuaaaaucuuacuuaugauucuuagcuuauuugggcucuuuuaagauggaaagguaauuuaugaauguauggguuagguauaauguauuuagagcauaauaugugucuaaaagucaacaaauaauguuuuguuuucauaaacauaugcaucugagg

SEQ ID NO: 180 - RNA, 1945 nt, Mus musculus
cucacucuguagaccaggcuggccuggaacucagaaauccgccugcuucugccucccgagugcuggaauuaaaggugugugccaccaccgccuggcuaacauuuuuauuuuuaaaaauaagaaguucaaguggauauuaaaguuuaauauucaaagcaugaacaauauaauuugauauuuguccuuaaaacuuuacauggauugacuuuccuaaaaucuaauuucccauuauuauucacuuugcuuuggguacaugaccuguaccuaaagauaaagcucuguuauuuuaaaaguaggcagaacucuaaaauucauuaucuuuacaucuguaucauugucaacauaacguuuauuauaucuuauugaaagcaaaguucauauauaauuauauguaugauuauucguaggaacugcuuuucuucuuuucuuuuuucuuucuuucuuucuuuuuuuuuuaagaaaaaaacuaaagauaucuguugccaguauuuauagcagcgggcuacuaagccugaauauauuacauuaaguuuaauacaauucguagucacuucaaaacccagguucucuuagucuguguguacuuaagaggaaugaaaucaaauuaguauauaguuuaggacuguauagguaaugcucuuuuguuauccauguuauagaaacuguuuuucaagaacagauagguuuucaucuuccaauaaugauuacgguuuauugcuaaauaucuuacauuccuuuuuuauuuggacugcuaaggagaaaugcuuguuaagaaacaaacuagucaauuuccagugcggagagaaagagcagaggacccagcgguuacuguguaaucaggaacaaguacagugaggauguguuucugccaccucauuccgccagguggcaggcaccuauagucccagugcaucucugugagcuccaggggagcccggcccacacagugagaucaggacagccagagcuacauagugaggcccaggaagaaagaaaagagauaacauauuucugucacuucauucuguuugaaugggucuuauguuaauauuuuuuauuaugagaacagaaaguuacauacauucuucccacaaacaaaaagaaaacagaaaacugaauacuuauaucucuaauuguauauuuuugcuuucuuagguagaaacuggaacuauuaauauuuuugaguauuuaaauaaguaguuuuuaaaaaaugguaucuaaaugaguuuaaaaauguauuugucuucuaaacucauguauagucacaacaugucaguguuggcuaaaggugcuuaguaccaguuuuugaaaacuauguuuacauauuuaaauauuuaauucuuuacaaauguacaagaucuuaaacaaaaguguauaaaaauuucaguaucuguauuuggcguucucuuaacaacuccacagcaaaauuuggcaauacucuuuuguucauguauuacaagauguaguaucuguaguggaaagcuggacauuuaaaauaagcaguuagaaaaucauaaucauagccuggcuuguuucucugcaguuuucauggucuaggccuccagguaaacuuaguauauacccaggaaauuacagauaaacaaccacaggagacuugacccucgguaguaauuuucuguguaagcagccaauguacuuagagagcuuuaacaucuuaugcagagugaauguuuccuaacugauaggaaacauaagcuuggagauccgguccugcauugaaguuuuuaauuuuaagccccagcuugugcuuuaucuugcuuauauccugucaagcuauauacuuaaucauguggguuugagauaguguuugcuuuauacuagauuuguaaaaagauuuuaaaauauguauguauauauuguaacuugauguacaguguucuuauuauaauguaauuuuuauuaaaaaauucuguuuuuuucuuau

SEQ ID NO: 181 - RNA, 997 nt, Mus musculus
uaaauaaaguuacuuggacacucacacucccaagaggucuuuacaugcacccagacugaucccuucuagauggugucuggcguucaaagacaagcucaaagcuuaaaaguggugccuugguucugucucagaggucagcaaacugcggccuacaggccaagucuagccacugucugacacugcacaggccaugagcugaagaauggauuguauguguacauacggcuagggugauggugcagcaaucagaggaaucacaauaucuggcaagaaaauuaaaggagaaucaaauaccaauauccauaaguaaaagcuugcugaaauacagcuaaucucaguuguuugucuacagugacagacugcaguagcuacaagaaacuauacagucaccagaguaacaguagauacacaaugucuaaguucuacagucaggacuaaguaggugccuuaaggugaauagaaggaggugaaggguuguaaaauacacucugauugguccacgcagagauaaggacaacagcguugcucuaucguuucuccuguacccaguccgcuuuucagagcugggaagacggucaucaaaauguuguuggaugaaugaagaagaagacaggacagagaggcacaaagcaaaugaaacaugaguugcacccuguuuggaaugaaaaagcauccccaugacaaccuccagcuagucuugcuucauaucaucuauaucacugguucccagacguuagcaaaaacccucacuuuggaugccaacguaucgaaugcucagugugugcauaagaaauugaaaaaaaaagucuguaugaaucuggcuaacuuugcugaugcuaauucaaacccaccuuucugacccucuuccucagucaccaaauguacaucaauuuagucuagacacuaaacucagaugaggaaguuaucaagggaaaggaaaucaaauguaaacuucauaaauaaaccuuuuguucaucucucucucuucuucccuccc

SEQ ID NO: 182 - RNA, 1072 nt, Mus musculus
caugugugaccagaaggcagugaucaaaaaugcaguuuggagcugagacgaaaggaugggccaucuagagacugccacacccggggauccaucccauaaucagccuccaaacucagacaccaucgcauaugccagcaagauuuugcugaaaggacccugauauagcugucucuugugaggcuaugccggugccuggcaaacacagaaguggaugcucauagucagcuauuggauggaacacagggccuccaguggaggagcuagagaaaguacccaaggagcuaaaggggucugcaacccuauagguggaccaacaauaugaacuaaccaguacccccagagcucgugucucuagcugucuguagcagaagauggccuagucugccaucauuggaaagagaggucuugcgaacuuuauaugccucaguacagggaaacaccaggccaagaaguuggaguggguggguaggggaggggggguguauaagggacuuuuggaauagcauuugaaauguaaaugaagaaaauaccuaauaaaaauauuuuaaaaaugcagacacgucagaagaaaugcaacaggacucaguagagugcgcuacucaggcguuggagaaguacaacauagagaagaauauugugacccaaaucaagaaggaguuugacaagaaguacagcccuacuuggcacugagccaaaacuucaauagauacgugacacaugaaaccaaacacuucaucuacuucuaccugggucagguggccauucuuccguucaaaucugguuaaaagucuggacugugccaaacacccaaugauccauccagaaacaaggacugcauccuaaguuccaaaugccagagacugaaucuucagccuugcuaagggaacaccucguuucaaucuguuguguuguguacagggccucauucucuguacaagccugugguuauaaaauuaguuaaacagcuuacauuuguauuuauuuucuaguccauacuucuguacccccauuuuuuucucccuuagaucauucuuuuaaaaauaaaucuguuggagaugaaaaaaaaaaaaac

SEQ ID NO: 183 - RNA, 3575 nt, Mus musculus
ugauugucccaugguccuugcuuucccccuccuggucccuggcaugcuugcuuggagauagcuccuuucagaguccuccucaaaugccuauaauuauuuuagacuuccacuaaagggcuaaaggauaccuaugagugggguggguaaacaaaacagagccugcuggucaggacacaccgagagcaauguccuagggaugucaguuccagaccaagugccaaacaguacccaucugccccuggaacagcaaguagaugaaagugugugugugugugugugugugugugugugugugugugugugugugcacgcaugagugcacucgugcgcacgcacaagcaugugauuaccagcauggagaagagaagauaaaaucgccuucuggauguuuaaugcgggaggagucaggcagggaaguaaagggagaugaugguaagauuaaaucagucugcaucugcucuaucucauuaccaaaugucagggcacagcuaaggucuccaccugauuuaaaggaaaagcauucugacguaagaagcugaaaagccacccuugcuuccuuugaacuuucuuauacagcacagcaucugaagcuuccugugugaccaagacaagaacacgugcacaagacugagaaacagcaagaaacggcccggcauucuggcuuucucagcgacugauacauacuuuaaaccuuucacguuccuucuucaccccuccaaaaaagucuuuaguucaauauagacauauuuuggcugagaguagaauaccauugaccaauagguuuuacugaauuguaguguucuagaagccauagaguagccauuuggcccaauucuuuuuuccuuuuuuaauuugaaauacuuuuguggccagcaaugaugcaauugcugguuuucgacguaaauagcgucauuugcuggacuuaggagagaucauuaucuaaaccacaauuacuguggcccucugaauuauagacugucaaguugcuuucuguccucuuccaucucucuucagccagcaaccuuacaucauacguaauuuguuccauggaguggagggucccaggcucugaucaacaaggucuuguggcugcccugaagguucccuggccaccaugcuggaaauggccuuuccuuugagacaaauguuacaaugagggaaaaaugcagugcaggaggccagagcauuaaaucaacucauaaaccaggaagguacuaugagccuagaagccacauaguaccacauaguaucaggaagccaaagcaggaaggcuucaaggugcgggcuagccuggacuaucgggugaguuugagaucauauaaugagacccugcauuuaaaaaagaaaauuacucuucaguguguucuauauuuuacucaaauuucugugaagcacugauuuuauccaaggcacaaguuuccccuugcaaggaggcugggccacuugcaggcuggcaagggguaggugacagugcugugcugcagagggguuggcccuugaggauggcugcuuggcucacguuuccagcuccagcauguucgcccuaggugcacagcaccccuacacaaaggcuacagaaaagcuucuccagaccuuggcuuuguguuguacacagucaacacaaucguugcuaauccugagaagcacacaaaaguccaaagguauuauuaaagagaacaaaaaaaaauagacaacagcuuucuguucuugcuuaaaguauagcacucacugcaucugauucugcccuaaagaacuaacauuauaucugugacagaggcuacagcaagccaagcaaugguuaagaaaagcuggggcaguaagcuuuaucaaugccuguguaacaucccuccaacugucuccccuccaaggcuacgagaccauuuuccagggcuccgggagagcauaugguuaucuggaaguccaggcuaugaucagcagguccccaggagaagggaauagcuaccaguauauuuacagccuugggaaaacucacuaggguaucucucuguagcugggagcucuauaacagagaaaggguuuuuaacaggagcuacaaacgugcugccgggccauccagccucgugggcccucuccucgccaccuccuccacccccuuuuuguauagcuagaaagguaugagagaggaaacucacugaaaacccuuuacucuaaagaauucagccuuccucacgagagagaacgcugccucacugguccaccacgcaccuggacugaggcaugaucccagugggcuuaacacuguuuccccacagggccaagucagcagacaaacaaaggaaccuuuccuucaaucauuauuucauagcaaacaaagcugagaggaaaaaaauaaacccgaaacucauuauucuucaacuuucagaacaucuauguggaacccacagggccacauggagcaaaaggcugaugaauucaauagcauuguagagaagcggagccuuggaggcuuuguggagccucauuucugcuaccaacagaauaaaauuaaaauaagacccacugccuugauuuuuuuuuuccuuuuaaagcuaaaccuaccuugugaaggaaauccuccugcaacuucaggaagaucagagagcugauuucucuguucccugguccacagagagaccaaaccuaaaaagagugauuacuuuuccccucacuggaaaucaccugcauuuguuuucguuuguuuucuguuuaguguuugagcaauguuauagaauuucaggcccguggaaggaauuggaaagugguugauacaggaaugugugucugagaauucccaucagcacugaacacugagauccacugugagcagcuuucaaacuggcguuaaauuggguagacgucccagugcuuccuggguccaugugaacagaaaguccaaguuuaaugcaauuaggcaggaggguguuccauucagaaaaguccauaauaguguuccucugcugccucaguucaugccaacuuaggguggaaacaaggcuacagugagacagaaaauucuucauaagauaucccuacagagucaccuuuccgauagaaaggaggaaaaauagagaucuaaaauaagccaggacucucacaugcaacuguggcuuccaggugcaacucuuucuuccuccuuuccuuaaauagccaugcagucgcccacagccuggcuuuuaaaaguugggguuggcuacuaagcucagauugagaagugaaccauucccacagacucuuugagcccaucucuugaucugcucuucagaaaguguuccguuccaucugcaaagcuauuuacuacuggaacauaaaacaaaaccuguuguuuauacccucgcuuucucucgucuuuccuguucuuuuaugauuaccaagucaucuguucauauguucuaaagauaaauuaugugaaaucauacuuuggcauauggggacggagagugaauucuuuacaaacuuuuuaaagauaaucccguuuauaucaccgaagacauuuuggauguuauuguauaugaguauauaaauuuuucauguuuuauuuugcauuaaaauaaagcuuuauucagucagugagauau

SEQ ID NO: 184 - RNA, 115410 nt, Mus musculus
cagaaggggcgggcccugagcgggcgcguaaucggaucgcucugccgcggcucugacauccacaugcugcucggccugaaaaggcgaggggggagccggaggggaggcagaggaggcgagcaaggcaccagccugcagcccgcccccggcacauccucugaagcacagacacucggccgggcgcugggcgagguggaggugagggcgggcgccagcgaacucggagagccgcucgcacacucgcgggcgaucccagccgccgcacccgcagcaacaccagcagcaccggccgcagcagcuuccugccucgcacuccccuccagagacuggccaagcggguguaaccgccgggggaggcuccagcuuaggggaacccagaaaggacaagagccggacgucugacugcuuaccacuccgccuguccagcggucggugccucugcccgcgugugugucccgggugccgggggaccugugucaguuagcgcuucugagaucacacagcugccuaggggccgugugaugcccagggcaauucuuggcuuugauuuuuauuauuauuacuauuauuuugcguucagcuuucgggaaacccucgugauguuguaggauaaaggaaaugacacuuugaggaacuggagagaacauacacgcguuuggguuugaagaggaaaccggucuccgcuuccuuagcuugcucccucuuugcugauuucaagagcuaucuccuagugagguggagauauuccagcaagaauaaaggugaagacagacugacugccaggacccaggaggaaaacguugaucguuagagaccuuugcagaagacaccaccaggaagaaaauuagagaggaaaaacacaaagacauaauuauaggagaucccacaaaccuagccccggagagagccucucugucaaaaauggauauguuuccucuuaccuggguuuucuuagcucuguacuuuucaggacacgaagugagaagccagcaagguaagcccuucaaaguuuuucuauucauuuuuacacgguuuccccuuuaaaggcgacagcuaauggagagaagccacugagaagcgcucaugaggaggcucccucaauacucaaucauuuaaagggagaucucagcggccuucuuuacaccaccagggcugcuaaacccaacuuuucucucuugcaaagggaguguguguguguguguguguguguguguguguguguguguguuuuguaacagaauuuggcgguguucagaugucacauauggacugaaucaaagguuuaaaaauacuacaaagccuuugcauuacaguuuuggggauuuuuuuuuccucccugucuugaagcagaacacaucucccuugaguuuccucaaccuagccagugaaauauaaaucauuugcauucccuccacuuagcuacauugagcaauguuagcugaagggcuugggaaaaaaaaaaaaaagcaagagucuagcuuugcuuuucagauguguggauucuuugcagacuggguggauacaucucagaaccagagggcugaagcuggugaagcaagccagcuugugaccgagaugggagcuuucccgugggcaguugaugguccccacucucucccgaauccguguguuuucugggaaagcgaaucauguucuuuaaauuuuuuucuuaaaagauaaaacaaacuguaugacccucggcagucucuccucuugugaagugguuagaaacuuuugaguggaauuuauucucaagcacugccaaaaaggguguguggacacgggcugcagagauaggcacagcagggccuaggagaggccgggggccagcucuuguggauugcgacaagggcuaccucucugaaaacaggucucuggucucugggaaugcgguucuuccacccugggacugcuucugggggugcuucccucugcucuaagacagugucuggaaccugaaaaaaaacuauuagccuauuagcguuugcuccuacaggugacuggggauaggguaccaucuaccaaggaaaugggggaagagagaaggagagaggaaagacagagacaaaaacucggagaagugcuauugccuugaggcacuuggcggagucaggcagccgcaguggugggucuccuuccucacagccacccuggcgcccccgcaccgugcuuagcggguggguccugaggcaaaagcuuagcugcuaccaagcuucuugucccuuccccaacacauaccuacagucacuuuaccugggauacauauggguuuuauguuuugcuaucuuuuggggguuuggcggauuggggaaagccguugagaugcaaauccaagccuuugcagcucccucucugcgguaacugguccuaugggcaacugcaaagcgugagccaaggaaggguugggugcagguccguccuggggaaauuuucugggccuagcauuccaucuugccuuaauucugaauccccagcuugaauagaaauuaaauugccucccacggaccugaaugcuguguaaauuauguaugugugugguuugcuguguauguguaugugugugugugcgcgcgcgcgcuccuugagaaugcccacgguauauuauguauucaagaacggacuccgguaggccccggugugcgagugcgcgcacacuggcaccacacacacacacacacacacacacacacacacacacacacacaacuucagguucccagugaugugcgaaguggaagggauuguaaagacuuggggaccaucuccuaucccagauguucgcacaucugucccugagcacugcguggagcauguguacguguguguacgacacccgcucggacccacuccugcucugccaccugccucccgcgcucucugcagaucccccucccaucucaaucuuuggucacgcugcgucacuuccagagaagcucaaaagcgcggggugcgaagcucaucgcccacuaaaagccucgcgggcagccucggucugggggugggacccgcccagaguagauauuaucccgcuccccgaaaaggugaucaaucaccggucaugguuucagucgaguaacugauugguaccgggagaccuagcccggguggcuaagggcgaggcuaagcuagaccucugacucacccuaugugcgcccgccaggagcugggcugacccuggcacuacggcggcggcaggaaccuauuccgagaaggaaagaagguggcgggcacacgugggagcaacugagcaaauacccggccgguccgcuguagcuggaaggcucugugggcaccaugcauccggcucccaggcgcauacccucccgcccgggucuggaggagucugggcagcugggcuggaccggcucggagcgcccccuccuagucuccgcgcagugcuaggcgcugcaagcucgccgcagccccuggagaacuagcuuguagaagcaaggggccugacgccggaagauucccguguuagccugggcgagaggcaggaagccagggugggauugcagcacccagggcggggagaggcgggaagcagccaggcagccuaagccgcaggaauucgcgcaacucucacagccugcgggagcacagugcagcuagcgcccgccuaagcgcacaaacaggugaagagcacgccgugcgggcauccacguggccgagacgugggcgccccccagcgcucucacccccaucccccagcgccgucccuaccgccgcaucgauuuguuugggcuacgcagcagaaacagagcugagcaauccauaaacauucuauuaggcaaaaauauucccagcaaaagcagaaccgaggcuaaagccucugcuaaguuggccgccuaggauuccuccaggccggucacccuccuccuccuccagacuaaggacaccccuggauagaagccugcggcauuucccugacgcuucccguugccagaaaguuagcucguggcugcggcuuguccuccagaucagccacugcagucgccugcaggcagauugugccucccgcccccuccccccuuccucgcugcccaugcccacguggggaaaaaaauuguucacgaccaaugcuucaguuucccugauugauuucuuuuuaauaucaacacaaguuaauggaggcgaggcaagcugugauuaaacggcugcccccaccccucgccucgggccgccugcgccccuagugugucccaccaguuccccaaguagcaucagcguggaggacacgaguggaccgauuguccuaagguggguguugcgugugugaggaagcguggaacggauugggcgacacucugagaaucuccugggguugggggcacuggaaucagcuuuccagaucuaaguagcagauacucccaucugugccgcagcuucugcggcucugguugaauuucugcuguaagggaagggacugaacgcuccaguuuauuggcguggacucccugcuuggcucucucuaccucccuucuuuucaguuucugacagagaggagagcccccuggcgcuagccguuccccuacagcgagccacagaacugcucugcuagaguggauccgcaaggguuugcuuucuacccuggaagucacucucuccuugcugcggguucuucagaagguggcaacucccaggcuuaaugucuccccccgccccaacccccaaccccucaguccccugagacccauggcucagagccagaaagaagccagacccuaaaccaccuaucuccgccuuccuucuuacuccaggagcgcuuugaucugugguggucuuaaaccccauugccauggacaugggcugacucaaccuucaauucaaccuucagucugagcuaggugaucagauaaaaggugcaaaugggcugugggagacaggaccccggguucaaacaaauccucuaacagaagcagugguaguccaagugcuugauacccccaaacgacccguggccauggauggguauaaucauuuacaaguaaaacaguaaacuccaggauucugaauagccuacuuagagcucuggggaccugucuccugcccucauuaaguaagugcccagucaccuuuuccccagaagcaagcacuggagguggugaggcuguuuuuuugccaacugaguacgaaguauaaaacaggggagagcgccccauagggcuucacggcaggucccuacuuguccaggauucaccagguagaauagcaaauguccagcagcaccuccagcgcgaguuuuuaacaucaucccguuggaguccucagagcacucaacuggcaaagugugagauugaaaagcugcagggacuggaggcugggcucuccagacaggacccccgcugucuaccaaauggcuccagcccccugcuguucaauggauagugggcauucuucuucagguucugucuucuagguauaagaauagugaggagcaggaccaccacuucuuaugcaauggggcauauaugcaagcaacaguuauugggcaggaggagaugggggcgggggcggggggcggacgcugaaguucccaggucuucuguaucucauucaacucuucauuagagcauucaaaagaaagaacugacuugagugaaccaaguguggggcauucugagcugacaaaauucaagagccaggcuccgcagauaguuuucagaaccuguuccccaaagauccaguuugcaaagaucuuaaggugagauuuuuccuuuguggaaaacacaaagcaugcuaaguaaaauggaggggggcauuguccccugauugugccuuuuccagccagcagaucagaccaaaccaaauuggaagcccuugugcuaaaugcuagccacguuuauccaacucaacgcugagcuaggccaauuuaaauauaacaaaacagcagagucacagcaaccaauaggaaggaggccaaaucaguuagauuugaagccccucucugccuuaaccaggugaggaaggcaacuugaaccugaccagcucuuguuucuucagcccucuaaucuagaacagcaccucccccgcccuccccgccacacacacacacacacacacacacacacacacacacacacacacuuagcuggguccuucuauagaacaacaaguugccagauugugaaucaaauagaaaagccaauuugacccaagaccaaauuuauuguuauuagucuuuugacaagcauaacacauuugaaauuccuugaacuaaggagauaggacuuuuaaaaagugaccucaggaggucaugguggcaugaacauaucugagguauuuuaucaucugacuaucccuugccaccuugaguggcagaugugucuuuugaggcccaggaguuagccauuguccuguucuuuccaagaacaaacucaucucuagcuuuugaagaggaugguuaauucauuucuggaagauacuacaggaguugugugccccacccccaccccccugcauuucccaaggcuuuaucugccuuguagagaaagggguccaauauuuaacugcuucauucccaagcaagguuuagugggguuggauuccaggacacacuggccuuguccuguggcuggcccaggagaaagcaucuaaagguuuaggaagcugucaaguuuagauaagacugagccccuauccuaugggaccuugguuguauuaauaaggagaaauuaauuuuuaaccacugggaauguugccaaauuaugugaccuuuggcagaccagcugugcuauaaaaauaaaucccccauuucugaaaaugcugcuucucuccaguagaacaauaacaacguggcaguugggacagagacgcacaagcaggcgggcuggagaagaaaggagaggaauggguguugacaaaaaaaaaaaaugugaugcugugaaacgugacugcagaccugagcauccugccucucuccugacaacccacccagggcuuccaggaugccugacagagcaagcacccucaugauggggacagggagccugugugcacgcaggcaauggagaagguguuaaguguuuccagccugcucacacccagcuuugaacacaucccccauuguucacacuggccagugacuggcaugggcagagaaaggggguauugaaaggggcaaaauauuuaucuuuuccuaaaugccaucaguaagugucccugaaggcugagagcacugguguaggacugcagagcaggaggcaggucagcugucuggguuugcaguccaacucagccaguugccagcucugccuucuaaguacucugugccacuggagugcuugauggcauugugccucaguuucccuaucuguuucuaccuaggauggcugcgccuugugacauaacagaacugacuugcugaguuuguucugaugucacuuacucuuccgguuagccaucucaugcucacacgaggcacuugccaaccacugugggaaguuuauuuuauuuuuaugagauguauucccucucggcuguucccucacuaaaccuuuguguuuuauaagcaucagcuuaucuccuucacaaaguuuuccacagacccaucacucgugcugaauucucagcucagcaaagggaugucuccuuuucacauucuuuuccucccuucuucuauucuccauguucuugguuccacuccucccccauuccaaaucugucuuuuuucuuucuguuccuuuccccucccuuuccauccuuccuggcugaaaguaugcucagcagaaaaugcuguaguuaaggcacucuuccgaauuuguaauaaccucuacucaggcauuaagugccccucagcaacugaacucaaaagaaaguagucagaaagacaaaauggcuuuuacccagcaagacucuuaaugaucccaguucccucugggucuucaaaaaggggcauggucuaauccagaaaaagagagacagggugaaugggaauaaaauaaaaauucuacccauagcuugcaguguacauggcuccagagagagagagagagagagagagagagagagagagagagagagagaggagaggagaggagaggagaggagaggagaggagaggagaggagaggagaggagaggagaggagagaggagagucugguaaccuggucccagcccccaaagaugcucugauaacuagcaauuagguucuggagagagccaguccuagaagaagauaaagggaauugcaaauuacuggaccaaaugauaauaauaauugugagaauagaugggggaaaauaaagcagauguucccugaaggcacaguaggagccagagauaaagacgcaggacagauuuaguggacagaggcagguuguagucacguaggagaaaauccaauaccaucaguggcucacugaugaugcuguuguagguuuggguuuuguuuuuuuuuugucuuauaagugcuacugaugaacaaggauuuagaaguugcccuuuugaguggggaggaacagccaacaauaaacaaucaaccaaaagcuucagaaaacaaugcuuucuacugcuaguuauaacacgucuaucacuggucuucaucauuagcuaagguuagggugucuguggagacucagcucacauuaaaaccaucuugaucuauggcugcaugccauuaucucaugauugcugcaccauuuaaaaaucuguauuuaauagcaauugaggauagggaaggaaaggugguugcugguguuuuacaauuugugguaaaaugaauuuuugauauccagcgauacacucgguguuaugucagguccaucuuaauucauuaauugcugaaaucucauugacugugacuggugggaaagauucuggauuugcucucauagggcugccaaggauggaugaugaaggauccuuggccucaggaggcugguggauaaggccaucugaauucuuaaugucccuuagaagaugcucaagacuauaguuuuuaagguauagagaagggaggaguagcccucggcaguccugguguggaggugaggaagggucguguguauacauagugagauuaucagcaaggaaaagacauucagggggaaaggaaagcaagagcagagucaugcucacugaguuucuuuaggggagcuacaguuuagaauucaugguuagaaauaguggcuugggcuucaugcaaggcccaauuugcaaggccaagggcuucaaguuucauguucuagccaaaggggaguaauugacauuucaaccugaguucaucaaaauaacugaaaaaaaauauauauauauauauauuuuuuuuauuagccauccuccuuccuuuggcuuuuggaaagaccucaaaauuauccgucuucuguuuccuuucccaaaugucuguuaaaauggucgagauuuguaaucccagaccucucaucaauggcaucaaaacagcauuugcaaugaggucugggaaagagcagacauaaauauaaacuaaugauauuauaucggcugcccuguuggagucgcacuuguuuaugaucugagaugacaaaucacaagguuaccacaggugguaggauucgaggucaggggaggcaaucgagucaaacuuacauuuucccauuaaaugaggguugguuuuagcauucagauagaagagggagagguguuccggaggcccugcuuccagucccaucugccaguuguguccuaggcaaguuggggguguaguggaagacaguuugcuuccuuucuucuugccuuccuugaacaagaacugacuuuuucuccugcuuccggucccuugucuccccucccuucccagaugguucuuuuauuuagauuuugaacuuuaucaaggcaagaguucagggaaauucucauuuaccgcacgcaccuccaggagugccuugcucacugccacccagccccauaaauugaauagauggcacccccuucuaguugccugaggaaguggucagacugccgcauuccuggcugauggauuggcucauuucuccccagcuuaagccaagauacggauuuuaugagacugucuugugacggggcugaagucacuuugaauaaaacaaaaaucuaaccucagcucaaagaaauaacucuuugaaggagcuuauccugagccggggagcaaaacuugguuaaacucccaagcaaaggccuuagauggucugcgugggggauuugacguugcugcuuuugguccucucuucaugcaucccugaucacgugcucacacagagaacccagagaaccgcguguccauaauauuuauaaauaagcagccacagagacaguuaagaaguucacaucaguccagcuaacgugauuaaaagagacauucgaacucucuauaaugcaagaccgacaugcucacaugaggucccuagcguuucguuucauccuuaccaagcaaauaaagcaguagguaacgccuugagcaagcagccuguugucucaggaggagaugccuuugaguuugaggucagucuacagguucuaggaacguuccccaccuugugguaugggcuuugaauuuuagaacuggaaauaaccuuuuaccugagagggcacagugucagcacaguggccuaagucacccaaggccacacagcuugccacuugauuguggagcucuucauucccauccacugcuauucuagugaacuguccauaaacagagagugacagugacaugggaagguggcagcuuccuuuguuuuuaaguagaggaaaaagaguaucuucuuugucugcuaugaauaauuagguaaaaauacuguuguggaauuaagggcaggaugggauuauguugaaaguaaagaauacauuguaaaaaguuuccaagggaagggagacagguagauagcaauccccaaguccagugaccucuacaugccugugaggaauuguucugcacucgcagcagauaccugacaccaaggauaaugcccaacucaauagacuauaguuuuuccuaugcauaaugccugugacaaaauuuaacuuguaaaugaagcauacuaaaagauuaacaauagcuaaugguaaaguauaacaauuauaauagcauaccaaaauaaaauuauauggaugcacucuaucuaucuaucuauauaucuauauaucuguaguuaauguacucuucuuuugaugaugcugugugcaaguauguaaugaauguaaugaaguaaaugacuuaacaguguuaggcugcuaucgaccucuuaacuauguguuagaaggagaauuaucaagguacagcaauaucuuugaccacugauaauuagacccacugaaggggcagcaacagaaaagugggguuacccacauaaaaaguagaugucucuaaucuuaucccuugacuugacaggauguuaaaaucaccaagaucuaguagcuuauuggguuucaaacaaguccaggaggucccagugauguucuuuaguuucugguuccuucccuuggagcauccaaggugaauuucucuucuaucuguauuguacuuugaaauucuggguaaaguauucauccaagaggaaagaguaucaccucuuaaaacauaaaaacguguaacuacacaccuaauacaauccacacaucgaacuaaacauauaaaggugaaacauaggaaggccccacucaaggaaggaguaaguuuaucccccuuuuuaauccuccauauacacaucuauacauguaugcacacauaauaccuuugacaguuaccucacuacuccagagucagccaacuaccaagugucccuguugaugcuuucuaucccuucaguuaacuugggaucuguuugcuuuucaucuguggucacaggguucuggcuguugaagcaaacaagcagaauucugaugauuuaaaaguccucaccaugguggggcuggagagauggcucagugguuaaagggacuuucugcucuuucagagaggacucaguuucaguucccagcacuugcauggugacucaggaccaucugugacuccaggagaguuccaggaaguccgaugcccucuucuggacuccaaggaccccaugcauauauguaguccacuaagauauauauauauaucuuaaaaaaaaaaacaaaaaaaacaaaauucucaccauggucugaccugaguuauaucaccaaaaucaggcaauaccauuuuccaauuaaauuuccuagauggcagacuagauuuguaaggguucuuuuucugccccuucuucaugcuuucuaaaaaucaaguauuaccaggagcuuggucuuaauucaggcucucuaagagggccuaagugaagggauagguaauuauuuuaucuuaggggaggggucaggaaacccauaggcaagaucaucauaacuauacugagauaaacagagccguagacguuuagaaaaauauacuuuuggcguuuuauuuuucaaaugaaagcaacuaaguauucacucugaggggaaaaaaaaucuaaacucuguggcuaaguuagcuccugcuuccgcagaaguuguguguagaggcaucccaucgugaccucuaacccacugaccucugacccagcucacccuucaagcuucccucccggauggaauuugcuguuucucuuugggaaauaaguuugccccagguggaagguguguacaaaauagcugccaaacaaggccccaggucagcucacugaacaggcucagcugcuuccauugugccugguuccucuuucuaguaugauuuuggccuuaaggaguuugcccuugaguucaaguuucuccguccuccuggucugcugccucugagaccagacagaaagcacugaugagguuccuuuggagcacaguaaaggccuaaaaggaauggaugaucuagcgcuucacgggagauucuagguaauucuucuuggggcaagccuguacuuaagacuugcaagcccauccccauuuagaaaugaaaagaucaguuaucaagaggagacacagaaggauuuaguguguuuucucuccagcuuguaccgcugccuuucaagaacucucuucucuccaagaaaaauacagacagaaauucuaguguuugucuuuguggaucuacgucugcacaaaaugauuugugauauuuuaugggagggcguaaacguguuuacaggccugacgugugaauuacugauaugcauauguaauugaugggagugcuguaucugugugugcuucugagugugaaugcggucuaagcaagaaugcccauuuauaaauauauggguauugaaaagguuaacaacacacaacugagacagauguuaaggaguccacagacaauucauuaaguggcuugauuuucuucugauaaagacgugauggagagggggcaggagacagaggaaagcagugggguuguccuuugucucuccaucaauaaauuucagccgcaggagugcagauuauuuggcuauagagcauagcagaguugaacaaaauuucuuuuguggggcaguaauuauacugaguguagauaagagagaaagccuuucugcaaggaaaguuuugcuccugucuccacugcugauccgcgugcauggacuaauugcugaaagcucaagaagccgaggggagaaagucgucuguuaagaguaauuggagagaagcagggauaggggacuugcgugauggggaaaccauaagggguuacuaaacggaagcucuguucagguuuccuccaggagcuccaaguggggaggcagggcaguuuucugcaaaaauaaccggcagugggcuggcccagcagaacauuccugucucugauaguuuggccgaaaccauaaaacaaacaaacaaacaaccuaguguaucuaaguacccacacaucugccucuauagaggguuacucccagccccuuucacccacauaagccaagacugaugagccaccauaugaccagcuggaagauacuggugcccuggguugguggggggggggugcuucugggcgccugcaaagccugcaggcaugggcuguagaggcaggggaggggagguggcugcaucuggguggcagggguggacccauuguccuccgggccuggggaggaugcagggucauuagguagaggaugauguggucucuguuagccugaggaaacagcucacuuuuguuuuccacccaguaggguguggacccgaauccauuagauucugggcaguucaacccggcacaguuugagcccuuggaagcaagaugccaaaaggcuacuuguguggauuugugucccaccaccauuguguaguaugccuaucauuuaugcauuuagagccugucaggcuggcaaucugcagcagagggcuggaagacaguaaugccaacaggcacaggggaugguaaagugcaccuguagaguuaaaaaugcaugacccauucccucuuggagggaacacaggagaaagacccccguccuggaggguaucugcugagcuguaauacauaauucacgggcccacgcugguccaugcagauggcgauauuaaaucgugauugaugcucagagacaugcaaggcucucgcgaaggccuccaagaggcuucagaauaucccugugucuccugcgccucucacucuaacuguggcauuaagcagcccacccccuuauuucccaaccccugcuagggauugcaggaguucccuccuagguagaugaaauucuucaaaugucaucaccuaccuuuucugccuuugaagguugccccuucccuccuggcccagggaggcuguuuaccuccaaccaggcacuggagugaggggagccagcucuuccccugccucuccgccuuuccuuuugagcaucuugacaaagcagcagcacacucugguggugacggagccagagggacagugggcagaaauggaagagaaaagcgaaggcggcugguugcucaacacaaagcaccuuugugcaaauacugagauuggagccagcggauucuuccauucagauucuuccauugggugcauaaugaaauaauaaaucaaauuugugguguguguggaauuaaacguuuuggggggaguuucuuuaaaaauaagcugaaaucacccucuagggccuguucuggcccaaagcugaaagugcgucuuugcaccucucauaauuguugccaggcuugcucaugggguuguaccacaaaaccacgauugucaguuccuggagcccggcugcuggcugacuaugcugggcugagagacaccaacuaaaacgaaggauuuaugagacaaugauagagaugggaggcuugaaggaagagaggaagaugggccaagaaagggagacaggaaaaggcagggaggagucuuaagugugcacucuuguuuucauaaucucuagccauagaauggaaccauuuaugaucauuuucuggaguguguguguguaucuguaucuaugugccugugugugucuauguuugugauucugugugugccuaugugugugugugucuguguuucuaugugugugugugugcguguuuguguggaugucucugucuugggagggggaguaggaggagaggagaguugaaauagucuccuggguugccauaaaagguucucaaacaguuguaaucagcuacugggagggaggaguuguagagggaaggcuaucucugaaguucuuuggugguguucucacuuccagauccacccugcggaggucggcugaauuccaaagaugcuggcuacaucacuuccccaggcuacccccaggacuaucccucccaccagaacugugaguggauugucuacgcccccgaacccaaccagaagauuguucucaacuucaacccucacuuugaaaucgagaaacacgacugcaaguaagcacagcccugcugacuggggacgcacacacagggccacugcucugauauucuguccuuucucucacugaagggcaguugugggcccuagccacagagggccacuuaaacauggcauuagcuucuaggagagguaggguggauuugauucugugguauuguaaagaaucuuuuggaaugagguacagaaaacagugguacccugucuguagaaguuggcaguggaaagaguuuccauuggggcaagaagcagacuacaaaccccgcuucuuguaucugugacuuagcuuccuuuggagggcucccccauuuugauugcugccuuaucaggaacccuacaagcuucccuaauaaaaugguagcuggguccucaaauauauccagcaauagggauuggcuuauugcuuuccaaaggcgcugcucauugcagaguuaaaaauacagaguuggugaaggauggguuaagacuccaauugauucuugauguccaugcugcacagguuacucucaaagaugcagguauagauuccuucuacaaacaguucuaauugcuuuacaauuaagccacucaguucuugcuguagcccugggaagcuggugccaucaugaucuucauuuugacaagaggacacuaaaacacagagagguuaagucaguuacucaagauggccucagcuggucuuauaacaggacaucuguucagccaccuuggagaugcagacagucagagaaaugcucguaagaugcugugcgcacucgggaaaacaggcuggcugaguagucucuagaccucuguccugugugcuugccucaugaaucaaaagugaaaguguucauaaaagacuauggcacuggcaguuuuggucuuuguaccauacguucuggugacuguucaguauccacacgacaccuaaacacuccgagcauuccugugaccaaggaguugggaguccuggauaauuaauaaggagacagcuggugggacagguauaagagagcaggugacacuccuggccccuaauguagagcaggcuucaguccaggccagugcuuccucugacggacucaaggcuccucuguaacuaguacuagaccccgaggccuggcaagcugcuguccuuauuauacucucaggaccacuuugcaccuacagaaugguuuccuucuaacaggagguagucugugcugaaaaccaaagaguuucccggauggaugccacaugugacuaagagucacaggaugggguuucuaauuccaggaccagucuuggcugccuggaugacauagcacaucaguuccuccuuugucugucuuacacagacacacuggacacauugacucagcaucccaggauuccacuuccccagcagcaaagcugacaaagaauuuggguuugagcagcucuguaaaaggacuuuugggucccagcgucuuuggcaucaacugagacauaaugcacagagugcuugagagcgggcucagaggaacuugacuaagcaccucuccggacagagggccaaauucgguucugcugaucccagugcaaucucgaggggaaauugcuaagaggccauuuuauggauauucacuaugacaggggaaaggggccuugcuuuuuagaagguuggauucagacagcaaugagcaaagccccagauauauuguguagaguaaaaggcuagggacgcacucugcagccccgggauccaacccacagggcugcagaacuugguguggagcagaaggacucauaccucaccuuugcuggagucugaagagaggaaacaggcaaguuacaggcucucuucccggcuucucaggccuuccuaacuagcuuccuguuuuucuccacaugccucauccuugcugcuggcugcagccuaaaaggucacagaggucagaaagaaaaucuuucuggaaucuauuucccccuagugucaaauugucugcaaggcuccucuaggcccacuuacccucgcucucgguccucacccaccccgccaccgcucccccacaccccauccucugucucucucauuaauuuuuauauuuagaaggccguaucuggucccacuugcccucauuugcaugcagaacaaggggcuugcccgauuuacuuucuugagaaaggaacacuucaucucauuaaauccuggaagguuuuucuuguucuuacacucuuuuugacuccuucuuuuccacgcugcauuuuuuuuuaaauagcauuugcuaucaaaggaaauccguccccucuuucuucgcauuuuggggacaugcucaauuguuuuaccucaaaguuuaugaagcagguaccucucccaacagaaaauugccucugcugcccaucucugagugagcaauagcuuggagaagaaagaggaaaugaaaggguacagccuacaugccugcccgaguugucucuucugcuuucucugcaugaaaugaacuacaaaaaaaauggcccucugaccuaagaccagggcccuuauagggaagauuauucuggucugugguaccuaagccuuuuccucucuguaccuuaaagucuccauuccagaaggucaaggcaacccccagacagaucuuuuccugaccaccgcuuguucauuuuguuccacugaaucuugcugucugcuuggaaaauuucacucacaagcgucagccguucugugccagugcaauccgaagccacccuuucucuuagcuuugccugccuccucccuugggcuauccacagggaaccaaccccuaagcaccagcaugcuguccuggggacuggggagcagcuacaggcagaagcaaaggccguuguggcauugacagcuaccugugucaagggacagaaagacaggacucagggcugucugggcaaacagaaagaagucacuucaucccccugggagcagaagauaccaggaggcugcugccuuggcagacagagagaagccauucgcuugagucaucagccagaggguucagcguuaugguuuuagaaacauacacacaagacuggguauuuuuccacuucuaaacugugaacuguaugaacucuuaaaaacauucaccaacaugcuguccuauacaacuuacucaccagucuucaagcaggcuuggugugcaugugcuuacacacacacacacacacacacacacacacacacacacccauuguagagguccaaucaaagguaacuaaaaucaagaccuaguuccuagaaagaacaaguauguagcagauagguaucuugaaaauaucuuggggaaauuugaaaacuaggaaguugugaacauacauuucuuaggccaccucacaaguaagucuacguagauucagaacaaaacuaccucauuccugucaaagugaagcccauugaggaacaaucucuccgggcagagucccuccguggaaguccugaacauuuuaaagccucacuuccauguuuucuuaaacaaaaccaacaaacguugaggagagucauuuuuuguucuugaugauuuaggaugguaauucuagacuucacuccuucgugcacgaugaaggccgaucaauguccucuuuggaucugauuggcucuugaggauggaugcacuugaaugcaguaccggcaaagcccagaagagggcgccagauuccccugaagccacagcuaacaagcaguugugagcuuuugaauggcugugcugugaacugggcucgccgcagagccaucuccucagucuacauuugaauuuuuguugagcuuuuaaacaucuuaagucccccaaaccaugauaacaaguacuuugcugugucuaguuuguguuaccacaguaaguuagcaagcucguuaaaugccucugucaugggaaacucgagacuauuuucuccucguacuucuugcuuucaauucuuaugaguauccuuccucauacagccucccucuucugacuugccuuuauuuuucauauguaucaauuuugccguagaagaucuuugcugucuaugccaaagauuagguccugggguucaagauuucaacccuaaguccguguaaauucaaggcuaccauuucuuacuugcuucguucagccaaggccacgacagaguaaggacugccuggagauugacucucaccccgacugagcguaacacagcacccauaguucucagcguugguuuagacuccuguuucuucugauccucucaguccccuacauucuggauauggguaugggccucuugccaacuguccuagcuaaacaaaaugugcuuguguuuacuuaccacagagggucccucuaaaucuuagaagauccuggguugauaaauuaaccaugaggcuaagcaggggcaagaaaccagaccucaguaagcuggucccuucaugacgagcagucagcgcuucccugugcucagcaaacagccaacauucccagcaaccaaacauagcucuuccacccguaugaagucucccugagcucccguggcaugggcuguaccuccuucucuacccauguuuccccaggguuugucuccuugcccuuuauuggcuccugcuccaagccaccucaaucacacugucuguuccagugugaugaucucacgcucuccaauggcacagaccccauacccagacuaugaacugcagaaacgagccugcgagagaacucagcaggugugugcacauacuucuuuuauugaugucuugucaccgauugcaccaaggcauccgugauaugaacugugguauaaauuguguuggaaagugggcaggucaggguuuccccauucuuccaucugagauuacaaaggaaggacaaagaugaugggaucugggcuauacaugucacuaacuacucagacuugggucugucaccagccaaauggccauaggccguucacucugugcccaggaagugcuuaaaagcaccuauuauugccaaacuugauggccaguuuuggaaauacaugggguuaguaaauuguacccuuugaccugauagauuuugggacuccagaguaggagguggugaggucaaacugucccagcuggcacaguacgucugagccuggcaguggguuggcaauuuucugucuuugucucaauagacaggaaagcauaugaaauagcuccuccgacacacacaaaugaagaaucgugcucucagacggcuuaagcaagugacccucagguccuguccucugaagggccuggguaaggauuugagcccuacuuuccagucugcccuucuuuaaucucaugcugucugccucccccucccucacacugcauguccccacugugacuugaugggagacuguuaucugaguccacaguacccagguccagcuuaggcuggaagacccggggaggcucccuggaagaggagcugccuauacugacccuagaggagucagucagcaagagggaaugugcaaggguggcacucugaagagaggacugucgcuagcucugggaaguacagucauaaacauggcugaccuucauuuccuuuccugugagugcugucagggcaggggcaagagaaggaaggcuguccuugugacuuuugcuacaaacccucuuccuggcaaaaaaaaaaaaaaaaaaaaaaaaaaaggugccugacauguuacuuaacucuauuuccuggccaggccacuucccccaccuccucaggagggggacccagagcaggaagcaggaaaggcugggauuauggggagucuacggccccgcccuccccgcgguuguaaugucucuucugccuagaucccuauguccagauguccuuaggauaauggagagugugguuuguucuggcacaguccagguuacaaucuggauuaaguccucgucaguucacuccuguccagacccuagaucccuuuucuuuucucugggaaaucaaauuacccaauuggagguguggcuucagcugggaaccccugaagucgaaacagagccagucucugugguauaagaggaugccaugugcuggcucaggaagagggacccuuggguugauuacucaugacauugggacagauuuacugccugcccaccacagaaauauccccauucuccaaggaucgggugagcauuaguauuuuucuguauugcaacaacccuccuaaugacagaaacagacccaccucugggaguuggugcaauaguaggaccggccgcauuagccagaacccagcugccagcugaccugcccucugcaaccuugaccaaggacucccucugcccagcaaugucagcucacccaagaagaggggaacaacagcccacagauucuucuccuccucuuuccaagguuaaagagcaguugggacaacaguuauuuuuggcuguuuguuuuuaaauauucgauguugcaaucgcaaacguucuccgugcaagcgagcuucacuguggcugucuuucuuaacaauguguuuuaucuccugauugagaaaaucacuugagauuuuauccuacaugaucccccuugcucugcuucucaacccuggcaccuucuugaagccuggagaucccagagggccagcaucucgccccauguaacucuguguaauucucccaucuaauuacaccggcaggcugucuuaagaaauucugagggacugugagauagauaaagguguggagggauaaagccuagaaggggagauaacaugucaagacauuagucuuuucuacagagggauuuguguuucccuguagucaugaggccuguagaaaaaaauccgaacucuuuguugucugucuuauuggugaggagauuuagacccugacgagagauacuuaagagauaacuuaauuccauuuuccccauucaugccuagguaaauuaucacacacauacagcccuugucuuuuaggaaaaaaacccaaaacccucauaaucgcccuucauuaugagaccuuuuggcucacaacccaucccaguugauugcagaauagaugccuguauucaauuuacauaaucaaaaaaauuuuucuuccuagaaggaaaaucccuaaaaaaaaaaaguuagcugggucaaaauuaaauuucaagaaacuaaggaaaagaagaaagaaauagacccagguuuggcuuggguucaagaggaccacaugguaaaagaaaaagcacacaguuuuguaaggccuuucucguggcuguguaggcaagcaucguggacuguuguaggaaguuuccagcucugcauaucagaggccacaaacacacagagcuguguguuugugggggaagaucaucaguuagacaauagcaaacacccauguguucucaaaggcggcagacauuaucuacagccaucgcccauagcaagcugugggcucagcaccaguauucccacugaccagaaggaaauacugaggcuuugagagagcacaccuggacuucaggaggccuggauuggaagccagauggcccucagcugccucuccaugccugcuucaaugcguugagagcagucaccugcuguccagcacagguuucuuuagaaucccacgagccauuccuuugcuccguuuauagccuugcuucaccucuuccuuccacgaggucacuuguggaugccagcaaggcagucaaggaaagagaagccuuucuaugucuuaaaggacaagcuagaggccugauucuguaaauagucuuagucugccccugccccugaguccccuggacuccuacacacacacacacacacacacacacacacacacacacacacacacacaaacacacacacccaccaaaccacacacaccacauacuacacacaaacacuacauauaccacauacuacauauaaacacacacacaccacacuacacauaccauaccacacacacauacacauaccacacguacacacagguauacaccauauauacaugcgcaccacauacagauacaaacaguacaccacacauaccacacacacauacacaaaccaacacauaucauacacucauauacauaccacacacacauacacacaccacacauaccagaggcacacacaggcauacaccauacacauaccgcacacacacacagaccguacaccacacacaaacacauaugcauacaacaacacacaccaccaacacacacacacauauacaaauacacucaccacccucuuuggguccccaccacuacuaccuuuucucuccaucuggaauccuaagaugugaaggccaguaauggagugucagcggaaguaauugauuccucacacacagagaaugccccugccuuuagugucaauggagcugaaccagauucugggcgggugagcgagacguguaaacaguucauagcugagcugucagggccaagccagacacaguggagagggggugagagggagaaccauggaacaaauaauuguuuuauuggaaaagaaagcaauaaauaauauuucagcccaggaacuggcuguuugaaagggauggagacagccuaggaccagaaaaaaaaaaaaaaaaaaaaaaaaaaaaacauggcacagguuugaaugggagaguuuuucuuugucuugagguaggagguuucuuccugccccacccccuuucucccauuaucaucauuaaaauaauuacucuaacaauuacaguugaugagaccugggguuuauggaacaccuuucaucugaaaguucaaagugauuuaucugugugucauccucugagaacugugggaggguaagaaaguauuauuauuguuauuauuauuauuauuauuauuauuauuauuauuugguccugccagauacaugacuccauccaaccccagggcaggcuguagguuaaaugcugggguauagacuucucuucuggggcgucuucacuauuguacccuucucagcaagccucuuuuccacacguggcucuuagacuucaucaccagcacuaaugucuucuccaugcuaugggguccccacauaugugugguguguguguguguguggugugguauguaugugguauguguauguguguggucaucacaauauggugaccagccagccagcugauccauacacaccacaagugaccugcuuacggcuuccagagaaauaaguccuuuaaguacgguucaacccagacuguuuccggcuaccuuggagacuuccugcaaccugccucucuucuuauagaagcgugugcacuuucuagacauauucccucaugguccacuaagacucagccuaacagcacccuauauuccugggugcuacuuccgugcccagcaaacgggguauuuuaacacaugcauuuccacugugcagcgaggccagggcugugacuugcauuccugaccgggucuggcuuugcucugagagccaccacaguguuucaggauguauaucgggacacagcauccaaguggcacuuugagaggaggaaacaguuccagcugacuggccaccaagggccacauucagaaucuccacccuggcguggcuacagccccuuccugcuuggaccuuaguguggaacuguuauuuccacagcccggugcuuaccagacaguagugacaguuugccccuggagcucucuguaacuuaaaacgccaagagaacaggauccaaacucugacugccacaucugccaccugcucccaaagugccucuguccuggaauuccucguagcacauuuuucagacagguccugugucuuccaggccuugugacagaggcuaggggaauaguaaaaugauggggauccuauccccagaaacucagaugaacuuugaccugaugacugacucccuggcgccuggcaagcuucucccagcaggcuuccauuuuucggacagauggggaggcuuuuauuucucucuuacaauuggcuccuucgggaggcagagguagugagcuccuucccagagggagcugucaucucagccaaguggagggaugcuggcagcacaccaggggcuuaggauggcuaucaguuaccuuaugccccuaguuggucccaagaggugaagagaugagcuccgugcccauuuagaaggugaggcaaaccaaggcaggacagcaugauagaccccggccagcaugagacaacuuagcaagucuuagcucuaucagguuucacuuucaccaucagaguuugaguugcuguuacugcugccagugaggagagaguggucuaugggcccuuguuaccgacuuaguacuccggcgucauuacggaacgcuugcaaggggcucuugaaguugaagcuaaagaaugaggauucuauagucauaaaaagaagcugacggucaugcugaaaagagccagucccaagccuucaacuucaccaguggcaaaaaaaaaaaaaaaaaaaaaaaaaaaaaaaacaccccuuacauaagcaaguguuuucuauccagauagccuccggaguacccgcugguacagaucugaggcucugcggcuucaggaauguaccuugcugggaagccagggcaguguggggaguagugugcaacuugagggcagggcagggcaggggcaccaguggcuuuguugugugcccuucauuuucugaaagugacccacagaagacuuaucagacacugugucaggagcagccuccuuccucacguagagaggguucuuggcagccugcgacccagggaacaaugagguucugaggccccuacaucaucccggggcaucuguggaaaaacaagcagcgauuauaaauagaugguauuugcaguuuccacuuucuugccuucaagguuuuguagaauaacuccuccaguuuguuuuggguuauucucugugcauacuuccuuugcuggguggucagauuuccucccuccuaacgagcguggugacccuggcugggaggggacugcagacgaaaagcugcaaacaucagagauuuguggcuugaagaaaugaaggaagaaagcgcaacugcacacagcugcuguggaaaaggcacugggcccuagugcagacacacaaacaacccuugagugguagacccgcugaggcuuuagagauagaugaauaauaaugacaauaauagcuguggggacaacaucugcucacugaggacugacugugugucaacccauguccugagcuaauugugagccucaguucaacagacuggcaagaagaugaguaccucacugcuccagacacagcaaacgaggacuacagcucucagucagugguagugggguguuccaguguucagucccugguuuuaagcccaacaccacuuaaagauagauagauagauagauagauagauagauagauagauagauagaugauggauagauaaguagcuagaugaugauagauagauagacagacagacagaaaaaugauggauagauagacagaugauggauagauaaguagauagaugauagauuagauagauacauacauacauacauacauacauacauacauacauacacagacagauagccuuucugacugaagauauagcccaacugguagauguucguucaaagccucuggguucacuucccauugcuauacaaacuggacaugguggaacacaccuguaaucccuucacuuaggagacagaagcaaacagaucaauaguuuaaggccauucuugcuuacacagaacauucaaccugagauaugagauccuauucaaaaacaagcaaacaaaacccaguagguggaagauaaguggcuuugaacccaucccuggcacccuggacccagaucccaggcucagaacuucaagagugaaauacaucucaacaacucaacuacauggauuuauauaagagguagauuuguggaaaucuacccgcaagguuggcagcaccaggacuguagugagguuuuucaugucuucugucuucaagacgcucugguguauguguguguacguacagguaugcagcucaucucucaccauuguguuauguuagcacgguggcuauaauaaaaauaacccucuccaaggcaucuggcccuguguuggggcucacuguacuuuuccagucuuucuaaccagcuccaaggguaggguauuauuguucccauuuuauagaugaagaacugagagcguaggugucucaucugugguuucacuaguagcuaaugccucggacuaacuggcucugucugcaaagcuuccuucccagaguucauugcgcucucuuggacauugaucuauguaauaauaauuucaggugggcuuugucacagagcccuuccuuagaaaaauaugucugcaugggaagaugacacaacauuucagugcacgauuacacugaaacuccugcaugaaccauauuggaaauuuguggacuuuagaauauguggcugguacuugaagcucuuauaaauacacuggauccuauuuucucacucaacaggccauauguucacauucggguguacacacgcuuauaaaaauacugcacuuacagaaauuaaugcguuauuccaucugaacacaagagcugcauuuccacugggcaaaucuugaagccaugcauuucaaaucugcucccuguucccucuggugaucugucuauuaauuuuggcacguccugcgggcuuuguuuaaucagaaugacugagaaaaaagagcaggguucugggaagacgcucuauacuucugcccauuuuguagaaaccagaggaaggaagguuucuuuccuccuggccccgcuccugcuuuugugcuaucugguguuuccagagagugaagaaagaggguggaggugaagccuguguggcagagugaggucaccugaguucaaauccuaccccugaccuuuccuggucaucaccuugagcuguuaaccugagucuccauucacacuucuccacaugagugguaaucauggccaacccaguauguauuaaguuaggguuaaaugaaacaauaucuaaacugggggggggggguucuagcuccauaguaauugcucaauaaaauauggucacuuuccaugauuuacuuacuaaaugagugguaacaauggaagugagaaaugcaaggaaaugagauauucuucuuuaaaaagagauaauaugacagcaagccaauuucucuguaagagcuggacccaagaagcagguggccuggcucugggccugugcuucccagagaccucaacauugugcaaccccgcccugcagccuccgugugucucaggcggcuucuuuguugggagguuuuugggagcugcaagcgacugugauggcauuuucucgcauuuucccugcagguuuuaauguaaggauuaauaagacaguguuuguagcugucuuugagcuuccuggaagaaaggcacuccgggaggugguaaauucucuggccuggauaauccacucaugaaauauggaacuuugaaagugugagaaaaaucuccaaucacuuugacagcauuuuaauuauaguugauuuguuugccgcuaauagugaaaaugcugucagcagguuuugagauguuucuucuccacaaaauguuauauuucauggcuuugugucacgaagcaacauuuagguuuucacauacaaccagaauagcucaguggauguguuggggcgcaaaggcagaagguacaccagggaccgacccaucacccccaguugaaaagcaucauccuaacacgcaacaccaacugcaaauccaggcuucauuuauucccucaacacacagugaucccugccugugccaaggaccccaaaauaucccaaaucuaccaaugaagagccaagucuggccucauccugcuuccucuguaguacaagagacagggcuaagcaaauagacaaguguacagacucacccuccccagaagggaggaacaaaugaggggaugccaccugaccaagaaagacaggagaggccuugggaauggcgucugcacuuaagcccaaaagauuggaaccagccauggacggaguuaaggaguaugagagacucgagaaagaaccagggcaagggcccagggguugaggaagcgcucagucugugucauaaccaucauaagcaacaugaugugaggcaggacucaucugccaaagggugguuucuuggggugcaggcauucagauguauagauccaaguccugagguuggggauaauguccuuauagggaccuaaggauugugccuuaggcauaaaacccccuccucacaaacauaugugcacccagaaaagcaggcaagacccaagcuagaccuuaaacugcucuaaacaagggccuuagccagggggagccuuccgcaccaucagcaguagccagccuagucugggugaccuaaugggacagagaugcggacacagaguucuuccauguuuuccgugugaugggagggagagauggcaccucucuucucucucucucucucucucucccucucucucucucucucucucccucccucccuccccccccccaccccucagaacauuaauuccacugcccauauuuugaugccaauuccugccucccccauccccaauguggauuugggggggaaaauaaagacuuugaagcugagagagaggaggaagcauucucuagacacccgcugccagugcagaugucacaagcugugaguuacaggaaaaaaaguacucagggacccucugagugagacaacaagaaugagcuaaagauggccacuuuggcucaggggaagaaaauaaauaacuaaaauacgaagagguagugugaaagcuucgaaaggaauuuuuucauuugcgagagauuacgaauaaugaaaugcaaacacuguaguuaauaugucuguuagcugccucaugcuggcuucugggaggcaguaauaggcugggaaagagggcaacuuucaaguuauccaguuucacuguccuuggggugaagcucgagucugcaccccagacuucuugaucaaacaaacacuggagauucaaggcugcaugcaaagccugcguuuauuccaaagccacaaacuuccugagccuccuccgagcccuucccaaaugaaccugacaacgcugaaguuucuaaggagauuugcuccagcugcagcaaaucccuaauaauaaaaaacuuccccaaaugacucuaucacacaggagauaaaugagacauucuauaugaagucagugugucacugggacugugcccuuucuaucaaaagcccuucuagaaggccacauggugaggcggaacucguccacagggugcagccaggacccuggagggagaacacacuugcaugccaacuuguaacuccuggucuugucucccucaagcacgcgugauagaaaaacaaaaaacaaaaaaacaaaaaacaguuuuccuaaauuuaaggacugguuauuugcuucacaaagcgauugggggggggggguccccuuaacuaaaaagcacagagagagugugacucacuggcuuggaggaacuuuuguucaauguacaccgccuucacuggguguguauagauaaaguaaacacggguuuguugcugcccagguuacaaaaaagacauggggucgguguggucacugagugaccugaggcaagcccuuagcaauggcagcuauggccuuuguugguagcccugccuuccuucagaccgauucugucaaucauucuuuaaaugacuccaaaggugauugggcagccugacaaaaccugcccacuucugaggacuagccaguggaguggcaagaucuugguauccuuuguaaauagauaaauaaguaaauaaaauguaaaacaccaacauaaagccacauaucaggguuuuuaaauuauauuuaaaaaauauuauucauugaguaugauaucugaaauacuauucuuuuuauguugacaugucaugacuauugugguuuuuguucuacauacuccagcucaaugagauggaugguaaagugauauuggaagagaauccacaccuaucugcuaauuuuuuuguuuuuuuuuuuuuuuuuguuguuguuguuguuguuguuauuguuuggauuuuuugagacagaauccugcauagccuaaauuggccuugaacucugacccucccgucucaguccccaagggacaggauuuuggcaagcacagcuugcccaucccaaauaaaucauaaggauuguuuuucucagcguuucuacuuugaaaacuucaggacugcggcucuuuuuaugaaucuacucuuaucgaaggaaagugaacuuacaauacuaacucagauagcagaagaaaacaaagaaauuggaguuacccuauuggugauguagcucugcuagcaucuuagauuaggcuauuuuuuuuuccaacuucaguuuucuggcugcuuaggcaagaaaauucauguguacauuuuaagauggacuuuaaaaaucuguucuuuuuacauuaauaguauaucaugaacuuuuuuccuauagagccaaaaaaguccagaccugccacacugcuucucuguagccacugaauucuucguuuuauaaauacaccagaauugauuugcucgcccucccgaguuggauuuuucaacaugaugcuauuuauaagggaaacaucuucucacuuuucauaugcuucugaaaaaaacacucauaagaaugcauauacauccucacaccacucucugauuguuuucuuaggggaaaaaaaauccuaagguccuggcuuaaaggcuacauacaggauaacuuugucucauucuugccaaaaaaaaaccaaaaaaguaccuuccgaauguuugaagagcuuccaucuccagucucugaacuccuacuccuggaucccugucucuucagagaagcaucaucuaugugcauggcucaaccucuuugccuccaaaacgggugugagaauuugacaaaccaguuaguuuccuuaagcacaaacugagugccagacacuguaguaacucuuuaugcagaugagguucagucaugcaaagcuccuaacugaggaggaacacuccuaguagcucucuuuuacuguuguaucuucauuucaaaaguauuuguauguagugcgugugugauuacacacacacacacacacacacacacacacacacacacacgaaggugcuggugccccauagugcguguaugaagucagagugcaaucacugggggucugcuuuugccuucucccuuguuugagacagggucuagcuugcugcaagcaucccgggcaucuucuaucucuaccuuuggucucacaauaggggcuaugggaccauagacagaugcuacuguuuccagccugaccuggcuucugaggcuuuuacucaagcccucacucuugucuagcaagcucauuccuucuaagccaucuccucagcccucuuuccccugggcuuugaggcucagaaaggguuaaagcuuaaauuuuuuuuucucaguucuuuuagaaguuuuuuaguggauguauucgccaaauuuuauuuuuccgcuuuauuuuccaaauguacauaguccgugaggaggggcuguuuggcuugugugcacuuggccgagcacagccuugcucagcugacugcugaguaggguuuaacucacaggggaagggcguggaggggcuuuccaggagggauggggaauuuccccucaaaccaagugucuuuucacuuuuguuuuggaauugaggaagcuuccuuucaaagucagugcuaccucucagaaggaaaaccuaagcagaucccccacccuacccuggggccuuucuagucugccuaucucucccggaagccccuaucacaccuucuccagaucucuccagggguccugcaccagucuuugguugcaggagcccaucccuccagagccucaggauaaacuacacuccuuaaccuuccuuuacaggccuauuuauucugaaauggccgagccaucugaaauacgguucccagagguugaagggaagccucaggccucuaacuuacuccaaccaccugugcagacagccagcuuccacagaccagugugacaagagcuggaggccacaucccagggagggcuacaucgucaaucccuuuccuugcccacaaggaagaaaucuccuaugugucaugugugcagguugauguaaacugcagagagggagaggagagauggggagauggauagcuuuugaagaaaugucuguuucuuccugucugagaggaagguuccacuucggcucugugauuucaguagcaacuggaagcuuagaaggagggcacacaggaucauuuauuuguugggcaugcgccccagcggaaaacaaugugucuguaagaaagaagagggaccucuucuuuuaaucagucuaugaaccuagccaaggaagacucuaagacaucuauacccaugccaggcccaauggacucugucugaagggagcacaggcuauagcuuaugggaguccaaguagccuuaacucuuaaaaggcgacuaguuguggguaugcagacacaguccccagggagacaccaggcuuugggggaaguuuuuauugccuuaucugauuuagugccgaugccuuuugaaguccuguugacuagacagugccagugggaacuuuguaggcgcaucucaggaaaggaggugaacuacagaugcggagacugccaauuaaaagcaagagcaagaggggacggcccaggagaaaacugaaacaggcuaggagacaggagaacaaacaccucugaacuguccccaggguacuagucccugacauguaauuuuucaucccaucuucacgucaucaugagggagcagcuauuuuucuccuccuguuccacuggaagacauugaugcucaaagcauuucaguaacuugcaaugacugaguuaaaggagagacaaagauuuagagaggucacaauagaaauaaaaaggaugcuacugccacccaagggggcaaaacaaaacaagacaaugcucgcuuugagacccugauggaaugaugcaauugcuugcaugugaacaagagauaaggccucccacccaugcuuucauucacuauugcuugaacaaagcaacuuccuguggcuguguuugucugugugccaaagcaaguaguguccuuuguugauccgucuguaacaccugaacgccuauaaaagacuagggcaagcccaaggaggauaaaggucccuuuccaggccuucagacuguucguuccucaucuggucucuuuuuugcuguccccaccuagguaugacuucauugagauucgggauggggacagugagucagcugaccuccugggcaagcacugugggaacaucgccccgcccaccaucaucuccucaggcuccguguuauacaucaaguucaccucagacuacgcccggcagggggcagguuucucucuacgcuaugagaucuucaaaacagguuagugggguugaguagaggccauagaugggugucuuaggugaggugaaacauagaaggaagcccuggucgauggaugauaucagguggugagggcuucagucaucuggccccacuaugguggcgggugaagugacaccuacagugagccugggguggucugaggagacucugguaacgccuugauaauaaaaggcaggucgagcgacuuccaauuugagaggagagaugaagcaccagccuaagaggaggagcccgggguguacauauaagaacaucucuuagaagaauuggauuuuuguguuuuuuaaaucaagcagcucuucaugguugaacuugguugaacuucauccuaaccucuucaugguuuaauguugucuuuauuugaaauuacauggggcuggaggauauaaucuuuucauuguuuaggguuucuaaagaucucaccaugacccucagaaugaggucagucacugcuuuuaaauuaaauuaugacuccuagacauuccuccuuggcaauauuuuaccaccccuauacacugaacuccuauuucccauaugcuagggacucagacacccugaaaagcuacugaaaguuaguggaaaccagggcagaaaacauaacacuucuuugaguugacggcuggguccuauacaucucauuaggugcucugggccuuuacgggcaggacuaacuucugaggcucaguagaguaguucucaucugaaugcuauguuagggccacacuucugcucuuccagugaugugcccucugccucguuccaguucucacuauggcuaaggaagggauggcccugauucuuccucaucguacccacucagggcaaucuucccucagaagaucugccuccauauuugcuuucuuccuuuaggagcccaacuucuguaaucccaacauagagucugauuccaggagaaguugucauuccaucauugagaaacccaagucuggcuccuguuaaguucagugcaaggggaacuauccguaauguagcugcuuucuuuucauuaaacaguucuuggaaggaagugguggcuguugaacacacguuuuauauccacucugucuaaguauuuuggacaugucugccuacaaagguagacucaaaugaagagguguggucaguaggcagaguguggagccuauucgcucagagggcaaagaccuacagauggcccaucugccaugcacugucauguuucuggccaugauaaacucaggaacugaucuaggugcccugggcuggggcugcugugagccuccugcauagcuggauccacgacucuuugagucccagugcaagaugcagaucauuaccgaugaacauccucuucuaagaaugugagaggaagaagaaaugaggcagauuucuuguccugggcuuguaggaaagacaaacccucaucacacagaucacuaucuguauuucugguggcaucaaaaggaaauuguacguguuuguauggcacaagucacggucacuauauuaaaaaugcaacugaagcgcacugagcaaggaaucucaggugccaaacuccccgcuccucagaaggaaagcagcucaugaaagaccuucuggggccuuuuaaguuuaucucuggucucacgguccauaucucagugcuccccacaguauggugccucacucuccagaaaggcccagaaaaaaaaaucccucacacaaacuugauaggagggcauuaaaagauauaacacacaagaaagauucauacacagccugcuguuuagucgacaugcagaaguagaauuuuaaagaaggcagcaagucugugaagagccugaaagaguagugccagcuaagguacguaggugacuugagccuggagcaaugaggcagcccacuggaaugagggggaugaccacugaaagacauacucuagugagugacagacccaaaccacaaggcugggagugugugaaagaaaguccagggccccccucggggucaucaggaagaguagcucuuggugugaaagucacuccuauaaaugccuagcacaggaaugcacaagagagagaaagucaaaaccaagaugucucagaagguauauauucuagauaggugccuugccuugugucccuauuucuaugguuacaguccugugagaaaauacacaguuuacaucauccacagaacauggaagaaauggguggacaugcugaaagaaacucaaacaaacauagcuauguuugccagucagauucauaaaaagaaagaggggaaacuguaaacacagauacgcaaacagccauacagaaggcucuagaagcuugccuuucugcaggcucugcuacagaguuacagugagacacaugcacccucaggcuggggcacacagagcguacggauggagugaaaggucacgucuacccuaaaggaaggauaaaauggcauauauuucaccaggcugugucaccuagaaaaggguaagccaagaaaaaguugcaaauugaaacaaucugaagucaccaaaccaggaacagaauaaggaaagaaauuuguuuuuuagaagaacuugaaagauggcaugagaaucacaaucagucagaaggguuugcugcuuuuagcagaaauucaaaauccaaauuucucuccugucuccaauacucagugguauuucugaaagugaaauugugggacuugcccaugggaagaggaauguccaguauucugagccccuaagauaaaggcccaacaucaccaccugcggucaagucaagcuugacuucugauaggccaguguauuuuuguuaucuuuguauggguuaggcuccucuuccuauacuuccaugauguaaacuauucuucaggccaaagacuuuggaaggaaugcuuugcuccagcccaggccccacaacuucaguuuuguguuguucugcuguuuuaugagccagagccucacucuguagcccacacuguccuagaauucaguucauaguucaggcuugccuagaacucacggugguccuccugccucaguuuccuagaauuacagugcuuggauuucagguaugagccaccacacuggcucaaaccuccaagagucaucuuaucaucgaaucgacaucaauguuugucagcuggguauuuuaaaaauuguguccuuuuaacauguuucgggaaaggauugugaauuagucagauuucugcaagacucucaguuugccuccauugccaggaucccuuuugaccugggguuuuugguugccauucaggugccuugaccauggugggaccagagacaaauauauaauuuuauaagaugccugauuuuuuucugcuugcaaaggauaaaacaauaaugucuucucaccacccucaaaacaagaaaggaauguaucuauuucuaaccauguaucagacaugcacugguuuuguuuguuuguuuguuuguuauuuguuuggccuugaguacuugauguugaaaaaucccuuccaguuacaugcuagacccgaugauccugaaacagaauguuuuagagucucacguucuccagggcccguauuaggcucuacacgcccauuguucaaacacuuuguucccccaaggaugacaaggaucaaagauucuaucauaaauucccagcucccaaggaggcgccgaguccccgugccuucugaaggguugacaauggagccagcucuaggagggaacucuccagaggcuaacucucaagucaguugugaacagagacuugauucccauccagcacugugugaggcucccugugugugcugugaagaaaucugcauagcagccuuaaacucuaaccuuuucaaaauucuucuuggcccccugaagaccagccagcuggccuggcuuucccaaaucacaucaucccaggccacugaggaagcccucaggaguuugcugccugcugguaaacaaagcugaggaagcagggaggggcaccccugcucaucccacccaagcuagcugcccacuggcaagguugggacuucccugcugcuguugugccacugagcgaaaggcaaagccucugagauguggccccuagagcuccaaauaacccaggaagguucuuucuugcuccugguccgcauccccuacacagcccaaggugcagcaaugacaacggaaggagguaauccauggauauagcuguagaugcugggaauucccuaugccgccugaacuacagaaaguuacgagccuaccccaaauacacauauaccuguuugcacgggaccuucuccaagucagauauuugcacuuuccagaaagucaucaugcauagagacuugcagagggcccugccugcuacaggagccuuagauaaagauguggucgcugccggcuaagaucggcauauugacaacccacaguuauauuucagugugaucuccagaggguacuuccugccgguaaacaccugguuuauugaguauuucuguguuguuuguuguuuuuaguuguuguuguuguuuucgucaugcuuagagugucuauuaucccuuuccuaaauucugcuuccuuuacuuauuuuaaaauccaaacguagugaauaaaaacuacuguaauugccagcauuugcacccacaucauuaacucguacucacucuugcucuuuguauaugcugggucucuguuccuggcucugcccagagccaacaguugcuggguuuaaagcacaagggcuccucuacuaugacuccaccucugggguugugguggcuguaauccucucuguuccugcugcugcugcccaagccuguagcaggcugcgauugugugaguguguggcauguuucaucaggaugcaucccaagaaagcuaacccaagagcuuaggagggaaacaaggccauccccaccacaaaggcaccagaagccuuccaaaugucaauacacugcugcauuuuuccagacucgccaccagagcggccuuuaacauccccaacgcccugcugugaucuaccggcugaaaaccucgauuguuaauugucccaccacuacagagcagcccguuuaauccagucaggacaugagggaggcuccagcuccccuuugccccuccccugaggcaccuuggaacuuggagggagaaggggcacuuagcuggcuaggguacaauagaggcuaguguugaggucagcaauaaauaagggauaacauuguuuucucugcuggcaaccagcaagccuuccuuaaggauugaaauaacuuacauucuggagugagcagcugaguaauugagaaagaagacucugucccucuuucaagaucucucucucucucucugucucucucucucucugucucucucucucucucucucucucucucacacacacacacacacacacacacaccccucuuuaccucuuacccuccaaucccucgacuguugcucuuauucuaauauucaaagcaaucggcugcacuguccuaauuucuguccaaaagggaggcuggcuugaggacuugaaacacagagggcaaggauguguuguuccaagugcuacuugaacagaaauaaaaaccuuguuuagacaaggggacauagacacaaacauuuaaauaacccaaaggcagaggagagagcagagaaaggcuacucucuaauaacuucucucucuccuucucucccucucucucucucucucugucucugucucugucucucucucucucucaggcucugaagauuguuccaagaacuuuacaagccccaaugggaccauugaaucuccaggguuuccagagaaguauccacacaaucuggacuguaccuucaccauccuggccaaacccaggauggagaucauccuacaguuccugaccuuugaccuggagcaugacccucuacaagugggggaaggagacuguaaauaugacuggcuggacaucugggauggcauuccacauggugagugaacgcuuaugcucagcucccuuucuccuucuuaugaaggucaggacucuaaccuagggaauaguagcacccaaagugggcacaucuucccacuucgauuaacccagucaagguaaucccccagagauauacccagaggacugucucuaagaugauucuaaauuucaucaagugaaaacugagauuaaccauuagagauugcaaaacuauaaguguuguuccuuucuacauaaguuauuaaaauagaagugaaucaauuaucauaugauguggccguauagaaggauuuaaagccaaagugacuggacuugaaucucucugacguacaacccagccaagguauugaaccucucaguauguugucugggaaauaccuaucaucacuauuaucacgaguacuauuauuuuauuacuauuuaauauagucauggauauugaaaagcaagcauuuauagccaagaggggccuauauaaaucaggugaaggacuaacacagauuguguagucgguauuggaaauuguucaucuuugugcuuguucuaaguauuuucuaauguaaaggauaccugguacagaggagcaauuucaucuugagaaaagcauaagauguagguaggcaagcagggauugggucccagcucugcuguuuccuaguaaugugaacaggaaaaugucacccgaccuucugaaauucuauuucuucaucuguagagcagguacuguaaugauaccuucuggcccaucuuucugggauggaagaacagaacaaagccagcucagggaaagcacuuuuaauguucagggggaauaucagacaucauucuucaagcacaccuucaguuuuuacaucaaggcauuggcagugagguccacgguguuguggagugagaaaacauugaaagccaguuugagauuucucugacuacucucuaucuccuauauccaguuggaccucugauuggcaaguacugugggacgaaaacacccuccaaacuccgcucguccacggggauccucuccuugaccuuucacacggacauggcaguggccaaggauggcuucuccgcacguuacuauuugauccaccaggagccaccugagagugaguugaccauuggggaaucuuugucuuggcuucuuucucauuagggacagguguacguacagguaaagggcugaccucuuugaaaacaguugacagaaaugcugaagauuuuguggugcuaucugaguucaaggaaagucauguuuuccuucccagcaaagaugaaugggaaagggacaaugucuaucuggguucuuaguuccuuauaaaaccaaacaaacacacaaguacgaguuauucccagaaaaagacauaggacuaucuggagccguccuccguucccucguccauggauugaaaaguguccugaggauggugcacaugcugucuaaccuuuucagguguagaucaguuccuccaucuccagaccucaaaagccauugucaaaaaacagccacguguaacucacuguuacauaaaggucuguagcuccacggagaguuucucuggcucgacuauacgaucccguaacuuccacuucacacuugcaagauagaccauuuugggagcuucuacugagugccagacccugugcacagcaauugcaaagugcugcggugagcccagcuguuguggaaccuaccacccgagccacuggucucccauccugagucccauuuucaagccaucugcucccagcccuguguuucagacucacugccauggcugcuuagagacacaaaugauuuccugaaaggaaaaaaauaaaagaaaacaaaaacacccaagcacuuucagaugaugagaacugaggagcucccgcuacuguuguggacagcucaccauccauguaacuacagacagagcagccugaccugccaggaaaaugagcaggcuccgcucuggguguuugcuucuguguuuuccaucagagucccugaagagugcaugagaaaccacauagcaagcuauagcuggcucaguaaauggccggugcauccccagagcugaagaauagguuugauaccucagaaggguggccgguuuuuaucaaacgcaugacuucugcaaacacugaucauuguccacagcauccaggagaaggauggcacuuucucugauggcauaagaccagggucagacuccuggaucuguuagcccagccguugguguaggggaacucaauggggcgugcacguccucacggagaaguuucccacagauggguauuuauacuuuguagugucugucuucuaugccagaaaucaggaaacacuuggcugaaagagagacaugcaaaagugccuccuggguguggguuaauaagccaggcuucccacaauggcucagcccacccaaauugucauguucaccuguaccacauggcuggugcaucuggcaccucaaagcauccacagccugcagcacucguguuuuaggugguauuuuuaauuuauaugaugauucuuauuuaucuaucaucuaauuucuucuagguccaauuuaguuccuugaagacccagagggguuguuaacuaugugacuuaguguaguuguuuuuaaaaugugagcguauaauuagauucaagaugagggagugccuguaaggacuugucccuagaaggaaacagugucuggggggccccagaaguuugauauuaagaugucuaacucuguccuugaccgaucuucacuccccagauuuucagugcaaugucccuuugggaauggagucuggccggauugcuaaugaacagaucagugccuccuccaccuucucugaugggagguggacuccucaacagagccggcuccauggugaugacaauggcuggacacccaauuuggauuccaacaaggaguaucuccaggugcuuacucggauacucgaggggugggaugagaauggaucugcugaugggauagugauguguucccucggcuagagucaaaagaggaugcugaaaaaucaaaugcaugagaauuguauccauccacccaucacccauccaaaaagguucuaugcugugugcugguauaaagugaugaguaagaggaccacuugcucuugccccuaggcagauuagugggcccauggagaguugauuggccaggauacuguuugcccuaucaguaucaaaggaauguucuauaaauaguuccagaucguccucauucuuggcacaggaaggcaucugagauguggggagagcguuuuccugaaggcagguuuguugggugcuagcugaauauggcaauuucuucugaucuuugcuaucuggaaggagccugccaggaagguuuuacacauagcuaucagagaacacaugggaaaaugucacuacggggaacgcgacuagaguuacccagaugcucggcagcgucucuucagacuauuguuugcagucuuccugagcaagucuugcagcucauguugaguaaucuuccugcacugcacacggguccagcucugauccccugggaauaaguaaacgggaagaacaaacugccaguucuauacuagggcaacgucugcuuuuaugacacacacagacagccuugugacccauuggcaagccugucccagcucugaugugacauggugaccucugcucuaagauggauacugcuuuguagacaucagggcagggagagcgaccacuuagaaacuccagggagccacggaggcucuaagaacacaacucucaggccauuugucacugucucaccccucugccgcuccaaaaauccuuucaucuugcaaagcuucuagaaaguucuuuguuguuacagucuguuuucuauauccuuauguuugccccuuuauagucuauuuuucacuauugcuaucuaccuuuucuuguguacaagaaguuacuguacauuccuuuugaauguuucaugaugccgcgcacacacugaguagccaagaagugcuuacuuaauugccuuucaucaguuugcacacaguagcucacauagaggcugccauuaagaaagaccauagccagcagaggaucaacauccaguaauuuccaaauggguuuggcauugucagaggggagguaccucaacuguuggcuguccuccuuguagggugaaaggucaggacuuggugcauaagccuaauuacuugggcagacucugcauguccuuugaccccuuagugacccaagugauuauaggcacaauggagugagggaauaaagguugaaaagacagcuacggauugucacuucugggggcuuacagugcauugcacuggaauagaguagaguuuugccuaucaguguuccuuuaggacacuucugccuucacggucuggaacagaccauagguuaaugagaggucauaagucuuaaguauucaguaguuagaagaaacuugauauuacccauucagauuggcaaguggaagggaaaccaaaaaaauaagcaagagagaaagagagagagagaaagagacagagaaagagaaucaaguugcaguuuuccagggaaaaugcccgugauguucggaaccaguugacuuuagcugucuaguggagucacuugacuaccugguuacaaacacacagucagguuugugggcuuaacaugacaacuguauccuuugcagacgaggucagauauuguugggaguagugguccccuuauucucugaccucucuucccagguggaccugcgcuuccuaaccaugcucacagccauugcaacacagggagccauuuccagggaaacccagaaaggcuacuacgucaaaucguacaagcuggaagucagcacaaauggugaagauuggauggucuaccggcauggcaaaaaccacaagguaagcuggcuuccccaagaaggucgaagagcuucaggaugaguccaugcuaggaagagccuuguuuagcaaggcuucuagaacuguuggaggcaagggauacaccggccuugagcauuuacuuuuucauguuaaagugauuggagaacuccagcugcugcugcuuucugcaaaaaagcagaggagaaaaaaggagggggacuuuacagaguguuaccugacuguuaaugaaggagaaaaaugccuaccucauuccggcuaccccacaccucacaggacucauugagcauuuauggccugagucucuuccccaugcugggugaacaaucacaaaacugcaugaaaugccaguugaggaguuacugaggucugggaauaaaaggacauaaccccaagagagucccagugucccugagaagaaccaggacaauaaguaaugagaagaaaucccauuuguugggguugggaucugaauuggccagcaugauuaguggggaagcauuguauccucucggccggugccuucagugucugccguucacagacaugcgguccacgugggcgaugcgaggcuuuuguuguauucagggaugagugucuggcacucggcacucuuaaaaacacguggcauccuguuucugcagcuggcagugagcugcauuuggcauauggagggcucgguggagaugcuccgucuucaccugaguggggaugggugccucugugaugggaacguagcucucggugauccuugaaaacccuggugaaggagacauaccgggcaucccagaggcugcugacccucccuuggaagagaaucaagagagauuuaaaaauaggucuguuucucuuccuuggcuacgguuccaucagguucuggucugcaaagauguaaguuaucaaaauaagaccaauaagcauuuccaaaagggcaccucuuuggccccugucaccgucccacggcaguaugcucuacaaccacacauagauuuaaaauccuuggaccuacaaaauucugaccuauaauguuggcagucucacuuagaaaaugugaguuuuuuaaaggaguaguuuuuuuuuuuuuuaaucaaaaaucgccauaguaacauggcaccauucauaugaaaguaugguuucuagauaucaccagcaaucucucuuauguacaagcauacauugcuucacaggcccaguaaauaaugugaaaucuuuagcaauggaaagauccucaccuuuacccacaggcuaggucuggucucccauugccuuagcuuggaaaggccggauacugguuagaagcaggaacugaaucagcacuggaggccaggggaagucccaagagcugaguccucaucucaccccauucccuuuccacccacguuuucucuccccacccacauuuucaauaagaaagugcuaaaaccugggagcucagcuagcaggugagggagggccagcagccagguaggacagauccugggcagaagcacgaggcuccccugacugucuccugguccagguucaaugacuaagcacugcuggccagggggaugccauagcauaagcugauuuuaaaagcacacagauggacugggaugcuauuuaaaacaccauuuguaggaaagcugcuuuuggaaauaccuuagcacugcacauuuugauagaacgccauccuggcuuuaucccugcuauucaauuuugcagggaagauauucccgagaacugaauugagcuuucuagucuccagacugauccucuucaauguccccgugucgaauacauccucacugucuucugcauccccuucccaccuuuggcaaaaugucucuccccaguaaccaauggguaacuugggaggaaacucuuguuugaguuucugugcucgaggaucaguuuugcccacauaagaggaagugggacagaggaaaagcccucucucuuuccucuagaaagacacccuccugguacuuaaaacgaggaagaaaaauggaaagccugccaauuaguguccagcucccucaccccguugcucauguggugggaggccaagaggccuuccgguccuccuccccugcaaagaugcucucugcagccuguucguuaacaggucucccccagauagcuguguuuaaugugcagcucccugggccgcugagguugaaauagcugagugaaccgugccaaauagauuugucaaguucgccacagcuugauuuggugccaugacaaggaggcaggaggaaggaggggacuggggggcagugaggcuguagggaggaguucauccaugcugguauuaccaccgcguuucucuuugugguuucuggaugcugggcacggugccaagcucucugguguucuguggugggcuugaaagugaaauucagacagcaggacuuagggagaaggcaaaacagaggaagaggcugcaguuuucugggcucuagagugcagggaaagaacuggaaaacaucuucccagggcuuaggaaguagagagcguguugugacauuuggggcacaaauugggaaacucagucucaauucccugaucacugucaacaccaguggagcauaucagggagcagggaacuggagaauccagagaaaaacaagauuaaugggcucucaaggugguggggaaugauuugugcucuaucauggcaauuucucccagacugggcaaggaaaggucgaagccugggagugucuuucuuuuugcuaccaggagguguggaaggcuaaaguauuccuuuccagacucuccagucagugaccagccucuuccuagccuuuuuaugguuaacaggguauucacgagguuccggugaaaaaccugaucgauguugcuagugguucaugagcaucuuccuggcaaaaacgcagccugcuuaugcagaccacaugcacaacacaucccccaguccucacuggguuucacaugccauaaauauggaacccaugaguuuuauauaggcggggccuccuuaugcauauuuauggugcaaccacaaagcagagcgcuccuccucccauuagagcccauaaccaacgcacgugcucccucagauuauacaaaugacuucacaugagucccucagaagccacagcagaaaugagugccuuuugguuuuuccagcugugugaguagcaucccagagauaggugcuaucauaacaguggugagagguuucaugugcucggguacaaguguguacaauuacagauguggguaugcacauaaacaccaacugaugugcuuggagaacaguggggacagcuuaaaggcaccaguccuuggugacgcuccuuccugccucugagauucuaauccucuaagucuuugaccaaguggcagucuaugccugaggaaugaagacauccccuuaucuaugguguugccaggcaggguuuuuuuuuuuuuuuuuccuaguuggaaaaaaaaaaucaacacaaaaaaacaguuguucuaaaccccaguggccagguugaggauagaaaggaugaaguaaaaccagccuccagcccaugacucugcaaaauuacccaauaauacgugggagggacacaccgagaucacauuaauguaaggacaagcgcuaagagauucuacaggcccucaggcacagacuuagcuccuucagaauuucaugauguuucucagguggaauugcaacucucuagagucuaagcaacuugccccagggaugggggugggagggguuuuggaguccccaggagaggcuccuggucaccaggcucagacacagaagcagaugcucucaacaggcugucuugcuucuugccuuccagccacagggaaaguggcuuccuuagcagcucugaggccuacaggugugcguagccuggaguccuuguuuacaaagggagucuaaugaggacagugcaauucaggauucaaggcuaagcauuguguugggaaaccgggcuccaucgcaggauccugaggauggagaguugaaagaagcugcuguuuauuugguuuggcuauaucccuccaaaacaagagccucugcuuccaaacgccucuguccuguauuuauuuucuuaauuaaaacaaaucauuuuguaaagcagcgcccuggaagaaaagaguagccuuagaaagccacaucgccaaccccucccuggcaauguguuggaagcaugggacaucugcuguaaaucuccugggacaauggacggcacagccuugaacauucccuucccaacucugucuugguguucccaguggaacacugcagcuugccaucagaggagcaccuggccaucugcagagagagggugcuccucagaugcaaucaacggguuaaagcacaaagcuuuccuugagcagagaugcaaguugucaguuuaaaaaaaaucacagguccccaagggauauauauaauauaagcacaguccuggaagggauggagagaagucacccaggccuugcacuugagcagauaaauguccccucacugcuucuguuuuuuuauuggggaugguuauuccuucaauuaauaauuugaagauuuuuuuuucaaaaaaaaaaaaaacauccucaugaauucuugucaugauucauuccuuuugugguuugucauuuuguuauucuuguuguuguuguguaaagauuagaaugugaaucagucuucaggcuaggauaggacauugcuguccaaagccaugcaugcaacugcaugaucuaaacaugguuacaugggcucugaagaggacaggugcccuuuccaaguucaagucucccaguuuguacaucucccuccauuaggacugagaggaguccagugugcuggguaauucaguuugucccuuauccauuugucgugggaugagcucagaccuuuagccucugcacuuaggaagcuggagggaaaauuucauuaugcaugcgcuugaaccuuucuaugucaggcugccguuagccaacuucccugggucuccugggugcugaacugucucagagcugaggccagccacccuggcgcugccaaccuuggugcuggauucuuugugcuccuaggccaaggcugaacacggagauucugggaaagaaagggaaacagacagaacauugguguggcugccuuaaaaaaaaagugcauagacacugauaucaggaagcucagaugcagaggccucucaugcccugaugaggcaucugccuucaucccucccugcaucuuccaugaaugguguauaugauuccuuuccagccuggguccccaaguguccuccucuccugucuucccugaugcuuuccugucucaaauccugaaacccuaauccuguuaguaggcuguguuccagggcucagugucuccaugggaguaacauaauccugcauuaaauguagaggccccacaaggcacacacagauggggauggacacaacccacccuccgccucucacccccccccccaaagaagcagccugaugacaaaaacagccuuacaguaggggaggagaagggcagaggccaucacgggcacaaacgagcauuugguuauuaaagagcuccuuugcccuccccucccgcucccuuagauggaauagauagauaaauagauagauagauagauagauacauacauacauacauacauacauacauacauauguacauacauacacagacagacaggucugcaaacacacacacauacacacacacacacacacacacacacacgcaugcacucgcacaaaugcaucccuuuuaacuguaucucacuaaauccccacauucaccaaaaugaaggcagcuugcuuuaaaauuuuccuuauggccuuuaagggaaauuuucuaagggagaaaaacguuaagacuaugauuuacaaacaggacaggaaacaacaaaacccauucccuuaacaucauuuuccccuagugccaaggccccucucucccuccaccuugccuguuugguacaucaaauuaauuaaaugagaugccauucauugauuaaccauuuauuuuuuaugggcagaugugauggcugguuuagaaagaaaaagugagacaacacaacgggggucggggugcuucuguucccaccucagcauaaguuacugcuguucaaagugacuguggcuucccagguucccccaccuucuucuucugccugcccugcucuccuggaagcugagagaguucaggugcuuacagccacauagaaguaaacaguaggcugagccauauguagagaagagacagguagaauauggaagcucuucucacucugggcaccacgcucgcauggagagcagcuugcccaccagugggcauccucacuuaggaagcuugcacagcuacuagaccugaauggugucccugcucucaggugcucaauggccuucccagaaucuucuccuucaccuguuaggugggcaaaaugacccauugcaucuauaccaucccagacauauggaugcugcagcagagaugaauaguguguaggauaggcucuucaaguaggcugcaaagcucuuguccguacuuuaaaaaagaaguccagcgaaagugacaugacuacggcuagaaaugggaaagaaacagggcaaggagagcuuaaaagucaucacugauccugucuugcucgaagaauggaaauuuauauauauauauauauauauauauauauauauauauauauauauguguguguguguguguguguguguguguguguguguguguguguguguguuuucuucuacauuauauuauauuguucauaaaauccaagccuggauauugugagcacagugaaucuguguggacuuuuccuggggguguuugauggcuagcagcugauuuacuuggcaggcccuuccccucccccagaggugcacaucagaaauccauuccgugcugccgggcuucagcuucucucccacugaaaacaaagcagaggccucaagaaucaaucugaaaauguuggauuauguucagaauucagggaggcaccaaauggauuaccaagccacucugugcccugaaccggcuuuuggacuugguuuacacagaugcauuucaagaaagcucuuuauucaacauagcuccuuuaaaaaccaaaacgaaucaaaacaauaacacauauauguauugaauuaucaaccuccagaaagauagagucagauugaacacacucaugguuguccuuugggugguuaaguaacuguaguagucuuugaauaaauuguauaucuccuucaacuuguagcuuuuuaaacagcuguuaaaauucgaucauugugcuugaaugucuaucuggguauaagauacaugagcagucuauagcauuucuaacaucuuacugccaagaucuggcuugacaguauuugagcacaagcaggaacuaggagugaguggucucuuaaacuugaacucuucccaauuguccaaaggccaauuuaccauuuguaacuuaguuccugcuccaacauuugacuugggcauuguacaggcacuggagaaggucaccagggcugguagguucuaguaucugccugcaagcaucuaaugacuuuaucuuccuagaggagaaauuaaaguaucuaagguuauugaucugccuaucgugauuuagugaaucggcagagaacagggaauaaaaccaauuugcuggcaccacuucccaggcacaccaccccuuacuuuccauugccuagacuggaagccaagaauccaucuuagggaauuugaucagaaaaacauaugacgggugauucuaaaaccacagaagcauugagaaagucauaaagauguauaauauaugauagcauuuacuagcuauaaauagggggggaugcaaggagaaaaauagagaccuuguaaauccauugggucaggagaaauagaaacugcuuaauauuucauuaaaaauggauuuucauaaauuguacuuugauaucuuugggccaaaggcagugcauaaggacuaaggcguuguuauucauuacucuugguuauuaauaauuugaacuguuauugaaccaacacaucaacaagguauauccugcccgugaauggaguauucaccauauguucugggauugaauuaaauauccaaggcaauugcccacaaaagcacuuagguuguuaggaacaaugggucauucaagugcccuuuuacaaaguggauguucugagaggaguucaaaccaugaagacucuuguggagaaaggcuuagagucugcuggccagccagggccuagcaaaucaacucauacagagcccccacuuaacagugaaggacauuguggccccaagggagacggagauauuugccuaccuuaugagcuaauuagcagcagagccuggcuccaggcuccugauuacgugacaggguuuguuuuauucucucugccacacucagagugaaagguguggagaaauuuucagaaggaugaugcuuccccuguagagagucuggacucagggcaggcagagaugcaaggucaaaagccaaaaaagcaagcaggaagaaacuaaacuuggaaaugugaagaauaauuggaacccaaauucaacgggggcauuguuugcuuccagagauugggaaagaaugagcaaaauugaacagcagacuagaacuccaugugagacacacagaucagucaugugcuugucucucauccugacuaaaucuacuagcgguggaguuugagggccuucauucaaagcucacggucacaugcgcucaaggggagaucauccucucuuggcaggugcauccgagugugugcacuccagggcccacgugcgguacauuucugccuacacugcccaccucuuaggauacuccagguagucaaucauuuuucuaggaaaggagggucgagaguuaggcacagagguauguaugugcuugcaaucccagcacucaagaagcuaaggcaggaggaucucaaguucaaacuugacuaaacuacaucauguauucugggccaacuugagccacaacguaagacucuguacagaaaaggcaaaaggaaaaggagaaaaacaaaacaaaacaaaaauagguuuccuagaauuuuaugcuaaggcugagaaaucagggguuucagauaagauaaaauuggauauuaaaaaaaugcauaaaacaugcuguguuucuaaaugguaccagcaugguguguggguugugaauuagcagcugugugcaaguucaaauccuuucagcucuccaguuacauauuuaugugccaaccaaagccaccuccaauaggaacugcuuaguaucuccugaugaaggccacacacagucacuaucaccauccuuggggaacauccagagguggcccccauugcucacagcacccaucuagagucagcaaagcauuucauuugcugcucccuugccaaaacaaaacaaaacaaaacaaacgaagucucuguugcaugcuaaacucuagaagaacugauuuaucucuuugacuuggauucaguuccucgagcccuuuccucagcgugguagaaucauugucaacaugaaggaagaaaugcaaauaacaaggccaggucuuuccuggaucugguucuccacacaaugaugaggaucugaaagggucagguggcucuccccacaggccuccugccaagugcugguucugggauggcucccugcagguccugccucuuccuagccuugucucuucacucccugucugcagucacaguaggggcagcagagggaucaagccugggcaagagugguccuucucccuguuagaaaagcugcagagggggacaugaguugccuuaggauccagcauaggagagcugccuagggagaagaaggaacagugagcagagugguugagcagaauucuugcagauuuggcggguuucaucuugggggguuagcacaauggaccgaagacacccauuucguuguuguuauugcuucguuuuguuuuuguuuuuguuuuguuuuguuuuguuuuuuccuguguagagcaagcugcuuaccuaacuucauuugguuaugguggguaugaagacuccuacuaaucuguggaggguucuuaacugucucuauuuugaccuuagcaaauagaaaauguggagggaucaggguugccaaaugguaggguucacaguuuacagagcccaucacugauugccuaugugcuugcgugguacucugcugcucccaaaaccacucuacagugggauuguaaacucaccauggagucacaucacuacacuagccugugacuuuacuucuguucaaaccaugaugggaucugugggcaucaugacuccuagccaccagcuggcaugcuaagcuaaggguuaaccaaggacccauagauuggaaugucacagauccacacagcaguucccuuguaagugugauacucagucauuguguugaaagugucuggcuucauacauguucagcuauacuaguuuuccgucucucuuugccccaaccugucuguggccuaaacacagcaggagaaaaugcugguccaggaagauugaccgugcguaaauacacaagguccuguaguuguuagauguauggcaaacaugacuuagaaaugacagugggcugcuugguuuuuuccauccacccuuauccagggaaacuaaacucacauauucuugcucuaguuacuuauuuuuaaugaagaacauacagauacaugagguccauauggcaguuauugauuugggccaucugguaagccagggcuugugccuaccauguuaggucagaagcuacuccaaaaagccuuuccucccauaagagaggccccggucagcuggggacagggauggauuucauuacaggcugggggcuacaguaagaggaagcuggagcacuacucuuaagaggcugucuacaacccuggcccuacaguaaagagcauagggaaccaaggaaaguguugacugacaggagguacaggguagaaggcaccucucacccgcuugcucacucagaauggggaagugucuaaggaacuaacaaaaacaaaggugaagggcagugcagcuagaaacugccuguaaguagccccgugugccugccacaggaggaagagggcgugucaaguucaagcuaaugugugaggucugcuggcccugacagaugacaugucuaccuccuucguaaugacugugcuuuuccccuucucuuuauuagcuucugaaguguuuucuuuuucaaaucuccuuccucuguuugcucucagcccagaagcaaaauaacccuuccuuccuuccaaaacuuuuuuacaaaguucauccuuuguuuuccaguuagagcaggaugagaaacuuaauuuuuuuuccacagugauucuaaaacgcccaacacagcaaagccacuggugauguuuaggcaugcggagccuuccugccccucucagcggcgacugcucaaggguucgcuuuguaaacaaggauuucagugacacugcuuugcgucuugcuuugcagauauuccaagcgaacaaugaugcgaccgagguggugcuaaacaagcuccacaugccacugcugacucgguucaucaggauccgcccgcagacguggcauuugggcauugcccuucgccuggagcucuuuggcugccgggucacaggugaggagcaggagcggcgguucuggugaaacauggaaaucaauugcuuccuaggauucuacccuccguuugaaucuauaagguugugcuuaugugaccuuuccaaaaggaguggcucaaaggcucaagcccuaccauacuuuaucuguucauguauuuauccauccauucauccaauauguuuuuuuuuaagcccaugcugauuucuacugguuaaaaguuauugaguuauuugaugccagaaugcaguccaccauaagugugcuaccuuuuauuauucuuguugggauucuguggcauagguguugucacuguccucgcuuugcacaauaggaaaccaagaguuaaagaacuaaguccccaguuagugauggugccuugguaaccuagguaacaugaguuucaaauaaugcccucugcugccucauguacaaaccaagaucuagaugaggcacuauagacacaaugggagaaugccagacccaggccaguauaggcauacggagaaguugaguggauaaauuaauaacaagcaagaugguaaauaaauguaaaaucagaaagcuauaaagaauaucuggaaacggaaagggacucaugaucccugaagugcucuacagaagaccugacauagcccggcaggucaagaaauacuucggugaggaugaguuacugaggucagagggcagacaaaccaaauauuaccugcugaagagugauuagaaagcacgcucagcagugauggcugcuugcuuauuggcacuguagcaaaagaauggagagacagugcauaaggacuauuaucugaaggaauaaugguucucacaugggcuaagacucaagggcugcacaguggagaacaccagaguagaagcugaggccuuugggaaacugguacaaugguauaguuguacaaccauggugauuagaccagcaauaguaugaauauuuacaggucagucaucuccacucugaacuccaccuagacaggcaagcugcuuccuugacauggaaggauccucacugcccauccacccaccugccuaccucuccucaccccaucucugucuaagagcacaccauggaaugacccugcuuaggguuucugguucaagcacgcagucucugcgccuucucugaaucuuucaugacucucuccuguacauuaugcugccuguucuucauaaugccuaagagacucuguugaggacauuagacucugaaaggcaauaacuuaccccuaaucaucauccauccagaaggugauagaaccaagacuuguacccaggcuaccacaagcucaucuuguaggcaaaaugaucuuccacugugcccgcuguccuugagagggucagugaggaucugguguuguggauaaauugugccaacaacacacauucucagaagcccuggucagagccauacauucagauagcuaacagccacuguguacuuagguguaccagccucuauucuaaggccagcacaacagguaggccccacucagagcacuccuuuagagucgggggguucgauguauggaauaauuaaaucacuugaccaaaacuguacaacuaaguaagcugcagagugaacauaaaaccaggcauucugaguccaaguucaggcuccgaaccacaguucaaacugccucaaaaugcaagauaaaaugaauaagcaugugaccugacggccugacaguugcuuaguggguggacuccaauuaguaggucucagccacgacuucuaguauccuccuugucucuccuagaugcacccugcuccaacaugcuggggaugcucucgggccucauugcugauacccagaucucugccuccuccacccgagaguaccucuggagccccagugcugcccgccugguuaguagccgcucuggcugguuuccucggaacccucaagcccagccaggugaagaauggcuucagguagaccuggggacacccaagacagugaaaggggucaucauccagggagcccgaggaggagacagcaucacugccguggaagccagggcguuuguacgcaaguucaaagucuccuacagccuaaauggcaaggacugggaauauauccaggaccccaggacucagcagacaaagguaggucauuucccagagggguuaaaugggguacagagaguuggggugcugauuucucaucuaguagguaucuaucaaaccccaucagcacaacaaaucagguaucauccaagaggcaauguugcgcagggccugguugcuuaaguuagauuuguucuuaauucccauaaucuuucuacaaagguauuuuuggucacucacguuucagagauggcagaacuaaggcguaugucauauccagggucacacuguaugucgguguuugagccaugauucagaaaccaaaagucggacuucaaacccagauaccuaaccagugucuaacaugggcugcuuaugaaauuugguagccuucaaagccucuucuggaugaaguuuacaugaaacaggcccgacaucccaaggggaugugguugcuggagaccaaacuauagaaacugggaguuacuuccaaaaauaacuguuuuucugaauguuacacuccuucguauuuucuuagucuugauugcucagaucuuuuccugccucucacacugaguuugaaagaagaaagagaaucuuaugcugggauagaaguucaggccagaagagcccauccccagccaugggagaaaggaaggcugacccucacccuauaugcaaggaggcccagaugggagaggacuccaugccucuucccucuuuagagucaucuccugguaggccaggcuagcugguccucuggcugcagaagugcaggguucuuaacaagaaaggacuccucccuacaauagccaagguuuugcuuucuguaugcacaggcaagggcuaaguggaagguuuuacacugauauuaacuucuagaucacaacuccagggccucggaaagacuuaggguuuggaaaucagacccuucaaugaguagugcaggaacuggaccacagauuccccagugacagcuaaucaugacucaugaagaaagaaaugaucuuggccaguuucagagcaugcccuguccugcgccccuacaguuggcugauacccaggcaucccugaauguaaccaccucaacaacuguccucucccaaugugagggaccccacaguggcucuggaugggauccccacgcggcuucaauucugccagcaauuuuacacauuggugaucucggagagguuucuuuugguggaauugcugcugauagacaaggguccaaaagacgaucucaggccaucaguuuguaaccaagaggacaccauuaguauccuaaagaaggaguagccauuuuccuuucugacugucaguaaacuggaaacugcuauguauugggauccuuuugucccugugcuucagggaauugaauaaccugaaaguuauucguccaggcaggcaugcaucauaccaccaaccauacccuaucccauucaggauccuucuacauacagacuuccaaagcauuaggaaaagaaaacacuucuuuaaaaacugaaaacuaacuaaauaaauaaauaaaacaaggagucuggaaugguagauacagccaacccugucuuccuuuuuuuuuuuuuuuuuuucuggccaaggucagcuuaaaucucauuuggagcuuagaccuccccugacaauggccacucuaaugcucccugauuuccauaucccacggucccucauggacuuuccaaaugaacaaagaccuuggcuugagauaaagcucacagaggguaauacuaccacacaucaaccgugaagcugacuccuggguuaggugugcuugggggugugcuuggggaggagucccacacgggggcugaacaaccugucuccuugcagcuguuugaagggaacaugcacuaugacaccccugacauccgaagguucgauccuguuccagcgcaguaugugcggguguacccagagagguggucgccagcaggcaucgggaugaggcuggaggugcugggcugugacuggacagguaagggggggggggugguuccucuccaugucuuucucauuugaucuugugaucuugguauccuaggagggggacagagguagccagcccucgugaagguagauaucacuggcuaccugcugccuggucucugcuauauucuuggaccuccucugagcuuggagaaaucucuccagggaagcauuuuguccuuuaucaaggaucacgucaguucuucaacgggagucucucaaaaacaaaucauaaccacccaccacccacccaaauucaauuagaccccagcucuucaggccagggggcuguggcuguugauuuaggaaagaaaaacccucucaugauaauaaaguaauccguuuaugccugaaucuggccuccagaugucagcucagaggcagcauuuucguuucaaagcuacagcuguaaaaggcaucuucgcucagaagggacaguggugcaggggugcaucuucccaggcugcagcuggucuccugcucuuuccucacccaccaaguagcacagaccuggggcuagugccuccgugaauucuccuugugagggugaggccccggagcucccuccuggaaagaccagacgguccugagucaggcuccaccuagccucuggcuccugacccugcuucuuccucagagcuggcacagacugucaaaaggagcuucugggagucaccugaagcucaugucccacccagugccagcaggagccuccugcaggcugugcucuccugccccuccccaccagggccccggguaaucccauuuuccuaucugccuuaccugucacuggugggauggcaugaaggauuaauaagggcaugucagagaagcgcuuugggcucccagggagaaaaguguugcgggggggggggggggagagcuacaagagcccagaagaaaccugggcagacguacuggccaggaauggggcccaaguucacuucuaggcuuggaagugaagacacuaccuaccauggaaucuauacuaggagggagacucacaucucgccccauacacacuuguaaggguaaggcugaguuccccaaugccugaauguguguuaacugugccucaccaguauggaaaaauccacuucagacauaaacuaguuucauuuacccaccuuagacuccagguuuagacuauagaguuuuauccagaaacuuuuaggcuaguggauuccacauuugaucaugugcuucaaguuaaauggcaucgccguugcagcuccuuucauuggcaagcacgcacacacaugugcacacacaugugcacauacggagaaguucuugagcuccagaaugauugcuacauucaagccauucccuggccaccacuaggugcagagccuaggacaaaugacuucaucuuuuaccuggaaaauggggguggcaucaaaacccugcagcuguuagaagaaugguguggaguaauggugggcaggauuuaggaugucgcccaucacuggcaggcagguuacauacagauguaagggaagaaggggaucccaggcagugcucgaccugugcgcauccugcaggauuauagcucagacauuuaauaagcuaucauaacccauuucauugauuccauagucuacugaugagugugauacaugguucaaaaacaaaccacagaacucagccuacugcccuaguuucacagacugggaaacugagucucaggaagaucauccagugggcugagagccaagucacacuucccucuggccccuuugccuucugugccgugcgugccucucccaggcuggccuugcuuggugaccagcaggacaguuacugauguccucuucccucauugucccuccaaccccaaccugccccaaacugccccggugacagcaacagguuucccauuucaaaggccagcccugcucuuggaagaucagagcugggguguguuucccucugcccagccucccagucuuugaagucucugacaucugguuuuaauuuuggaggaccacugcuguuuggugaaugguuaccucggagcacccaguacaaacagugggcacagaggcgggcuccuguuuccucaauuugccucccacacccugcccacuugucaugugaucggccccucucuaugucccuggguuucacuucaucagcucccaccaacugcccagcuuugccugaaacuuccgguccuugguacacauucuucuaguuuuuaaaaucgccaucucugucgauaauucacccuugguuccuuucuuauuuuuuuuuucccugucccaaaaaggauaacagaaaaacgaaagggcugggcugaaccagucuggcuaaauaauuuaacaggccugcuuuacccguuagccaguuuguuuagguuucgaaugauuacuucuugccuugccgcccauaguuugcuuuacaauugaguuugagauucgaugacacggugacaaauuugaacucacaaauuaggacgcuucgagguuauuuguuauuuacuuugagcaaaaggcagacacggcaaugggaaacacgaaagguuaugugcguaguguuuaauagcagaaaggugggaagucgaccgugaaaaagcuuuucagcauauuuacccauuuccucagcuccuggcuuuacuaaauaguguccugaaaggugccccacaaaggcaccuuaaucguaugcaacagugcaaaggagcaugcacaaagacagaaggacggugcccucaccucuccccggcaucuuguugaaggacaccucuaggagacacucaccacucuguaagacaaagcuuuucagaacccuucccaccccacccagggccugacucacaaccucauucauuccccgaauaguuggugaaugagugacccagggagcaacuaaacaagugaacgaacgaacggaugugugagucaccuaccuggcccaggugggaaccgacagccuacagcguaggcuagguuuauuguguguuccuuauuauuaacacugcuuaugagcuaccagcauagaaaguuuucccaaggaaugcuaggcuucccuugcugggggaggggcuuuuggaagaaccagccagaguaggcuuucugcucucuggaccuuugucaauugaaucaagucauggugccuugguggugccuuugcccacuaccacuaucuccaccaugccuggcucuuuuggcuguggucagaacgguagcuguauccaguggguguuuuaacuugucagaccuuggccagaagguuuaggccaaacuacuuucaccuagccaaagucucuuuaaaucucuauguucccaucugucccuguccaugaaacaccaacacagccuggacuucggcuucccaagcugcugucacacauacagcuuuggugacaagugcuucugauuauuugauccguaggugggccccaaggaccagauuguuuuagagaguucauuuugauuccaaauaaauccugucuggcauagugaaaggguguguuuugagaaagcaggaccaguacgacucaccagcagccaugaagcggcaggcuguuggggccccguuccccacguaacagaaaccagcuucguggugcauggagauguuucuaauggcuuuggugggcuacauucauuuugauugugugcccugacacacuggccucugaacaaaauacccaaaugcaguucagcuucacuauggggucaacaucacccaaccccccaugguugcuacuuuugugcugcccuuagagccugcagugugggguucguguccauggcucuugaagcuucugccagagcucuagauuauuauccaaccaagagauccuugcuccaccaacagcucacagggugaauuuacagcucugugggcaucuucccuguccuccucacaaggccacgucuagagagaagacuucagguuuuuuugggggggggaggggcacauuguccccugcuggguggcagugcagccugcugcagcaauuaucuuuucucugguuaccuucacacagacucaaagcccacaguggagacgcugggacccaccgugaagagugaagagacuaccaccccauaucccauggaugaggaugccaccgaguguggggaaaacugcagcuuugaggaugguaaggauuggagugaacaucauauuucaucuuggguggcguggguacggaccaggcaagaacuucggaucccuugguuggaggucccuaugaacuugcagaaggauucagggagguaccaauacucagaggccugaggcagugguuacuagaaacacucagauacuguaagcguagcaggcaugguucuaccugacuauaucacaucugcagagaucacacaggcagaggcaggcugugaggcucugcagccaguccuucacagccccaaggggucuuaguguuuggaucaucucuucacauggaaaaucuguaucccccucauuuuaucuucuaaacacacccaaguuagauaaagucuguaacugaaagauccuaaauguaaggucuuacucuuucgauccuacuguucaucuccccguauauuagggcauugcuaagaaaccacggcuuuuacuacaccugguguuuugggcuggacuuuuaaguuugacagccucgauuuacaguaaauuauugaucauuauuaaauguucauuaaacaaaaggcgggaagauuggcaaggagacuugagaagagaugcagagauguaaauagcuguugaaaccccggagcuugcucacagcugggaggcaacauggaaaacugccuggauaguagggauagccacuaagaagaaugggaggaaagccaaacauuaaugcugaaguuuugggaaagaaaaaugauaacuuaaugcacaugcuuugggguguuguguggguaggggauacuguuagucaggguuaguugaauacaaaaucuugacauuuuaaugaacuuguuuuagucucauaaugagaaguaaagaaucuuccaagauggugucugagacagagagcuggaaaugaaacgcacaaggagcuaaugcagagcuuuaaauucagaguuagcaugucgggaggaaugggaauggggagucuaucuaaacggcaauccaaaggaaaauuuaaggguucugcuguaaaauuucagaaguuuauuuuuaauauaauuuuaccguuuacagcgguuuguuugauuugagguuucuuugauggccccucccuucuuuuuaggcaaagaucuuuuuuuuuguggaauuuggcuccugagauacuguauguguauaaacauuacaggggaauuaugguauauugaauuacucuuuauuuucgaauggaaaaauagacacgcagacauuguggagagaaaggcauggcgagggcugaagacugacuuucccaagccacagguugaugcuuccgugauggcuuccauguguuuccuuuccccucaagcugacuuuggcuaagggugggcaaacacugaauguucccucuuggggaagggggcacacaaguagggucugcuggcaacuauguccugcugcugagaucagcagaguccuuuccucugaaaccaagcuuccuccaccccacgguaggcaauuuguuucuacccagcugauguugucuuuagacauuuuagccagaauugagccuuccccguagagauuucucucugggaacuugggaagggaaguaagaaggccaagggccccacuuccucacugcuaacagguuugccaaggcuuuuccucugucgcuggcaaguguccaaguuuggcuucccauuuucucuuucuccaccucuguuccaccccccacuuaauuccaagauuaguaguaagucauacuggguuuucagaucuggguggagccccagaaaaacacccacuugguuccacuucuggguucaguuagguaaaucucucaacgcagauggggugagccauuauguggucacuuuuuagagauuuguggagaacauguucuucaccucgccugggaucccaacccacccuuuaggagcucugcacuccagaauaaguaggguaacaggcccgagcugccaggccuaacauauagaaauacccaucuuacucagcacugagcggggcaacuccaaggacagcaccugcaccuucacgaguaacaugucagauugcccaccacagagaggugaaggaucgcaaacaaaccagccuuguuuccaaggucacuuuccuugcaucagccagaaguuccuuggcauucaggucucucugggugcuaaugggcugccccaggacuucugagagccaggcuggcaggagaugagaugagacuuuuagggagccagccuuccacugaggcacuggggagacauucuucucuggcauuuagggaacagcaauuuucacauuugucugcucgccgagguaaaaagaggaggcugauuagagccugaagccauuugguggccucauuuauaauugcuuacuaugggaaccacuggcagacuuggcuuuuaugccugggaaggaugagaccaaagccugaccugaaagucagccaucgccaagaugucugaaaugcaagagcaaaggggagcccuucuuucucugccuccuacuugggucuugccagccauugaaacagcgcccugccgcccugccgccgggccccuguuguccaguccuguuucauuugccugcccuuuagucacuuuuuuuuuucccuuuuagacaaagauuugcaacuuccuucaggauucaacugcaacuuugauuuuccggaagagaccugugguuggguguacgaccaugccaaguggcuccggagcacguggaucagcagcgcuaaccccaaugacagaacauuuccagguaaggccauugagacauccuaugaaagauggaaagccagcuugcacauguuugggccccaagccccuugcaaguuucagaguuccccacuacaaggcaauugucugcucuuuaaccacaaaccaccacagacaucagcacacacacuggcuggucagugguuccuagcccacugagaauuucagcacagcuuggaguugcuagggagaaagagaaaccaggauaaaagagggaaagaagaagccucugggagggccuuaggagaugggaggaguucauuagugucccccugucccccuagccaccacuagcuacugucacauagcuucuugccaacaacaagguagguauuguuuccaaagcuguucacugggaaaacugcuggccuugauucugacucauagcucugggagaaccaccucucuuggagucagucaaggcaaaaaccugaaaugcugccauguacaagguaucacaucgguacaucccacagaugugaugccguggguaugucuuagcaaagagccagacacuuggccuguaaaaagacuugcugucagaccuuggcaugucuugauaccaucuuuuggccccaaagaaccagcucucagaagcccauccugacacuguagauagccacugcuuuuagccccugugagggagaaaggaaagguaccugcugguucuacugcgcaugcguuaacaauugccuucgggaaguauugaacaauagaccuuccaagaauugaaacaaagucccaaacuugcuugacaaggugugccacauucaguaguaaaaauacucuccccacaguuuagcuagggagccucagacugggagguggagcuggaggcaggcaggcaggcaggcaggcaggcaggcaggcaggcaggcaggcaggaggagggcuagaggaacguuuucccaugguacagguacaggaaacacaaaucaucggcagagugaaguagacugaaauaauuaagaaauguugaguugcggguauuuauuaauuuccuuuuuaaauauaauguaauagagcuuuguaugauuuaauuuuuaacaaugauuauauuuaacuggcucgugaaguuucagaaaauuuaacaaguggcccucacaagccaguacacauuggccuaaaaaacacuuucuuuggcuuccgauuuccacacaccuccugacuggaccucagaugcccauuaauaagccaccaagagaaaaggggguuaauucuggaaauuuagcagacugcauguugauggagcauacugggggaaggccagaaaaugaaaggggaggggcuucgcucuugcugacuucuucagcgcuacccucaccccauaugcccaugguguccucucugguccccaggaguuagagguacuggugaggggagauaagcucuagaagaacacuuggggccacuuuccugccacggcccacacuugcuuucccagagggucacagcaucugcucugaagaaaaacauuuucauauuucaaguguuuaucucuucagcauuggagugcuggcucagagagauuuguaucugaggaucaccacugccucgggcacaggagagagcacuuaccccagucccagcuccugcccccuccccccucucagucucugcaauaaugcuuaauuaauauaaugagccuccugcacguugggaaaaaaaauacuuauuuuuauaacccagccuggauuuuucauuucauuuccucuccuuugagacuggguccaauuaauuggugguuuuucccagcccccaucuugcucugaacguaagaaaggugaaugcgguauguguguauauguguuuacauuucgucugcaugagagauaaagaaggcuuggcuuggcugaggcacuuuaaauaaaggguuguacacguggacucucuguggggugagaggauuuaccaucucuuacccaggguccuuucgaauccucugacuuccccucccuaugguucugagguuuccucugaaggugucugaggcuagcccuagcuagaccacaaggccaccagugagcuagcuagaggcaguucugccagagcuuccucugccuccccucugccuuagccugcugcccucuccucccacucucaccugaaagccugcucccuucacccuugcuacucauuggaaacaacgguagccuuugcuuuuguuucagcugauucaucacacucugcagucagggggugggggcaugcuuuucagaacaggcagaauuccaacaucuggaugaauagauggggacagagaguaaauggcggccauaaggaacugcuggguuuaccguuguuccugccuuaagacucugagaaggaaaacaauuauuuuccuuuuccagaggaaucacucaaguuugggaaagggacacuugcaaccugacuccgggacacaaaaucguaauauuguucucagaacccuuuauccucagaugauuaaaaaccccaucgucucuguuucccacuguccuacuuacaaaauaccgaauuacguugcaagcagaagauagaccucuuucugcuuuggggugguuccuucuuguucuuucaaaagaaaaaaauggggccccaagggaacuagucaggagaaaggaaacagcuguugcugagcucagggcagagaggauacuaaugggcacagaaugacuggcaccucgccccaaaccugaaagccacugugucacccuacuuugcucuuccacaaagagaccagacccauugcucucuagaaggaugcaacaugccuuauccccucagugagugugcaaacagaagucaguaaauuccggaaaagauguaucucagucaaacacggaggaggugaggaugaagggggaagggggcgggucaggauggccaugccgaaauucaacacagacaguugaucgcaaguguccauggaaaccacuuacauugcuuagauauuuucugauugaguuguuuucucguguuuucuuuccuuuccuugcucccuuuuaagucagcaauuaguucuguuccuuuggcuagugguaaugguugcuccaggcugacaagacacccacugguuucauuccacuguuauuguuuuucaacaucgccuuucaagccacucagaauuucuuuuuuuagcucuuguggcuaagcugccuagaguguguucccaccacccccaccccuacugugcuccaaauccagugaccccuggugguagcagaagagccugccccacccucccugacaagccacuuugucaucucucugaagcuacaaugacauggggucauugguaggagagcaggcauauuuagaguucugacaaugaucagacuugggucuuuaaggaaggacacaaacucuccuugaaaugauugguguccaguucuccaguguugaggaaggagcgcccccucccacagcuguuuguggcuauuucuaguauaauuuuaaugaccuaaaauaguuucagccgaugcaucaguucugccguggcacuggucuuauuucguggaugcagagaccgcacuguccgugcguggaagcagcaucccagucauguauuagauaauaccuacuguagcaccuuaggcaguagcagaagaucaagcccccaauucuuccugaugcuucuauagcuugguuuagugagaaccaugaagcagggaguuacggagguggauuugccugagcccauucugcaaguguugcuauuuugauuuuccaucgaugccacucuaucucccucagcaacuaugggaaauuaacgagggauaacgcauuaaggacuacauggggucacucgggaauaguauacuaaguaaauagcaauaccaauaguaucgagacuuguuauugucguggucauuauuguuguaaagaaugagauaagagcugggccugcugguugcuagcguauaaugucagcuacuugagagaccgaggcaggaggauuggaaguuuaagcuugagcugcagaaugaguucaggagcaaccuaggcaacuuagcaaggcucugccauuuaaaaaaaaaaaaaaaaaaaaaaaaaaaaaaaaaaaggaaagggggaaaaaaaaggaaaggaaaaggaaaaaggagagcugaguuggagccacugguagagugcuugccuagcaucugggagugucuagagugccuaagucccaucccuagcaccacuggggugggaaggggaaggaggagguaaaggaagaagaggaggagggggaggaggaagaggaggagauaaggccagagacaaacaggauucugcccagugccucccgaucaugauccaaguguggucuggaacaugugcucuuucacuccggaaugugugcgcccuuuuauacagugauugaccugugacaugugguuacaaugcuccccgacuuugguaacuaaacgccauacaagcaucuaaagaaaacuggcaaacuuggacugggacagcacugugaagggagcuuugccccgcuuacaggaggcucagaggaaagcuaagugggaguaagccaagaauguaaacacucaaguuuuacccaugcuggccaucccuucaaauggagggcgaauacccuguuaacuuguuacugggguuguuuugcugcagacuugguugcugauaaacgccagcagagugggagaccagagcccugauggaugaaccuaagacgggcuugcuuuuuuuacuguaagcuagcaauggcucugaauuuaaaaccucccucuaugcucaaaagaucaggugacagcuuucaauucagacacugucaaaucaguagucucagcuuuccugaugcugccacccucuaauacagguccuccuguuguggugcccgccccccagucauaaaauuauuugcauugcuacuucauuacucuaaaucuaaugcuauugugaaucagaguguaaauaucugauaugcaggauaucugauaugagaccccaguaaaaugaucauuugagccucugguggggucgagacccacagguugagaaccacugccuugggaggaagguggcuaugguuugccuagggcauagcccuuaaaaauacuaagccagaaaacuggggcuauggaucgugauagauaauuaaaggacaggacgagcugagcugaagcaagcaauaaucaagggauaauuucaacuagaacaggaaagaauggggcggggggaggggauccucuuguaagacaggaggaaaacagcccuguugguggaaaagaugaaaacagagagaagcuguuaucccccuuuucuugaaaacccugagagacuggggugauauuggacggggaaauugagaacaaacuaacuagauggcagagcuuucuguggaagcugacacaccacaucgaaaaauaccuccagguagcuagcugccugcaaggacugguccggcugaauccuuaaaucccugccgaauguucuaucauaaaccuugaaaacauccugccgaguucauccaaagucaauguuucccuuaacugguuguuaauuugaagaccuuagcagagauagacugaccuugggaggccggcggaguggcugacucauguuuuaaguaugaccuauacuaagagacuccaucuccugcugcacuaaauauucuuucagaugguuguucuaguaggagggcaagaugcuagccaggagaugcgugugagggacagauggcguguuuggcuuugcaauagccaggaggaucaagcuggugauuuauuuugggguuggcuaaaggggaguagacacaauugaauccauugcaauugggccgaccccagucacgugcccagaggacacuuaagcagcugaagccagaugggaccauaaaucgccaggugaaauaucaagaggcccuuuuagagacagcgucaggugaagugccugagcgacccucuccucugcaccuccucucugcccuuuugaacuugaguuguucauucccgugugauuguuugcucugugucauuggcaacagcggacauuccgagucaaggacauagcaaaaugccuccuaaauaagucaggcccaagaggacagggauuuuauaucuuagggacuuuauuucuucguucucuuucagcagcuggguggauuuccuuuccauugucuuuuuguuggaaguuacccacugcugguguccuagcuaucagccacagaagaacgcagauuccuccccacccccacccucgccccccagggccagggcuuagcuggcugcuugucauauuagggcaacuucuuggaauccaaaagaguuccuuccuaaggaccaagggaauucauaaagcaacccugccccccacccgaccaugcccacgauucuuucaggcacugaguacuuggccuuucuuaguauuuaauggugguagcccauaagcuggaauauucuacaaggucuucacuuucagaauacauccaagcuugguaccuugucugaaugucaggacuuucaagagcugaagcacuccaugaacaaggacccagaaagggagcauuuaaagagaguaggguuguguuuccuggggaagcacagacuaaaggucuuaauugauauucucucucucucucucucccucucccucucccuccccccccccucugcaucugucuaucucuaucucuuucuuucccucucccucuccuuuucccucccccucucccucucugucacucuccuuuucucccucucccucuucuuuucuucuuuccucucuucuucucucucucccugucucccccuuccucucuucucccccccccaucucucccuucucuguuuguauuugaaugcaccacagugcacaaccccuggugucaguccuucuaucuugucugagacagugucuguuuguucaguggaguguaccucaggcuaucucagaaacuuccauucuuuuucccaccuacuuguagggguacaguacagguggguuuguagaccugugguuuuacuuccguccuggggucaucaggcuugugagacaaaccuuuuauacacuuagccaucuccccagcccccuggacuccuuaacgccuuaugaguaaaaugcuucuaagucauagaacggaaaugagcugugucccaucagggauagauggagcacguguguccacacgacagcaggaagguguuaaacugaaugugagauguucuugacagcuggggauguguccuggagaacacauugccaguguggccuguggagccccuuucugaagggaaggguggguggcauggagucaggauguuuccacauacuuccucuggccagugcuaguagucacauggguucccacucacgauccaagacacuaucucauuuuauuucauccucugaagauuggcacagaagaccugugccaaugggaggggcacaugauggacagcugggaacuggcugguuucuaagggaaagcaucuuauuucaaagaaugucaaugucaauaccaccacacccccaggaugaauccugcuucuuuuuguaucuugcacuggguucccagguuuaugguggucuuuagucuauggaaggcaguguguggcauggcaucaguagcuugacugagcucuugcuauaucccuguucccaugcaaagugcucuacagggcuuagccuuacaaccucaugcaguaauaccauuauuauacccaguauacagauggaaagacuaaggcuuuccaagacuuagagccuccagccaggauuccaccacaggugacaaggagccagcaaguuuacucagucccaucuguguccagagccuacuuccaucacucgguagcaguggaccuggaagcaugaccucauaucucugagcuucagagggaaaaugggcuugaugcggaugggggcacauagcuaauuccagcacuggagagcaucgggcaggacgaucaugaguucagggccaaccugagcuacuuagcaggguggaaggggaaagagagauagagacagagagagagacagagaggaugagggaaagagaaaggugauauuccugggugcacagggauggguacgaaccacagcuaaggguaaagccgugguguggugucugucaucuguaucugcucaguuugaucauccuuauccucugcuuuuuugguucccuuccuugugcauuuccaggucuguuuuuccuucgcgguuccugguucuaaucaggccucugucaugacaggcagcgauguuuugcagcucuggcaucucucugacugaugucccugcuaauuccuuaaauuuacauaucaucuuucuucccuggaguucauagcacuuaacagacaaguggggcacaaaugauuuaacugagugaaauccagaggccugcuugucuggagacucugcaaacccguggauuagcucagaugucagcgcugaauuaugauccuucagcugcucgugcuuagcacgccaccagcauuaacucgauuccugccgcggcccuguaaaucaugcauagugauuaccagccuacugugagagaagggaggagagaagaaaggagaaagacgcaggcucuggagacugcaccaguugucuggggacccuuuggccugguugaauucuaaugacagggucgggagauaagauagacccagaugaaaauccuugcagcccgccaucucacaccccagacacauuuggcuuucccgguuguaaccguucugcuaugacuccuuugcuuaagaaugcaaauucacacaagugacagaauuuccgccaagcaauucucaggcagcaagugggucuuauuugugaagcugugaagggagaaagcugaauaagaaacuucucgauucugcuuuccuuuauagaugggguggaaaggguaagggcuuggaaguuccaggagcgcaggggaucagggggacccucacuggugucucagucuacugggagccuccacaggugaccccaauauuagcuuaccucaucuuuaaaaggggccugcuggcucaggaaaacagucgguggcaaagggauugugugaacugaagacuuggcagaggcuagcagauucucucuucucauuauauaccauuccuucucaucuguguguuugccauucauucauuuauucauucaugggauaagauuucucaggguagugugauaugcacggacuaaggagaggagaaagaugcgauauucaaccuucugugugcaagacaaucugugauaggcgauugaagauggcucaccggguagaggugcuugccaccaaacuugaucugggacccacaugguggaaagaaaaaacccaacuucuacaaacaauccucuggccuccucaugugcauuguggcacacucuugugcacagcacgugcacacaugugagcauacacacgcauguuaaauaaauaaguacuuuuuuaaaaaucugagauauaggaaagacacaugacccuguuaagggugacagguaguggguagucacuauggaaaagucuaaacuccuuuuaaagguaagcaagaucaggaaggagggggugacuauugcccgugccagaaugguuagaaguuggcagcagagccaggcuagguggaaaaaaggaagagcaaggggcuucagggucagugaggcugugaggcaguaggcucaggggggagaggguuugccucggacagggagggguugcaaggauuuggggcaagaugcuuuugggcaacucaagaguuuacuguaggaaggugugggaucccucauuuaaguuuggggucucccuaccucugaaccagcauuuccuccuuggacaagacacuuaaaccuuucuugguuucuccaucaagugcaaaguaaaauuaggaagucuuagcucacagguauagaccaaggacgaggugauaucuugcguaccagugugcuuuguaaucugaaaggcauuaugcaaaucugaguuguaauuauuaucauuaauagugauagcaggaagaucggauguggaaacagaaggcuggaagaucacccuaugucuggugaugcuaucagcauccccuccucgucagaccccaucauuaaagcucuguucucgaggcagccuccccuuccuuaucucugccuugaacaagcugcugguggaggcucugugguaggcuuagccccucaccuaacaagauaaugccaacagguuugauagcaaugaaucugagauccccucccugagagggcauggauccaggcuucuggaacccuagcuuguuccagaaacgccagcaaacccaagguacucaccauuccuacugacugagaaccucuacuuguggcucagacuaaaauagcaccaaauuaacaagacccugaagugucuggccugcucacauucuaaguugguuacacagugaaaauaugucccugacccgcuugcagaggaguuuagcagaccaugacccaugcuucagggcccaagaucaugggaauucuuccuccucugagcguuugcucucuauacacaggcuggaguuccccaucuccauaccugugccugugaggcaaaggugcugccaaccauaacaagagcucagccuucugcauaaguaucagauggauuuaagcccagucugccaagaaggccauucuugaaacauuuggacagugaacccuugacuucccagaacacauacauucucugcugaagacacagccuuuguuaaugacaauggccauaccuuucuaaccacuggagcuguaugugaauggcugcuugagaaagucaaguccaggaacaaagugggauggccagcuacuccaucccugaucugcuuagaguugacuugagugucugcaugauaguuacugaggcuuaggcaccaucuagcaacccuggcagagacagaagguuuuuaaugucuuccauuuggacagugcccagccugacaauaccugaccagagucacacuccaaucuggcagccaccucauccuauaaucuguuccccuguaauucaguucaggaggcugcacuggcccauuggguaagccagagaugaguaagacaugggucaggcugcuucacucuagggagaaaagacaaguguguacacagccaggauuuaaaacugaccaccccaggggguguauaugaaagacauggcacagagagccgaaggggaaccagugugacuuaaggauugaagaaagggcuucaagaagaaugagcauuugacucaagagucugaaagggccuaagaaaagagcacaguagacccagcauaguggcacacaccuguggucauagcacugaagaggcagaaucgagaagguuguaaguucaaggccagccugaucuacauagcaagcuccaacauauuucaaaacacugaaaacagcccaacuccuguccaucuuucugauggagaggccacaguuacaaagugggguauuucccaagcauuuaccauccacguuuggaucuucuuccccagaugacaagaacuucuugaaacugcagagugauggccgacgagagggccaguacgggcggcucaucagcccaccggugcaccugccccgaagcccugugugcauggaguuccaguaccaagccaugggcggccacgggguggcacugcaggugguucgggaagccagccaggaaagcaaacuccuuugggucauccgugaggaccagggcagcgaguggaagcacgggcgcauuauccugcccagcuaugacauggaguaucaggugagucagggaagaaaaggggugugugugugugugcaagaggcaagggacucacugugauccccauuccaacauuucaaagagccugcccauucaucauuaagggacgugguuaagcuccgcuguuuucauuguguuucuuguguugccauggcaacuaaaugacacuuauuuguuauucagaaugcgccuaucucuacacccagacuugguucuuuguuccuccuauugccuuuuauauugcugaaaucuucuccaacaaauguuucuucucuccauuuuauuuuagauugcuaucagguaggccgacaaaaggacacagaagccagggaaauaaacacaaauguccccucuauccccaaggcaguggagggcucaggauggagguggccguggccgugccuucccagaccugcuccagagagcacggauccagaaaggggcguaagauggauaggcauccuccaucaaacccgagagccccaaacaaguggcuucucucucagcuucuauuaucucugucccacggagcaagaggcacagaugggcccacacaucuguacccacaucuuggguuagaguagacacacuguggacgagggcgcugaaaaccagccaaggcauuaaccugcuccuccccagaugaagagcagcaacagauggcuggagaggcagccaacugcucuuucagcuugccagaggacaugugcucguuugcagaaagaaccuggggagggcgagaaugaggagugguuaaagaccacagagcugaguguagugugcaggcuguagccacucacuucugagacuacaaggcauccggagacccuaacuccccaaccugggccccccauuuauuaaccuuagucccagggggcauuagaagaaccuguuagagguuuugucuccguuuuugucuuuguuugaguuucuccaggcagaaauguaucuuacuggauuuuguuacuaccucaucugugugccuaacacauaguagaugcucaguaaauuguugauaaaagaguaaauuauuucccugcuguuauaugaacagaucucuaagucagagugugaggagaggucaugcagaaggccguccaaaccuaaggaccguguuuccuuuauuaccaucacuugcucauguccucugaguucucaaauaccugcccugagcacccgaaggauuuccaggaaaggaaccucugaaauagcuagggaaauaucaguaccccucucccucaaggaugcuucaauugugguucuuuuaaucaguauguucuuguuacuggacagcaauaucuaucaacuuguuacauuuucuuauccucucaaauguguaauugauuugaaccaacucuucuuaaauuaagauuucaagagauggagccaugugguccacagauguguauguaccaggugcaauaacacacacacaccggaugaaccaggaagauuagcuaaucuuggcucuuguccuuccggcucuagaucguguucgagggagugauagggaagggacgaucgggagagauuuccaucgaugacauucggauaagcacugaugucccacuggagaacugcauggguacgugccuuccucucucuuggcgguuguuucaaauaagacauugggauaugcagaaggaagcaacugcugucuucacauuucccagagggucgggcugugcuagucugugcaggaggugaaguauagacuugguugagucuugggcugagggugggagggguaagacuaagacaugaggugaagguuuuauauauccaucucccaaacagaaauagaugugcauuaaguaugugaaaauuuggggugccgagaccccaucaucagacuccaguuuuuaagcaaagaaaaugcuagaggacacgagugccugccagucagaauuacaugcugggaaggguugauggauuuaauggaagccuucaguggugggcaaaagugcuacccgugcuauauaagaaugcuaacacaauuacccacgccauucuuucacaugaaugaacugcagggaaaauuacggcauaagaaaucaaauguuacauuuuguuuucaagcuaauauuucuaaugcucaagagucuagacuuguaggauuaagcauggcguaccagaggacccccucacuaucucuuuggucagaagugcuaagaaccagcccuccugaaaugcacacauuucugcccaaggcuccauccugaagcagggguuucccuaagggcaccccaacaaccucccauccuagccguggaucuuuccccaaacagaaaaggaauaggacucgcucccagccagcggaguugcuguaauaaguuaccaagugcuguucuuggaccuugggugucugugccuagugaugucagaagcaacugggacuuccccagucccccaagcaacucucagggcuugggcaucuaaaacuaaucccaggucugagaaaguaaucagugguaaguggcugauuacagugccuuggggaccuguuacucugugaaggacuuuuuguuccaaagcaacuugagcauccucucugcuuacccuagccccgugaugaugguaggcagagucuagaaaacaaacaggaggugggccacguucugaagcauauugccaaguggccuaacagacucaauugugucauauucguuaacuuuucucucuaucuaacucaacuuuuuuucuguuuuuuguuuucucuuucagaacccauaucagcuuuugcaggugaggauuuuaaagguaaaaaaaaaagaacauuuguuuugcauggcuuuuucucuuuccaugugaugugaauuugguggggggaguaacucccauuuuaacaaagcuugcaggagaaaacaaaugcuucacuuucucaccacuagguggcggcagcgacacccauagauuccggggauugagauccucaaugucucucauuuaauuaaagcuuagaaaccuauaauagagacaaauagguuacagauaaaccuuugagccuugcauuguccacucgggagcaaugagguugaaaaugcaggaguggugagaaaggagaggcugugggaagauuaacccucagugaggcguaguaccagcauucuagugaagauguugggagaaggaaaaaaaaaaaaaaaccugaggagggcugugaucuuaacagggggaaaggugcugaauucaaagcugguagagggagcaaggagguucauucucugacuagagucagggcacuugaaucucauggcugggaacagaaagggacacuuccucccuaagaaagcaacuagagaacaaagcaaaguagagggaaauugggaugcuugccucauccaagaaaagaagcaagggcucccagccuggagcgaaggguacauuugugcuuuucaaaugcagcggguuuacacucgcccuccacagucagucuggcugcugaugcugcccaaguccuaauacuuaagcucaguagcugcucuaagugcugagugcuccucugcaguugguggaccgcagcauguucacagacccucgcccagugcuuagucccaagggccuguuuggugccagccgugagagagcuguuacacccugucugugcugccuaggcuggacccucuaggugacagcauuuuagaaauaagauccccauuuuauauauccaaauucuccauaucuuaucuccgcucucaugcaucugccuaguuccugacuagagagagagaugagcccuuggcuugacaccuguauaggcucccugaauccaagucgcccugccuaauuugccauucgucccuagcucuaagaccaucaauacggaggggaaagugguagaauagagcucuggccgguguauguuuugauucuuauccucucuccugcucccccaccacauguggaaguauugugcauccaugugcacaccuugcugcucccugggguguagcugugaacgcaaagccugacagggaaaguuaaggugcaaacggaacagcuuggacuguuagagcuuggcgcucaccuuccuggugcagccuaagguuuaugcuggggaagagaagccugcucccgacucucuguggguuguugagccucaaagcucccugaaaggccaguaacugcuauaaaagcugugcucgacccaugucugggcgugacugacaggaacaacagcugaaggcuucacuccucugagagaauaaacacaccaagcgcacgugcucuccuugaaguugugugcggcacaaggcugcacacccaggcccuguucgccuguuaaaaaaaaaaauauauauauauauauauauauauauauauauaaaauaaagucucaucugaguggcaaaugugcacuuaggcuaaauaaacaccgggcucaguggcucgaagguaagacuucucaguauguucuugaugcuuuggggcuguacagagagggcuccaguugcaagcauugacucacggaugcagacaugacaaggaggcaaccaggucuuugggugcagagacuuggcucaagaacauuagagagccaagagcacagugcgaauuagaaguuucaaccacacugacguguguucugugacgcuucugggugcuagccaggugaaccugggaccuucucacacgucuccaucuuuacucaaacaaauggucuccacuugggagacaugacuuuuguucucuucaugggcaggacaguaggagccucuugcucaagacauaaaaucagcauuuuuacucaaaacagagaaucagaguaaaaucagauucaggcaggcaaguuaccaagaacugauguggggaccccgcuuacaaccaccauuugcauugcuucugugccuauaggauucggguuauguuccuuuugauuauaaacuagucaugcaggagaaguaauccuacucacuacaggagagcaguguguucuggguggaucuucagggaaaugcagaaguggccuuuggaccugugcugaugggggcucuggaucuuucuucguuugaaguaucuuugguuucugccuuuaacuggcuucuugcauugccgcuucaugugccuguagaccguguacguggaugugacuuaguguggaagagaaacuguacagagaaggaggaggcagaggaauugaaaacacuguguccucaugccauucuuuagaaagaucuuuuugucgcucauaugagucauguuugaaacaauguaacuugggugugcuugcuuugcuugcuugcuugcuugcuugcuugcuugcuugcuugcuugcauaagcagugacuauaaacauggugucgucacguaucuuuguucuuaagguucgagcuuuaacaaaugaaaaaccguguauaaagggaaaggggaaaaaagacugaaaagccguauaauuaaggugaugaauuauuuccucuugcucagugcuuuuuuuuucuuaauaaaagaaaagguaacaagcaagaagccaguaaagaaauagauaaugcccacagucaggauaguggggcuccugaccagguggauauuuuuaguagcuucuggugaagacaagaguuguuguugcuccuguaggaggcuguguguacugaaugcaguaggagcagaaaucauggagacccaggcagggcugcacugugaagguguucuugggcugcgguucccugaacucccuucuuauuaagggcccuuaaaggaacacgcguaugcucugauagucccaugguugugaaugugucuccagccguuucuaaggcuucugugcucucucuuuuggacucuacugugugccuuucugcugucccccuaccugccccccuccgauuuucauccagauacaaccaggagaaaaugagcaucaaaggccguccuguggacauggcugggaaucguuguuagggagccgcacauaggguaaagcugaggucaggcuggcaccugacuccaugccucagagaguuugaguuaauuuauuuggguccuacgggccaaucugccauuucuacucacaucucuuuuccaccaccacugucacucucacaaccugccuuccacuccaaaacuuugcaugccaguaagacaccccgucccuggguacaggacuggaugggccccaucaguguaucuuucucaucagcuucccuuuacucuacagugcugucucgcugaggaagcagaguuaguucaugcacauacgucucagaugaaguuagagacgcacccuaaacccccaaagccuccagggcuccagauaggcaccagugaugugagaaucuuccccgaugccccacccucauccccagcugccuaccugaggcuagguguugcagaguggaggacagggagagauguguggaaccacugugugcugcuugaccaccaucucugcccacaggacacggaggcacuguuugugaaguuugcuugcauacucagccucuucugacacagaagccuggcacaucccccuccccgcuagggcaucuaagcagcugccaggacagucugucaaagggcagcaaaaagcguuucuccccagcaucucucucuaacaacgcagccuggcaagccucaguuuuaagccuaaguucuagaagaggagaaguugcugcuucaggcaguaagggguugaauguugaggcauuuuagauagauggggugggggagagagaguggggaguccccaacguuccuguaggcucacugcaaaccuccaaugagccuaccucugcauacuugcuuguccaacaaauggaaaaaccuuuucucagggauacuuuaaauuuuagcaucccuuaaagagcaccggaggccuggaguucuuccacuagcuuccauauacuuuucuaguggauccaagcuuuuucucauguuuuuauaaucccacagaugaaacaaacggcucgccugaacugucccuucugcuaugccuguucucagcuggcacagaaaagccccccacacccacaguauaaaacagcucuuagguccagagaggaaacccacccuuggugccuuucauaccauuccuuggggggaugcuggguagcucuuccaggucccagugacauuucaugaacauagcugugagagacgauugcuuuuuuuuuuuuuuuuucuuucauggugaaucugcauuaugccaauucucugacagguucaggcagaguaggaggcagaagggagaaaaggcagcuuucuguuccugccuuacuugguuugaggaaaaucugcauagcugugcuaugaaagaccagauaauaaauaucccaggcuuuggagcacauacagccuuucuggcaagcacucugccccgccaaugaagcacaaaggcaacccccaaguggugcggaaacaaaugggaguguucaaauaaaacuuuauuuauaaaaauggacagugggcugcagcuagcugaggauuuugugugucuggcuucaagccuggcucagucacucagcagcaguaagcgauucuucagagagcccuggauuucccccuguguuacuuugcucucuuccuuaguuuucaaagugcucauccucuuaggucuucacauuccccacuuaaaacucauggaaaauaaagacauucacguagagcagcaaaccaagggcugacacgcuggaaaugucugcuguugucgauguucuuacagccacaucccuaauuauuuacuaagccggugacaguguuuauagacauaaacaggcagagcagucucacuccauaacagguaacuucuuuucacuuuucccaugugugacuucucagaauuucuuucuggaaucccaaauucuuagccuucacauuucucuucucuggggaguucagaacuuuugcagauggcagccugcucaaccuugcaaacgcacuuggaguuauugacuauuuaaguaucuguuucucauuaucucaaacaaugagaaaacuuuguggagaauuggggggguggaaauuaauaaaaaaugguugaggaauugaaaacauuuuguuuccaacugaaaagaaagaaagaaaagauuugugagcgagugguauaagacaagugaauguugggacaggcacugacgcucugggcaaggcugaugucucaucuacaauguuugcucacagauugguguagcuagcccaggacucuuuauuuaugaagauauaggcuggucacaccauaggagucgugggguggauaagacugaaacccaguucccugugggcccaagcaucuuuuucugcuuucccauggggcacugugagugggaagcacuucuaguaccuucugagagcuuuucugugaggucuagugggaaaucagcauuucccugggagucugaacauuggcauucccauaccacucuaucuaugucucucugucagucuguccaucugcccaucuauccaucugucuacucauccauccaucuggcauuuauuggauuucuaccguugcuggaaagauguuuugaguagagauuuaacucugcuugauuuauuaccuuccuuuucuguaacuggcaaaccacagccuaaugagcacagaaccuuucaaggcuguggcagcuccagauuccaagucacugacuguuagaaucacgucucuagcuggggaauguucugagaaccuucugaugccuacaagcuuucacuaaacuccuuguugggacacaaggaagguacuguuggucauagccucucuuuucuaacuccauuguugaaagcaaaauuuauaugguauguuuucucauuuuuccggaacacauauccaaggaaaauguuuaagaggucaaaacaaauuaucucuugucauucaaauuaucacaugguguacauguugauaauuuuagguaagagggcuuuggugggaaagaggagucucuuuuuuuuuuuuucuuauucacuuuacauuaugcucucugccuccucccagucagccccucccacaauccuuccucccauccccucucuccucaucugagcaggugggguuuccaugaguacucccacccuggcacaucaagucucuguggggccaggcacauucucucccacugaggccagacaaggccacccagcuaaaagaccauaccccacaggcaagcaacagcuuuuuggacauccccuugcuccaguuguuuaggacacacaaagaccaagcugcacaucugcuacauauaugcagggaggccuagguccagcccacgucuguucuuugguaggaagggggaaucuucagcauacgguggaaucuaucuuccauggcacaggacagcucugaggugaggagaggauggcucacauaucugauucugaauacuaauccuauaucaugauuugucaucuuacaaaaggacagagcauuuuccaacuguguacccagguuaugucuaccaucagaaacacuuucagggcaacacccuccccagcuccagcacuuggagcuggaaacuuuuguacugaggccaggugguggcagaggcaagagaaguggcuguaacugcuccuaucuuuguggucaggcacuuuagagugggcucuguugccuaguuugccaccugccuuuucucugaugggcgagcuguaaccucauuagaggaugguccucauaaagcagcaaaccugagucagaggcacaaccagggaacacuuuaugggagaaaaaagauggcucuggugaacucuagaaccaccugugcgcuuaggcauuucacagcaucguugagagcuccaugaaaacccaguagcaaggugauugccaagcagcagacacucugggugaccugaaucaggacuugacauuagcugacuugcaaccugaucacuucaaggaaccauuuucaauacuuuguuuccuuucuuucucucucucuccuuuuuuuuguauguaaauuucucaauuugaguaccaaugagagagacagaaagagagagagagagagagagagagagagagagagagagagagagagagaggagaggagagagagagagagagagagagagagagagagagagagagagaggagagggggggaggagaagauaaaugaaaaaauuaaaagauggaaauuagagcugggugugguggcucaugcuuguagucccaccacuugggaggcugaggcagggggauuguuuaaggcuagcuacauggugaauuacaggcuggccucugcuaaaaagugaaaaccuuucucaagauaacaaacaaaagaggaugaaaacacuuuagcggaaaggaaaagaccauauagucacacggaaaaggauaagguaguaguagaaacagcuuuuaggaguccuaggauaauggggucuuuggaaaaggauaagguaguaguagaaacagcuuuuaggaguccuaggauaauggggucuuuuucauccuaaagauacagaugugguuaucaagucguaugcuaagcaacucgucuuggucaaagcucuuccaacacuggaggacuuuugguggucuacaaggugaaacugcacccugacggaaggggauccccaaauugacggaagcaguaauucagaacuagcaagaugggcaggcuucaucagauuuucuaagaaacauucucucauuuuucucucacuucugaggagacaugagaucugacauacuacucagcuaucuggggaccaggcuguggggucgggagaaauugagaacugggggugugggccucgggucagcaguugcuucauaaggcauuuacagggcaccuucacugcauguccuccucgguggaggcugagucuuggcuuccucugcuucaggagcucuaagucugguggggguguggggguggagagaagaaagguagccgggggcccugccugcguggugagcaaagguggguccacaaacagaugcugugaauaggcagcucaucugucccucuuccggcacacccuguaaguaagggaagcacguuuuagccauccgcccauggugcccgcagcucgagaagcauuucucauagguuaagcauacaucggcuuuuucagaaguaaagaucaugucugccuuuggcaagcucaaaaccgccuuagucccuuucugggccagauucucaucugauguaaauccuugggagaaucaaguuguagcacuguuuugcauggagugggagucaauucagucuuuccccugaguuacccugagcgaaacucuacuacagcgucuccauggcaaccagaggcuggccaguaaacucgguugccuccuaaaucuccccacccccagcuucuccccgcucuuuuccacgguuaagaaugaggcucccucgcucggugucccucgcucucacacuccuuuauugcuuugugcucauaucuuuuuuucccccugcaacuccuuauccaaucugcuuuuaaaauccuccauccaguuuaaaaaaaaaaugaagacggguuagucauugcuugacaguaguaauugaccuguuuagacaagaccaagcugauuucaaugggcacagaaaccuuggcaaaccaaaguggaauuuaccuucaagucuagccagccuaauuaauacauuguugagaauucuggccagccacaccaaauauggcuuuuccacccacuugaagaauucaccaaucugaauuccagcagauacugcaguaucauuguguguauguggugugugugcguggaaguguguguguguguguguguguaugugugugugugugugugugugugugagagagagagagagagagagagagagagaaaggaagagagagaugagagaaaaaauuauaaugcuuugacacaugguaaaguaauucugauuaaauaauaaagaaagcuauguaaggguaggacucuugguugagacauauuuacuaccaggugagcagcaauugucgauugaaccucugugagccuguuuccucaucuguacaguggguuaaaguaccugaugcauaaagggaccagcgaagagauugcagauaauaaacggcuugguauauaugaaggccgaguaccgccugagucccuggaucccugcuguaugacccaaagcauguguguuucucucuuucuuuucuuuauuuuuuuucuuuauuuuuuuaauugauuuuuuuuuaugaguccgcaugcucucagccuagcaacacucucugugucucucccccagggggcacccucccgccagggaccgagcccacaguggacacggugcccgugcagcccaucccagccuacugguauuacguuauggcggccgggggcgccgugcuggugcuggccuccgucguccuggcccuggugcuccacuaccaccgguuccgcuaugcggccaagaagaccgaucacuccaucaccuacaaaaccucccacuacaccaacggggccccucuggcggucgagcccacccuaaccauuaagcuagagcaagagcggggcucgcacugcugagggccgaagcaggaacagcgcccccccaaaaaaaacccaagaaagacugcaaacacguugccucgauuuugcacuuuuuuucuccucgccuagucucugugugaacccucagacaucucucuccaggguccccaacccugagcgcucucauguaccccacaccauucucugugguucuugguuccgguuucucuuugcucugauauuguuuguuuuuaaucauuauuuuuuuuccuuuucuucuuuccuuuuuaaucuucucucuuuuauuccuuucuccccuccccgccccgcuuuuuucuaaugauuuuaaaccaacucuaaugcugcaucuggaaucccagaagagacccgccccuaagcacuucacaacccaaggcucuguugguuuuguuccagagacaggcccuguuguuuucuccccuugccuuaucccaucccuccucuccugggcaggcugccaggugucuugaggggagccugguccuguauguauguacacaguacacucccaugugaagagguguguguguguguguguguguguguguauuuucgagggagagacugauucacuguggaagggggggaguguggguguguguagagaggggccccuucccucuuauguugcuucuucugggguacuuuucaagaaaauaauauacuguacacauuuuguuuacuuggagaagagauuggagcuuuuuuguugccuuaucuagcucuggcuggguuucuguuggcugucauugucaucuccagguaccuagacaaauagagaccauugggaaugcaauguggcuucacccauccuuauccccaucccaagccacccaagacuaugguuccuccagugcacucagacaugaccccuuuuguuauguuuccuggugucuuugaagucacaagauaacagccauugggugcauggagucauuucuacuuccagcccugaagcaaaugugucucauguugccuuauaaaaagaaaaaagaaaagaaaaaaaaaagaagaagaggaauaaaaaguucauaaugaauguuuagcucugacgguccaguuguggaaugucauaaagaauaacacaccugggaugauguaaacucaguagucuguuuuaauugugagcaggaggggaccgauagaagggaggagauggaaagacccaaauguugucuuugcagagucuccucacccccgggcaucauuauguugagccuaacgugggaugggguugaggaagaagguauucuuugguauuauuuuggucauugucauagaguuuguaaaauacaagggagggguuuauuugcucuccuuucaugguguuaacgugugccugaauccauagcugcugaaguauguggcuguccuucugacuuaguuaaauaguauaagaaaguaaaaaggaaucguuugcuaaaaugaacccaagugcugccaccaguuaaagcacucauggcaucuggcuaauacacccccaaugucuggucugaauacacccccaagggcuggucugacaucagcagauaaacuagcaugggcagagagaagacgccgugguaaaguuauaccuguugccccuacuuuuccucccccaaacucucuaccgagagagauguuagagaugugcaaaagcugcauuaaacggcagaaucaauuugguugcaaugaagugucuauuugaagauuccaaguauacuagggcucagucuugaagccauuugcuuucuacuuuccagcuaaaaggcuucuuagaaagugaacaauucucucaagaugguugccuggucacaugacucuccagacaccuucuaagaaagaacaaaauacuaaugauuuuuuuuuuuauuauugcuugggagagagccauucagcauucucucagaguagccacauaggucccuccagcacacucucagcuuuugcaucuggugccuuucaucccccugaaaggacacugcucuccugcucuuacucuguuucaaagagcuauucugucucaacuguagcaacucugccaagaaaagaaagaugaaaggcuaguguguggcuaccuugagguguccuaccucaguggaagauagagaaggaagugugaacucaggugggcaagcagcccugagugcugagagaaccauggcgucacggagcacuuuuuguuguuguuuuuaaacagaguuguuuauucaccacuagcugaacauuuagggccagucauuccuugcaaaugauugacauuccuacaggugcccugugcaggcauuuauagaaaaccacagcuggagaguagcugaugagaguuucuuccucuuuaaaagaaaaugguggccauguugugaacuugcucuaugcucaccugaugccccaugcagcaucauauucauguacaugucacaaaugagaagauggugaaucccaugauaccuucaaccaggacucagcuuaagcucucucucucucucucucucucuccucuccucuccucuccucuccucuccucuccucuccucuccucuccucuccucuccucuccucucuccucucuccucucuccucucucuucucucuucucucuuucuccugcuuccagcaucucucauagcauuaucuaaaagggcagcucauguguaaaaaggccaugccuugaugcuuuagaaagcaaaauucuguauccuguuagagaggaaagaaucaaucucuucuaagcaaacucgaccggacagaugaauccgugcaugcacuaguguagucuugcuucucagaagacgaagcagugaucccaacuguucaaauucggaagaguguaugaaugaggugaagggccagcuggucuagaaagcauuugccuuccuagagcucucacaagaacccuucuugagagaauacuagcagcugccaucuccuauugcuggcuaaaacagaauaagaaagaaagaaaacaaaacaaguguaguauugccauugacaaaacaggaugcccaaaauaaaguuaucccuuccccugucccacuucuuuugauuaaaaccauaauaggagauccaguacuauuuuugagguuguugccccauccuuuaaaagacccccagucuuuaaaacaaaaacuagcaggcaagcaaacaccuaaaaggucaaaaucuaccaaagaacaacaaaacaagaaaaccuaaagauuuucacuuccuguucuuaucccuccuguaacugugacacccuuugcauugcucaguugccugugugucaaaauaacuuguggauguuggaaacuauuugaaaauguauuguguggaauguaauaaaaugacgauauuuuuauacaaacaucuggguuuuuuucccugccccuuugccugugagaacaaaguuugacauggaagcuuugggggaaaaaaagaaaagaaaaaaaccuugaugucuccaaaguuuacacauugccuucugaacuguggggcauuugugugggagggagggagggagggagggagggagggagggaggaaggaagggagggagggagggagggagggagggagggagggagagggcgagaugcucucuccuugaggcugaacgccagccuuccuuucuuuuuauuuccauaacugcuuguuaggaguuuuagccaauuugugcagcugagccaacuuucaugauuggugugggauuuugcaaaaguugcuaagugcuaaauugcucaaugugauuccacaaaauuucucuugauggcaaaucccugaacacuggaaucuccuuucaauuuagcccggguuggggugggggugggggcgggggaggcugggugcagcucucaggcauggugugcuuggcuccacagaggcagggcccuuccucuggaauagaaauggugaccucuugucccacaccuuccaaaucauuacuuccugagggauguugaucuuuaauuuaugaaugaugucccuggagcaaaggcaauaggaacuuguagcauuuccagggcucagagguagucaagauuuggugguggugggguggacagaaaauggaaauaaagagauggacaccacaaacccagagauacccuuuuauaaaagaaacacucuguaaaagcguugaggguaaggagucuuacucaagagucugaucuugaguuucuugcucugcuugguuuggguugguccaccucuaggaauagucagugaugugcuugugguagauguccaaaucugagagacauucuguagggcagaagggcauauguaggaaaauuaacuuucaaguagcuuugaguuuuucaaugggaggcaagaauuugucacaagaggauuuaauauugccucucgugucaccccagagacucucuaaaaggccgaaugaucauccuagauggccuugcaagaagacaccuguccagaggguccucuuucugccacugcccugacuccuccugagucccaucacaaccuaggcccuggauucagcacuuuucagauaugaagccuguucuaacaccgcaaagggaagccuggcuccucaggucucacaggagacugcuaguacagauggcucgggguagaugucauuaucuguccucugcaggagcacaaagccgaagguccacgauuagaacauugucugcuuuuccugcgccaggcacaauuacccauuuugucuaaguaacauuuggcuggccuaaaacuguugguuccuguuagcacaaggcaaaauggaagccucucaaaguguuuauguccaacaagaacccagacucaguccacacuugccuucgaugaccuaggaggaccucaugugccaggcugaauuaaauucgucaggacuuauguuuuguuggcacuacuaagaguuuuggagccacuugugggaaguauuccaccuugaccccagugccaagacuuauauuaggaguacugcuucucccagggaggcuggcaacagugaggagucaauuuuacacauugcucacagcacuuucaccaguaaaacaucccugccugguuugcagacuuaguccaguuauaaauguuaccgaguuauguucccaggaaucaagguccagugugcccugugcuugccccuacaugggucuucacuaagacuuaaauguacauucuugcuucaacccugguccgucuagcccagaccuccaaagccuggcuacgucagggugauauggaguuuauuuuucucaugcucuuuauugacugugguuauucugcacagacauuguggccuucuguacacuucgaugaaaagagguucauuuugaaguuuugaguugucugcauuguggccgcacaucugaggcaagcugcagacugcuagguguguaggugugggcuugguuucucucucucucucucucucucucucucucucucucucucucucucucucucucucucucucuaauuguacagagcacuggggcucucccagcuguaauuugccuuucauccacuucaaugauggcccaaagaaaacacaaaacgaauccagucagagagaaggggggucggggggacaagcugaccaucuuagaaucaucgggggaugggaagaauuguccuguacaaagaaguuagaaaucagagguggugggggauuuaauuaagcuucaccucggucaggcacacaggaguuugugcuaagguccacuccaacuagaaaucuaguuccuuaagaguccacaagcugagcccaaggcuguuugcccuuggaaucauucuuauggcaccagaccuaacugaaaugauccaggauuuaggaauucuccauagagcaggaccuuaguuagcaagaugggggaggcagggggggagauaaaaaaaucuagaagguucagguaaccagcagaagccauuacugccccaaauucuauggacaagagacccacaaguaucucucuucuggggaaugucauugcucggggauuguccaucaggaccuuaaagagccacacaauguaauuauaaauaguuaaugauaaucuaauguaaauucucauaggcauuggaccgggaaaugagaaaccucuucagaaaggcugagaaccagaaggccuggaggcagggcugggcauugggugggaaaaaaaccugcucuacugugguaguuaucaacaccaaacaaggauguugggggaacuuuucaaaugguaacgggcaggugcuucucucucucucucucucucucucucucucucucucucucucucucucucucucuguaugugugucugugucucuguuccuguauuucugucucucaguucacaaguguauauggcuaccuuucaaaaguacaauaauacagaaaaggcaauaauuaauuuuauuguuaaccaaucccacuguccucccuggaagugaccacaaagagaauuugaagucaccuuuuuauaccuuuauagauacacaaguuuguaucaaauucugcgguuugguuuagcugccguucauuuuguuuuacaccagaauaucacagugucucuucucuuggcuggacagccugcuucuuuucauaugccaucuugaagauccuuccguaggcgucagguuuauuccaccccucccagucauauugugcugauaugccaucacuuauuaauuguccccauuuguguugucccuguucagauuauguccaguuuucuuuuguuauuugguuugcuuuuuacuguuagcaccaauccugcaguggacauuguagacguugccucuucagggauucccauucacauuuuaauaaacauugcaaauaaauagugaaagguuuaucuaugaaggaacuagucuucauuugggagaauagcagaaacugggagacagccguauuugaacaagccaccaaaccucugugacucucuagaguaggcacaguccuugccacagaagaguugugccaguuuuagggaauuugaaacucaagggauacuucuaggacuugaaaaauauuuuuuucacugccaaguuguggagaauacaguccuuuccgaaaguggcagcuguggcucaaguuaauucugucccuggguucagcaaagaguccuguuguccaugauuaaugaguucugcuugguuucuccaaagaacgacugugcugugccucguuguuauuuauuuauguuuucuacugaaaaauucauguaaaaauauucuuuaaggucaucgcacagcauuguacugcagacagaaugauuccagcaaccucagguagacccacaugccaagaggaagucucaaguccagaugcucccccaagggguguugcccugagaggaacagaucuugugggcugagaggaggcccugaucuuucuuccaaggaggcucagggcuuuggcaaugaaagaaaggcauuggcagcagggcuguucucuggugggaugucucgauauguaggcaaaucuguuuaccccacagagcucaagcaaggaauagcaucaggaggagaagccaagagaccugaguccaaaacacuauuucuaacaauagcacugccuugaguucuauuauaugugagacaagagagucacaauaauaucauauuagcucuuagcauaggaaacuauguguagggccauguaugugccuugugggcuuuaucuuaucugccaaagauccagcguuccuuccucuuggaaaugggauuugaacacuugacucaggaaacagucuugccagugugagaccugauaaguuccagaugucagguacugcacacauuauccuauuuuaucuucucuuugcagugguacacucuugaucccuucucauaacaucacuacucaaagcagagaauccaacccagaugagaguacaccucugcaacucacuagaaagcuaccagcucccaggaugguaggagugugcaaagcacuuugagcuggaugugucccugaccaaaauccuauuggcugauggucugcuacuuauugaaagacauuucagcaccaaggaccuuuucauugcuuguauuuccuuauacaauugaggucuaguagaagagguguaaugauuuggagaggcuauugagcaccucucacuugcuccucuuggaaaaugccaacauaaggaauugagaacauaaggaauugagauggccauuacauuagaaccuagacaaaagcuaacauggguauguccagagagcuccaaaggagacaccucaguccaagccaacuguagaccaaaagugugacccuaccaauaauguucauuaaaacuguugggcccagcauuacuuccuggaucugaaauuccagauggggccacagugccucucuaucucucccaaggaggacccagucuccaccccuaccuuugugccaagugcaguucaucuucagauucaucuuccccugacuugguggucccuuuucuucucugaugucuucacacucucucuaccauccuucuuccaacaccuucuuccagaaaaauuauaggucagaguccuuuacucaagggcuuaauugguauuuccaccaaagagaaagguucuuuucagagaacaaaucuaaagccaacagaaucuuucugccgagacuauaguccucggcccccagcaagcaugaauggaaccuuauuagccacgguaaaauuauauuauugaguaacucauucuuacuuaugagaaugucugagcaaagcccaacucauaaggggcaugcgugggaaaagaguaguagaauucauuagccuuuuagaaaauacccauuugguuuugauucuucagccuucccucuugaccaugauuacaucaaaccacucuaccugagugaugauguuucuucuauguuuacuuuauggguuggguaaaaauguccccaaaggcuccugaguugaagggagagaugacagucaggaggauacugacuucaucaauggguuaagccauugguaaggaauacugagcaggcuauuagaaugugggaugugguuggagaaaguggguuaaugagggugugcuucugaacggugcauccuguccuucaccacuucgugugugugugucucugugugugugugucuguuucccaauggcuaccaugaggugaacagcuuuggccuacucucgccauguucucugccuuccugagagcccacagugaugggaccagugccugccaacuaagucccauggagccauaagccaaagcagacagcuccuccuuagugucucucaggcauuuggucagcauugacaagcugacuggcucaauaccucuuggcucaguaccucuugacucaauaccucuugacucaguaccucuugacucaguacuucuuggcucaauaccucuuggcucaguaccuccugauuacugggacucagcgauauaagaaaugucagaagucccccuaggaaaagaaaaaucucuggcauauaaauuuagaagaauuauuuucuuuuacaucucuaggaauguggggaaagagguaaaacgcuuuuccccugagauucucuaugccuucccccaccaucauuucuuaauagaaacuagccaacaaaagagugcagagagccaauugcuuguugauauaccuacuuugggggauggggaauaucuggcuuuucaaagacuuaguugguuuaaaaaaaaauaccagaauguucucccuugacuuguaagcccauccauauuauaaagucucucuggcugcauuuuuuuuucuuauuuccaugccauuggugaggcucaguggagacuuccagggcccgauugcucaucugccuucaugccugaagguguuauuaggucguuucacagccugcucauuuccaguuaauauuuccaagccuuuuaaggguuucuuccugguuuuuaacuacgaauaauagaaaauaaugacugcaugcaagccgacacucccccagucagcgcaucccaacccccuuugucuuuuccuaauggaaaccacauggaaaaauuccaaaacuuguugguuuuuuuuuuuccgugacccuccauacauuuggcuguaccccgaaaauaauccaugcuaaaggauccucugcugggcucuuaagcucaggccaaacccagcaagagaugaagagcccucaaguagccugacuuucuaaugcagauuuggcaaaggcuguagcaacaucugaacuucuggcuccucagugcaacuggggaugaacaaacugaauuagggaaauuaagugugguggggagggagaacccucagccaacacuaaaugugaaaccaaauuaaacauuuugaagugccaagaaauaucucuuuaguccuccauuauuucugguuuauugagaucucaguguugugcuuccugcugggggaaaaauauaaaacagaauggcugagagaauuuucugaagacgacuuccaccugaaugacccauugauuuaucuggcugcuggguguguguggggcagggguggggggagcuucaggaacuuggaaucaaauccagcaacagcucucagcagcccagagcaucucccagauaaaucacaggcugcgaacaaggugcugaaaauccauggcuugcuuucagucucuggaugauuuguucaguggcuucuuguauuuuucuacccuccucaguccacuucaucucuaaaagggaaguguuggcaccugguaccuucacaaaugaaagcguccagagguuuccuguaagagacucuugaauucuuucaaagcuaguugaauguuaguggcuucaguaggcaucaagacuaguuuucuauaagcuguuauugcccagcccuaauuaagguggagacauaagagggggccacgggguacccauuucaucaugucccuagucuccaguuaacagcagcaguuccaaagucaaacaagcaaguguugaaaauguggaacuuuuugacucccaaugcuccgugcuuuccauguucuuugaaaugacuuaagagaagacagggcgggguuaagaaaugaucagggguagugugaaugacagaacucuuguguuuggaaguccccuuguguaugucaacccucgcagaaaggcagaugaugggggcugaagagacagguagcucagcuguuaagaauguauacugucuugucgaugacuagcucacagccgccuguaauuccagcuccuggagaugcaauacccgcuucuggcuuucauggccauucacaaacauguaucaugcacucgaacaagcacacauuaaaacaagacaaaaugaaucuaaaaaaaaggaaaagaaauguuaaugauggaauuccagagcagaggggcacagagugaacucagagaggucaggauagggaggggcucugaccuaggaccagaggaccaucugcuccuggccuggagggccuguacacccauggagccucuguuccaguacauagugaugcuuaugccaaguguuccucugaaugucuuugucccaugcauuggguggcaagucuggucucuuaagccccugcccagaguugucauggaagggccucauggaagaaaaucaauguguaucauguucugaaacgaucccaugcaagugacccagggauggacugucuuacauuauuuaucugaaagcagccagcgguuugaagcagacugcccauuccccuggcaaccuugugaaguuccuuuuacgaugcagaaaguacacagaagacugauacucucacaguaaaccauagcauaacaagcggagaaagugaaggcugagaauuuccuguuagaaacuacagaaaggcaaacuaaugaaggcaugcuaaccccagagaaucccaauuggggggggcagggggagacagagacagacagagacagggaaggagggagggagggagggagggagggagggagggagggagggagggagggagggagggagagagagaaagagagagagagagagagagagagagagagagagagaggagaggagaggagaggagaggagaggagaggagaggagaggagaggagaggagaggagaggagaggagaggagaggagaggagaggagagaagaggagagagaaagagagagagagagagagagagaggagagagcccuuacuggagagguuggugggcauuucccagcuucagguaggagugucaagggguguccugcugauuagcaugagucugacaguaucaggcaguacuccaggcccccuuagggagaaacacuuuccauuagagcagucugcuugugaccgggcauggcuacucaccauuugugcuguagugcagucugcuaagcaagacacuaccauacuugacucuuccaggaugacucuggagcagcccagagagguuuuagcaacuagcuaugguaccucucuuucugaaacacagcauaacaggagcuaggcaagaacuugagacauucaucuuccuguaacuaugggcucuugauccuguaaaaugaagggagaccugaggagacaaggggacuccuggaccucagucggacuuccauugcaacaucagugcagccaggguuuuguuaguuggguuguuuucauucugaaauggaggcaacucugcugccuuggcugcucaaacuguguuauuuaacuacuuagcggcuuucagugaucugagucugucuccucgucucucugcucugguuuucagccgcugagagugggcagagcucugccucacugguagauaaaugcaaggugggagauuugugagucacaaaggauugcaagccaaaaaagccaaaagacaaaugugugggugaaaaggcucagauaugauccugacagucaaacagauguggacauggaaugcccccaagccuacccugcaguagucugaacucugaaacauccaacucccugcucccacagcuuccuagcugacaagggcccagcuucauuugcccaauucuuccccugggcuccagcagcacugugggguccccuuuacaaaugcuucauuuucccuuaugcuauucugugccuuuguuucucagucauacugguggaucuuaauauuagagaccagaucuaguacaucuuuacuacccaaaucccuuaguguggucucugggcaccuaguaaaccuuuguaagugauaguuggccaauugguuaggugagacugugcuuugagugugguucagccuccucuuccugggugaugccuagcauggaaaucucaaagcuccaaacuucagaucacagauaaagccuuuagaagauaccaugaaagugaugagccagcgagccagccaagucucuagacgaucacauccuaccacuugggaucucagucaaggcugaugcuugguuucuguaggauagaauggagaggccggggugauggcacagcuggcaucacaaguguaaggaccaaaguuuaaucuucagaagccauguaaaaaugcuaagggugguuauauaugcuuauuaucccaggcacuggauaugaugagacagaucucuggggcucacuggccauccaggcuugcuggacuggcaaguuccaagccaagugagagacugucuuuaaaacaaaaacagaaaccaugaaaagcaaggugaagaauaauauuugaggcuauucucuuguuuccaugugugugcaugcacacacacacacguguacacacacacacaaggauagaguaguagagauguguguggugaugcaguguagucccuagagaaacugagcaggucucagcauucccguuaguccaguucaguuggaguaaccaaguacacuaggccuugagaguuagcggccagguucuguggucagacugaccuuagauggacuccacacagacucacaggagcacaaagguugaaagaggaaguccuguggguggugagaucugucccugaccuauccugcuguguggcguggcucauuucacucucccuagccuagcucacagucacaaacacaccuuaccacuaaucauuuuggaucaucuucuccaaacguuucucccauugcgaugagauucuaaauccuugucaucuccaaccuguccucgguuucccagcuggcucggcaucccgaggcugacauuucucccucccacacagcugcuaccucacucccugccuggugcucaaacucauccuucuuccugucucaugugggagccaggaccccuccuucuggacuuugugacagcaacugcccauccuucucuuaccuugucuuugccagaacuccagaacucccuaugcaacuaacuaccuucuugcagccuucaucuaaaaacaaaaccaaaaaaccaaaaaaccaaaaaaccaaaaaaccaaaaaaccaaaaaacccaauaaauaaaagcaucucuaguuucacuuagugugugcaacugaaaaagcaaaaggccagugaaaagcaaagaugcuuuugagaggaaaaucucuuaaucaaauacagauaucaagaacaugagcaaggggacuggagaagcugcuaucaaaguaaauugguuuuuguacaaauguuccuuuuauuuggguuuuccccagugugcuauucucucuuuaaggcuuggcgaacagaugcgcuuuugaaaauguugauuaccuuauccuuuccuugaccccuucccacucauccacauuccugggaccgugauuaucccaagagcagagcugagccaccgaaguguuccuuaccuuaaguggccuuugcuucuccaggugcggaaucucagcuggggcugagcaagcaaguccacugaaacuuaggaaugggccaguucuuaggaaaccgacucaccaguccucugccucuagagaugacaggccuaguaggaaauguccucacugucacugccuuauauuugcucuuuucccuucaagaccaaugccacauugucccucuguagucuaugaucagugguggccuuggucuucuucucugggguaugagauggagcaaggugacacuccacccuccaugauauuucauggucuuugacagaggcggaacaccuaaaucaagugcagggauuggacccaaggucacugguaagagcccccaagguucuugcccauaucugacucgcauagccuuauccaggauccuguauccucugcucaugaaaauguuaagaccuaugagcauuccaucaaagugauuaauugucaggaaugugagcuucuuccagcuuccucuuguuuuucaauacauaauccuauuuuuaaaaaaggcuggguugacuuucauaagcucgcugugaucccugugacagacaccaccugugucuuguccaaucaucuucacaucuucauuccaaagaaacagccugcuuugugggggccuggagaauaaugggcaccgagguaggaaagcuggcauggccugcaggugccaguugcuauacuaaaagcaugccaggaacaggcuggacucacagaggacuggcgccacauggcaaugguccuuuccggugaaucuuggcagcuuguuccgguguccuuuucuagagaccgaugugaacaugcuucagcacucuggccaggaaugaagaagacuuuuaauaugauuggaaaugaguagauuuccagggcgacagugauagaucuauccucaguucagcucacggucaaggagauggucuccgauacacgacacugauagacaagauguuguuccauguagucuacaguucuucucauggcuguuucagcuccuggagguuuuagguguccuagucagcuugagacacgggcaacaaugaaaagacccugcuuuucacauauuuaucacauauuggacuaucuucuuagguguuuuagcauuuuagauggguaauuuucguugguucugauuucuacaaguugggcaguuuuguguauaaaucacucaucuuguacauuccucaaauuaucauauaaaauauggaaaauauaaaaauauauaaaaaauaaaaaauauaaaaagaugggcaaugaucauauugaaaaauuucagagcaaauuaacucuauuuaagccuggacuagucagauugggugccucuguuuuaaacgggguguguggaagugggggggggugacaacacaaaaauagccugggacaggaaggcaagagauagccccacacacgugagagggggacacugaggcguucuuccaguucuuucauauuaagcccucuaaugaugaaguaugacuucuugcaguugccauaugucuucuuagguacauacauauggggcgucacaguuggcuaccuaaguaugugacauuguaaugguggcugaggauguaacaugggagcugagaggccuuccuagaaagccccaacuucagcuaguaaugaacggcagcuaagagacgagacugagcuuucccaccacugaagaugugaccuuccucaguuuguucucuggucauuguuggaagaacagcaugcaugccaagugaucuuaacauggguauaguucucuagacgcuuaccgagaugcgagucgggcucaaucaauaaugguuggcucuuugccuuguagcugugaugauagaauuucugauaauuugguguguuuguuuucccuuuuuuuuuuuuuuuuauuuucauaguggacaucccagaaacccaugggggagagggcuaugaagaugagauugaugguggguauuacaaugauuuaacagauaaucacaaaauuccaacuuugguuauaaaaacgucaacaaaaauaaugcucuggcuauuggaggaccugaauuuagaacgaucggucagaaauacaagugaaaaggacccagagaagaaugaaggaaccauuaauuaccuugccagggucaaagcuccagauuuagaaagcuuaccgauccccuuggccuaaucugaaacaggcaacuuucucuauggauggaugucaaaccugggaaaugccuucugaaguguaaagugagccccucucugccgucacugcuugaccccuauccucuuugcugucacugauugacccccaugaccuccuccacagaaaggagugaauuaucugaacgugagcagucuccagcuaucguggacagcucauuccacugcuuacauggaaacuguaauacuagccaagaugccagaaguugcuuauugaagauuuaaggggguuuguccacaugucccaccucauauuuucauauuuauuccaaguucuagcuuugcauuucaaaugcacauacucuggaagcuaauuccagagucuugggagggcauguaaacacauagguguuauuucugccuucagcucagcagugggcgugccaggccugcucucugggaucccacucacagagcaaccucacaccaagcgugaacauucaggagaacaguugcuuuucacuugaccuuaaucagaaacuucaaaugucauuauagaaacuagagugacaaacccaagcagcaccuugucagcugagugcaggaucucccugcaaaacccacugcaguucuccuuuuaugggcaaaagcgcacaaguggccuguacaggagucugcagaucaaacagaagcacuaaagagcaaagcacagggagggggaugaagaacgcuggcugcugguccuguguuaacugcuugcucacuaccuggugccagcuacugcucaccggguccuucaaaccucaccugucuuguuccuacacuagacaugucaggauauccuuuuccucaggugacuggagcaaggccacagagcuugguugcuucacgcacagaaauuuauuuucuuacugcuuuggaggcuuguccuagaugaagguaugcucaaggcugguuccuucugaagacuguaaggagaucucucucucucucucucucucucucucucucucucucucucucucucucucucucucucucucucucucucccccauccaacuucccuucuccucucucccucccucccuccccauccuaccuuccuucucccucgauuccucuuacucccucccucccucccucccucccucccucccucccuuccuuccuuucccccuuccccucccucccucccucucucucccuggcuugugcaugaacauuucuguguuugcucaugucuauguucucccuuuccgugaggguaccagucagauugggguuagggcccagccuaauggccucuucuugauacucagcagguuugaauuuaaacaagaacaguggaggccaauugaaccuguaucaauaaaguuuacaugccaggggaggucugagggucagaaaggaggucuguuauguauauagucaggaaugcuaagugcaggagcucaaaacaaucucagccagccuuugauuuaacuuaaagccacuggaaaugaggaaugagaagacaaacaaagaggugugccugagacacauggcuguccugugcauugcaaaguagcuccaaggagucuguuaaacccugaggguugaauguacagcagaguggugauacgccugcucagcaugcauaaggcccuggguuugaucuuccccagcaaaaacaaacaaaacaauaucacaucugaacuuauauaauguaagccaaauuacuuaagucucagauaucuaucuaucuaucuaucuaucuaucuaucuaucuaucuaucuaucuaucuaucuaccuaccuaccuaccuaccuaccuaucuaccuaccuaccuaccuaucuugugguacgguacaggggauugaauuuaggaccccauacauuuuaggcagguauucuaucauuaaguauaucaccaguccuuaaagaucuuaucuguaggggcuggagcugcaguucaguuggcaaagugcuuggcuagcaaauacugagcccugaauuugauccauaacacuacauaaaacuugauauggugguagaugucuauagucccucuacacaugaaguagaggcaaguucaaggccagccugggauacucuuuauaaauaaagugauauaauauauguuauauauaauauauuauauauaacauauauaauauauguaauauauuauauauauauauauauauauauauauauauauauauauauauagagagagagagagagagagagagagagagagagagagccagagccagagccagagccacagagagagcaauuauucugugccaggaugcaagcacuugacaauuauuaauucacuuaagccuccuaauaacccagggaggccauuuuauugccaucuucacuuuacaaugaaaaacuggagucagagaagggcuuagguuacaugcuucaaauggcacagcuaggauauagcaagguucccaagugccugcuguuuacugcuaagcccuaaagugacuugggucuggggagccucggguuugucuccaugccuacacucuuguguauuuugugucguagaugaauaugaaggagauuggagcaacucuucuuccucuaccucaggggcuggugaccccucaucuggcaaagaaaagagcuggcuguacacccuagaucccauucugaucaccaucaucgccaugagcucgcuggggguccugcugggggccaccugugcgggccuccuccuuuacugcaccugcuccuauucgggucugaguucgaggagcugcaccacacuggagaacuacaacuuugagcucuacgauggccucaagcacaaggucaagaucaaucaucagaagugcugcucggaggcaugaccgauugugucuggaucgcuucuggcguuucauuccagugagaggggcuagcgaagauuacaguuuuguuuuguuuuguuuuguuuucccuuuggaaacugaaugccauaaucuggaucaaaguguuccagaauacugaagguauggacaggacagacaggccagucuagggagaaagggagaugcagcugugaaggggaucguugcccaccaggacugugguggccaagugaaugcaggaaccgggcccguguucucugcagggacacagacaggagcgcaucucuucggagucacaguucuguuuccuuuguggguuuguuaugauuaugauugcuauuguuauauuuuauuuuauuuuugucugugagcaacucaaagaggcagaagaggauggcuuauccggggcagaaaguggagaggucaguccuguucuccacaucucuuucuagucaacacuugaaaagcaaaggggcuuuucagcccuuccauccugagaaauggaaccuaagaaacaaaagccacccagcuuagcucacccucagauggucucccaacucaagagacuugcugggguguguucggguucugccagccaacccuaggagcugccguuuccgguccuagcauauugaaguaggauguuauugccuuuagcuuuuuuuaauccaggggaagauugccauuuuagggucagcuugaacaauucuuucuuauauaagauuuaaaguaaaacauaacagaaacuucauacaccagaacccauagacacaccucuaugguuagacacagacaagccuuaaaaugcuuugaugacugggugccauuccuuaaucuagacccagaguuuguggcugugggaugucccuuguagggucucagcugguggcuuugccuuuucuuuucccuccuauuuguucuucuacagcguauacauauauucacaugcacacagcaugcucauaugcagcucaugugcacacacacacacacauacuugggggggggggaggaagugggagauuuugcagucucuauucuuuagucucagagcagagagaaagaauaacaaaggaagagagagaaacgcagccuguauugggaagaaugaccaguguggacagagacauuuuguugaaugagucuccuugauagguuaagaacauugauuucuugugggaggcuacauccuuauagggauauaagugcaaagacaugcacuucuaccuacaagucagcaaguucuauggauggagaagcuuacacacagcuucaaccucaggagaccugaguucuuauucauacacauaugugccauguacguacacacacacacacacacacacacacacacacacacacacacacagcaguucauguguuuuuuauuaagugccuugaaaaacaaugaagaaaaauguccuuuccucuagguagaaaucaccacugucucacaaguuaaggcuccuccugcuucuccugccccagugacuccauucccagccccccuacccacggcugagccacaguggacugagucuggcuacccggggaaaaaaaucagagcccuagaugacuccagaaagggaggcaucaggaagauaaugaaauugugugaaggauaagauuguccucaucaagauccaaaucuugacuuucuguuaaugccuaaagauugucugugcccuagaaauacagucuaagccccaccaguauguccagacuguugcauaucagugguaaacugucugaccguuuuuuuugcugcugugaucacccacaauuucauuugucuugcacccaggcaaaagggggaggguggacgggacuggcuguggucccuuuaaauguuaacuuaugaaaacccuaguucagaugguaaugucgcaguguuuuguaugaagagggggaacagucaugccgacaucuauuuauucccgcguguguguguguguguguguguguguguguguguguguguguguguguguguguuugugugugugugugugugugugugugugugugugugugucgcacccuugaguucucuguaucuacuguguaugugagugguaacgugggacucagugcugguguugugauuuuugaccuagagccuggguguuacugcugaucuuggcacucguuggcacagugguagaggugaaaaguucauuugucuagcccaggggggcauagcguuaggagcccucugagcugggcgugcaguagaagaaaguugguauuuagcucacccucuucuucacccucccaugcagcuaggauucagaaagcuggggguuucuaaggaggagagaagugcccacuccggggguccugcccucacaugcccaguggaccauuuaccauaauccacccccccccaagaccagcccugucuaaaguuaugugcaacucaaccugcauuccucuacaaguccugcauccacuucacuuuggcugauuugaggcucugggugaguccugagggccgaaaagaagcaggguccccggggcuacauguagauaccucaccaaggcuggaggcuggucuguuguaagauguaaagaaagacagcugagucugauucuaacuuagccagaggacaccuugacgaaucuguuaucucuaucugcagguaagcuagccagccugucuccuugaauuguucccuuugggaaaucuaauucacaguauugaucuccuuuuuugccuuguacugaaugacacauuaccuccacgcucucccggacuaacugguccacagggccacaggguugcuugcucucucuugcaggaauggggagucgacagggaugaggguccaaggaaugagcaugaaugacaagaaaacaaggggaacauuaagcuuuuccagggugugcgguuaaagguauuugaccauucacuggcugagccagaucacgggaacucgagagcuuuuacugugauucuucaauguaaaaaauaaaacaaugucagacuguguuuauaugauuuguauaaagccuuuuuaagauuacuauuuaaauaaacauuauaccagaacuau

SEQ ID NO: 185 - RNA, 43904 nt, Mus musculus
uaauuuuuuuuuccuccuuccucccccucaacccccccucccucgccuaggcugacagaucagagaggcgcuggcaguggacuuagggagcucggcugcuacugcucccucccugggcuucggcaagagucuuucccugucuaacacgaggggugaggaucauauuuuuauuuuggaaacuaaaaagugcucccagggucggugaucauuaaggggaaaucccugaauauacucuccagccaagaaggcagggcugcccgccugcacuagaagaggcagcagccuccuacagcaccacuacaggcaccgcgaggacauaacaccacagagcaguuccucugcccuccgaaacgacaacuuuccuaccaucuuggaggcagaggagagaggggccaaggggagaagugcaccggcuccagccagauaaaguccaaauuucuaccucucaucgcuggaaaaaagcccauacuugagaaaaagcagggaagaaacagaaaggaggucgugugcuccgugguggggaauguuucugcaccuucugauggaaagaaaucuuuacaagacacagguuuuacgauauuauuguuuuccauguuaacuuuuuccauaagggugacaguggcagcuuacuuuuuuuuuucuauuuuuuuuucuuuuuuucaggcuaauaaugauuuuucucuauggcagguccaaguucuguaucugguggccagucuguaaauuggcacuugagagacuuagaggucacgguauugucuuuauuuaaugcucguuuauguuguauguauucguacuuaugguuucauguauuagagguaagauuuugugguuuugguaucugaggaacugaggcugcugagagucaauuguaaagagauggcuuuugucuucucucagagcaauguaaguaaaaccuauugacugcccagaaaggcauaauacagcuguuuauuuuucacggugcaaauagaaguaguguguauuuaaacucucaggacagcugagcaagccaguucaucuaucagcccaagaagaaagaugacuccuauaaaccuagcaacagauugaaagaugccuuggauuuucuucaaguaaaauuauuuauuaagaauuauaucuagaauuccauuucuguuauuuucuuuuaguuugcauagauugaugaaugucuaggccuuugguacauugcauacuuugcugccugcuucuuggaacacagaauugagggguaggcuucucuucccuaguguuggaauguucagaacuuccgguguagugucagccuguugagcgacuuuguacauugcaaagauguaauagguuuacuuuuuuuaagugauuuuuuguuuuauguacauugguguuuugccugcguguauggcugugugaggguuuuagaugcccaagaacuggacuuacagacaguugugagcugccauguggcacuugagcuggguccucuggaagaucagccagugcucuuaaccacugagccauuuguccagccccagaaucuccucccuuucuuucuuucuuuuuuuuuuuuuuaaugaacaaacuuuagcacauaaacaggaucaaagaaaaagugcaccaggcauggagacagccagcugcugcugcagccugacauguccauggcggagguguuaggagaaguaggaacuagccaggcuuuuuguauguugcaagggaauuagggaugcucauuuaaaauucauugcaaagcauuuuagguguaauugauguuuaaaaugccuauuucugaguuauaacuuuuuuuuaaaaaauauuuauuuauuauauguuaaguacauuguagcugucuucagacaccccagaagagggcaucagaucucauuagggauaguugugagcuacccauguugcugcugggauuugaacucagaaccuuuggaagagcagucagugcucuuaacugcugaaccaucucuccagucuccgaguuauaacuuuaagaugaauucagauacuauuugucuggggagcuuuauuaucuaaauuugaauauaaaaccuucugugaguuuuuccuccuucauuggugggaaaaacugugggcauuaaaauuaacuaguuccucucacguuggaagucuuacuugugagguugugugauauuuacauuuuuaaaaauuuauuagguauuuucuucaauuacauuuccaaugcuaucccaaaagucccccacacccucccccgcccccagauauuuacauuuuuguugguuugguuugguuugguuuguugaaaggaucuugcuaucuaacccaagcuggcccuggacucaguagguaguucaggcuagcauggaacucauagcuuuuugugccaguauuagucacaucacccacucagcccaguauuuguucugucccccuuggacauaaagcacaguggucauacaagagaguaagcguccuuugcaggucgcaguggaccugagaagcauguguguggccccaugucucuccucgugugugccuuccuuuauauagccggugaucgccucccuuuacaagcugaagcugcauuucauuaaaguuaauacuuuuuaggguuuugaggggaguguaggggaugagacaagguuucucuguguagcccuggcuguccuggcacuguagacuguagaccagguuggccucgaacucagagcuccaucuuaaucucugccuuccagguccuggacuucuuaaaggcgagugcugcccacugaucagcuagacacuuuaauguauguguuauuuuauucucucuucuguuugguuuggcuugagucaguccuacuauguaguagcccuggcuggucuggaacucacuguguagaccaggauggccuugaauucacaaagauccccuugcuucuaccuccugggugcuggaauuaaagguguauaccacuauauccccccaccccuuugaaguuguuguuuuguuuuguuguuuuguuugaggaagcaucuugucuggaguccaggcuggccuugaacucccuaugaggcccaaaauagucuugaauucaaaauccuuuauccuucuucuauagccucugaaguguuauaugcaccaugacaucuuguuaguucuaccuuuugcuacuagugauuuuaguauuguaaaaacugaguacuucacugggugugguggcacacgccuuuaaucccagcccucgggaggcagaggcaggcagauuucugaguucaaggccagccuggucuacagagugaguuucaggacagccagggcugcagaaaaacccugucuccaaaaaaccaaaaaaaaaaaaaaaaaaaaaaaaaaaaaaaaaaacaacagaguacuucauugugaaaauuauagugacguuauuaagaaaaugacaacuauauucuguccuuaaaaggucucuuuuaaacagugguguauauguauggaaauguaacaauacccauuauuuuguaugcuagcuaaaaaauuaauuuuaaaaaaaaucuuauuuagacauuguagauuuaaaguaaaagauucaugugugauuaauguauuagaaucugucaauaaguaaaagagccauucuuggcaaauaguugcugacaaaaucaccauuuuuuuuucuuuaaagaaagaaagaaagcacugacaauagaaauuguuauucaggguuacuaagauuuuugucuugcaggaacuuguuuuggggguuguuuguguuuucuuuccugagauggugucucaagaacccuaggcuagccucaaccuauauuuagcugguccucuuuucucuaccuuugaagugcuagggucauagauguauaacaccauagcucugucuuuuuacuucuagacacacagguugaccagauguguggucuggacuccccucucccccuuccauugugagguaccauauucagcauauuccaacacuucuaaaagcaagacuccauaccaaacagaccaugguagcuaaugccugugcucucagucauaggaggcugaagcaggaggauggacaguuccagagaccuugguugaauggaugaauggguaucguccaagcacagaguugcaguuacugcagaggcuaggcagcauaugugccaagccccgugcuggcugcuauggugcaccgcacagaccugaaguccauguauguucuggcucuaugugguaaucuccccaccaugacuggagguaaggggcugugccuaucaaucuccacuguaccccacccagccuagacagcugaccucaaaagcccggaagauggcagguaggugugugccuaaauucuacauuaacaugaccauagacacuuucagucuaaaccuuacuguuuuagaaauggccauuuauaguguuucaaagauuuggguuuuauugugguuacugggucuugaaagaaacuguuccugagguaagcaccgaaugaagcaggcaugugaucgcuuuagauuauuucagugugaaauuucuguaaaaaaaauacacaaguuuaagguaggcaugguggcacacaucuuuaaucccaacaacugaguagauggagggagacggaucucuucaaguucaaggcuagccugguuuauauucaggagugcucacucuagauagguagguaggagguagggaaguagguagguagguagguaucucugauucaaauguagucaaauauaggcaaucugaauucuaacuuauccacgacuacucagaccugagaacuguuaccugaucuuaugcuaaauaagaagggagucugucugagaguugcugagagggcugcugguuugucugucuuaagucuccucaaagcccagcaggagcccuuccagaacuagauggucaguggcugugcuggaggaggccccuuucaggcuacaggcagagaaugacaaugucacacauaucagggaacauuauuccuccugauguuaagaaaauaacucuccaacagaagucacaucuuaagugauaauuggguggguuguuuuguuuuguuuaauuaaagcuucaaaguaagauuaaagauugaauuuagguagaauuagcauuaauagucaaucuuuucuguaauuuauaacaagaaaaaaaaaguguccccaaaguuaugguuagauuaguuaaauauuguaguaaggagagaaauccauggagaccucaggauaauaagcagggguuagcagaaaggugacacuguucauuucugugacauuucuggcuaaacaagcuuuuguagacccacugggaauguaaccacuauuuccaugggaaaauaaauuccagguuccagacaaguaauuuagagauguuguggaacacagccacuaauaaguuuagacuugugugcuccagaggccccaucgcaccauugugauagauagccagaguucagcaguaaggggaaaugggguaaaucgacucuuacagauaaaaugaagauuaacuaugaucauagcucagaagagaagacugucaaagaccgaaaccaccauagcacagaagaaaggggaaccccagugacucagaucagaucgucccccuuacucuguauguagugcugcuccuaggugucacaugauauaauagauauuugugcuuuguuuuauucuguuuguuuuguucuaguaagagagacaaggccucagacuagucuggaauuaacacuguaaaccagacuggccuggaaacuguggcaguccuucagucccagacucccaaguguuaggauuacaggcauucauuagccaucaugucuggcuuuauuuuagacuuagaaccagaaggaggaacagugcaguggcucacuugcugcacuacccuggcaaccugguucaaucccuggcccccagauaaaggugauaggagaggucugacugcaccaagcagcccucugacccucacaugugcaugcaccguggaacucaggccgcugccacacgauaacgaauaauucucuaaucagaauaggaaagugaugaggccagagccuucuguuugccugcuacucuacugccucuuguugugccuccauuucugacuuaaggugacagggcagagcguugcccagcauacccaaggccuagaguuugguccccagcccuaguuuaaaaaaggcuuaauauagugugucugcaugugcuucuggacuagaucaaaaacagugacaggaaacacugcugcuauguugauaaaauguguggcaucaccacacaugagauagauagauacacacacacacacacacacacacacaguugcuggcagcacuaaauacauccaugggaacuuguuggcuaaucaggauaugucccaccuagaacaucucgucaaaauguagugugaccaugcuauuauauuaagaucacccuguaaaauagacaugaaggagcugacaagaugcauggaaucaugggggcgggagaugcaaugcaaaguuuuuuuuucuuguggaaaaucaaaauaaauagguguuguguguuguaguuuaacugugaaaugccacacccuaucuuacacuggccuuuuuugcccacugaugaccuuguaggaagugauuagaugauaaggcuucaggauuuguagauggauugauccacugauaguugaucgucugauggcauuguugaguucugguuggaagaagugggccacugaugugugccuuugagaaauguaucuuguucccagcagugcuucuagguuccugcuuccugguugccuggaggugagcagcuuuacuccuguauacucaucugccaugaugcucugucucaccaugaccuagaaaccucugacacagugagccaaaauaaaucugcccacccuuucaguaguuucuuucugguauuuggcacuucaaaggaagucuaaacacagcugaguugauacuaaaguccauaaaagaagauucuuuuuuuuuuuucaagauuuuuauuuaaaugaguacaccauuucugucuucagacacaccagaagagggcaucagauccuguuacacaugguugugagccaccaugugguugcugggaauugaacucaggaccucuggaagaguagucagugcucuuaaccucugacccaucucuccagccuagaaagaagauucuaaacauuguuuacccaugagucaaaaagaauguguggaucuagagagagauguguaagaaagaaggaagugcuggagagagagaaggagaaacgaaaagugucagggguguuuuguuuauguuuuuugcuuuauuuggagacaggcucauauagcccaugauggccuagaacucuguagccaagguuagccuugaacuuuugguccuuuugccuccauguauagacuccuggcauuucaggcaugaaccaacauagccaguucaugcagaacugauugaugauaggacccuaucuccccagcaagucccagucaaaauaccuuauuuuaaauauugacgcaaguggauuuaaaggguaacuuuuuuuuuccccaaguuuuguugucacuauagauggcucuauaccauaacaaaaauuuuauaagccugucuuucguuauacaaguuuccuuuaaaucauuggguguuuggggguggcagaugacaacacaugauggggacccaaccuuucaacugauuaaauaaaagucgaucuucccacagucacgaaccaucucuguguccacaggaguugugugucuguucuaaauguaugaggggcaguuauguaauuuacuaccaacagaauuuauccuucaaaugucaugucgcaacaaugggucaccuccguuugugguaggacacacaggugcuuccuguugcccugcccaggacgauguuaacaucaaccucagagaaggccguuggaccagccuggagccaaauaguagccacugugucuguauugaggagguagggagaacuguuucuuaaaauguauuuauuuguuucugguuuugagagaagauuaucacauuauauggcucuggguagccugauacuguguaccccaugcaggcugcaaaucacaguaacccaacuuaacuugacuaacacugaacccagagggaaguaccacugugcccaagaacaggauuggagagcuagcccagcauuaagagcacaccaaaggaauccaagcacucacauagugucuaacaaccgucuauaacuccaguuccaaaggauccaacacgcuuuucugaccacuguggacaccaggcaagcaugcaguauacagacauacauguaugaaaaacaccuauacucauaaaauauaaacaaaauuuaagagcaauaaaucugagugcuuuauacaacaguaguuacuaguggucagguaaguuaucacaaguaagugugucgaccccugagauaaacuaagaaaacaauucauggcagccauaacggugcacacucauaucccaguaugaaagaggcugaggcaggcuaauacugugaguucagaaguucaagaccagcuuggccaacauaguguaacuccgugucaaaguaagaagggcugaggauguaguucucuugguaguguguuugccuagcgugcauaaagccccagcacuguauaaacagaguguagcagucuguaccuauaaucccagccgcuaaaggcaagauccaaaguucaaggucaucgucagacacacacacacacacacacacacagagacuguuucaaacuaugugggguugggcgugggagaaggaaaguagaauggugggaugccauucuaagaaacaccauguaacuguucucacaggccauuugucuuuuuguugcuacuguuagaaggaaguuucuguguucuucagaucaaauauguauguguguauacauaaauauauagaguacauauguauuccaacaugggaucuucauuuucugcuggaggaguaugcuacuauucucuuucgcuucaagaauaucuuagcugagaugagaaaaauuaagauucuuuaaagacauauuuauuuuauguguccgaguguuuuaucuacauguauguaaaugcaagugcccucagaagccaaaaggugcuggugcuggcuccugaggcugcaguuagaguaguuguaaggcaaggugugggugcuggaaacgaaacugggucuucaaccagagcaauaaggaaaagugaaugauucuuuuaagcagggaggaacaauuuguguauuuaucauuccauuugcugagcucuuugcccaaacaauauuucuaauacuguuggucacagugacacaugcuugucugucuguagucccaaauuuucuagagacagaagcaacagaccucuacagcccaagagucugaagucugucugggcaauagaacaagacccagagaggagggagggagaggaagagagagaaagagcgagaaagcaaaccgcauguaagcauucuggacaugugugggguuucucauuucaaccaauucucccaacucucugguuauauaaccaaguguccuacagcucagucaaaacugacgcugugacaccaguuaccagggcuuauuaucagaccccacaggguuaguggcucagucacacaagacaacccucacuucaggugcuaguuccuaguaucagguccucaggcuaccccaacuaacaucccacguggccaaagugagguuguccuacaaccucuaguuuaaagauuagcuagaacucauuauacaaacagcaacacuccugguuuauuacagagucuaacccuggaacaaccaaauggaagaacaagauggccaggacacuguggaggugcuggagaggcacgggguuucgguguccucucuggacacaucacccucugagcucagguguguggccuccauccuggaagcuuccauacccuggcaugugggauacugauggccaggcacguagacaugcuuaauuauuaacuccaucuccuccccucuuccuuccccgaggccaugggguaagcaaagcuuccaggccucugauccagguuuggugugucuggucuccaguuauuccuaaguuguuuggggcaggucaagagucacucauuagaaagauacucuuuugacccgggaauuccaagagcuuucagaagucuguggaccagggacaauggccaaauaucagcacaggaggcacacacaucugucaucuggaaguuauguggaccagagaggcuuugugucaggaagcaaggauaaagagcauggauacguuucuuauacaauauauacagacacacuaucuugaaauaaagcaagaagcagucaucuagcgcugggacuggagagauggcucagugguuaagggccuagauucaguucccaggaccacgcagaggcucagucuguaacccuaguuccagaggcucuaaggggggggggggggagcacagugaugaugacacuguuacgucuccuacccauaauggacuaguaacgcuuuuuuuaaaauugccuugcaaauguauuaauugcccuaauuuucacuuuuggauuauucucauuaacagguacucuuuuuuuuuuuuguuuuuuuuguuuuuuguuuuuugagacaggguuucucuguguagcccuggcuguccuggaacucacucuguagaccaugcuggccucgaacucagaaauccaccugccucugccuccugagugcugggauuaaaggcgugcaccaccacaccuggcucucuauuuuauuuguguguguguguguguguguguguguguguguguguguguguguguguccuuggcauguggaggucaaaggguaacuuuaaggagucauuuuuuucccaccacauaggaaucccauucaggugacgaggucucugucuuuccccacugagccaucucaccagcuauuggcuaagaguaugucagcacacuacaaacacuuuuguuuuaagaaggaaaaucuuuuacugggucucauggcauauacuuuuuuuuuuuuugagacgcgucucacuauguacucuggguagccucaaacuugcuauguagaccacacuggccugaaacccaugccucuugccucugcuuccccgguguggcaugcacuuuuaaucgcagcucagaggcagaggcagaggcagguggaucucuaugaguuugaggccagccuggucuacuuagugacuuccaggcuagccggggcuacaaaaauacaacaaagaaaugcuuucuuuucaauuacagauagugaguaugugcaggugaaugcuggugcccucaagggucagaauccccuggaccuggaguuacaggagauugggagcugcccuguguagguccugguacugaaugaggccucugcaagugcagcagguacucugaaccacugagccaucucuccagucccuguaaauacuuuucaucuuaacaucuggaaggaccagcaagauagcucagcagguaaagacaccugcuaccaagccacauggcaaaaagaaaaccaacuccuccugaaaauugucaucugaccuccacuugugugccacgguguacacacacaaacacacacacaagauauaacugguguguuccuguguuuuguuagcugucuauccucagagcuccucaguuucacacucuuuccuucccagcgacucaguccuuccugucuuuccugaccucagcacuccggaagaauacugcucuuaauuugauagaauugguacuuugguguuuuuccaguguuuuuuguuuguuuguuuucaugauuagaugaagguugguauauuuuuugcaagaaucucagauguaaugaccuguaggugaugucaauguauuauuaauaaguauaucauuuucugucaccuccauaacaaguuaccacagauuugcugucugaaagcaacacccauuucuuaucucagcuucugguggucagaacuaugaguaacuugugcaaugcuaaaaguuccucuguggguuggacagccuucucauccagguuagguacuugcccguuccuuucucuaagcuacuaggagauauuuccauaggauugccacaugaccgccaucuacaaaggcagcagcuguuccugcaagcagaccucacacuuucccuacuucuagacucaagucugaaauguugcauaaaguugggcauauggcacaucccuguaaucccaccgccuggaaggcagccugaaguuaaggacugcugcaaaucugaguccagccuagaguacaaacugagaccacaaugcgagacccuauuucaaagaaaggaagaagauggggaaagaggaagggagggagggaaaaugguuguuuucacuggugguggugagccacccaguguuggugcuggaacugaacuugaguccccgcaaaagcaguacaagcucucaaccacugagccgucucugccacauggcuuuauuuuuuuauuuaaaaaaacaaacaaacaaacaaaaaagaccuaagaaaacaaaaaaaaagaaaagaagaaagaaaaaaauagaaaaacaacaacaaaaauaacccuauuaaucauaaauggaaaaaaacaaguuuguaguggagaaagcagcauuuuaacuaguggucaguguuaucaucacuagcaagguugguaaaauucugguugcccuguauaaggaugauggguggcucacaaccaucuguaaucccaaguccauuggaucugacacccucuucugacauccuugggcacacauauaauauccauucaggcaaacacgcacauuaagcaaaaucacuuuauucugaguaagucacaaaaacaucacugagcugguaagaagaagccacuuaagcccaguuccaaacuacacaucuuggugaacuucuguauaguuacaguggucauucugaagaaaaggggcuuugcuuaggacuuuacacauuuuauuuauuuauuuauuuauuucaagacaagguuucucuguauagcccuggcuguccuggaacucacucugaccaggcuggccacaaacucagaaaucugccugccucugccucccaagugcugggauuaaaggcaugcaccaccacuacccaacaauauuuauuuuauguauaugaguacacuauagcugucuucagacacaccagaagugggcaucggaucccauuacagauggucaugagcuaccaugugggugcugggaauugaacucaggaccucuggaagagcagucagugcucuuaauugcuaagccaucucuccugcucagggcuuuauacuuuacuacuaacuacauuuuguauuuaaucuugggguucuugcauaauuaaguuuuuugagggagauauuugugucuaugcaaagguucuguuucucuacaauaugucucuuuucuuauaugacaucacuauaugguccuuucuucuaugugcuaauuaugugcguucugcuuugucguggagacuugccucugaugcucagucuguugucagccucccaaaugcugagguuacaaguacaugucucuacaccuaccuuaaauuaucacaaguuuaauuaauggccuaagccaacacaaaguguauugucuugucauucuggaaacaaagcuccaaaauaguauuuacuuggcuaaaaugacgccaucaguaagagguguggugaccaccagccaccgugcauacucuacuacagcacacacgguuuaugcuggcauuuggugggaggcuauucuagucaacacaacagcuaguccuagccagacagaccacauaguuagccuccaucucaaaacacgcaaacaauaacagagaaucuuaggaaggccccacuguacccggagacagccgggauaaccccagccuuucuccugucuucaucgugacuagauucucucucucucucucucuuuuuuuuuuuuuuuuuuuuuuuuuuuuuuuuuuuuuuuuggagacaggguuucucucuauagcccuggcuguccuggaacucacuuuguagaccaggcuggccucaaacucagaaauccaccugccucugccucccaagugcugggauuaaaggcaugcgcgccaccacgcccggcuugacuagauucucuggucucuuucugacucugaucuagauggcuugcucuaaggucucugguucuguuaggcccacuuggauaaugcagggucaucguccccauuuuaagaaacuuaauguauuaacauguacaaaaugucuuuugcucugcaagccuguucacagguccagccaaacaugacacccuugagaggcacuacucugcuucccacaugaacauauuuggacuaaugagacaacugaccacucuggcauaaagcuguuuuguucugcuuaagcucaggcuugcacugugucaucaugcccugcuuagaaagugauucuuuugguucuguagauuaaacuagggauucauuccuacaugguaguaaguacucuacacugagaauaagcuccacgcucuuuugcuuguuuuucuuuaaauagggucucuguagggaugaccuucugccaucuguuuccaccucccaagugcugggaucccaggcaugugcuguuauaccccaugcauguggugcugggaaccggacucugggcuucauacauacaaggcaaacgcucugcugggcaccucuaccuuguugauuguguuuuguuugaagacagguuuucacucuaguccagauuacacuagaacucccgauggccucaaauucacaguaauccucuugacucagccagccaaguacuacgauccuguauauuaaucaugaccaugccuggugcuuuuaaaaaaacuguauguguacacuugucuaaauccuuaauaaaagcaaaugucacucauuccccccuggcaggacacugguuucaauucuguccuccagcaacagugaaaacugucgacccaucugucugucccccucuuucauguuugucaguggcacagauuuuuacccagcuguaaaagcaaugauucucauccaccccacugugcugcucugcuguauaaagagugguuuauaaaccccuacacgcaucucugccugggaauuacaucuuuaaagccacauacagaaaguuaacaaucuaagccaggugcagucaugugugcagguggcugcauugacccgggaagccagcacaaaagguucacguaagcugaagaucuccaagucacacuaggcagcauaguaagauccuaucucaaaagaaaaucacuuaaaaacaaauaaauguucucagcauacucuuggcuauaaugcauuuuuauuuuuuauucacuuauucauuaaguaaauguuuauugaagaucugacucugaaaaagcacugugguaaauauugguggcaaacaguaagauguaauaaaucauaacuuaaaauauagaaaagccgcuuucaguagcuuaaucucaggaucauuggaguagauaaaguaaccuuccuaugaguguugcggccgccagcagcucgcaacgugaacgguucgacugauauggcuacucgagcuguaagagaggaaucuagacggggcgaaagaagaaauggagcuaagacaaauucauucugaucaaaguucaaauuuuauuguugcgacacuaguuaugaaggaagggggaggggacccgauucccgccgaauaaucucugguccaguagaaaguugagcacguguguggcuccgcagguuccagcagugggcguggcagaacgaaugagcaggaagcuccaccccugagcaagcagguuucaggcugggggaggggagacuacauaugagcaguuuuaaaagucaaguuccccccucguuucaacugacuagaaacaggguaccugguguaaagcacugugugcagacaggggugggggugggcagugggagacaaggaccaggaggacccaaugccagccuagagcacgggagauccgcucucacaaacaguagaggcuagcagcagguaacgggucuggcugugcaggccuggauaccugaagccaauagauagaaguucacaaauauaggagagaaaaauauaagaaaucagucuuuuucaaaagaguucaaagacagccuggacuauguagugugccucugcacacacacaaggaagucguuuaaggcuuucuauuuuaguacugaccuuuacaguggucguauuagaaaucacccugggacuagagagauggcucggcccuugcuguuguugcagaggacccaguucaauccccauuacccauaugacagcuuacaacugucacacaacuccaguauguucuaggaaccaguauggucuucugaacucagagggcauuaggcauguacacauacaugcagagagagcacauagaauaaacuaaacuuuuuuuuucuauagccacaggauuuucucaguguccacuuucauucucugaagcuuguuuuaaauuuuaugugcauagguguuuugccugcauguauggauguguaccacaugaguaucugauauccuuggaggcucagaagaagguaucagaucugcuggaacuggaguuacagacauuugugaggggcugucacgugggggcugggaacugaacccgaguccucugcaacaucacccagugcuccacugagcaacucucuagcccccacucucauucuuuuuuacagaucagacucuuguggaugaaucugugguuuaguucuguaauccaagguccucaggaaaugaggcaaggagguucuaaaugucaggccaggcuuugugagauccugucagagaaaaucauuuuagaagggcuagagauacagcucagaggcagaacacaucuaguuugggagaggcacugaaguaccccaagaggaccaaaggagaagggaaaccaaaguggaguuccuacagccaucccugguggugugcagguacaugcauuaucacuccugcacucaggggcgugagacagaaggaagugucacaaguucugaggacuugcuauggagccaaggauaaccuugaauuuuuuuuuuuuuuuuuugguuuuuuugagauaggguuucucuguauagcccuggcuguccuggagcucacuuuguagaccaggcuggccucgaacucagaaauccaccugccucugccucccgagugcugggaucaaaggcgugcgccaccacacccggcucuugaauauuuuuuaaagcguuuuaauuuauuuuguuaugaauguuuugccugcauguauauuuguaggccaugugcaugccuagugcccacggaggucagaaaaggacacugggucccuaagauugaaguuacagaugguugugagcuaccauggcacgcuuugcugggaaucaaaccuggguccucuggaagaguagccagugcucuuaaccacuggaccaucucuccucccucuaacucugaggaccuggaauuauaggcgcuguauuaccaagccuggcugaugcuuacuuacgacuaaagauggcuuccagagccuugcgcgugcucugaaaacacauggccgacugaacuacuucucuagacacuacuuggugacauucgacguacuuggauuaguaaggcacuccuuugugaggacacuuccagaggagcaccagcuccuacguguggaagaggacccgccuucaacguggauggcuccacccaguguguggauggcuccacccagugucugugggccagaggaauaaaggagaagaggaaagaagccauuucuccuucggcuuccuggaggccaugaaggaagagcacugucccaccacaccuucccagauacaguggacuggaaacaaaaucaaaauugaauuuuccucuuuaguuguuucucggguauuuuugucacaaugaugaaaacgucuaacaaaaugauaguagcuuaucaaccauagaacuagaguuuccauuuagagaacugauccugcggcuuucucucugagcacaugaaugauggaucuaucaccguguuggcacccaguaagcaguacuagaugucacgaugucuucaaacucguucacagcuuagugauuucucccagcuuuggcagaguugaaaaacuguaauuucaacagacagaaaauacacagggugaaaaucucagaaauagacuaagugccacacagacuuagauuuacaucaaaauccugcuaauaugcagaggcguuuuuugagacagggugucaaguguccuaggcaggcgucaagcuugcuauguacuugaggaacaaaugaacuuugauccuccugaaaguugggaauauauaccaccaugcccaguuuuaagcaguagcuaguguuugaacccaggguuuccuacaugcuaacaagcaccccaccagcugagccuagaacagcuuucauauuugcuuuauuucuacacaggagagcguguuuccuauauggaaaccuguuuuccuauuuuaggaccucaacaguauaauguuuuucuuuucuuucuuaccucucuuugauuuguuuuuacucucuuugagacaagguuucucugugugggccuggauguucuagaacuugcucuguagaccaggcuggcuuugaacucacagagauccuucuaccgcuggaauacugagacuaaaggugugagcuaccacaugccucaugcucuuaaaaccagucucccaguccuaccuguaacuuuucucuuaauguguuugcauuuggugcacuuguguauacacauguguccaggggucaaggaguacauguguguauaagcaugcacaugaaggccugggguugauguuagggcucuuuuaccuugcucaguaaggucagguuucucaaugaaaucuagaccuggugauauggcuagucuugcugggcucugcucuggggauccugucucuagccuucugaggcagguuacagguggcuaccauauccauccagcuuuuauguggacucuggagaucugaacugggguccucauccuuuuguggaagucuuagucaucucccaggcccaauccuacauuaaaaaaaaaacaaaccaaaacccggaaugaguaggguguggaggcuuugucuauauucugaguaagcagcagcugagguaggagaauugauaagaacucaaggucagcuugagcuacagaaugugaaccuucuucaaaaguggaaacgaauuaagguggaggagagggggaggaagaguggggaaggaggaggagggaggagaaaggaggaaaagaaggaggaagaagaagacagacagacagacagacagacagacagacccuaaccaggugugcugugauauaccuauaaacauagcacuuguaaaauggaaacagcagagucagaaguucaagguugucuuuggcuacagagcaaguucaaagccagguuugggcuacaugagacccugucucaaaacaaaacaacaaacaaagaauaaaaaacaaaaaccagaccaaguucaguauggaaugucuuaaucccagcacuccagacaaaggcaagcaaguuucuuaggaguuugaggccagccuagucuggucuacaaagugagacccuaugucacacacacaaacaaauaaacaaacaaacauacauagcauaacaacaacaaaaugaaaccccauauaaugugaaaaggaaaaaaaauucacacuuguaggagucuuugaaauuugaaauauaguaaggaauauuacuuauuaaaaguuuuagaaaguagaaaaccacugggcgugguggcacaugccuuuaaacccagcacucaggaggcagaggcaggcgaauuucugaguuggaggccagccaugucuacagggugaguuccaggacagccaggacuacacagagaaaccuugucucgaaaaaagacaaaaaggcaggugaauuucugaguuugaggacagccuggucuacaaagugaguuccaggacagccagggcuauacagagaaacccugucucaaaaaaacaaacaaacaaaaaaaaaaaacaaaaaaaauugaaaaccugcaaaaauaugacuuacaagucaaaauaauauguauuauuuuuauauacuuuaaaauauaaaauacauuuuauauuuuaaaaauuauuauuuaauaauaucuuaaaauguauuaagaguuugcgugugugcauauguguaugugguguauggagacacacucacauaugugcacccuuaaggcuagagacacucacauaugugcacccuuaaggcuagaggaggguguuguguguccucucuccugccuuaacagcuaugaaauaugaccuuucacuaacccuggaacuagccugaugcgcacuacaguugcaaucuuccugucuugccuacacacaauacugggguuccagguguguguggcuggguuaugugacugcuggggauucaaauucagguucucacgcuuacucagcaagugguccuucccacugagucaccgacccagcccuucaaaacaagucuguaggguuuucuacuuguuugcauuuugagucaaggucuugcuguauaauauccuccugccucaccugagugaauacuugaguguugagauuauaaaccugucucucccauaaugccuggccgauguuauaauuugagagguuuuggguuuuauuuuuuucauucugguuuuucaagacagggcuuuucuguguagcccuggcuguuccuggaacucacucuguagaccaggcuggccuugaacucacagaaauccaccugccucugccucuccagugcugggauuaaaggugugcaugaccacuaccuagcaaaaguauuuuauuuuuaugauuuauuuauuuuuauuguaugugcuuugguguuuugccugcauguauucugugugaagguguuagacauccuaggacuggaguuacagaugguugugagcugccaugugggugcugggaauugaacucagguccuuaggaagagcagccagugcucuuaacuccuuagucaucucuccagcuccuugaaaguguuuuuaugagcauauauaacuauacauaauuuacacuggguugcuaaugcuuacaacugcuuuucuaucaauuuugguuaucuauaaagaaaucaaaguuaguauucaaaugaacuaagaaacuguguuguaugacagaauugcauuguauaacuuacuaguuaauauugcaacaacaacaacaacugaaugagacucacggagcagugccaaguugaaaugagucauuggaucgguauuauggugauugaauggggaaaguuaacagguaugguaacugguccagaagaaaaacaugacuguuugguuugguuuuucuuggagcuaggaauugaacccagagccuugacuaucaaggcaaguacuuuaccaggaaauaauaauaaaguacagcauaguuaaucaaaguuaagaagaaguuguaaugauaaugaauuuaucauuuggauuggaaagaaaaggauaaccaacaucuuugauguguuagcuugaugaggaguaaggagaggucuaagaacuaacuaugggccuuagauaaugaaugguagggaauggauguguggauccuuuuugccaucucuguguguuaguaccaggacacuccaagccccggccuaacuaugugacccuugaccuacauugcuaggacaacgacccucaaucccacaacccauuuggcucaguucccacccucacuggcgugacgucauuuuccauauaaauuaggggaucacccccuccuugcucucuuuucuucucucucuucucuuucuucucuucccccucuuucucucuuuuuccuauccucugcccuucuacccgcuuugccaccccccuauccaugcacaauaaaccucucccacauggaaccaccuugaccuggucugcugucugguuuauccgcucaaaauauacauagauuaauaguaucugauauuaauuaacauaucacuguguacauaaacuagccuguaucagagacuagcagaggcaacuuaauguuguguaaccgugcugaaucagaaggcaugaaagaagaguucucaaugagggaggaugaccuccucguggacagaagagccuauuuaauacaauuccuugcccaguccccuacccagcaauugaaugccuaggagagaggaacuuacucuggggguaagcauuuggcucguucuauucaacacuggcaccaggcaugaagagcaaagucaacaucacuguucccauuuaaagagcacaccagauacuuccuggaauauaacacugaguaggcacaauccuuaccucccagccuuaauuuaagcuauuagcgguaacagcagacuguuguauuagaagcaguaaaagccccuagggaucuuuuuggugguucuagcauaaguuuucuaucccauugcagguuguuucucaucuggucucucaggacggcuucuuuugcauguguacuuuacacauauguucauuuacguauauguuacagcagaacaugaguagaagaaccaaguccagucagaaagguuacagugggauaagauaugggcucuuugcucugggggugguuuuggcugcuuuuugagauaguuuuguuauacaucccaggcuggcugugaacucaucacauagcucccgcgccuccaacuccuauucuccuccuuccugucuuagccuccugaguacugacaguacaagaguguccucuuauacuaggcaccaaauauauuaagaauuagagggcacuagagaugccucagggguuaagagugguugcucuucgcugggcgugguggcgcacgccuuuaauuccagcacuagggagggagaggcaggcagauuucugaguuagaggccagccuggucuacaaagugaguuccaggacaaccagggcuauacagagaaacccugucucgaaaaacaaaaacaaaaacaaacaaacaaaaaaagaaugguugcucuucaauaacaguuuuuuaaauguuuguggguaagcaggcagaaauguggcccucugucccacccaauaagcugugaaauuugaaaaaaagaaaaaaaaaaaaagugguaagagugguugcucuucuagagggcccagguucaauuuucaacauccacauggugugguucacaaugacccuguaacuccagucccaggaggucugaggcccuuuucuggcugccuuggccauuguaugcacauggcacauaugcauauacauagacaaaaaacucaugcacauaaaaauuuagaaaaagauuagauauuuccuuugauaucuaaugauuuacacaacaugucggauuuuccuaaaaucaugcuguuuguccuacuaucugauuaugcacugggacucuguguuuaccaaagaguaaugcauguuacaagccaauccuaaguuaagcacagaguagaaagguacauuuuagauagaugcuuauuuauuuauuuauuuauuuauuuauuuauuuagguagaagcucaccucagucucccaaguguugugauuacagcuguguaccaccacuacuggccaugauuacuuaaauaaucuaugagauggcaauaugaguggggaauaugagggaagcacauuagagggaagugaccagagacgcugcaggugaaacugagacgagggagaugccucucccaucuacagagaacaaagguuugaaaagagagaguccaaauauauuaaguacaaacaguuggccagugauaaaggcuguggaugcuagaggacacauuccaguuacugaaaaauaagcccaauugccaagggaacaaaacuguccgggauacuuaucccuuaacugaccauucucugaggcuugcagaugcaaaacaagcccuaccccacaaaaaggcuuggcuguguacuuccugcuaagcaaacaaaaaauguccacaguaugcauggggaagcuacaggaagugacccuauuauuauuuauauaugcaaugaaccaccucagauaaaacaacuuccucucagcauugggggaaaaaagggcuuaaaauuuguuuauuauaagcaggacaugauggugcacaccuuuaauuauagcacuugggugauggaggaaggcagaucucugaguucaagaccaaccugaucuauacagugaguuccagaucagccagggcucaagaaaacaaacccaaaacaaaacauuuauuugaguaugugugcaggugccauggacugcaaauggaggucaggacagcuuucaggagucaguucucuccuuccaccaugaguguaauacacacacacacacacacacacacacacacugcaguuaaguccaauaaaaugguaauggagcagcuucacucuagaacaggagggacccuaagggcuuuuuccagccccacacccuccuucccuccuuucagcuuccucuucccaccugaggucaagggucaaggcuaggccaaguuccauucuccacccaaaggaacauuccugaguaaaaaauucucagaauguccugacagucaccugacccuuuggaaagucccagguagaguucaaaugcgugucaugcuugcuagccaauagauuuaaaggucaauaggcuuagcuaauaaguuugaacuguaaccuugcugauguaaccugugccccuaaaaaguauaaaaauugcuuguaccugggcagugguggcgcacgccuuuaaucccagcacuugagaggcagaggugggcggacuucugaguucgaggccagccugaucuacagagugaguuccaaggacagccagggcuacacagagaaacccugucuugaaaaaaaaaaccaaaccaaaacaaacaaaaaacugcuugcaauagccauucaaggucaccuucucaucacuuaccuccaggaaaauaaacuucuugcuuuugcaucgaucugauuugcaucucgaaaggggcaucucgaaguaaguaccaauguccaaggguugcggucuuacauauacaaacuauaauguuaagcauuuucucugaggaguaucacuuuaguuaagacucauguugaccuguaguaacccagaucacacaaucgguaagacaccuaccagaaaaccaucuccugaagccagguguggugguacagaccugugguucagcauuugggagguaaaaucagaaagacuggaacuuugaaggcagccugggcuacaaaguaagacuuuccuugggaaaaaagagaucaaaacaaacgcauuuuuuuuuuuucuuuagaucuauuuaaaagauuaagacuggagagacagagccggucgugguggcucacaccuuuaaucccagcacucgggaggcagaggcaggcugauuucugaguucaaggccagccuggucuacaaagugauuuccagggcuauacagagaaacccugucucgaaaaaccacaaaauaaaaaauaaaagacuggagagacggcucagugcuaagagugccugcuguacaaccaugagaccgaguguccguccauaggcucagugcuguaggggugcuguggggguggcgggagacaaaggacugaugggacuugcuggauggcugccuagaugcgcuucuguuuugggaagagacugccucaaaggaacaagguaaagcagauuagaggacaccuuguagcauguaguuuuaaaaaaugaacccaagcuaaauccggcuaugugccaacaucagcggucugucuaauccuagccuagugcauagcccgagaccauguauuucuucuagccaaugccucucucauaaacacuaucucugccucucccgcgcuucaagaucgcucucuugccaucccacuacacuccaagggagaguggagcucgguccuuugcccaaucuucccguuccaaagccuggccgaauuccuggcuaugcucuuucccugcugcccaccugagcugccaagaaugaaaaaacaccagacaaucguaguuuaaaaccaacagaugacacaacugcugcgcgcaaaaucucuccuaaacucaucaacuauucuauguugggaaucuuccggugguagaggucgccacugggucuaacagaucccaucuacauccugccuccuuucguccccaccucgcucuaaaaaggcguuuguagccgggcgugguggcacaugccuuugaucccagcacuugggaggcagaggcaggcgaauuucugaguucgaagccaacagccagugcuauacagagaaacccugucucaaaaaaacuaaaaaaaaaaaaaaaaaaaaaaaaaaaagcuaagaguggcuucaaccuuauccuauacucgccuagggauuugcagguuuuauacuggacacaagagcaacaaaguuuaauauauaagaaaauauuuauaggcgcuaaauugaaaauauuucauuuuauaaucuauauuguuuucaucuacauacguaccuaagugugguacauguuacauguccacagugagugacuauucuuuucuuauagugguguuccaggauggccuugaacacaggacugccccaccuugcauuaagugucagaugugugccauaccugcuccauguugacaucuuacaccuuuuuuuuuuuuuuucuuucgagacaggguuucucuguguagcccuggcuguccuggaacucacucuguagaccagacuggccucaaacucagaaaucgaccugcuucugccucugccucccaagugcugggauuaaaggcgugugccaccaugcccggcuacuauaguuuuuuaauuguuagcuuaacugguggugaggugagucugguucuaacagacuaacagucuguuaucaaaugcuggcacugacacaaauacauaaauacucaggaguuuugucuacuucaauacuuaguauaugguuuucuuguucuaaacgcccuguuuaguuuugcucucugaaaccaagcauaguggcaaaaaucuauaaucccagcauguaaagagacaggaagaagaaucaauggcuaaguccauccuuggcuacacagugacucugaagccagucugagauauaugagaucuugucacaagauaaaacaaacaggaaaaauacacacacaccacacaguaaauuauacuaaaaguguuaaaauuuucaucaaaauaaacaaagaauaucuaaauaauaaauuaauuuucauaggcuguggcaguaagcauuguugauugggcuaccacaggagaauucauuaaauuucuuagaaccugagacaggaaggcuuuuguucuuuuuaggaaaauauaaacaaaguagaggucauauaaagcaugauuauugcucagccuaggaacuaagucccugacacacucagauggugacuuuccauccaagaucaaggacucucucauugcagccucuggaagcgguaacauuugagucugccuuuacaauggagcccucaguuacuaagcagacugaacaccagcucucaggaacuagccaaaaguuuuauaaacuuucugauuuuacugugggguuauuguaaggugggaguuauaauuuuuauccacagcuuacaaaugaagaaacaauguuuaaaaauguucaacacuucuaaaguuaaauaagaucugauuuggcaagaaauacuucaguaaguuauccauaacuagcaugcaguuucccucuucugauggaaauuuuauuuuacucuuagaccauucuuuacgcuuuacaccauucuugccauuaguaucuaaguguauccuuaguuucuggaggacaguccaaagauguauggucagcuuaggcauaccuagguccuuuccugaguauccacuucacugcagacuacugcgggaaacacagagcugggagucauauccucucgaggccagcaguguggagugcugaagaauacgggagggaggcacaggaacaauguacuggacgcaaacucuuaacauaaagaauuuauacuuucaggcagcuaggaguuuuaguaaguuauccguaaucaaucaugguggcccaaccauguaguaccagcuuuauaggagguaugugcugugguuugaaccuagggccacauauauguuccuucacugagcuauguccugaguucaguguacuuuaaaguauauaucuucaagacauaucacuaacgacaaguauuucugaaaagguuaagaugacaaacuuuguacaauuauuuugugugcgagaaagggaaccuagggccucacauacacuaagcacacuguccaccaccacucagccagcccugaaccacuucuaaaggacugauggcacacuacuacucuaaaaccauuuuauucuuaugccaggaaaaugguguccuauaguugggguuuuagugcaaagagaaagaaagaaaugagaauuacaaaagaagagaguuuuggggaaagugaacuaaaacccugugcugugcugaggaugcacuggcggaggagcacugcccagccagccuaggcccuggguucaaaccucagaacugcagguaaaacaaaacaacccacaucuuuaacuuacuuuuggaucaucucccaaguuaauaauaaaauguugggguuuuuguuuguuuuuaaagauuuauuuuguguauaugaauacacuguaguugucuucagacacaccagaagagggcaucagaucacauuguagaugguuguaagccaccaugugguugcugggaauugaauuugaaagagcaguuagugcucuuaaccacugagccaucucaccagcccgauaaaauguuuuucuuuaauuacuuuuuguuguuguuuuuuuuuuuuuuuuuuuuuuuuucgagacaggguuucucuguguaauccuggcuguccuggaacucacucuguagaccaggcuggccuugaacucacaggaaucugcuuaccucugccuccuuagugcugggauuaaagggguauuccaccauacccagcuuucgacaggaucuuaacucuguagcccaggcuggcuauauuuguauguguagaauuuguaggauucauuuccuccuaccauguagguuccagggcucaaacucacauuaguuagaguuggcagcaagcaccuuuacccauuuugagccauccugcuggcccauaaaucuucugcauaaaauguggagacugaauggaagaucuguguuguuuccuuaagcuucagggguugagucuuuagccucacauaugcuuggcaacuacucuaccagugagcuaugucccuagcccugaaugaucuaugaaaauaaaaaaacuucacacuuuaauaucaguguuuuuaacaugaaagagaaaaugauaguuuuauuaaacuaguuaaugcuugcacacaauuacauacauuuuaaacugccaggauuuuugauaaguacaauaccauuuucggauaagcauaguauaacuuuaaauauuacaucauucagacucauguuggaaaacauuaacuuauaagggauuacagcaauguccauuuacugucuguagcaaaaagggucccuguuagaugucucagcauauggacggcuccucuacugccugagcgcccucggugacagcuuugacacacuuggccauugucugugaggcucugcuaauggagucugaaagacauuaagagcaugcauuuuguuaauacaacuuccuuuguuguuuuuaaaacaaugucucagauuucaggccagcccagaauucaauaguauaccaaguuagccucaaaucuggggugauccuccuaccucaaauucccagggaagagccacuaaugccauuuuuuuuuuuuuguuacugugacuuuagaacacacggagaauuuuaauguacacaugcaagaacaaaagccugugaagcuggaacgcaacuguagguaagcaauaagcccugaacauaagcucuuuacugcccacgguuuuuaguuagggucuuagcuaucucuggcugucuaugaagccaaggaugaccuugaacuuugaucugucugccuccaccucccauuuaccacaacuuucugguuauauguuuuuagucucuagcaguaauuaaauaaucacauaaaaacuagauuacaugacaguaugaaaaauuaaaugauaggaaauucuuuaaaaaucuaaggaaaaaaauggacacaauaugcucugcuuaucagauagauguuguagcucacacucaucgcgcuccagcacuucacaagaugaggcaggauugcugugugucugaggucaaccugggcuucaagagauagaaucauuuccaaaaaaacccaaaaaccccaccagaggcuggcaugaugguauggcuggacaagcugaguuugaucuauaucccaauauagaagcuuaauguacaggcacauauuaguaaucacagcccucuauaggaugagcaccaggaacuaagagaaucacccuguagcuuggguuagcuagccuggaauauaaaacauccuagagugguaggguuuuucuguauccacagcacucaaagaagcugagguagaaggugguaaauuggaggccauugugggcuacauaagaacaccuucccuuggggacuggagaaauggcucagugguuaagagcacugacuugagugcucuucugaagguccugaguucaaaucccagcaaccacauguucgcucacaaccaucaguaaugagaucugaugcaugcccuccucuggugcugaguucagcaaguagagguccugaacucaaauucccagcaaccacacgauggcucacaaccaucagcauagcuacaguguacucauauacauaaaauaaauaaauaaauauuuauugaaacaaaaaacaaaacaaaaaccaaaccuucucuuaaaaagagagccagacagugguaccacaugccuuugagaucucugaguuuaaguuuagacuggucuacaaagugaguuccaggauagccagggugucacagaaaaacucugccucaaaaagggaaaaaaauuaaaaagcucaauuuguuugucauucaugucuugcuauguggcagaauuuaauguugaacuccuuaaucuccugucaccaaguacugagacuccagguguaacccaccaugagcagaaaacccgccaaucuuugaaugcauguaaaucuuccugcuuccagcacucacaagucacaguacuguuucacuguaguuugugcuugguuguauaguguacaaugacuccaacuugcauuuauuuuuaaaacuguuuggaaauguaucauuggugugugaaugugaggggguaugagcauguccaguguuuguguggaggucagaggacaacuuuugggaguugguucugcuacugugggguccgguuuacaucacaagcuuuuacacaauaagccauucugcuggaucugauccuaacacuucuaucaccucacugaaauaaccuuacuaguacaugcuaacuuaaagauguauaaacacagagucugaaauguuaagaucauuugcaaaucuugcagagggcugggauuauguuccuaacaccuccauagaggcuuacaacugucugcaacucuagucccaggggauccaaaacccucuucucaucuccucaggaauuagauacacaaauaguacagaggcaugcauguaaacaaaaccuauacacauuuuuuaaaagguaaaauuaaacaucauuuuaaggcucauaagauguaguucaguuggaaaaaugcugcacuagcacacaggaagcccuaggcugggucuccaguaccauaaaaauugugguggugcaggccuguagucucagcacuuggcacugugagaaagaagaguacaaauucaaggucauccucugcuuugacaagaugguuuuaaggucaccuuggcuacaugaaacccaguuuuuaaacagggggggggggggggcccgcagagagauggcucagaggugaagagcaaugacugcucuucuagagguccugaguucaauucccagcaaccacaagguggcucacaaccaucuaucuguaaugggaucugaugcccucuucugguguggcugaagauagugacaguguauucucauacauaaaauaaacaaaaucuuuaaaagauuaaaaaauagaaaaccaaacaaauuuaugcuccuaugugcuuuuagguaagaaauuauuuacauaucaacugucucauaccuuuaucaacuguugucaaaguuauagaaaaugaauggugaucugcauuucuuaaaagcguucuaacaauuuacaccagaagcccuguuuaauauauuaaaaaaucuuuaaguauucugaauauucuaucaauaauuuucagaaaaccuugagaguuuuuuuaguacuuuaaauuucuauucauugauuuuuccauauacuacuaaauuuuacaauuuaaaucuguuaaaccuuuuggguguucaaacuuugcuuucaugucagaaacacacagaaugcuagaaagcuagggguauagugcccgugcuuaacauguacaaaaugagccuugacacccagaucuaccgccuaaauuacauuagcuuugaugucuaacaaugucagaccagaggcuccugagauguccucaguggacaagggugcuuguuaccaagcuuaaugacuugaguuugauucccacaaauuguccugaccuccacacucuucauggugagcguaugccugcccaagcacaaguaaauaaauauaaaaaaaucaaguucuuuagauuaauagcaaauauugccaaaccaaaaaaagcuaugaagcuaaaggauucucugauucucugugaguagguagcagucaaacuuaccugucauauagaagucuuuuauaguuagcugagguggaacgagugggucagcaagaaccuccugguuuacuagcuggaaagagagagagagaccagaaucauacugaaaaccaguacuaccaugccaagauacagcacauuaggaaaacugcacacaggcaaguuuuuaccuuggcaagcucacuugcuugcugaaaguaauuaguuucuucaauaucaucauaucgaaccagauuaggagagaccucuucaagacgguuccuuacuugauccagagugucauauggaagagugauaccugcaaucuacaacacaucagauucaccaugacaaacaacuuuacuacuuaaaaaaugucagaauuggggcaagccaggaugacucaagacaucaggcaucaagucugaagagagucaaucacuaggacccacacagugcaggaagagaacagauucccucagagcccucuaaaccuccaaauauuguugcagcacgcacagcccauggcccaauauaauaaauaauuguuguuuagcaggcugagauggccuggaucuuuaaucuuagcacuugaaagacagaggcaggcagaucucugaauuuggggccagcuuggucuauagaacaaguucuagggcuucaaagagaaaccuugucuugaggaaaaaaaaaaaaaaaaaucaggguuggggcucaaucuccagcaacaaaaaaggaacaaaacaauucauaauggaaacuaugauaaaauaacucgguauuacuagaaagaaaaaagucuuuuaguauauuuuagcaggcauuuuuuuccuuuuuccuuucuuaauuuuuuuccuuuuuccuuucuuaauuuaucugcagaauguugcucugugguagagagaauacuuagcaaguauaugguccugaaguaaaagaucacagagacgaugcuaggcuaacuaucaaugcuucuugcuugauguuaaucuacaaggaaaguaccaacuucaauucuucauuuuucugaacacuuuauuuccuacacaaccagguuaugccacuaacuuagccuuaaugaaugaaaucguaguucagcgguggaggcccugccuaguaccugccgaggcccuggguucugucuccagcacuacaagcuacauacaggaauuuauugaacuuaggacuucuucgugcaugcuaagcaaguccucucccaacugagccacaucuccaguugcuuaaugaauauuaaggaacaaaaaaagacuucaaagaaaugccucaaaaauaauaccucagagagagcucuuaugauuuuccagucuucucgugccaagccaggaggcgucacugcuacuuugguuugcugagcucugcccucaguauugacauaaguagcagacuuuucuguguaagcagccccugggagaauaacaucagccaugggagcaccaacaucaccaugguguccugggaggagaaaaacagugaaccauauuuuaguaaaaacuggacugggcuggagaaauggcucagugguuaagagcacugacuguucuuccagaggucucucauuuguuuugucaagacaagguuucuaugaaaaggcauacacuaccaugcccagccacuuucauaguuuauaaagugagacuaagagugcaguucacuuuuaaccccaaauucucgggaggcagaagcagguggaucccugaguucgaggccagccaagucuacagagugaguucuaggacagccagggcuauauggagaaaaaaaccaaaaaaagaaaaaaaaaaaaaaaaaaaaaagguaguuuagugguaaauugcauaguuugcaugaccaucauaaauaaaaaaacaaauaaauaaauaaaaauggcaauuaacaggugguauacugucuucccauauaauaguagccaguguaacuccuacugaucucaagguucuccugccuugauccccgcacugggaauacacauguguaacacuacuuuagauuuuauaguccaguuuugguuuuuuuaaaagauguauuuauuauauauaaguacauuguagcugucuucagauacaccagaagagggcaucagauuucauuacagaugguuaugagccaccaugugguugcugggaauugaacucaggaccucuggaagagcagucagugcucuuaaccacugagccaucucuccaccccaccuaugauaaguuuuaagaacugccucaaacucuuugucuucccaucucauccucauccugggcuaggaucacagguauaugcuacuccucugguuaacaaacagauuuuguuucuuaugauuuuuaaaauaagguuuauuauuuaaaaauugcaaauaaaaaagucaauauugggacuggagagauggcucagcgguuaaaagcaucuacugcucuuccagagguccugaguucaauucccagcaaccacaugguggcucacaaccaucuguaaugagaucugacaucuucuucuggggugcaugaagauagauaccguguacucauauacauuaaauaaauaaauuaauuaaaaaaagucacauauucauguugcagacccaaaguauauacacuucaaugaacugcuauauagucagaacaguuauucaaaacagaagcuguguauaucaaacaccucuuaguaugcaucagguaugauucucuuuuguuucuuguuuuguucuguuuuuucgagacaggguuucucuguguagcccuggcuguccuggaacucacuuuguagaccaggcuguccuggaacucagaaaucugccugccucugccucccgagcucucuuuuguuucuacugccaaguugcuacuuaccuugauaaacaaugaaacaauccuuuggcaaguccugucgcgugauacaaccuccaucugcucccagaagaaacagcauuuugggaggguucuuccuaaucgcuucuaccccagguuuauagccaagguccaaagcagcuaccuggcuugcaauccuguaaaacaauuauggauuuucaaauacaugcagcauuuaaguauaagcaauuugaguaauuacauaggaauaauuuguagcuucuuuuauauucaacucuuuuuuuuuuuuuuuuuuuuauuuuuuuuuuauauucaacucuuaccacugaaauauaagaugcauagcagagugucucucuuuuucuuuuugagacaggguuucucuguguagcccuggcuggccuagaacucacucuguagaccaggcuggcgucaaacucucagagauccuccugcuuccugagugcuggaauugaagucaugggcaaccaugccugguuucucuuucuuuuccugugguuuuggagacugaacuagacucuugugggcgcuaggcaagcacuuuaacagugagcuacucaucuuccuccuccugaaacuguuuuucaugaauuaauaugcaaugaaguaacuaugaaagccaacuguaaauggcuuaaauucaacacaguaagacauaaaacuuacaguaaaucaaacauguuuuagaguaaagccgcaggauuuuaaaaucaaaagagagcuaggugugguagcacacuaccauaaucccagcaaaggcaggaggacuauuagagugauguucugucugaggccaguuugauaguaaaucguggauuacauagcaagauccuaucuuuaaaaaggaaaaaaaaguaaaaggggguggugguggcuggagagauggcucagugguuaagagcacugaccauucuuccagagguccugaguucaaaucccagcaaccacaugguggcucacaaccaucuggucuacagagugaguuccagaacagugagcuacacaguaagacccuuucucgaaaacaaaaggaaaacccaccaaaaaaaaaaaaaaaaaaaaaagcagacacagacagacagagagagaggagggaggaggaaggagggaggaggagggaaaagcaaugcaggaacaccauuacuacacagacuggaauagacccuuucagaacggcuuccuacaacuguuuccauguuuuagugaagauaaucuaaggaagaagcucacaacaacagcccuucuaaaacaugcagagacaugcaaaacagcucuugaaaccucugccugcuuuaguccagccauucuacuuuauaaccuauggacaaggggaucuacaguucaguucccuggguuauugcugcuugcuuacuuagcuuaguuuuggagcugagaguggauucgagucuugcaccuggauaggugugcucguuacaccacgcaauugcacccuagucacucacaugguggcucacaaccauccguaacagagaucugacucccuugucuguaguguccgaagacagcuacaguguacuuacauauaaucaauaaauaaaucuuaaaacaaacaaacaaaaaacaaguaacaaaccuaugcagaauauucauaacuuuccacucugcagcaacaccgguugucacucgaaucuuuuguaccauguuggacacagcuacaagaauugcugcuccaucaucucucuggagugcagaacugccuaaaaccaccauugguuuuuuagcauccuuuaagaccuauuuuuaaaaauaaauaaauaaauaaauagauagauagauagauagauagauagauagauaaaaaaaaccuguugaucuuaaagcgcuauaugauauuugcaucuacugauaugcaaguuuggggaucuaacaugaagaaccauuaauuuacuuaacaucugaauuaauagaaacaucuugcaaauguuacuaugaaaaagcuuaguaucacauaaaacagauuuuauacaaguaagaauuaaaugauuagguuucaggccagccuaaucuacuuaacaaauuccaaaucauccaaggcuacauaccaagauaccaucucuaaacaaacaaaaagaauaaaaaauuuaaaauaugacagaaaaaauuguguugcaguaucaucuccuacuacuucuuaucuguagagauccagacagaagagaaagcagggagagcaacagggcauuccuaaagcagggaagaguuugcuuuacgccacaguaagggagugagucucaaggagauaggaaacuacaggcuuggggaagguugguaaguaaaacugaaaaucaaauagcucacacucguauaaaaauacuaaguuaaaagagccugagagacgcucggaagcccuuguagaguaggaaggaguucaguucccugaacccacauggcagaucacagcaucuacuuacuaacucuaauucaggguacacaauguccucuucugacuucuguagacauuaggcuggcaagugauagauauacaugaaggugggcaaaaaaaccucauacauauaaauuaaaauaaauaaauuuaaaauaauaauaauuaaaaauuggagcuggagagauggcucagugguuaagaaccugggcugcuuuuccagaggaccuggggucaauuccuagcacacacauggcagcucacaacugucuuuaacucuaguuccagaggaucuggaacccucacaaagacauacaugcaggcaaaacaccaaucacauaaaaauauaaaucuuuaaaauaauaguaacaguuaaaaaccagcaacaguagguauauauuaacuuaaaagcaccucgcagaaugaaugccucccugaagcaaugucuugcagaauuuuaggagagucuccuagauggucguaucuguaagugagguccacuggacuaccgaugagggccacuuuuaagucauuaugaagccagcugaaacaaaaacaauuuuagagccaaauaagcauagccuuugguuucaacaauucuaaguccuaccucuauuuacaaucauaaaauagcaaaagcacaaaagaacucacagacuauuuaaucuuaacacauauaauuuaagauguaccuuucaagauaagaguguuguaaaaauguauaaauaauucagggaguaaaucuguuguguggcaauccuaaguaccagucuaauguaaacaaaaacuauuuuagaauaacugaccuguaguuauauuccucaguacaugcuaugucagagucaguuauuucucaaauauccacaaaaauaaacugucauuuauuuauucuuuauagcagaguacuaaggggcuaccuccuucaaaacuauuggaguuuuuagguuuuuuuaagacaggguuucucuguuuaguccugccaguccugaaacucacucucuagaccaggcuggucucaaaaucagagaucuuccugucucugccuccagaaugcuggaauuagaagugugaaccacuaccgcccugcuauccuucaaaacuauuugugaguaugguaagucuaauucucguuugucugaagcaguacuaauuuuaccugaaguaguaacucccuuccacucucaaccauuuuacaggugagauaauaaucuagguagauaauacaguugcccuauuuuaaaugucuacaacacaaaugaaaaagacaauagaugugggagguguucuauaaaauaacuagccuguacucuauaaaaaaaaguaaaaugugugugugcgugugcaucuuuaaggaccaaccaaagaccugggaugggggaggcuccagggagucuauggagucacucuagcugagacuccuagcagugggggauaugaagcaugaaguggccacuccuauagccaggcaggaacccuagggaagugauaaggacaccaaucuacccacaaaaguuuccacccaaauuuuauucugucuaaaagaaaugcagagagggggcuaaagagaugguuaagagcacugacugcucuuccagagguccugaguucaauucccagcaaccauaugguggcucacaaccaucuauaaugagauuuugugccuccugguguauaggcauaaaagcaggcagaauauuguguacauaauaaauaaaucuuaaaaaaaaauuaagauuguucccugaguuuaaaauauagguagccaguuuuuguuuuguuuuguuuuuguuuuuguuuguuuuaaaaaaaaugaaaagaaauacaaagaaaggagauaagggaaagacugggggaauggccaaccaauaaccagcucaaccugagacccaucccaugggcaagcacaaaucacccacacucugauacucuguuaugcuugcagacaggagcauguuguccuuugagaggcuccacccagcagcugacucagacaugcagaaacccauagccaaacacuggauggagcuuggggacucuuauagaagaauaggaagaaggauuuuagcaucgaaagagauagaagaauaggaagaaggauuucagcaccgaaagagauaggaacuccccauaggaagaccagcaaagucaacucaccuggacccuuggggcucucagagucuaaaccaucaaccagauaacaugcacaggcugauccuaggccuccugacacauauguagcauaugugcaguuuggccuucauguggguccugaacaacuggagcaggagcuaucccaaaaguuguugccuguacuuaggauauguucuauuagcugggcugccucuucuggccucagugagagaugaagugccuagccucacagagacuugaucugccagguucagggcaugaaaggugagggguggggggagagggggagauacccacaggagcccucaucugcucagaggaggagaggggguauggaagaaggaucgugggaggggaugacuggaaggaaggagugagcaggagguaaaguaaauaaaaugggguggggggggaaauggggcccgaaaugucaugacauuaauugcaaugugacucuagauagaugcuggucaagaacaaaacugcuauaaaagauggggcuaaggauacaacucaguugacaggugcuuauguaguaugcaagaaaaacucugaauuuaaucccuaguaccaacaaacaaacaaaagucagagggugggacgggcaagacugcucugcagggugaggugcuugccaccaagccugacaagcucaguucaguccugagacucaaaggugaaggagggagccagcuccuaaaagcugcccucugacugccagauguacacugcacuagagcaugcucaugcacacacauauacauacauaaaauaaaguuuaaacacacaugcccguaacucaugaaauuacgguuggugagauggcucaguggguaagagcacugacugcucuuccaaagguccuggguucaauucccagcaaucacaugguggcucacaaccaccuauaaugagaucugaugccuucuucuggugugucugaagacagcuacaguguacuuaucuauaauaauaaauaaauccuuaacuggagcaggcagggcagaccgaagugagcagaggucagaaauucaaaucccaacaaccacaugaaggcucacaaccaucuguacagcuacaguguacucauauacauaaaauaaauaaaaaaaaaucuuuaaaaaaaagggaaguucaagggcagucaugacuauaucauaaaauuuuguuuaaaaaaaguacaggacaaagugucguagcacaugucuaucuauaaugccagcacuggagagauaggcaguuaaagguucacucugaauauguauugcccuagagacuagccugggucacaugagacccucacucauuaauaaggaagccaaguggggugguacaugucguuaaucucagcauucaagaggcagaggcaggcugauuucuugucaguucuagaccagccuggucuacauagugaguuccaggccagccagggcuacguaaugagaccaacucaaaaagagagagagagagagagagagagagagagaaaagaaaaagaaaagaaauauaugaacaaaaacaaaguacauuaaaaggcagagaggugggguagaaugaauguguuaggaaucccccuccccccagccucuguaucacuacaacuuauuaggaaucacccaaaauaucauuuccauauauuaaauuaaagaaaucacguauuuuaagguucuuauuaaauaaggauuaaauuaccucuuucuaauucuagcauuaaacagcggugccucaaaacguggauuuguaccaacuagaagaacaacaucugcuucuuccacaccagcaauugugguauugagaagauaauuggaacguaagucuguacuaaaauauaaaauauaacucaaguuuaagaagaaaaacaaacaguaaccacauaagacccugcaaguaaaccuaacacaugcuauaacacacacauaaagcuaauacaugcacgaguccacagacucgucucggaucauaaaucccagugcacucucacacacagguuuucauaaaguguguccaacugcuguccuguuuacagcccaaguuggccuugaacuugagcagccguccucucagcuaccacaugguugagacuaccacacacaccgugaugccaggcagguguguccaaaugaaacuaaacuuacaacauguauuaaggacuacauucuucuguaagauuuagcuguugauuucguuuauuagccuguguuaacuacacaugaugggugagaauuccacuuucauacauguguaaucugaucacguucaccucucauugcccucggagcuuccuucccaccccucuaagcuaccuuugcucagacaggaucuuucuacguucaugcugucugguuugacuuagaugugaaaguguacugguauguuagagaacccagugugucaaagauugaacagugacauuacagauguggcugcuuuuuuuuuuuuaaaaaaggaaaacgauagcugagaacaguuguaacacucaucuucaauccaaguacuuaggagguaaagacagaaaguucuucugcuacacagaguucaaggccagccugggcuacaagaaacucaaaaaucaaaaugaaaucccaaacagcagccuggagcacagcuuacugcuucucacccagcuccuucaguggggaagaucucuucagugcauaaguugucagagucaacuuuauuaagcaagucuuucagagcuacuaaggcuucagcauccaccaagccuccugcaaucgcugccacagcauugccuucaaaauucuguaacuggaaacagaaaagggcaucucuaagaaaccuacagucagcaaagaccaugacuguucaggaaauaaaccaagucauuuucaagcauccagaguagcaggaggcacagccgucucuccugaauuaguguagcuaccacugcacauuaaagaagcuuuuuacagcaaaugcagaggaaaaccacacuggaaacaaugcagaaaucaacaaauuguggggaccccagccacaacagacacaucuacaccauggcucuugcagcuauugcucaaggaaccagaaaauaaagagucuaagagccagcguaccagaagucugcuguaaagcagugucuccuagaaaggcugcauaaacaagauccgaauaccaauaccaacaggaauuuuaacauggaagggagaaaauuccacaggucucaccucuagacaaagaacugcaagcaacugacugcugggagaaaaagaauuagcuucucucaggaaugaacccccauauagguuguccaguacagagcagucagucagccuugaaaucauauauacacaaacaauaaaaauguagagucuauuugugcauguacauaaauuuauauauuuacuauauauauauauaauauaaauauaaaaaauaaaaaaguuuuuucaauuaaaaaaaaagacagaggcuaucaacuugagaauagaaggggaaugagagggauucagggauaggucacuaggagggccuggagagagaagccagauaagugauacaguucuauuucaacuauaaaaugaaaauauauauauauauauaaaacauguauuuaaaaagacauuguugucaaaaaauauuagcuagcaaauaaaaaacauuuaaccuuuucuuuuucuggugaauuaaauuaacuaacauuugauuauugaaauaacuuccgaguucucaaaauacucauacagucaaggaauuuaauguauuuugggucugaaugcaaugaaccacuuauauuucuuucuaauaaacugauuccuagcagacua

SEQ ID NO: 186 - RNA, 43904 nt, Mus musculus
uagucugcuaggaaucaguuuauuagaaagaaauauaagugguucauugcauucagacccaaaauacauuaaauuccuugacuguaugaguauuuugagaacucggaaguuauuucaauaaucaaauguuaguuaauuuaauucaccagaaaaagaaaagguuaaauguuuuuuauuugcuagcuaauauuuuuugacaacaaugucuuuuuaaauacauguuuuauauauauauauauauuuucauuuuauaguugaaauagaacuguaucacuuaucuggcuucucucuccaggcccuccuagugaccuaucccugaaucccucucauuccccuucuauucucaaguugauagccucugucuuuuuuuuuaauugaaaaaacuuuuuuauuuuuuauauuuauauuauauauauauauaguaaauauauaaauuuauguacaugcacaaauagacucuacauuuuuauuguuuguguauauaugauuucaaggcugacugacugcucuguacuggacaaccuauauggggguucauuccugagagaagcuaauucuuuuucucccagcagucaguugcuugcaguucuuugucuagaggugagaccuguggaauuuucucccuuccauguuaaaauuccuguugguauugguauucggaucuuguuuaugcagccuuucuaggagacacugcuuuacagcagacuucugguacgcuggcucuuagacucuuuauuuucugguuccuugagcaauagcugcaagagccaugguguagaugugucuguuguggcugggguccccacaauuuguugauuucugcauuguuuccagugugguuuuccucugcauuugcuguaaaaagcuucuuuaaugugcagugguagcuacacuaauucaggagagacggcugugccuccugcuacucuggaugcuugaaaaugacuugguuuauuuccugaacagucauggucuuugcugacuguagguuucuuagagaugcccuuuucuguuuccaguuacagaauuuugaaggcaaugcuguggcagcgauugcaggaggcuugguggaugcugaagccuuaguagcucugaaagacuugcuuaauaaaguugacucugacaacuuaugcacugaagagaucuuccccacugaaggagcugggugagaagcaguaagcugugcuccaggcugcuguuugggauuucauuuugauuuuugaguuucuuguagcccaggcuggccuugaacucuguguagcagaagaacuuucugucuuuaccuccuaaguacuuggauugaagaugaguguuacaacuguucucagcuaucguuuuccuuuuuuaaaaaaaaaaaagcagccacaucuguaaugucacuguucaaucuuugacacacuggguucucuaacauaccaguacacuuucacaucuaagucaaaccagacagcaugaacguagaaagauccugucugagcaaagguagcuuagaggggugggaaggaagcuccgagggcaaugagaggugaacgugaucagauuacacauguaugaaaguggaauucucacccaucauguguaguuaacacaggcuaauaaacgaaaucaacagcuaaaucuuacagaagaauguaguccuuaauacauguuguaaguuuaguuucauuuggacacaccugccuggcaucacggugugugugguagucucaaccaugugguagcugagaggacggcugcucaaguucaaggccaacuugggcuguaaacaggacagcaguuggacacacuuuaugaaaaccugugugugagagugcacugggauuuaugauccgagacgagucuguggacucgugcauguauuagcuuuauguguguguuauagcauguguuagguuuacuugcagggucuuaugugguuacuguuuguuuuucuucuuaaacuugaguuauauuuuauauuuuaguacagacuuacguuccaauuaucuucucaauaccacaauugcugguguggaagaagcagauguuguucuucuaguugguacaaauccacguuuugaggcaccgcuguuuaaugcuagaauuagaaagagguaauuuaauccuuauuuaauaagaaccuuaaaauacgugauuucuuuaauuuaauauauggaaaugauauuuugggugauuccuaauaaguuguagugauacagaggcuggggggagggggauuccuaacacauucauucuaccccaccucucugccuuuuaauguacuuuguuuuuguucauauauuucuuuucuuuuucuuuucucucucucucucucucucucucucucucuuuuugaguuggucucauuacguagcccuggcuggccuggaacucacuauguagaccaggcuggucuagaacugacaagaaaucagccugccucugccucuugaaugcugagauuaacgacauguaccaccccacuuggcuuccuuauuaaugagugagggucucaugugacccaggcuagucucuagggcaauacauauucagagugaaccuuuaacugccuaucucuccagugcuggcauuauagauagacaugugcuacgacacuuuguccuguacuuuuuuuaaacaaaauuuuaugauauagucaugacugcccuugaacuucccuuuuuuuuaaagauuuuuuuuuauuuauuuuauguauaugaguacacuguagcuguacagaugguugugagccuucaugugguuguugggauuugaauuucugaccucugcucacuucggucugcccugccugcuccaguuaaggauuuauuuauuauuauagauaaguacacuguagcugucuucagacacaccagaagaaggcaucagaucucauuauaggugguugugagccaccaugugauugcugggaauugaacccaggaccuuuggaagagcagucagugcucuuacccacugagccaucucaccaaccguaauuucaugaguuacgggcauguguguuuaaacuuuauuuuauguauguauaugugugugcaugagcaugcucuagugcaguguacaucuggcagucagagggcagcuuuuaggagcuggcucccuccuucaccuuugagucucaggacugaacugagcuugucaggcuugguggcaagcaccucacccugcagagcagucuugcccgucccacccucugacuuuuguuuguuuguugguacuagggauuaaauucagaguuuuucuugcauacuacauaagcaccugucaacugaguuguauccuuagccccaucuuuuauagcaguuuuguucuugaccagcaucuaucuagagucacauugcaauuaaugucaugacauuucgggccccauuuccccccccaccccauuuuauuuacuuuaccuccugcucacuccuuccuuccagucauccccucccacgauccuucuuccauacccccucuccuccucugagcagaugagggcuccuguggguaucucccccucuccccccaccccucaccuuucaugcccugaaccuggcagaucaagucucugugaggcuaggcacuucaucucucacugaggccagaagaggcagcccagcuaauagaacauauccuaaguacaggcaacaacuuuugggauagcuccugcuccaguuguucaggacccacaugaaggccaaacugcacauaugcuacauaugugucaggaggccuaggaucagccugugcauguuaucugguugaugguuuagacucugagagccccaaggguccaggugaguugacuuugcuggucuuccuauggggaguuccuaucucuuucggugcugaaauccuucuuccuauucuucuaucucuuucgaugcuaaaauccuucuuccuauucuucuauaagaguccccaagcuccauccaguguuuggcuauggguuucugcaugucugagucagcugcuggguggagccucucaaaggacaacaugcuccugucugcaagcauaacagaguaucagagugugggugauuugugcuugcccaugggaugggucucagguugagcugguuauugguuggccauucccccagucuuucccuuaucuccuuucuuuguauuucuuuucauuuuuuuuaaaacaaacaaaaacaaaaacaaaacaaaacaaaaacuggcuaccuauauuuuaaacucagggaacaaucuuaauuuuuuuuuaagauuuauuuauuauguacacaauauucugccugcuuuuaugccuauacaccaggaggcacaaaaucucauuauagaugguugugagccaccauaugguugcugggaauugaacucaggaccucuggaagagcagucagugcucuuaaccaucucuuuagcccccucucugcauuucuuuuagacagaauaaaauuuggguggaaacuuuuguggguagauugguguccuuaucacuucccuaggguuccugccuggcuauaggaguggccacuucaugcuucauaucccccacugcuaggagucucagcuagagugacuccauagacucccuggagccucccccaucccaggucuuugguugguccuuaaagaugcacacgcacacacacauuuuacuuuuuuuuauagaguacaggcuaguuauuuuauagaacaccucccacaucuauugucuuuuucauuuguguuguagacauuuaaaauagggcaacuguauuaucuaccuagauuauuaucucaccuguaaaaugguugagaguggaagggaguuacuacuucagguaaaauuaguacugcuucagacaaacgagaauuagacuuaccauacucacaaauaguuuugaaggauagcagggcgguagugguucacacuucuaauuccagcauucuggaggcagagacaggaagaucucugauuuugagaccagccuggucuagagagugaguuucaggacuggcaggacuaaacagagaaacccugucuuaaaaaaaccuaaaaacuccaauaguuuugaaggagguagccccuuaguacucugcuauaaagaauaaauaaaugacaguuuauuuuuguggauauuugagaaauaacugacucugacauagcauguacugaggaauauaacuacaggucaguuauucuaaaauaguuuuuguuuacauuagacugguacuuaggauugccacacaacagauuuacucccugaauuauuuauacauuuuuacaacacucuuaucuugaaagguacaucuuaaauuauauguguuaagauuaaauagucugugaguucuuuugugcuuuugcuauuuuaugauuguaaauagagguaggacuuagaauuguugaaaccaaaggcuaugcuuauuuggcucuaaaauuguuuuuguuucagcuggcuucauaaugacuuaaaaguggcccucaucgguaguccaguggaccucacuuacagauacgaccaucuaggagacucuccuaaaauucugcaagacauugcuucagggaggcauucauucugcgaggugcuuuuaaguuaauauauaccuacuguugcugguuuuuaacuguuacuauuauuuuaaagauuuauauuuuuaugugauugguguuuugccugcauguaugucuuugugaggguuccagauccucuggaacuagaguuaaagacaguugugagcugccaugugugugcuaggaauugaccccagguccucuggaaaagcagcccagguucuuaaccacugagccaucucuccagcuccaauuuuuaauuauuauuauuuuaaauuuauuuauuuuaauuuauauguaugagguuuuuuugcccaccuucauguauaucuaucacuugccagccuaaugucuacagaagucagaagaggacauuguguacccugaauuagaguuaguaaguagaugcugugaucugccauguggguucagggaacugaacuccuuccuacucuacaagggcuuccgagcgucucucaggcucuuuuaacuuaguauuuuuauacgagugugagcuauuugauuuucaguuuuacuuaccaaccuuccccaagccuguaguuuccuaucuccuugagacucacucccuuacuguggcguaaagcaaacucuucccugcuuuaggaaugcccuguugcucucccugcuuucucuucugucuggaucucuacagauaagaaguaguaggagaugauacugcaacacaauuuuuucugucauauuuuaaauuuuuuauucuuuuuguuuguuuagagaugguaucuugguauguagccuuggaugauuuggaauuuguuaaguagauuaggcuggccugaaaccuaaucauuuaauucuuacuuguauaaaaucuguuuuaugugauacuaagcuuuuucauaguaacauuugcaagauguuucuauuaauucagauguuaaguaaauuaaugguucuucauguuagauccccaaacuugcauaucaguagaugcaaauaucauauagcgcuuuaagaucaacagguuuuuuuuaucuaucuaucuaucuaucuaucuaucuaucuauuuauuuauuuauuuauuuuuaaaaauaggucuuaaaggaugcuaaaaaaccaauggugguuuuaggcaguucugcacuccagagagaugauggagcagcaauucuuguagcuguguccaacaugguacaaaagauucgagugacaaccgguguugcugcagaguggaaaguuaugaauauucugcauagguuuguuacuuguuuuuuguuuguuuguuuuaagauuuauuuauugauuauauguaaguacacuguagcugucuucggacacuacagacaagggagucagaucucuguuacggaugguugugagccaccaugugagugacuagggugcaauugcgugguguaacgagcacaccuauccaggugcaagacucgaauccacucucagcuccaaaacuaagcuaaguaagcaagcagcaauaacccagggaacugaacuguagauccccuuguccauagguuauaaaguagaauggcuggacuaaagcaggcagagguuucaagagcuguuuugcaugucucugcauguuuuagaagggcuguuguugugagcuucuuccuuagauuaucuucacuaaaacauggaaacaguuguaggaagccguucugaaagggucuauuccagucuguguaguaaugguguuccugcauugcuuuucccuccuccucccuccuuccuccucccuccucucucucugucugucugugucugcuuuuuuuuuuuuuuuuuuuuuugguggguuuuccuuuuguuuucgagaaagggucuuacuguguagcucacuguucuggaacucacucuguagaccagaugguugugagccaccaugugguugcugggauuugaacucaggaccucuggaagaauggucagugcucuuaaccacugagccaucucuccagccaccaccacccccuuuuacuuuuuuuuccuuuuuaaagauaggaucuugcuauguaauccacgauuuacuaucaaacuggccucagacagaacaucacucuaauaguccuccugccuuugcugggauuaugguagugugcuaccacaccuagcucucuuuugauuuuaaaauccugcggcuuuacucuaaaacauguuugauuuacuguaaguuuuaugucuuacuguguugaauuuaagccauuuacaguuggcuuucauaguuacuucauugcauauuaauucaugaaaaacaguuucaggaggaggaagaugaguagcucacuguuaaagugcuugccuagcgcccacaagagucuaguucagucuccaaaaccacaggaaaagaaagagaaaccaggcaugguugcccaugacuucaauuccagcacucaggaagcaggaggaucucugagaguuugacgccagccuggucuacagagugaguucuaggccagccagggcuacacagagaaacccugucucaaaaagaaaaagagagacacucugcuaugcaucuuauauuucagugguaagaguugaauauaaaaaaaaaauaaaaaaaaaaaaaaaaaaaagaguugaauauaaaagaagcuacaaauuauuccuauguaauuacucaaauugcuuauacuuaaaugcugcauguauuugaaaauccauaauuguuuuacaggauugcaagccagguagcugcuuuggaccuuggcuauaaaccugggguagaagcgauuaggaagaacccucccaaaaugcuguuucuucugggagcagauggagguuguaucacgcgacaggacuugccaaaggauuguuucauuguuuaucaagguaaguagcaacuuggcaguagaaacaaaagagagcucgggaggcagaggcaggcagauuucugaguuccaggacagccuggucuacaaagugaguuccaggacagccagggcuacacagagaaacccugucucgaaaaaacagaacaaaacaagaaacaaaagagaaucauaccugaugcauacuaagagguguuugauauacacagcuucuguuuugaauaacuguucugacuauauagcaguucauugaaguguauauacuuugggucugcaacaugaauaugugacuuuuuuuaauuaauuuauuuauuuaauguauaugaguacacgguaucuaucuucaugcaccccagaagaagaugucagaucucauuacagaugguugugagccaccaugugguugcugggaauugaacucaggaccucuggaagagcaguagaugcuuuuaaccgcugagccaucucuccagucccaauauugacuuuuuuauuugcaauuuuuaaauaauaaaccuuauuuuaaaaaucauaagaaacaaaaucuguuuguuaaccagaggaguagcauauaccugugauccuagcccaggaugaggaugagaugggaagacaaagaguuugaggcaguucuuaaaacuuaucauaggugggguggagagauggcucagugguuaagagcacugacugcucuuccagagguccugaguucaauucccagcaaccacaugguggcucauaaccaucuguaaugaaaucugaugcccucuucugguguaucugaagacagcuacaauguacuuauauauaauaaauacaucuuuuaaaaaaaccaaaacuggacuauaaaaucuaaaguaguguuacacauguguauucccagugcggggaucaaggcaggagaaccuugagaucaguaggaguuacacuggcuacuauuauaugggaagacaguauaccaccuguuaauugccauuuuuauuuauuuauuuguuuuuuuauuuaugauggucaugcaaacuaugcaauuuaccacuaaacuaccuuuuuuuuuuuuuuuuuuuuuucuuuuuuugguuuuuuucuccauauagcccuggcuguccuagaacucacucuguagacuuggcuggccucgaacucagggauccaccugcuucugccucccgagaauuugggguuaaaagugaacugcacucuuagucucacuuuauaaacuaugaaaguggcugggcaugguaguguaugccuuuucauagaaaccuugucuugacaaaacaaaugagagaccucuggaagaacagucagugcucuuaaccacugagccauuucuccagcccaguccaguuuuuacuaaaauaugguucacuguuuuucuccucccaggacaccauggugauguuggugcucccauggcugauguuauucucccaggggcugcuuacacagaaaagucugcuacuuaugucaauacugagggcagagcucagcaaaccaaaguagcagugacgccuccuggcuuggcacgagaagacuggaaaaucauaagagcucucucugagguauuauuuuugaggcauuucuuugaagucuuuuuuuguuccuuaauauucauuaagcaacuggagauguggcucaguugggagaggacuugcuuagcaugcacgaagaaguccuaaguucaauaaauuccuguauguagcuuguagugcuggagacagaacccagggccucggcagguacuaggcagggccuccaccgcugaacuacgauuucauucauuaaggcuaaguuaguggcauaaccugguuguguaggaaauaaaguguucagaaaaaugaagaauugaaguugguacuuuccuuguagauuaacaucaagcaagaagcauugauaguuagccuagcaucgucucugugaucuuuuacuucaggaccauauacuugcuaaguauucucucuaccacagagcaacauucugcagauaaauuaagaaaggaaaaaggaaaaaaauuaagaaaggaaaaaggaaaaaaaugccugcuaaaauauacuaaaagacuuuuuucuuucuaguaauaccgaguuauuuuaucauaguuuccauuaugaauuguuuuguuccuuuuuuguugcuggagauugagccccaacccugauuuuuuuuuuuuuuuuuccucaagacaagguuucucuuugaagcccuagaacuuguucuauagaccaagcuggccccaaauucagagaucugccugccucugucuuucaagugcuaagauuaaagauccaggccaucucagccugcuaaacaacaauuauuuauuauauugggccaugggcugugcgugcugcaacaauauuuggagguuuagagggcucugagggaaucuguucucuuccugcacuguguggguccuagugauugacucucuucagacuugaugccugaugucuugagucauccuggcuugccccaauucugacauuuuuuaaguaguaaaguuguuugucauggugaaucugauguguuguagauugcagguaucacucuuccauaugacacucuggaucaaguaaggaaccgucuugaagaggucucuccuaaucugguucgauaugaugauauugaagaaacuaauuacuuucagcaagcaagugagcuugccaagguaaaaacuugccugugugcaguuuuccuaaugugcuguaucuuggcaugguaguacugguuuucaguaugauucuggucucucucucucuuuccagcuaguaaaccaggagguucuugcugacccacucguuccaccucagcuaacuauaaaagacuucuauaugacagguaaguuugacugcuaccuacucacagagaaucagagaauccuuuagcuucauagcuuuuuuugguuuggcaauauuugcuauuaaucuaaagaacuugauuuuuuuauauuuauuuacuugugcuugggcaggcauacgcucaccaugaagaguguggaggucaggacaauuugugggaaucaaacucaagucauuaagcuugguaacaagcacccuuguccacugaggacaucucaggagccucuggucugacauuguuagacaucaaagcuaauguaauuuaggcgguagaucugggugucaaggcucauuuuguacauguuaagcacgggcacuauaccccuagcuuucuagcauucuguguguuucugacaugaaagcaaaguuugaacacccaaaagguuuaacagauuuaaauuguaaaauuuaguaguauauggaaaaaucaaugaauagaaauuuaaaguacuaaaaaaacucucaagguuuucugaaaauuauugauagaauauucagaauacuuaaagauuuuuuaauauauuaaacagggcuucugguguaaauuguuagaacgcuuuuaagaaaugcagaucaccauucauuuucuauaacuuugacaacaguugauaaagguaugagacaguugauauguaaauaauuucuuaccuaaaagcacauaggagcauaaauuuguuugguuuucuauuuuuuaaucuuuuaaagauuuuguuuauuuuauguaugagaauacacugucacuaucuucagccacaccagaagagggcaucagaucccauuacagauagaugguugugagccaccuugugguugcugggaauugaacucaggaccucuagaagagcagucauugcucuucaccucugagccaucucucugcgggcccccccccccccccuguuuaaaaacuggguuucauguagccaaggugaccuuaaaaccaucuugucaaagcagaggaugaccuugaauuuguacucuucuuucucacagugccaagugcugagacuacaggccugcaccaccacaauuuuuaugguacuggagacccagccuagggcuuccugugugcuagugcagcauuuuuccaacugaacuacaucuuaugagccuuaaaaugauguuuaauuuuaccuuuuaaaaaauguguauagguuuuguuuacaugcaugccucuguacuauuuguguaucuaauuccugaggagaugagaagaggguuuuggauccccugggacuagaguugcagacaguuguaagccucuauggagguguuaggaacauaaucccagcccucugcaagauuugcaaaugaucuuaacauuucagacucuguguuuauacaucuuuaaguuagcauguacuaguaagguuauuucagugaggugauagaaguguuaggaucagauccagcagaauggcuuauuguguaaaagcuugugauguaaaccggaccccacaguagcagaaccaacucccaaaaguuguccucugaccuccacacaaacacuggacaugcucauacccccucacauucacacaccaaugauacauuuccaaacaguuuuaaaaauaaaugcaaguuggagucauuguacacuauacaaccaagcacaaacuacagugaaacaguacugugacuugugagugcuggaagcaggaagauuuacaugcauucaaagauuggcggguuuucugcucaugguggguuacaccuggagucucaguacuuggugacaggagauuaaggaguucaacauuaaauucugccacauagcaagacaugaaugacaaacaaauugagcuuuuuaauuuuuuucccuuuuugaggcagaguuuuucugugacacccuggcuauccuggaacucacuuuguagaccagucuaaacuuaaacucagagaucucaaaggcaugugguaccacugucuggcucucuuuuuaagagaagguuugguuuuuguuuuguuuuuuguuucaauaaauauuuauuuauuuauuuuauguauaugaguacacuguagcuaugcugaugguugugagccaucgugugguugcugggaauuugaguucaggaccucuacuugcugaacucagcaccagaggagggcaugcaucagaucucauuacugaugguugugagcgaacaugugguugcugggauuugaacucaggaccuucagaagagcacucaagucagugcucuuaaccacugagccauuucuccaguccccaagggaagguguucuuauguagcccacaauggccuccaauuuaccaccuucuaccucagcuucuuugagugcuguggauacagaaaaacccuaccacucuaggauguuuuauauuccaggcuagcuaacccaagcuacagggugauucucuuaguuccuggugcucauccuauagagggcugugauuacuaauaugugccuguacauuaagcuucuauauugggauauagaucaaacucagcuuguccagccauaccaucaugccagccucuggugggguuuuuggguuuuuuuggaaaugauucuaucucuugaagcccagguugaccucagacacacagcaauccugccucaucuugugaagugcuggagcgcgaugagugugagcuacaacaucuaucugauaagcagagcauauuguguccauuuuuuuccuuagauuuuuaaagaauuuccuaucauuuaauuuuucauacugucauguaaucuaguuuuuaugugauuauuuaauuacugcuagagacuaaaaacauauaaccagaaaguugugguaaaugggagguggaggcagacagaucaaaguucaaggucauccuuggcuucauagacagccagagauagcuaagacccuaacuaaaaaccgugggcaguaaagagcuuauguucagggcuuauugcuuaccuacaguugcguuccagcuucacaggcuuuuguucuugcauguguacauuaaaauucuccguguguucuaaagucacaguaacaaaaaaaaaaaaauggcauuaguggcucuucccugggaauuugagguaggaggaucaccccagauuugaggcuaacuugguauacuauugaauucugggcuggccugaaaucugagacauuguuuuaaaaacaacaaaggaaguuguauuaacaaaaugcaugcucuuaaugucuuucagacuccauuagcagagccucacagacaauggccaagugugucaaagcugucaccgagggcgcucaggcaguagaggagccguccauaugcugagacaucuaacagggacccuuuuugcuacagacaguaaauggacauugcuguaaucccuuauaaguuaauguuuuccaacaugagucugaaugauguaauauuuaaaguuauacuaugcuuauccgaaaaugguauuguacuuaucaaaaauccuggcaguuuaaaauguauguaauugugugcaagcauuaacuaguuuaauaaaacuaucauuuucucuuucauguuaaaaacacugauauuaaagugugaaguuuuuuuauuuucauagaucauucagggcuagggacauagcucacugguagaguaguugccaagcauaugugaggcuaaagacucaaccccugaagcuuaaggaaacaacacagaucuuccauucagucuccacauuuuaugcagaagauuuaugggccagcaggauggcucaaaauggguaaaggugcuugcugccaacucuaacuaaugugaguuugagcccuggaaccuacaugguaggaggaaaugaauccuacaaauucuacacauacaaauauagccagccugggcuacagaguuaagauccugucgaaagcuggguaugguggaauaccccuuuaaucccagcacuaaggaggcagagguaagcagauuccugugaguucaaggccagccuggucuacagagugaguuccaggacagccaggauuacacagagaaacccugucucgaaaaaaaaaaaaaaaaaaaaaaaaacaacaacaaaaaguaauuaaagaaaaacauuuuaucgggcuggugagauggcucagugguuaagagcacuaacugcucuuucaaauucaauucccagcaaccacaugguggcuuacaaccaucuacaaugugaucugaugcccucuucuggugugucugaagacaacuacaguguauucauauacacaaaauaaaucuuuaaaaacaaacaaaaaccccaacauuuuauuauuaacuugggagaugauccaaaaguaaguuaaagauguggguuguuuuguuuuaccugcaguucugagguuugaacccagggccuaggcuggcugggcagugcuccuccgccagugcauccucagcacagcacaggguuuuaguucacuuuccccaaaacucucuucuuuuguaauucucauuucuuucuuucucuuugcacuaaaaccccaacuauaggacaccauuuuccuggcauaagaauaaaaugguuuuagaguaguagugugccaucaguccuuuagaagugguucagggcuggcugaguggugguggacagugugcuuaguguaugugaggcccuagguucccuuucucgcacacaaaauaauuguacaaaguuugucaucuuaaccuuuucagaaauacuugucguuagugauaugucuugaagauauauacuuuaaaguacacugaacucaggacauagcucagugaaggaacauauauguggcccuagguucaaaccacagcacauaccuccuauaaagcugguacuacaugguugggccaccaugauugauuacggauaacuuacuaaaacuccuagcugccugaaaguauaaauucuuuauguuaagaguuugcguccaguacauuguuccugugccucccucccguauucuucagcacuccacacugcuggccucgagaggauaugacucccagcucuguguuucccgcaguagucugcagugaaguggauacucaggaaaggaccuagguaugccuaagcugaccauacaucuuuggacuguccuccagaaacuaaggauacacuuagauacuaauggcaagaaugguguaaagcguaaagaauggucuaagaguaaaauaaaauuuccaucagaagagggaaacugcaugcuaguuauggauaacuuacugaaguauuucuugccaaaucagaucuuauuuaacuuuagaaguguugaacauuuuuaaacauuguuucuucauuuguaagcuguggauaaaaauuauaacucccaccuuacaauaaccccacaguaaaaucagaaaguuuauaaaacuuuuggcuaguuccugagagcugguguucagucugcuuaguaacugagggcuccauuguaaaggcagacucaaauguuaccgcuuccagaggcugcaaugagagaguccuugaucuuggauggaaagucaccaucugagugugucagggacuuaguuccuaggcugagcaauaaucaugcuuuauaugaccucuacuuuguuuauauuuuccuaaaaagaacaaaagccuuccugucucagguucuaagaaauuuaaugaauucuccugugguagcccaaucaacaaugcuuacugccacagccuaugaaaauuaauuuauuauuuagauauucuuuguuuauuuugaugaaaauuuuaacacuuuuaguauaauuuacugugugguguguguguauuuuuccuguuuguuuuaucuugugacaagaucucauauaucucagacuggcuucagagucacuguguagccaaggauggacuuagccauugauucuucuuccugucucuuuacaugcugggauuauagauuuuugccacuaugcuugguuucagagagcaaaacuaaacagggcguuuagaacaagaaaaccauauacuaaguauugaaguagacaaaacuccugaguauuuauguauuugugucagugccagcauuugauaacagacuguuagucuguuagaaccagacucaccucaccaccaguuaagcuaacaauuaaaaaacuauaguagccgggcaugguggcacacgccuuuaaucccagcacuugggaggcagaggcagaagcaggucgauuucugaguuugaggccagucuggucuacagagugaguuccaggacagccagggcuacacagagaaacccugucucgaaagaaaaaaaaaaaaaaagguguaagaugucaacauggagcagguauggcacacaucugacacuuaaugcaagguggggcaguccuguguucaaggccauccuggaacaccacuauaagaaaagaauagucacucacuguggacauguaacauguaccacacuuagguacguauguagaugaaaacaauauagauuauaaaaugaaauauuuucaauuuagcgccuauaaauauuuucuuauauauuaaacuuuguugcucuuguguccaguauaaaaccugcaaaucccuaggcgaguauaggauaagguugaagccacucuuagcuuuuuuuuuuuuuuuuuuuuuuuuuuuuaguuuuuuugagacaggguuucucuguauagcacuggcuguuggcuucgaacucagaaauucgccugccucugccucccaagugcugggaucaaaggcaugugccaccacgcccggcuacaaacgccuuuuuagagcgagguggggacgaaaggaggcaggauguagaugggaucuguuagacccaguggcgaccucuaccaccggaagauucccaacauagaauaguugaugaguuuaggagagauuuugcgcgcagcaguugugucaucuguugguuuuaaacuacgauugucugguguuuuuucauucuuggcagcucaggugggcagcagggaaagagcauagccaggaauucggccaggcuuuggaacgggaagauugggcaaaggaccgagcuccacucucccuuggaguguagugggauggcaagagagcgaucuugaagcgcgggagaggcagagauaguguuuaugagagaggcauuggcuagaagaaauacauggucucgggcuaugcacuaggcuaggauuagacagaccgcugauguuggcacauagccggauuuagcuuggguucauuuuuuaaaacuacaugcuacaagguguccucuaaucugcuuuaccuuguuccuuugaggcagucucuucccaaaacagaagcgcaucuaggcagccauccagcaagucccaucaguccuuugucucccgccacccccacagcaccccuacagcacugagccuauggacggacacucggucucaugguuguacagcaggcacucuuagcacugagccgucucuccagucuuuuauuuuuuauuuugugguuuuucgagacaggguuucucuguauagcccuggaaaucacuuuguagaccaggcuggccuugaacucagaaaucagccugccucugccucccgagugcugggauuaaaggugugagccaccacgaccggcucugucucuccagucuuaaucuuuuaaauagaucuaaagaaaaaaaaaaaaugcguuuguuuugaucucuuuuuucccaaggaaagucuuacuuuguagcccaggcugccuucaaaguuccagucuuucugauuuuaccucccaaaugcugaaccacaggucuguaccaccacaccuggcuucaggagaugguuuucugguaggugucuuaccgauugugugaucuggguuacuacaggucaacaugagucuuaacuaaagugauacuccucagagaaaaugcuuaacauuauaguuuguauauguaagaccgcaacccuuggacauugguacuuacuucgagaugccccuuucgagaugcaaaucagaucgaugcaaaagcaagaaguuuauuuuccuggagguaagugaugagaaggugaccuugaauggcuauugcaagcaguuuuuuguuuguuuugguuugguuuuuuuuuucaagacaggguuucucuguguagcccuggcuguccuuggaacucacucuguagaucaggcuggccucgaacucagaaguccgcccaccucugccucucaagugcugggauuaaaggcgugcgccaccacugcccagguacaagcaauuuuuauacuuuuuaggggcacagguuacaucagcaagguuacaguucaaacuuauuagcuaagccuauugaccuuuaaaucuauuggcuagcaagcaugacacgcauuugaacucuaccugggacuuuccaaagggucaggugacugucaggacauucugagaauuuuuuacucaggaauguuccuuuggguggagaauggaacuuggccuagccuugacccuugaccucaggugggaagaggaagcugaaaggagggaaggaggguguggggcuggaaaaagcccuuagggucccuccuguucuagagugaagcugcuccauuaccauuuuauuggacuuaacugcaguguguguguguguguguguguguguguguauuacacucaugguggaaggagagaacugacuccugaaagcuguccugaccuccauuugcaguccauggcaccugcacacauacucaaauaaauguuuuguuuuggguuuguuuucuugagcccuggcugaucuggaacucacuguauagaucagguuggucuugaacucagagaucugccuuccuccaucacccaagugcuauaauuaaaggugugcaccaucauguccugcuuauaauaaacaaauuuuaagcccuuuuuucccccaaugcugagaggaaguuguuuuaucugaggugguucauugcauauauaaauaauaauagggucacuuccuguagcuuccccaugcauacuguggacauuuuuuguuugcuuagcaggaaguacacagccaagccuuuuugugggguagggcuuguuuugcaucugcaagccucagagaauggucaguuaagggauaaguaucccggacaguuuuguucccuuggcaauugggcuuauuuuucaguaacuggaauguguccucuagcauccacagccuuuaucacuggccaacuguuuguacuuaauauauuuggacucucucuuuucaaaccuuuguucucuguagaugggagaggcaucucccucgucucaguuucaccugcagcgucucuggucacuucccucuaaugugcuucccucauauuccccacucauauugccaucucauagauuauuuaaguaaucauggccaguaguggugguacacagcuguaaucacaacacuugggagacugaggugagcuucuaccuaaauaaauaaauaaauaaauaaauaaauaaauaagcaucuaucuaaaauguaccuuucuacucugugcuuaacuuaggauuggcuuguaacaugcauuacucuuugguaaacacagagucccagugcauaaucagauaguaggacaaacagcaugauuuuaggaaaauccgacauguuguguaaaucauuagauaucaaaggaaauaucuaaucuuuuucuaaauuuuuaugugcaugaguuuuuugucuauguauaugcauaugugccaugugcauacaauggccaaggcagccagaaaagggccucagaccuccugggacuggaguuacagggucauugugaaccacaccauguggauguugaaaauugaaccugggcccucuagaagagcaaccacucuuaccacuuuuuuuuuuuuucuuuuuuucaaauuucacagcuuauugggugggacagagggccacauuucugccugcuuacccacaaacauuuaaaaaacuguuauugaagagcaaccauucuuuuuuuguuuguuuguuuuuguuuuuguuuuucgagacaggguuucucuguauagcccugguuguccuggaacucacuuuguagaccaggcuggccucuaacucagaaaucugccugccucucccucccuagugcuggaauuaaaggcgugcgccaccacgcccagcgaagagcaaccacucuuaaccccugaggcaucucuagugcccucuaauucuuaauauauuuggugccuaguauaagaggacacucuuguacugucaguacucaggaggcuaagacaggaaggaggagaauaggaguuggaggcgcgggagcuaugugaugaguucacagccagccugggauguauaacaaaacuaucucaaaaagcagccaaaaccacccccagagcaaagagcccauaucuuaucccacuguaaccuuucugacuggacuugguucuucuacucauguucugcuguaacauauacguaaaugaacauauguguaaaguacacaugcaaaagaagccguccugagagaccagaugagaaacaaccugcaaugggauagaaaacuuaugcuagaaccaccaaaaagaucccuaggggcuuuuacugcuucuaauacaacagucugcuguuaccgcuaauagcuuaaauuaaggcugggagguaaggauugugccuacucaguguuauauuccaggaaguaucuggugugcucuuuaaaugggaacagugauguugacuuugcucuucaugccuggugccaguguugaauagaacgagccaaaugcuuacccccagaguaaguuccucucuccuaggcauucaauugcuggguaggggacugggcaaggaauuguauuaaauaggcucuucuguccacgaggaggucauccucccucauugagaacucuucuuucaugccuucugauucagcacgguuacacaacauuaaguugccucugcuagucucugauacaggcuaguuuauguacacagugauauguuaauuaauaucagauacuauuaaucuauguauauuuugagcggauaaaccagacagcagaccaggucaaggugguuccaugugggagagguuuauugugcauggauagggggguggcaaagcggguagaagggcagaggauaggaaaaagagagaaagagggggaagagaagaaagagaagagagagaagaaaagagagcaaggagggggugauccccuaauuuauauggaaaaugacgucacgccagugagggugggaacugagccaaauggguugugggauugagggucguuguccuagcaauguaggucaagggucacauaguuaggccggggcuuggaguguccugguacuaacacacagagauggcaaaaaggauccacacauccauucccuaccauucauuaucuaaggcccauaguuaguucuuagaccucuccuuacuccucaucaagcuaacacaucaaagauguugguuauccuuuucuuuccaauccaaaugauaaauucauuaucauuacaacuucuucuuaacuuugauuaacuaugcuguacuuuauuauuauuuccugguaaaguacuugccuugauagucaaggcucuggguucaauuccuagcuccaagaaaaaccaaaccaaacagucauguuuuucuucuggaccaguuaccauaccuguuaacuuuccccauucaaucaccauaauaccgauccaaugacucauuucaacuuggcacugcuccgugagucucauucaguuguuguuguuguugcaauauuaacuaguaaguuauacaaugcaauucugucauacaacacaguuucuuaguucauuugaauacuaacuuugauuucuuuauagauaaccaaaauugauagaaaagcaguuguaagcauuagcaacccaguguaaauuauguauaguuauauaugcucauaaaaacacuuucaaggagcuggagagaugacuaaggaguuaagagcacuggcugcucuuccuaaggaccugaguucaauucccagcacccacauggcagcucacaaccaucuguaacuccaguccuaggaugucuaacaccuucacacagaauacaugcaggcaaaacaccaaagcacauacaauaaaaauaaauaaaucauaaaaauaaaauacuuuugcuagguaguggucaugcacaccuuuaaucccagcacuggagaggcagaggcagguggauuucugugaguucaaggccagccuggucuacagagugaguuccaggaacagccagggcuacacagaaaagcccugucuugaaaaaccagaaugaaaaaaauaaaacccaaaaccucucaaauuauaacaucggccaggcauuaugggagagacagguuuauaaucucaacacucaaguauucacucaggugaggcaggaggauauuauacagcaagaccuugacucaaaaugcaaacaaguagaaaacccuacagacuuguuuugaagggcugggucggugacucagugggaaggaccacuugcugaguaagcgugagaaccugaauuugaauccccagcagucacauaacccagccacacacaccuggaaccccaguauuguguguaggcaagacaggaagauugcaacuguagugcgcaucaggcuaguuccaggguuagugaaaggucauauuucauagcuguuaaggcaggagagaggacacacaacacccuccucuagccuuaagggugcacauaugugagugucucuagccuuaagggugcacauaugugagugugucuccauacaccacauacacauaugcacacacgcaaacucuuaauacauuuuaagauauuauuaaauaauaauuuuuaaaauauaaaauguauuuuauauuuuaaaguauauaaaaauaauacauauuauuuugacuuguaagucauauuuuugcagguuuucaauuuuuuuuguuuuuuuuuuuuguuuguuuguuuuuuugagacaggguuucucuguauagcccuggcuguccuggaacucacuuuguagaccaggcuguccucaaacucagaaauucaccugccuuuuugucuuuuuucgagacaagguuucucuguguaguccuggcuguccuggaacucacccuguagacauggcuggccuccaacucagaaauucgccugccucugccuccugagugcuggguuuaaaggcaugugccaccacgcccagugguuuucuacuuucuaaaacuuuuaauaaguaauauuccuuacuauauuucaaauuucaaagacuccuacaagugugaauuuuuuuuccuuuucacauuauaugggguuucauuuuguuguuguuaugcuauguauguuuguuuguuuauuuguuugugugugugacauagggucucacuuuguagaccagacuaggcuggccucaaacuccuaagaaacuugcuugccuuugucuggagugcugggauuaagacauuccauacugaacuuggucugguuuuuguuuuuuauucuuuguuuguuguuuuguuuugagacagggucucauguagcccaaaccuggcuuugaacuugcucuguagccaaagacaaccuugaacuucugacucugcuguuuccauuuuacaagugcuauguuuauagguauaucacagcacaccugguuagggucugucugucugucugucugucugucugucuucuucuuccuccuucuuuuccuccuuucuccucccuccuccuccuuccccacucuuccucccccucuccuccaccuuaauucguuuccacuuuugaagaagguucacauucuguagcucaagcugaccuugaguucuuaucaauucuccuaccucagcugcugcuuacucagaauauagacaaagccuccacacccuacucauuccggguuuugguuuguuuuuuuuuuaauguaggauugggccugggagaugacuaagacuuccacaaaaggaugaggaccccaguucagaucuccagaguccacauaaaagcuggauggauaugguagccaccuguaaccugccucagaaggcuagagacaggauccccagagcagagcccagcaagacuagccauaucaccaggucuagauuucauugagaaaccugaccuuacugagcaagguaaaagagcccuaacaucaaccccaggccuucaugugcaugcuuauacacacauguacuccuugaccccuggacacauguguauacacaagugcaccaaaugcaaacacauuaagagaaaaguuacagguaggacugggagacugguuuuaagagcaugaggcaugugguagcucacaccuuuagucucaguauuccagcgguagaaggaucucugugaguucaaagccagccuggucuacagagcaaguucuagaacauccaggcccacacagagaaaccuugucucaaagagaguaaaaacaaaucaaagagagguaagaaagaaaagaaaaacauuauacuguugagguccuaaaauaggaaaacagguuuccauauaggaaacacgcucuccuguguagaaauaaagcaaauaugaaagcuguucuaggcucagcugguggggugcuuguuagcauguaggaaacccuggguucaaacacuagcuacugcuuaaaacugggcauggugguauauauucccaacuuucaggaggaucaaaguucauuuguuccucaaguacauagcaagcuugacgccugccuaggacacuugacacccugucucaaaaaacgccucugcauauuagcaggauuuugauguaaaucuaagucuguguggcacuuagucuauuucugagauuuucacccuguguauuuucugucuguugaaauuacaguuuuucaacucugccaaagcugggagaaaucacuaagcugugaacgaguuugaagacaucgugacaucuaguacugcuuacugggugccaacacggugauagauccaucauucaugugcucagagagaaagccgcaggaucaguucucuaaauggaaacucuaguucuaugguugauaagcuacuaucauuuuguuagacguuuucaucauugugacaaaaauacccgagaaacaacuaaagaggaaaauucaauuuugauuuuguuuccaguccacuguaucugggaagguguggugggacagugcucuuccuucauggccuccaggaagccgaaggagaaauggcuucuuuccucuucuccuuuauuccucuggcccacagacacuggguggagccauccacacacuggguggagccauccacguugaaggcggguccucuuccacacguaggagcuggugcuccucuggaaguguccucacaaaggagugccuuacuaauccaaguacgucgaaugucaccaaguagugucuagagaaguaguucagucggccauguguuuucagagcacgcgcaaggcucuggaagccaucuuuagucguaaguaagcaucagccaggcuugguaauacagcgccuauaauuccagguccucagaguuagagggaggagagaugguccagugguuaagagcacuggcuacucuuccagaggacccagguuugauucccagcaaagcgugccaugguagcucacaaccaucuguaacuucaaucuuagggacccaguguccuuuucugaccuccgugggcacuaggcaugcacauggccuacaaauauacaugcaggcaaaacauucauaacaaaauaaauuaaaacgcuuuaaaaaauauucaagagccgggugugguggcgcacgccuuugaucccagcacucgggaggcagaggcagguggauuucugaguucgaggccagccuggucuacaaagugagcuccaggacagccagggcuauacagagaaacccuaucucaaaaaaaccaaaaaaaaaaaaaaaaaauucaagguuauccuuggcuccauagcaaguccucagaacuugugacacuuccuucugucucacgccccugagugcaggagugauaaugcauguaccugcacaccaccagggauggcuguaggaacuccacuuugguuucccuucuccuuugguccucuugggguacuucagugccucucccaaacuagauguguucugccucugagcuguaucucuagcccuucuaaaaugauuuucucugacaggaucucacaaagccuggccugacauuuagaaccuccuugccucauuuccugaggaccuuggauuacagaacuaaaccacagauucauccacaagagucugaucuguaaaaaagaaugagagugggggcuagagaguugcucaguggagcacugggugauguugcagaggacucggguucaguucccagcccccacgugacagccccucacaaaugucuguaacuccaguuccagcagaucugauaccuucuucugagccuccaaggauaucagauacucaugugguacacauccauacaugcaggcaaaacaccuaugcacauaaaauuuaaaacaagcuucagagaaugaaaguggacacugagaaaauccuguggcuauagaaaaaaaaaguuuaguuuauucuaugugcucucucugcauguauguguacaugccuaaugcccucugaguucagaagaccauacugguuccuagaacauacuggaguugugugacaguuguaagcugucauauggguaauggggauugaacuggguccucugcaacaacagcaagggccgagccaucucucuagucccagggugauuucuaauacgaccacuguaaaggucaguacuaaaauagaaagccuuaaacgacuuccuugugugugugcagaggcacacuacauaguccaggcugucuuugaacucuuuugaaaaagacugauuucuuauauuuuucucuccuauauuugugaacuucuaucuauuggcuucagguauccaggccugcacagccagacccguuaccugcugcuagccucuacuguuugugagagcggaucucccgugcucuaggcuggcauuggguccuccugguccuugucucccacugcccacccccaccccugucugcacacagugcuuuacaccagguacccuguuucuagucaguugaaacgaggggggaacuugacuuuuaaaacugcucauauguagucuccccucccccagccugaaaccugcuugcucagggguggagcuuccugcucauucguucugccacgcccacugcuggaaccugcggagccacacacgugcucaacuuucuacuggaccagagauuauucggcgggaaucggguccccucccccuuccuucauaacuagugucgcaacaauaaaauuugaacuuugaucagaaugaauuugucuuagcuccauuucuucuuucgccccgucuagauuccucucuuacagcucgaguagccauaucagucgaaccguucacguugcgagcugcuggcggccgcaacacucauaggaagguuacuuuaucuacuccaaugauccugagauuaagcuacugaaagcggcuuuucuauauuuuaaguuaugauuuauuacaucuuacuguuugccaccaauauuuaccacagugcuuuuucagagucagaucuucaauaaacauuuacuuaaugaauaagugaauaaaaaauaaaaaugcauuauagccaagaguaugcugagaacauuuauuuguuuuuaagugauuuucuuuugagauaggaucuuacuaugcugccuagugugacuuggagaucuucagcuuacgugaaccuuuugugcuggcuucccgggucaaugcagccaccugcacacaugacugcaccuggcuuagauuguuaacuuucuguauguggcuuuaaagauguaauucccaggcagagaugcguguagggguuuauaaaccacucuuuauacagcagagcagcacagugggguggaugagaaucauugcuuuuacagcuggguaaaaaucugugccacugacaaacaugaaagagggggacagacagaugggucgacaguuuucacuguugcuggaggacagaauugaaaccaguguccugccaggggggaaugagugacauuugcuuuuauuaaggauuuagacaaguguacacauacaguuuuuuuaaaagcaccaggcauggucaugauuaauauacaggaucguaguacuuggcuggcugagucaagaggauuacugugaauuugaggccaucgggaguucuaguguaaucuggacuagagugaaaaccugucuucaaacaaaacacaaucaacaagguagaggugcccagcagagcguuugccuuguauguaugaagcccagaguccgguucccagcaccacaugcaugggguauaacagcacaugccugggaucccagcacuugggagguggaaacagauggcagaaggucaucccuacagagacccuauuuaaagaaaaacaagcaaaagagcguggagcuuauucucaguguagaguacuuacuaccauguaggaaugaaucccuaguuuaaucuacagaaccaaaagaaucacuuucuaagcagggcaugaugacacagugcaagccugagcuuaagcagaacaaaacagcuuuaugccagaguggucaguugucucauuaguccaaauauguucaugugggaagcagaguagugccucucaagggugucauguuuggcuggaccugugaacaggcuugcagagcaaaagacauuuuguacauguuaauacauuaaguuucuuaaaauggggacgaugacccugcauuauccaagugggccuaacagaaccagagaccuuagagcaagccaucuagaucagagucagaaagagaccagagaaucuagucaagccgggcgugguggcgcgcaugccuuuaaucccagcacuugggaggcagaggcagguggauuucugaguuugaggccagccuggucuacaaagugaguuccaggacagccagggcuauagagagaaacccugucuccaaaaaaaaaaaaaaaaaaaaaaaaaaaaaaaaaaaaaaaagagagagagagagagagaaucuagucacgaugaagacaggagaaaggcugggguuaucccggcugucuccggguacaguggggccuuccuaagauucucuguuauuguuugcguguuuugagauggaggcuaacuauguggucugucuggcuaggacuagcuguuguguugacuagaauagccucccaccaaaugccagcauaaaccgugugugcuguaguagaguaugcacgguggcugguggucaccacaccucuuacugauggcgucauuuuagccaaguaaauacuauuuuggagcuuuguuuccagaaugacaagacaauacacuuuguguuggcuuaggccauuaauuaaacuugugauaauuuaagguagguguagagacauguacuuguaaccucagcauuugggaggcugacaacagacugagcaucagaggcaagucuccacgacaaagcagaacgcacauaauuagcacauagaagaaaggaccauauagugaugucauauaagaaaagagacauauuguagagaaacagaaccuuugcauagacacaaauaucucccucaaaaaacuuaauuaugcaagaaccccaagauuaaauacaaaauguaguuaguaguaaaguauaaagcccugagcaggagagauggcuuagcaauuaagagcacugacugcucuuccagagguccugaguucaauucccagcacccacaugguagcucaugaccaucuguaaugggauccgaugcccacuucuggugugucugaagacagcuauaguguacucauauacauaaaauaaauauuguuggguagugguggugcaugccuuuaaucccagcacuugggaggcagaggcaggcagauuucugaguuuguggccagccuggucagagugaguuccaggacagccagggcuauacagagaaaccuugucuugaaauaaauaaauaaauaaauaaaauguguaaaguccuaagcaaagccccuuuucuucagaaugaccacuguaacuauacagaaguucaccaagauguguaguuuggaacugggcuuaaguggcuucuucuuaccagcucagugauguuuuugugacuuacucagaauaaagugauuuugcuuaaugugcguguuugccugaauggauauuauaugugugcccaaggaugucagaagagggugucagauccaauggacuugggauuacagaugguugugagccacccaucauccuuauacagggcaaccagaauuuuaccaaccuugcuagugaugauaacacugaccacuaguuaaaaugcugcuuucuccacuacaaacuuguuuuuuuccauuuaugauuaauaggguuauuuuuguuguuguuuuucuauuuuuuucuuucuucuuuucuuuuuuuuuguuuucuuaggucuuuuuuguuuguuuguuuguuuuuuuaaauaaaaaaauaaagccauguggcagagacggcucagugguugagagcuuguacugcuuuugcggggacucaaguucaguuccagcaccaacacuggguggcucaccaccaccagugaaaacaaccauuuucccucccucccuuccucuuuccccaucuucuuccuuucuuugaaauagggucucgcauuguggucucaguuuguacucuaggcuggacucagauuugcagcaguccuuaacuucaggcugccuuccaggcggugggauuacagggaugugccauaugcccaacuuuaugcaacauuucagacuugagucuagaaguagggaaagugugaggucugcuugcaggaacagcugcugccuuuguagauggcggucauguggcaauccuauggaaauaucuccuaguagcuuagagaaaggaacgggcaaguaccuaaccuggaugagaaggcuguccaacccacagaggaacuuuuagcauugcacaaguuacucauaguucugaccaccagaagcugagauaagaaauggguguugcuuucagacagcaaaucugugguaacuuguuauggaggugacagaaaaugauauacuuauuaauaauacauugacaucaccuacaggucauuacaucugagauucuugcaaaaaauauaccaaccuucaucuaaucaugaaaacaaacaaacaaaaaacacuggaaaaacaccaaaguaccaauucuaucaaauuaagagcaguauucuuccggagugcugaggucaggaaagacaggaaggacugagucgcugggaaggaaagagugugaaacugaggagcucugaggauagacagcuaacaaaacacaggaacacaccaguuauaucuuguguguguguuuguguguguacaccguggcacacaaguggaggucagaugacaauuuucaggaggaguugguuuucuuuuugccauguggcuugguagcaggugucuuuaccugcugagcuaucuugcugguccuuccagauguuaagaugaaaaguauuuacagggacuggagagauggcucagugguucagaguaccugcugcacuugcagaggccucauucaguaccaggaccuacacagggcagcucccaaucuccuguaacuccagguccaggggauucugacccuugagggcaccagcauucaccugcacauacucacuaucuguaauugaaaagaaagcauuucuuuguuguauuuuuguagccccggcuagccuggaagucacuaaguagaccaggcuggccucaaacucauagagauccaccugccucugccucugccucugagcugcgauuaaaagugcaugccacaccggggaagcagaggcaagaggcauggguuucaggccaguguggucuacauagcaaguuugaggcuacccagaguacauagugagacgcgucucaaaaaaaaaaaaaguauaugccaugagacccaguaaaagauuuuccuucuuaaaacaaaaguguuuguagugugcugacauacucuuagccaauagcuggugagauggcucaguggggaaagacagagaccucgucaccugaaugggauuccuauguggugggaaaaaaaugacuccuuaaaguuacccuuugaccuccacaugccaaggacacacacacacacacacacacacacacacacacacacacacacacacaaauaaaauagagagccaggugugguggugcacgccuuuaaucccagcacucaggaggcagaggcagguggauuucugaguucgaggccagcauggucuacagagugaguuccaggacagccagggcuacacagagaaacccugucucaaaaaacaaaaaacaaaaaaaacaaaaaaaaaaaagaguaccuguuaaugagaauaauccaaaagugaaaauuagggcaauuaauacauuugcaaggcaauuuuaaaaaaagcguuacuaguccauuauggguaggagacguaacagugucaucaucacugugcuccccccccccccccuuagagccucuggaacuaggguuacagacugagccucugcgugguccugggaacugaaucuaggcccuuaaccacugagccaucucuccagucccagcgcuagaugacugcuucuugcuuuauuucaagauagugugucuguauauauuguauaagaaacguauccaugcucuuuauccuugcuuccugacacaaagccucucugguccacauaacuuccagaugacagaugugugugccuccugugcugauauuuggccauugucccugguccacagacuucugaaagcucuuggaauucccgggucaaaagaguaucuuucuaaugagugacucuugaccugccccaaacaacuuaggaauaacuggagaccagacacaccaaaccuggaucagaggccuggaagcuuugcuuaccccauggccucggggaaggaagaggggaggagauggaguuaauaauuaagcaugucuacgugccuggccaucaguaucccacaugccaggguauggaagcuuccaggauggaggccacacaccugagcucagagggugauguguccagagaggacaccgaaaccccgugccucuccagcaccuccacaguguccuggccaucuuguucuuccauuugguuguuccaggguuagacucuguaauaaaccaggaguguugcuguuuguauaaugaguucuagcuaaucuuuaaacuagagguuguaggacaaccucacuuuggccacgugggauguuaguugggguagccugaggaccugauacuaggaacuagcaccugaagugaggguugucuugugugacugagccacuaacccuguggggucugauaauaagcccugguaacuggugucacagcgucaguuuugacugagcuguaggacacuugguuauauaaccagagaguugggagaauugguugaaaugagaaaccccacacauguccagaaugcuuacaugcgguuugcuuucucgcucuuucucucucuuccucucccucccuccucucugggucuuguucuauugcccagacagacuucagacucuugggcuguagaggucuguugcuucugucucuagaaaauuugggacuacagacagacaagcaugugucacugugaccaacaguauuagaaauauuguuugggcaaagagcucagcaaauggaaugauaaauacacaaauuguuccucccugcuuaaaagaaucauucacuuuuccuuauugcucugguugaagacccaguuucguuuccagcacccacaccuugccuuacaacuacucuaacugcagccucaggagccagcaccagcaccuuuuggcuucugagggcacuugcauuuacauacauguagauaaaacacucggacacauaaaauaaauaugucuuuaaagaaucuuaauuuuucucaucucagcuaagauauucuugaagcgaaagagaauaguagcauacuccuccagcagaaaaugaagaucccauguuggaauacauauguacucuauauauuuauguauacacacauacauauuugaucugaagaacacagaaacuuccuucuaacaguagcaacaaaaagacaaauggccugugagaacaguuacaugguguuucuuagaauggcaucccaccauucuacuuuccuucucccacgcccaaccccacauaguuugaaacagucucugugugugugugugugugugugugucugacgaugaccuugaacuuuggaucuugccuuuagcggcugggauuauagguacagacugcuacacucuguuuauacagugcuggggcuuuaugcacgcuaggcaaacacacuaccaagagaacuacauccucagcccuucuuacuuugacacggaguuacacuauguuggccaagcuggucuugaacuucugaacucacaguauuagccugccucagccucuuucauacugggauaugagugugcaccguuauggcugccaugaauuguuuucuuaguuuaucucaggggucgacacacuuacuugugauaacuuaccugaccacuaguaacuacuguuguauaaagcacucagauuuauugcucuuaaauuuuguuuauauuuuaugaguauagguguuuuucauacauguaugucuguauacugcaugcuugccugguguccacaguggucagaaaagcguguuggauccuuuggaacuggaguuauagacgguuguuagacacuaugugagugcuuggauuccuuuggugugcucuuaaugcugggcuagcucuccaauccuguucuugggcacagugguacuucccucuggguucaguguuagucaaguuaaguuggguuacugugauuugcagccugcaugggguacacaguaucaggcuacccagagccauauaaugugauaaucuucucucaaaaccagaaacaaauaaauacauuuuaagaaacaguucucccuaccuccucaauacagacacaguggcuacuauuuggcuccaggcugguccaacggccuucucugagguugauguuaacaucguccugggcagggcaacaggaagcaccuguguguccuaccacaaacggaggugacccauuguugcgacaugacauuugaaggauaaauucuguugguaguaaauuacauaacugccccucauacauuuagaacagacacacaacuccuguggacacagagaugguucgugacugugggaagaucgacuuuuauuuaaucaguugaaagguuggguccccaucauguguugucaucugccacccccaaacacccaaugauuuaaaggaaacuuguauaacgaaagacaggcuuauaaaauuuuuguuaugguauagagccaucuauagugacaacaaaacuuggggaaaaaaaaaguuacccuuuaaauccacuugcgucaauauuuaaaauaagguauuuugacugggacuugcuggggagauaggguccuaucaucaaucaguucugcaugaacuggcuauguugguucaugccugaaaugccaggagucuauacauggaggcaaaaggaccaaaaguucaaggcuaaccuuggcuacagaguucuaggccaucaugggcuauaugagccugucuccaaauaaagcaaaaaacauaaacaaaacaccccugacacuuuucguuucuccuucucucucuccagcacuuccuucuuucuuacacaucucucucuagauccacacauucuuuuugacucauggguaaacaauguuuagaaucuucuuucuaggcuggagagaugggucagagguuaagagcacugacuacucuuccagagguccugaguucaauucccagcaaccacaugguggcucacaaccauguguaacaggaucugaugcccucuucuggugugucugaagacagaaaugguguacucauuuaaauaaaaaucuugaaaaaaaaaaaagaaucuucuuuuauggacuuuaguaucaacucagcuguguuuagacuuccuuugaagugccaaauaccagaaagaaacuacugaaagggugggcagauuuauuuuggcucacugugucagagguuucuaggucauggugagacagagcaucauggcagaugaguauacaggaguaaagcugcucaccuccaggcaaccaggaagcaggaaccuagaagcacugcugggaacaagauacauuucucaaaggcacacaucaguggcccacuucuuccaaccagaacucaacaaugccaucagacgaucaacuaucaguggaucaauccaucuacaaauccugaagccuuaucaucuaaucacuuccuacaaggucaucagugggcaaaaaaggccaguguaagauaggguguggcauuucacaguuaaacuacaacacacaacaccuauuuauuuugauuuuccacaagaaaaaaaaacuuugcauugcaucucccgcccccaugauuccaugcaucuugucagcuccuucaugucuauuuuacagggugaucuuaauauaauagcauggucacacuacauuuugacgagauguucuaggugggacauauccugauuagccaacaaguucccauggauguauuuagugcugccagcaacuguguguguguguguguguguguguguaucuaucuaucucauguguggugaugccacacauuuuaucaacauagcagcaguguuuccugucacuguuuuugaucuaguccagaagcacaugcagacacacuauauuaagccuuuuuuaaacuagggcuggggaccaaacucuaggccuuggguaugcugggcaacgcucugcccugucaccuuaagucagaaauggaggcacaacaagaggcaguagaguagcaggcaaacagaaggcucuggccucaucacuuuccuauucugauuagagaauuauucguuaucguguggcagcggccugaguuccacggugcaugcacaugugagggucagagggcugcuuggugcagucagaccucuccuaucaccuuuaucugggggccagggauugaaccagguugccaggguagugcagcaagugagccacugcacuguuccuccuucugguucuaagucuaaaauaaagccagacaugauggcuaaugaaugccuguaauccuaacacuugggagucugggacugaaggacugccacaguuuccaggccagucugguuuacaguguuaauuccagacuagucugaggccuugucucucuuacuagaacaaaacaaacagaauaaaacaaagcacaaauaucuauuauaucaugugacaccuaggagcagcacuacauacagaguaagggggacgaucugaucugagucacugggguuccccuuucuucugugcuauggugguuucggucuuugacagucuucucuucugagcuaugaucauaguuaaucuucauuuuaucuguaagagucgauuuaccccauuuccccuuacugcugaacucuggcuaucuaucacaauggugcgauggggccucuggagcacacaagucuaaacuuauuaguggcuguguuccacaacaucucuaaauuacuugucuggaaccuggaauuuauuuucccauggaaauagugguuacauucccagugggucuacaaaagcuuguuuagccagaaaugucacagaaaugaacagugucaccuuucugcuaaccccugcuuauuauccugaggucuccauggauuucucuccuuacuacaauauuuaacuaaucuaaccauaacuuuggggacacuuuuuuuuucuuguuauaaauuacagaaaagauugacuauuaaugcuaauucuaccuaaauucaaucuuuaaucuuacuuugaagcuuuaauuaaacaaaacaaaacaacccacccaauuaucacuuaagaugugacuucuguuggagaguuauuuucuuaacaucaggaggaauaauguucccugauaugugugacauugucauucucugccuguagccugaaaggggccuccuccagcacagccacugaccaucuaguucuggaagggcuccugcugggcuuugaggagacuuaagacagacaaaccagcagcccucucagcaacucucagacagacucccuucuuauuuagcauaagaucagguaacaguucucaggucugaguagucguggauaaguuagaauucagauugccuauauuugacuacauuugaaucagagauaccuaccuaccuaccuacuucccuaccuccuaccuaccuaucuagagugagcacuccugaauauaaaccaggcuagccuugaacuugaagagauccgucucccuccaucuacucaguuguugggauuaaagaugugugccaccaugccuaccuuaaacuuguguauuuuuuuuacagaaauuucacacugaaauaaucuaaagcgaucacaugccugcuucauucggugcuuaccucaggaacaguuucuuucaagacccaguaaccacaauaaaacccaaaucuuugaaacacuauaaauggccauuucuaaaacaguaagguuuagacugaaagugucuauggucauguuaauguagaauuuaggcacacaccuaccugccaucuuccgggcuuuugaggucagcugucuaggcugggugggguacaguggagauugauaggcacagccccuuaccuccagucaugguggggagauuaccacauagagccagaacauacauggacuucaggucugugcggugcaccauagcagccagcacggggcuuggcacauaugcugccuagccucugcaguaacugcaacucugugcuuggacgauacccauucauccauucaaccaaggucucuggaacuguccauccuccugcuucagccuccuaugacugagagcacaggcauuagcuaccauggucuguuugguauggagucuugcuuuuagaaguguuggaauaugcugaauaugguaccucacaauggaagggggagaggggaguccagaccacacaucuggucaaccugugugucuagaaguaaaaagacagagcuaugguguuauacaucuaugacccuagcacuucaaagguagagaaaagaggaccagcuaaauauagguugaggcuagccuaggguucuugagacaccaucucaggaaagaaaacacaaacaacccccaaaacaaguuccugcaagacaaaaaucuuaguaacccugaauaacaauuucuauugucagugcuuucuuucuuucuuuaaagaaaaaaaaauggugauuuugucagcaacuauuugccaagaauggcucuuuuacuuauugacagauucuaauacauuaaucacacaugaaucuuuuacuuuaaaucuacaaugucuaaauaagauuuuuuuuaaaauuaauuuuuuagcuagcauacaaaauaauggguauuguuacauuuccauacauauacaccacuguuuaaaagagaccuuuuaaggacagaauauaguugucauuuucuuaauaacgucacuauaauuuucacaaugaaguacucuguuguuuuuuuuuuuuuuuuuuuuuuuuuuuuuuuuuuugguuuuuuggagacaggguuuuucugcagcccuggcuguccugaaacucacucuguagaccaggcuggccuugaacucagaaaucugccugccucugccucccgagggcugggauuaaaggcgugugccaccacacccagugaaguacucaguuuuuacaauacuaaaaucacuaguagcaaaagguagaacuaacaagaugucauggugcauauaacacuucagaggcuauagaagaaggauaaaggauuuugaauucaagacuauuuugggccucauagggaguucaaggccagccuggacuccagacaagaugcuuccucaaacaaaacaacaaaacaaaacaacaacuucaaagggguggggggauauagugguauacaccuuuaauuccagcacccaggagguagaagcaaggggaucuuugugaauucaaggccauccuggucuacacagugaguuccagaccagccagggcuacuacauaguaggacugacucaagccaaaccaaacagaagagagaauaaaauaacacauacauuaaagugucuagcugaucagugggcagcacucgccuuuaagaaguccaggaccuggaaggcagagauuaagauggagcucugaguucgaggccaaccuggucuacagucuacagugccaggacagccagggcuacacagagaaaccuugucucauccccuacacuccccucaaaacccuaaaaaguauuaacuuuaaugaaaugcagcuucagcuuguaaagggaggcgaucaccggcuauauaaaggaaggcacacacgaggagagacauggggccacacacaugcuucucagguccacugcgaccugcaaaggacgcuuacucucuuguaugaccacugugcuuuauguccaagggggacagaacaaauacugggcugagugggugaugugacuaauacuggcacaaaaagcuaugaguuccaugcuagccugaacuaccuacugaguccagggccagcuuggguuagauagcaagauccuuucaacaaaccaaaccaaaccaaaccaacaaaaauguaaauaucugggggcgggggagggugugggggacuuuugggauagcauuggaaauguaauugaagaaaauaccuaauaaauuuuuaaaaauguaaauaucacacaaccucacaaguaagacuuccaacgugagaggaacuaguuaauuuuaaugcccacaguuuuucccaccaaugaaggaggaaaaacucacagaagguuuuauauucaaauuuagauaauaaagcuccccagacaaauaguaucugaauucaucuuaaaguuauaacucggagacuggagagaugguucagcaguuaagagcacugacugcucuuccaaagguucugaguucaaaucccagcagcaacauggguagcucacaacuaucccuaaugagaucugaugcccucuucuggggugucugaagacagcuacaauguacuuaacauauaauaaauaaauauuuuuuaaaaaaaaguuauaacucagaaauaggcauuuuaaacaucaauuacaccuaaaaugcuuugcaaugaauuuuaaaugagcaucccuaauucccuugcaacauacaaaaagccuggcuaguuccuacuucuccuaacaccuccgccauggacaugucaggcugcagcagcagcuggcugucuccaugccuggugcacuuuuucuuugauccuguuuaugugcuaaaguuuguucauuaaaaaaaaaaaaaagaaagaaagaaagggaggagauucuggggcuggacaaauggcucagugguuaagagcacuggcugaucuuccagaggacccagcucaagugccacauggcagcucacaacugucuguaaguccaguucuugggcaucuaaaacccucacacagccauacacgcaggcaaaacaccaauguacauaaaacaaaaaaucacuuaaaaaaaguaaaccuauuacaucuuugcaauguacaaagucgcucaacaggcugacacuacaccggaaguucugaacauuccaacacuagggaagagaagccuaccccucaauucuguguuccaagaagcaggcagcaaaguaugcaauguaccaaaggccuagacauucaucaaucuaugcaaacuaaaagaaaauaacagaaauggaauucuagauauaauucuuaauaaauaauuuuacuugaagaaaauccaaggcaucuuucaaucuguugcuagguuuauaggagucaucuuucuucuugggcugauagaugaacuggcuugcucagcuguccugagaguuuaaauacacacuacuucuauuugcaccgugaaaaauaaacagcuguauuaugccuuucugggcagucaauagguuuuacuuacauugcucugagagaagacaaaagccaucucuuuacaauugacucucagcagccucaguuccucagauaccaaaaccacaaaaucuuaccucuaauacaugaaaccauaaguacgaauacauacaacauaaacgagcauuaaauaaagacaauaccgugaccucuaagucucucaagugccaauuuacagacuggccaccagauacagaacuuggaccugccauagagaaaaaucauuauuagccugaaaaaaagaaaaaaaaauagaaaaaaaaaaguaagcugccacugucacccuuauggaaaaaguuaacauggaaaacaauaauaucguaaaaccugugucuuguaaagauuucuuuccaucagaaggugcagaaacauuccccaccacggagcacacgaccuccuuucuguuucuucccugcuuuuucucaaguaugggcuuuuuuccagcgaugagagguagaaauuuggacuuuaucuggcuggagccggugcacuucuccccuuggccccucucuccucugccuccaagaugguaggaaaguugucguuucggagggcagaggaacugcucugugguguuauguccucgcggugccuguaguggugcuguaggaggcugcugccucuucuagugcaggcgggcagcccugccuucuuggcuggagaguauauucagggauuuccccuuaaugaucaccgacccugggagcacuuuuuaguuuccaaaauaaaaauaugauccucaccccucguguuagacagggaaagacucuugccgaagcccagggagggagcaguagcagccgagcucccuaaguccacugccagcgccucucugaucugucagccuaggcgagggaggggggguugagggggaggaaggaggaaaaaaaaauua

SEQ ID NO: 187 - RNA, 33313 nt, Mus musculus
aagggaaacgcccucugaggagccggaguugaacgaaagcgcucggacgcaaggccucggcuacuuccggcggaacugcagguccaagucgucuucuccgcuuccucccgggcucgcucucggaaauugccgaacagguccgaagacggggaaaaacagucgaaucuguguuucuagucccuccuggcuuuccguccuccaggucgggcugacagagguugccguggccgccauauugacuuagcggccaggguuuugaggggucagggagacccggacagguccgcggaacuacucggugggcuccggaggaaaggugaggacgcguugaagugggcaaguugaagcgcuucgagugguguuuucuuuuuuggcaggucugcaucccauaggucagacaagccguucuccucuugcccuugacuggguaccagcuccugccccgccaccucuggaacccgggagagccggcaggugaggguuaugagccuugguuucuggucugauggagccuaagccgaucaggagaccuuugggaguccgggcuugcgagcuacucucucuuugcaggggaagacaggagauggcccugucaucaggagaccgguucaucucccagggucacgagagacuuaaaccucaggcaucgguuuaguugcugucuugaaccuguccacgcuacuguuuguuuuugucuagcccggugaucauguuggguaguauuuuauucauuccaccgacggggagaacugacaaaaacuaaaaguuagcucagucggagcuggagggagagucaagcgguuaagagugccuugcagagaggauccgaguucgguucccacuagcccagucagaagacucccagcugccauguaaccuuaucagggaauucuccacucucuuuuggacugugagcaccggcacuuagaagugcacauuacccacacacagauaagcacaugcacacauaaacuaaaaaugaaucuuaaaaaguuagccuggaguccgcugcagaucaggaagcugcggugucuucaaguuugugagguucaugucuguaagaccaaacagauuucugggauccacccccaccccaucacuaaaucuaauauucuaagccagcucaucagcgccuuuuagaaaguuacuuuuauaagauacagccaagauauuagagccagggugugaugaugguaccugucuguaauuccagaaaggggaggcugagaugugaggauugaacggagaacuuugugugugauuagguaaggacucuacuaacugagcuacaucccugacuugacuggcuauuuuuguuccuauuugguagauacuaugucuaaaauacauauuagagcugggaaagaucuuaguuggaaaugaugcuugccaauccugacauccugaguuagaucuccaggacccacauugauggaaagaaagaacugacuuucaaaggguguccuuuaacuuucacaggcacccgccccacccaccuccuuguguguuuauggugacacucacggaguaaguaaaugaaugucaacaacaacaacaacaguaaaauauauaccaaucuggacaugguggugcguguugauaauucugcuccuugcuugggaaguggaggccugaaguuuaggaguccaaguuaauccuugacuucauagcaagugugaagccagucugagguacaugaggucugucuacaaacaaacaaaccccaccaaguagaaaaccccaguaaaacaaacuguacaguguagaagccagguuauccccaaacucuugauguagugcaggcuguuuuuaugggaugaagcuucauggguguagaucaggcuggccucaaauucaugauucucaugcuuuagguuucccagugcuggaaucacaagcauuggcccugugcuuggccucaucaguacuuguuaaaaaugagcuauguacugcucauucuggaauuuggugcaaaacuauuuggggacuugcuagucuucagaaaagagaaauaaccaaaucuuuugucaaggaacuuacagucuaguagguaacaaaaucgauaauuuaccuucaauuuaguauugugggcuuguuuguuguuuguacucugcauacagcccaaugcagccuaccuuuacguuuuaggccuugcacuaaagcuaccugcucagcccaaguuuaguaaguagaauaauaaaauauauacauggcguguuuuuaauaaggaaaagggacacagaugaagaacaguauacaacugauuaucaguagccauuacugauuaaauugauguuaguuuuuauuauuucuuuguuuuuuauuucuuuguuuuuuuuuuuuuuuaagauuuauuuauuuauuauauguaaggacaguguagcugucuucagauacuccagaagagggugucagaucuuguuaggaugguugugagccaccaugugguugcugggauuugaacucaggaccuuuggaagagcagucagcacucuuaaccacugagccaucucuucagcccuuucuuuguuuuauuauuggcaauuacugaccuaguaauuacacccugggaaacuguagauuugcuuuauagguaaagaaccaaugccuaguggauaacagacuugguaucugcaaauucaguauuguaaauuguagauuaccauuauuaaagaauuaguuaaauaaauuaugaguuaaugaaauguuuaauuauaugucaucuauaauaacuacagacuuuaauguuuaggauucuauuuuaucugaagugguagugcaugccuuuaauuucagcacuugagaggcagaggucuguugguggauuucugaguuucaggccagcuuggucuuuacauagcuaaaagccaguuguaguagcacaugccaguaggauauguucaagaagcacagacaggaggaucaugaauucaagaccagccuaggccauaccuuugggauuggaaagauggcuggguaguuaagacuguucuuucagaggacccagaucugauucucuaaaauuacaugacagcucagcaacugucuguaacuccaguuccagaggaucugauaaccucuccuggccuccuuggacaucaggcaugcacauggugaauagacaugcagacaaaacacagaacaaacacuuucuuuuuuuuuuuuuuuuuuuuuugguuuuuccaagacagaguuucucuguauagcccuggcuguccuggaacucacuuuguagaccaggcuggccuugaacucagaaauccgccugccucugccuccugagugcugggacuaaaggcgugcgccaccacgcccggcacauuggcacauucuuuuaaagauuuauuuauuuuaugugaguauacuguugcucuccucagacacaccagaggagggcaucagcuucuauuacagaugguuguaagccaccaugugguugcugggaauugaacucaggaucucuagaagagcagucagugcucuuaaccaccgagccaucucuccagcagcccucacauuuuuuuuuuuuuaaauuaaaaagggaaaaaaaaauauguuuugggauuauuuacuauuagaacugcuauuacuguugaaacuuuuuuuuuuuuuuuuuuuuuuuuugguuuuucgagucaggguuucucuguauagcccuggcuguccuggaacucacucuguagaccaggcuggccucgacucagaaauccaccugccucugccucccgagugcugggauuaaaggcgugcgccaccaccuguugaaacauuuuuacuauuuuuuuaauguugauacauuuuuuuaagucaauauauguguauauuuauaauuaaaaauuucuaacuacacauaaaccauaaaauuuugugauuguguuugaacauuauuauagucuaaugaaguacagcauauuucauuaacagaaauauuuguccacauuccaggcuuuguuuaaacuuagaaaaaguuuguuaauucuaugagaaucuuauauaacauguuuuguucauauucaucaaagaacuuuuucuuuuuuuuauuagauauuuucuucauuuacauuucaaaugcuaucccaaaaguccccuauagccacccccacccccacccugcuccccuacccacucacucccacuucuuggcccuggcauuccccuguacuggggcauauaaaguuugcaagaccaaggggccucucuucccagugauggcugacuaggccaucuucugcuacauaugcagcuagagacaugagcucucauguaaucucccucggucccuguuggacaaaggagaaucauuguuuuauuuuuuaauguuuuauaccuaguuauuuauuuauguauuacuuguauucaugucuauguacaauauaugugccugguauccacagaggcacgauagggugucagauaccuuagaacuagaguuacagacagcuuggcugauacauuacucuaaccucugagccaucuuucuagcccuucauuuaaauuuuuuucaguccugguuauugaaccuagggcugucucacacuugguaccauugagccacauuuccgucccuuacuuuacuuucaauuaaaaaaaaauugaaaacaauuuauuuuauuuucuuguuuuuguuuuuauuuuuugagacaggauuucuccauauagcccuggcuguuggaacucacucuguagaccaagcuggucuugaacucagagaucugccugccgcugcuucauaggcacugugauuaaagguguguaccacugugcccagcuuauucucuuuucguauaagugcuuugccugcuuuuacaugugugcugugugugugaguugguacuugcaaagaucaaaagaggacauuaguaacugcaguucuggaugcuugggagccaucauuugggcccugggagcugaaaccagguuuucugcacaagagcagcaagugcucuucaaccucugagccucuccacuuaccuuuccauuuuugagucagggucucgcagucugggaacaugggauccugcugcuuuggugucccaaauaacuaagauuaggccucuaaaacacccaaaacaacauagguccauuguuuuaaagccuaucuuuacuagcuuuugggaacugguacugaaaggaagaugucacaaguucauaguacauuuaggauagaagcauaauacaagcaauuguaggacugugagagaacaaagcuccucaaagaugcacauaaaauacauaucaugagagagugugcuggaacuaguugugguagcacccaggaagcagaggcaggggaauugcuucaaaauuagccaagauuaauaauaagaccuuguaucaacaaacaaaauucccaguguacugguaggaggugaacgcagaaaguuauuuuauuuuagauagcuauuagugacaaagaguuauucuugcaacuuauuuuacuuuauucuuaauucuuuuucuuuugagauguuuccuguaucucugccugacuucaaacuugcuguagcagauguccuuauacuucugauccuucugccuuuaccucucaaguucagggauuacacgcauauaauuggauugugcugugcugguguuagaaguuaggacuuccucagugcuaggcaagcacucuuguaccagcugagcuguauugcaagcucuuaccgcuuucuucuggcuagaucagaauugcccuuuauuuuauauuacaaagcccaaguuuagugcuggagauguagcucaguuguaccuuaccuauccaaggacccaaagccuacuauauacugacuacuucuuagcuauuugacguuguauaaacuaaagucucugggacugcauuuuauauguacaauuugagggaaaacagugggacuucugaauauucucuuagaauaauguaugcaaaacuauaaaacaguaccagaaauuuuauaaguaaguucuuuuccuucuacaaaauuaaucuuuuuuuuuuuaauguuuuuuagccaucauguuaaggauaccuauaaaaagggccuugauaggccuuucuaauucuccuaaaggauaugguaaguuuuuguuguauauucauuaauuuuuuuaauauuuauuuuauguauauuagaguacacuguagcugucuucagacacaccagaagagggcaucagaucccguuacagaugguuguaagccaccaugaguauuuuugaaugucuuuaaaaaauccaaaacuagccuggugugguggcgcacaccuuuaaucccagcacucgggaggcagaggcaggcggauuucugaguucgaggccagccugcucuacaaagugagcuccaggacagccaggacuauacagagaaacccugucucgaaaaaccaaaaaaaaaaaaaaaacaaaaaccaaaacccaaaacuaaaccugacaacauauguuugauguaauugaguuaaaaaagcuuuuaugcuuauuuagugcuugaaaaauucauaucuuagccaggcugugauggcgcaugccuuuaaucccagcacugagaauguagaagcagggggauuucugaguucaaggccagccuggucuggucuuuucaggacagccagaacuacagagagaaacccugacuggaaaaaacaaacaaacaaacaaaaaauuugcaucuagagagagaagacuaguaaaaaaugaaaauuuuuauauuuagcuaauucauuaggcucugcugcaaugaauucaauuuauuuuauuuguuuuuuuacccuauuguuuugauggccaguucgcacaacuggcacagcagcaaguaacuugauugaaguauuuguugauggucagucugucaugguggaaccaggaaccacuguucugcagguaauuacuuuuaugacucugugaguuuucugauuuuuauuuuaaaaaauuauuuccuucauacuguuuaguuucaauauagcaauguguccugcaaggcaggcaagugaaggacaguacacaguuucucuaaguuucuccagaaguaaccaauuugcucauagacagacgcugcuguaugacuguggguuaucacagaccuaaacuuuuuuuuuuuucauuucuagacugugguuagacauagacagacaggaaaacacugaauguuagccaaaaaauaaaaauaaaaacaaacaaacaaacaaacaaacaaauaaauaaauaaaaucaaggcacaauggaaaguauuuuggcuagcucgggggugguagagaugucagaaguaaaacuaaaucauggccagcuauaagguguaaguuggucugugacucagaugagaagagaaggucaggagugacgcuuugacagggagcuuuuguggacuguggacaaagcagauaauggagaaagacuuuaccauagacugugaggucuuaccuaauuucagagcucccagguuuggaacagagcaagaguucuugaggaacuuacauaggaguagguuaagauaaguggguaacggugauaaaauaauaaaagaugccuccaucuguuguguucaguaagaacaagauccaaaggaaauuauucuaaagcagcauuuugucuucuaggcuugcgagaaggucggcaugcaaaucccucgauucuguuaccaugaaagguugucuguugcuggaaauugcaggaugugccugguagagauugagaaagcuccaaagguacaugauaccuggaauucccuaucaugcugugggagggaaaagacuuuaaaucuugcagcaaacuaucuaaaaucaauacugcuauaauccaauauuuuuuuuguauguagguugucuuaguuuggguuuuauugcuaugaagagacaccauaaccaaggcagcuauuauaaaggcaaaaacuuaacugggcuggcuuacaguuucagagguucaguucauuaucaucauggugggaagucuggcaugaugcaggcagauuuggugcuggagaagccaggaguuccugauggaagggcugccaugagaagauugucuucucuaggcagucuguaggaggguuucuucugcacuggguggagucugagcauagacggagcccucaaagcacacgcccacagugaaaggcuagccuccuaauagugccacucccuauggcuaagcauaaaucuguggggcccauaccuauucaaaucaccacacaagugauucauuucaaacaaaauacauugauggaaauauuguauaaacauaaaugccauauagcaagucucagaguucaagaugguuucuuaagcuuucagggucuuaagacacaaucuuaaguacacgguggguguauaacguauacuagaagugcuuaugcuguacuguucucacuugacaaagacuuguggagcaaaaguucacuuuagguuaugucauugcauuuugguguacauagcuguagcucagcaaugccuacaaaugaacaaagguuuguguguguguguguacauguuccucucuguggggggcacaggacaaccucaaggauuauuccucagggauucuccauuuuguuuuuuacacacaggucuuucugcuuaggcuaggcugggcaaguuccagggauaucagcaccugucuuugccuccccagugcugagauuauagcauguaccagcgugcccagcuuuuuuuuuuuuuuuccuuuuuaaagauguguauauauauauauauauauuacaguguugcucucuucaaacacaccagaagagggcauuagaucccaucacagacuauugugagccaccauaugguugcugggaauugaacucaggaccucuggaagagcagucagugcucucaaccacugagccaucuuucugacccuugacuucauuucuuuuucuggacugaccucaaauauagcacuuauagcauagcacugucuaguguuaaacucuuaaaagcuuaaaaauuuuuaaauguuaaaaaagccaggugguggcauauaccuuuaaucccagcacuugggaggcagaguuaggcaggguguauguauuuaugugcuuauguguauacauucauauguguaugugaauacuggugcacacagcauucacauauguacuacugcauguguggaggucagaggagugaguucucuucuucuaccaaguugguccuggauaucaaacucagaucuaagcuugauaucaaaugccuuuacccacuauucuccugagugcuaauauaggcauugaccacguaccuuuuucuuuuuuaauucuuuaucaugugugugugugcaugauguguaugcaugugucauaaaacauguggagaucagaggacaacuuugugcgaucacuucucuccuccuuuaggcuccaggauugacuugguacaugccuuuacauacugagccauuuugucuguccauuccugguuuuugaaagcacaaaaaugaugaugaguuuggauguaguagaacacacuucuaauaccaacaugcaggagcagaugcaggcagaccucugaguuagagacuggccuggccuacagagcaaauuccaggucagccaggacuauguagugagaccuccucuuaaaauuuuuuaaaguaaaagccaggcauagugguguauauaccuuuaauccuagcacuuaggaaacagagguaggugaaucucuugaguuugagggaguuugaagccagccuagucuacacagagagcuccagaaacccugugucaaaaaaaaaaaaaaaagacccaauuucagagcagaauaaagaguugcuuuaacuaauagggcuaauaugucuuaguuucuuuggggaugcuauaacaaaauacccaaaucucgauacuuuaugaaguaaagggguuuauuuagcuuauaguuuuggagucccaaaaucaagcaaccacauuugguaagccucugguuguuauaugagaagaggaaaagcaagagacuggguagggccacuauuuguuuauuuguuuguuuguuuuuguggcaguaaucugcuucuuaugggaauuaaucuccaagaccuagucacugagaggccaguguaacucucacauauuccaggugccuccaacuaggcacuacuacacaaacuucuguagacuggggagcaaccuucuagaauaugaccuuuugaggggacaaaccacaguaauguuuuauuuguuuuuaagauuagcaugaauggucaaauuauccuauuaauaguuuuaaaaaauaugaauuuauuuauuuauuuauuuauuuuuagaaaaggucuuacuauaaauaaaagccuggcuggcauaggcuggccucaggccugcagccucugccuucugagugcugagauuagaggcaugugccacucuaccuaucugaaaacaaaaauugauuuugaaagauuaucuuuguuuuuguuuucuucugcucuguuuuguuuuuuuaaucauugagucaggugucaggcuguccugcaaccuauuguuauaucucauggucuuuuguuuuuaauggauuauucaauauuuuauguauacaaauaaauacaaguguggauuucuccauugaaauucuagguugucgcugcuugugcuaugccuguaaugaagggcuggaauaucuugacaaacucggaaaaaucuaagaaagccagguacuuuguuguuacuacuguagauuugucaggaggugauuaugcugcccacacacaagagaguucccgucaaacacgguuucucuguguagcccuggcuguccuggaacucacuuuuuagaccaggcuggccucaaacucagaaauccacccgccucugccucccaagugcuggaauuaaaggcgugcgccaccaccgcccggcucccaucaaacuuuuuaagagcagcagaaaugaguacaguagaggaggucacucagguguuggaggcguugcauggaauauuaucaguauugagaacuugagagggguagccccaggacuuacugagcugagcacacguugaugacacauuaguauuugcucuagugcucagcguauguuugugaggcuuguggauuaaacuugccauagugcuggaauucuagcccuguuuucauuuuaaauuaaaaaugauuuuacuuauuuuuauuuuauauguguugguguuuuuccugaauguaugucuuugugaggguguuggauccccuggaacaggacuuauagacaggugugagcugccacacaggugcugggaauaaaaccaugucucuagugcucuuaaccacggagccaacucuccagcccaaaaguuaugguuuuaaaaauagcacaugccuauaauuucaggaauugggugguugcuuuaaggaaaaaaaaaaaaaaaaaaaaaaaaagcugggcagugguggcgcacaccuuugaucccagcacuugggaggcagaggcagaggcaggcagauuucugaguucgaggccagcuacaaagugaguuccagggcuauacagagaaacccugucucgaaaaaccaaaaaaaaaaaaaaaaaccacugacagugaucgcacaugcuugugaucucaucacuuggaagguguaggcugggaaaugagcauacaaggacacaggauccuugccucauugugaguuggaugccagcugggcuucaugagacccugucucaaaauaaauauauaaaugaguaagcaaauuaugacccugaaagucauaauuuccuaggauuaauauuuaaccuuaugaacaagaucaaacuguguuuaauacuaccugaauacuaauaugauagcauaucuggaaguaaauguaaaauuuauguuaacuguaaaaagaaaaucuauaaagguuauugagcuagccuauaggucaccauuuuuagugauagcuucuuaugucgcuuuguauauuugauuuuucauacagagaaggugugauggaguucuuauuagcaaaucacccauuggauuguccuauuugugaccagggaggugaaugugaucugcagguaucuagaauaaucuguaaauguuuuugaugaacucauuuuaauuucauuagcagcauuagauugacugucucguaaucuacuuaaggaccaguccaugauguuuggaagugauaggagccgauuucuagaggggaagcgugcuguggaggacaagaacauugggccccuaguaaagaccaucaugacuagaugcauccaguguacccggugcaucagguaauguuucucuucuggcauagcaguggguacuugaaugaaaaaaagaaaugaaaaaggaacacaugacuggucccuggaaugauggaggagaaaguuuauuguagauaaaaggaagugcacagucagaggcagacagaccugggaaagugcagagugaacaggacccugagccaggggaucugagacggguggggaagggagagucagaucuauaggccaccaggguaaaugguagauaaaaagagcccaacaggauccccauagcaaaaugacugaagggcauuccagccucuuggcuggagauguuuggggaggugggggggggggggucugaagugcugggugugccugagaugcagggagaaucuggaccaggcccacuuugauauguuaaauaggcaccucaguuauccaucugcccuggguuugaaaccuaucagugcugacuuaacauucauauaguuucuucgaauaacaacacuggaaaugauagucauuauuaauggggaaaaguuagguuuuguuugcuuggguuugguguuuuuugguuuguuuguuuguuccauauguucugauaacaugauuucuacuugcuuucaguuaaugccaauuucaguugaauuuaaaacuuagucugguauuaauugugugauaauuuacugaauuguauacuugugauuuguacaauuuuccguuuguguguuacacuucaguuucagagaaaaauucacuuuuauuugcugacuauauuuaucauugaaaauauacuaauuccuuuuuaauguuuugaaagucauugacuuugugauuaugaaaaggaaaagaaauacuuuuugcugagcucauccauuugauaacaaauuuuauuuuuuagguuugcaagugagauugcaggaguagaugauuugggaacaacaggaagaggaaaugacaugcaaguuggcacauacauugaaaaaauguuuaugucugaacugucugggaaugucauugauaucugcccuguaggggcccuaaccucuaagccuuaugccuuuacugcccggccuugggaaacaagguauuuaucuuugugguuuugaccaacuuguuuuuaaaagauguuauuuugugugugugugacagguguggugcaggugccccuggauguauacagguauauuuggaggccggaaaaccaccuuaguggcauccccuggaacacuucuacuuucuuugaggcucagucucuuauuggucuguaacuuaccaauuaaaaaagacuggcuggcuuuugauccuuugcuucuccagcacugggagugcaagcauuuuuacaucuugaugaggcuagaacucagguucuuguacuuauuaggccagggcuuuacagacugagccaugcacccuucccugauuauuuguuuuaauuguuacuuggugugugccugugguuguguguucaugcacagcugggugguacacgccagugugcacaugugaagaacaacuguagggacucgguuuuuaccuuuuaccuuguuaaggcagggcucugauuucuucauuauguguaugugccaaacuggccagcccacaagcucuuggccugucucauucugccugccaucacacuguagucgugcugggauuagaaauuugcacuucaucugguucuugauaggacuuucagagaucaaucuuaggucaucagccuugcucagcaagggcuuuuccccucuaagccacccuccuggcccuguuuuuacauuuuaguucacuucuuuuuuuuuuuuaauaaaauuucugggucauuuucuuccuaaauuuuaguugguuuuaucuacauuuuuauguuugcauuguguguauguguguguguguguauguguuagaggaggguuguguguuuggaggccagauauguguuagguggcuuuaauuucuuuucaccuuauuuuuuugagacagagucucuuauggaaccuggaacucacugauuuggguagccagggagcccuagugaucccccaguccccgacucugugaugcuaagguugcaggcaucacugacacacucagcucuuacuagauucuggguaccagguccuuaugcucguguagucuguauguacugacugaaugauuugacccagccccauaaaauguuuuaauggaaaauaacuacuuaaguugaaagguaggacaagccucagcaaauuauauucuuucuaagauuuuaaguaugugcauauguacuugaguagucuuuagucuuuaaugaggagagagagaggagcagcaucaagacaaaccauaacagauuuuuuguuuucuugaggcagugucuuggaacuuggacacuguggaccaggguggccuugaacuuacagaaauccgucugccucugccucccaaguguugggauuacauugugugccacucauacucaacauuacggauuuuuagaguagucagguguguuuaugcaagcaccggauguugacaucagaugucuuccuaacucucccuucauucagugacucaggcuacauuccugcugagccugaagcuugccaauugcuaucuccaacucugaccagccagaguagguccccuuaccuaacccugcauacuccacucuccgccccuuucuugccucuagagugcuagacugccauguacuccugacuuuuacuugggugcucagaaucugaauucuggucuucaugcauacauagcuagcacuuaucuccuaaaccaucuccccagccccgcaaaacaguuguuuuuggauuuauuuuauauguguguguguguguguguguguguguguguguguguguauacacauauauauguauauacacauacacauauauguauauacacauguauauauguauguguguguaucuaucuauuugucugucugucugucuaucuauaucuauaugaaucuaaguuauguaugagcccuauguguaugcaggugcuugaagaagccagaagacggcauugaauccuuugaaauuagaguuggauagugauaagccgccacgugggugcugggaaccaaacucagguucccuguaggaguaacaaguguuuucaacuguugaaccaucucuccugccuuacagaguaguuuuuaaugcauuaaagcuucuuuuuuuuuuuuuuuuuuuuuuucagagcuaaggacugaacccagggccuuucgcuugcuaggcaagcauucuaccacugagcuaaauccccaaccccacauuaaagcuucuuauguuuugauguauaagugauaaaauguuauuugggaggauuuugauuuuuguugauuuuugucggguuuuguuucugcuuucuggaaugguugauucauugguaucugacugccagcagccaaggacuaauuaauuguaugcccuucuaauuggccuaucaaauaaugugauuaaaauauggaggugcuuauuucuauugcuguucugaguuccgcuaguuuuagaaauguagaaggcaagguggaucugguaguaaucccaacacgagggaugcaggugcuggaggacauguucaaggucacuuguuaucuagaggguuugaggccaacauggccuuaugagacuugccucaaaauaccaaaaaaggaaaccugauauggaaguaacuagcuaacagaaacucuucuuacucucagaaucagcauacuaaauuguguuuauuuucucagaaagacagaguccauugauguaauggaugcagugggaaguaacauugugguuagcacaagaacuggagagguaaugaggauuuugccaagaaugcaugaagauauuaaugaagaauggaucucugauaaaaccagguguugucuuuaauuuuuugcgauugauuuaaaaaucuaugaucuuuuuugagauuuauuuuauguauaugaauguuuugcuuuuauggauaaucugugugucccaugguguuauggaugguuugugagucgacauguaggugcuaggaauugcacuuguguccucugcaagaacaagugcucuuaacuacugagccaucucuccagcccucauggucauuuuuaauggacauuuuuuuaaagauuuauuuauuuauuauauguaaguacacuguagcuguccucaaacacuccagaagagggcgucagaucucauuaugggugguugugagccaccauaugguugcugggaucugaacucacaaccuucggaggagcagucagugcucuuaaucgcugagccauuucuccagccccuuuaaugggcauuuuuauguugcaaaaugauauacauuuuugaaaaauuugaguuuuuauaaagagaaugagaagaaaaucaacuugaguaguuacaaaugcugggcauaguggcacaagcuuaugaucuaagcuacuugaggccaaaacaggaggaugugaaauauauggacaaccuggaagauguaccuugucucagaaugcaaaugcaaaagggcuggacauggagcugaacuguagagcauuugccuaauguaguccagauccuggcuuugaucuccaguacuugggaaaacaagggaagauuuguuuuuaagacuacaucuuccuguguagcccuggcuguccuggagcucacucuguagacuagguuagccuuaaauucagaaauccuacugccucugccuccugaguacgggaauuaaagguauaugauaaggcagauauaucugcugccaccaucccuguguuagguauuuauuauuuugacacuuuaagaaaucuucuauuuaaauaacauuuguuacaguuuuuaaacuugaaaauuauaguugcuccuuagcaauuuucuauauuuuguaugauuucuuuugucuagguuugcuuaugauggacuaaaacgucaaagacuuacugaaccaauggucagaaacgaaaaagggcuuuuaacuuauaccuccugggaagaugcacucucucguguagcuggaaugguaaaaaauugaaauguagauuaaacaguguguagcuuucacgaaacagcuuugccaugaagauaaggcgaaucuuucucuuuuguuuguuuguuuccuuccuuccuuucuuccuuccuuccuuccuuccuuccuuccuuccuuuuuauuuguuuuagacagggguuuuauuguauagcuguggcugaccuggaacuccccauguaaaccaggcuagccuuaaacucacagagauuugccugccucugccacugagugcugagauuaaagucauaugccacuacacccauucuuuucuccuguuuuggcaagauuauaauuugucgcuauuugacauuuuuaaaauuuauuuauguacaugagugcuuuauuugcagguaugccugcaugacaagagagcaucagauuccauuauaguugguugugaaccacaugugguugcugggaauugaacucaggaccacaaugcucuuaacugcugagccaacaaaucuccagcccucuauuugauauuuuugagagccauaucucagauaugcuagauacauucuagaauuuaacccauagauuacugauucaugaucucugccuuucaucuuguuaugcuagagagagaggcauaaucauuguucugucagggcugauaugagagaaaacacauaagggaugugggacaccuaaccaaaauuaugguaucaggaugcguuccuaaagacagugauucuggagcaaagccuaagagcuugccagagcaaagguggggggggggggcaggguguaacucacuuguguugagugugcuuagcaugugcaaagcccuggguuuaauuaccaguagccaauaaaagggaaaagaauagaaaaaagaugaaagauacuguagacaaaaagcaaaagccuagagggaaugggagauacuuuagaagagauugaauuuaagguaaacuguaacuccaugauucucauucuccagagguccuaacgaagcugcuuuguuccuaaaguaaaauacacagcuucaggccaagcuggagucacucuccugggccccacacaucacugcugcaucuccugucuaggcugcgugagcacuguuacgcucuguagucagaugugcuuuacuucuugucugcuuugcauauuguuccauauguuuuauugauaaagugcauaguuauucuuuuauuuuuaaaagauuuauuuauuauuauucauaaguacacuguagcugucuucagacguaccagaagagggcaucagaucucauuacaggugguugugagccgccacgugguugcugggauuugaacucaagaccuuuggaagagcagucauugcucuuagccacugagccaucucuccagccccauaguuauucuuaaaguauaggaaaacuugugaaugugaguaguuuggcuuuaagaguuugucaaggaaaagcauauaaagcucauagucugcuaggaaucaguuuauuagaaagaaauauaagugguucauugcauucagacccaaaauacauuaaauuccuugacuguaugaguauuuugagaacucggaaguuauuucaauaaucaaauguuaguuaauuuaauucaccagaaaaagaaaagguuaaauguuuuuuauuugcuagcuaauauuuuuugacaacaaugucuuuuuaaauacauguuuuauauauauauauauauuuucauuuuauaguugaaauagaacuguaucacuuaucuggcuucucucuccaggcccuccuagugaccuaucccugaaucccucucauuccccuucuauucucaaguugauagccucugucuuuuuuuuuaauugaaaaaacuuuuuuauuuuuuauauuuauauuauauauauauauaguaaauauauaaauuuauguacaugcacaaauagacucuacauuuuuauuguuuguguauauaugauuucaaggcugacugacugcucuguacuggacaaccuauauggggguucauuccugagagaagcuaauucuuuuucucccagcagucaguugcuugcaguucuuugucuagaggugagaccuguggaauuuucucccuuccauguuaaaauuccuguugguauugguauucggaucuuguuuaugcagccuuucuaggagacacugcuuuacagcagacuucugguacgcuggcucuuagacucuuuauuuucugguuccuugagcaauagcugcaagagccaugguguagaugugucuguuguggcugggguccccacaauuuguugauuucugcauuguuuccagugugguuuuccucugcauuugcuguaaaaagcuucuuuaaugugcagugguagcuacacuaauucaggagagacggcugugccuccugcuacucuggaugcuugaaaaugacuugguuuauuuccugaacagucauggucuuugcugacuguagguuucuuagagaugcccuuuucuguuuccaguuacagaauuuugaaggcaaugcuguggcagcgauugcaggaggcuugguggaugcugaagccuuaguagcucugaaagacuugcuuaauaaaguugacucugacaacuuaugcacugaagagaucuuccccacugaaggagcugggugagaagcaguaagcugugcuccaggcugcuguuugggauuucauuuugauuuuugaguuucuuguagcccaggcuggccuugaacucuguguagcagaagaacuuucugucuuuaccuccuaaguacuuggauugaagaugaguguuacaacuguucucagcuaucguuuuccuuuuuuaaaaaaaaaaaagcagccacaucuguaaugucacuguucaaucuuugacacacuggguucucuaacauaccaguacacuuucacaucuaagucaaaccagacagcaugaacguagaaagauccugucugagcaaagguagcuuagaggggugggaaggaagcuccgagggcaaugagaggugaacgugaucagauuacacauguaugaaaguggaauucucacccaucauguguaguuaacacaggcuaauaaacgaaaucaacagcuaaaucuuacagaagaauguaguccuuaauacauguuguaaguuuaguuucauuuggacacaccugccuggcaucacggugugugugguagucucaaccaugugguagcugagaggacggcugcucaaguucaaggccaacuugggcuguaaacaggacagcaguuggacacacuuuaugaaaaccugugugugagagugcacugggauuuaugauccgagacgagucuguggacucgugcauguauuagcuuuauguguguguuauagcauguguuagguuuacuugcagggucuuaugugguuacuguuuguuuuucuucuuaaacuugaguuauauuuuauauuuuaguacagacuuacguuccaauuaucuucucaauaccacaauugcugguguggaagaagcagauguuguucuucuaguugguacaaauccacguuuugaggcaccgcuguuuaaugcuagaauuagaaagagguaauuuaauccuuauuuaauaagaaccuuaaaauacgugauuucuuuaauuuaauauauggaaaugauauuuugggugauuccuaauaaguuguagugauacagaggcuggggggagggggauuccuaacacauucauucuaccccaccucucugccuuuuaauguacuuuguuuuuguucauauauuucuuuucuuuuucuuuucucucucucucucucucucucucucucucuuuuugaguuggucucauuacguagcccuggcuggccuggaacucacuauguagaccaggcuggucuagaacugacaagaaaucagccugccucugccucuugaaugcugagauuaacgacauguaccaccccacuuggcuuccuuauuaaugagugagggucucaugugacccaggcuagucucuagggcaauacauauucagagugaaccuuuaacugccuaucucuccagugcuggcauuauagauagacaugugcuacgacacuuuguccuguacuuuuuuuaaacaaaauuuuaugauauagucaugacugcccuugaacuucccuuuuuuuuaaagauuuuuuuuuauuuauuuuauguauaugaguacacuguagcuguacagaugguugugagccuucaugugguuguugggauuugaauuucugaccucugcucacuucggucugcccugccugcuccaguuaaggauuuauuuauuauuauagauaaguacacuguagcugucuucagacacaccagaagaaggcaucagaucucauuauaggugguugugagccaccaugugauugcugggaauugaacccaggaccuuuggaagagcagucagugcucuuacccacugagccaucucaccaaccguaauuucaugaguuacgggcauguguguuuaaacuuuauuuuauguauguauaugugugugcaugagcaugcucuagugcaguguacaucuggcagucagagggcagcuuuuaggagcuggcucccuccuucaccuuugagucucaggacugaacugagcuugucaggcuugguggcaagcaccucacccugcagagcagucuugcccgucccacccucugacuuuuguuuguuuguugguacuagggauuaaauucagaguuuuucuugcauacuacauaagcaccugucaacugaguuguauccuuagccccaucuuuuauagcaguuuuguucuugaccagcaucuaucuagagucacauugcaauuaaugucaugacauuucgggccccauuuccccccccaccccauuuuauuuacuuuaccuccugcucacuccuuccuuccagucauccccucccacgauccuucuuccauacccccucuccuccucugagcagaugagggcuccuguggguaucucccccucuccccccaccccucaccuuucaugcccugaaccuggcagaucaagucucugugaggcuaggcacuucaucucucacugaggccagaagaggcagcccagcuaauagaacauauccuaaguacaggcaacaacuuuugggauagcuccugcuccaguuguucaggacccacaugaaggccaaacugcacauaugcuacauaugugucaggaggccuaggaucagccugugcauguuaucugguugaugguuuagacucugagagccccaaggguccaggugaguugacuuugcuggucuuccuauggggaguuccuaucucuuucggugcugaaauccuucuuccuauucuucuaucucuuucgaugcuaaaauccuucuuccuauucuucuauaagaguccccaagcuccauccaguguuuggcuauggguuucugcaugucugagucagcugcuggguggagccucucaaaggacaacaugcuccugucugcaagcauaacagaguaucagagugugggugauuugugcuugcccaugggaugggucucagguugagcugguuauugguuggccauucccccagucuuucccuuaucuccuuucuuuguauuucuuuucauuuuuuuuaaaacaaacaaaaacaaaaacaaaacaaaacaaaaacuggcuaccuauauuuuaaacucagggaacaaucuuaauuuuuuuuuaagauuuauuuauuauguacacaauauucugccugcuuuuaugccuauacaccaggaggcacaaaaucucauuauagaugguugugagccaccauaugguugcugggaauugaacucaggaccucuggaagagcagucagugcucuuaaccaucucuuuagcccccucucugcauuucuuuuagacagaauaaaauuuggguggaaacuuuuguggguagauugguguccuuaucacuucccuaggguuccugccuggcuauaggaguggccacuucaugcuucauaucccccacugcuaggagucucagcuagagugacuccauagacucccuggagccucccccaucccaggucuuugguugguccuuaaagaugcacacgcacacacacauuuuacuuuuuuuuauagaguacaggcuaguuauuuuauagaacaccucccacaucuauugucuuuuucauuuguguuguagacauuuaaaauagggcaacuguauuaucuaccuagauuauuaucucaccuguaaaaugguugagaguggaagggaguuacuacuucagguaaaauuaguacugcuucagacaaacgagaauuagacuuaccauacucacaaauaguuuugaaggauagcagggcgguagugguucacacuucuaauuccagcauucuggaggcagagacaggaagaucucugauuuugagaccagccuggucuagagagugaguuucaggacuggcaggacuaaacagagaaacccugucuuaaaaaaaccuaaaaacuccaauaguuuugaaggagguagccccuuaguacucugcuauaaagaauaaauaaaugacaguuuauuuuuguggauauuugagaaauaacugacucugacauagcauguacugaggaauauaacuacaggucaguuauucuaaaauaguuuuuguuuacauuagacugguacuuaggauugccacacaacagauuuacucccugaauuauuuauacauuuuuacaacacucuuaucuugaaagguacaucuuaaauuauauguguuaagauuaaauagucugugaguucuuuugugcuuuugcuauuuuaugauuguaaauagagguaggacuuagaauuguugaaaccaaaggcuaugcuuauuuggcucuaaaauuguuuuuguuucagcuggcuucauaaugacuuaaaaguggcccucaucgguaguccaguggaccucacuuacagauacgaccaucuaggagacucuccuaaaauucugcaagacauugcuucagggaggcauucauucugcgaggugcuuuuaaguuaauauauaccuacuguugcugguuuuuaacuguuacuauuauuuuaaagauuuauauuuuuaugugauugguguuuugccugcauguaugucuuugugaggguuccagauccucuggaacuagaguuaaagacaguugugagcugccaugugugugcuaggaauugaccccagguccucuggaaaagcagcccagguucuuaaccacugagccaucucuccagcuccaauuuuuaauuauuauuauuuuaaauuuauuuauuuuaauuuauauguaugagguuuuuuugcccaccuucauguauaucuaucacuugccagccuaaugucuacagaagucagaagaggacauuguguacccugaauuagaguuaguaaguagaugcugugaucugccauguggguucagggaacugaacuccuuccuacucuacaagggcuuccgagcgucucucaggcucuuuuaacuuaguauuuuuauacgagugugagcuauuugauuuucaguuuuacuuaccaaccuuccccaagccuguaguuuccuaucuccuugagacucacucccuuacuguggcguaaagcaaacucuucccugcuuuaggaaugcccuguugcucucccugcuuucucuucugucuggaucucuacagauaagaaguaguaggagaugauacugcaacacaauuuuuucugucauauuuuaaauuuuuuauucuuuuuguuuguuuagagaugguaucuugguauguagccuuggaugauuuggaauuuguuaaguagauuaggcuggccugaaaccuaaucauuuaauucuuacuuguauaaaaucuguuuuaugugauacuaagcuuuuucauaguaacauuugcaagauguuucuauuaauucagauguuaaguaaauuaaugguucuucauguuagauccccaaacuugcauaucaguagaugcaaauaucauauagcgcuuuaagaucaacagguuuuuuuuaucuaucuaucuaucuaucuaucuaucuaucuauuuauuuauuuauuuauuuuuaaaaauaggucuuaaaggaugcuaaaaaaccaauggugguuuuaggcaguucugcacuccagagagaugauggagcagcaauucuuguagcuguguccaacaugguacaaaagauucgagugacaaccgguguugcugcagaguggaaaguuaugaauauucugcauagguuuguuacuuguuuuuuguuuguuuguuuuaagauuuauuuauugauuauauguaaguacacuguagcugucuucggacacuacagacaagggagucagaucucuguuacggaugguugugagccaccaugugagugacuagggugcaauugcgugguguaacgagcacaccuauccaggugcaagacucgaauccacucucagcuccaaaacuaagcuaaguaagcaagcagcaauaacccagggaacugaacuguagauccccuuguccauagguuauaaaguagaauggcuggacuaaagcaggcagagguuucaagagcuguuuugcaugucucugcauguuuuagaagggcuguuguugugagcuucuuccuuagauuaucuucacuaaaacauggaaacaguuguaggaagccguucugaaagggucuauuccagucuguguaguaaugguguuccugcauugcuuuucccuccuccucccuccuuccuccucccuccucucucucugucugucugugucugcuuuuuuuuuuuuuuuuuuuuuugguggguuuuccuuuuguuuucgagaaagggucuuacuguguagcucacuguucuggaacucacucuguagaccagaugguugugagccaccaugugguugcugggauuugaacucaggaccucuggaagaauggucagugcucuuaaccacugagccaucucuccagccaccaccacccccuuuuacuuuuuuuuccuuuuuaaagauaggaucuugcuauguaauccacgauuuacuaucaaacuggccucagacagaacaucacucuaauaguccuccugccuuugcugggauuaugguagugugcuaccacaccuagcucucuuuugauuuuaaaauccugcggcuuuacucuaaaacauguuugauuuacuguaaguuuuaugucuuacuguguugaauuuaagccauuuacaguuggcuuucauaguuacuucauugcauauuaauucaugaaaaacaguuucaggaggaggaagaugaguagcucacuguuaaagugcuugccuagcgcccacaagagucuaguucagucuccaaaaccacaggaaaagaaagagaaaccaggcaugguugcccaugacuucaauuccagcacucaggaagcaggaggaucucugagaguuugacgccagccuggucuacagagugaguucuaggccagccagggcuacacagagaaacccugucucaaaaagaaaaagagagacacucugcuaugcaucuuauauuucagugguaagaguugaauauaaaaaaaaaauaaaaaaaaaaaaaaaaaaaagaguugaauauaaaagaagcuacaaauuauuccuauguaauuacucaaauugcuuauacuuaaaugcugcauguauuugaaaauccauaauuguuuuacaggauugcaagccagguagcugcuuuggaccuuggcuauaaaccugggguagaagcgauuaggaagaacccucccaaaaugcuguuucuucugggagcagauggagguuguaucacgcgacaggacuugccaaaggauuguuucauuguuuaucaagguaaguagcaacuuggcaguagaaacaaaagagagcucgggaggcagaggcaggcagauuucugaguuccaggacagccuggucuacaaagugaguuccaggacagccagggcuacacagagaaacccugucucgaaaaaacagaacaaaacaagaaacaaaagagaaucauaccugaugcauacuaagagguguuugauauacacagcuucuguuuugaauaacuguucugacuauauagcaguucauugaaguguauauacuuugggucugcaacaugaauaugugacuuuuuuuaauuaauuuauuuauuuaauguauaugaguacacgguaucuaucuucaugcaccccagaagaagaugucagaucucauuacagaugguugugagccaccaugugguugcugggaauugaacucaggaccucuggaagagcaguagaugcuuuuaaccgcugagccaucucuccagucccaauauugacuuuuuuauuugcaauuuuuaaauaauaaaccuuauuuuaaaaaucauaagaaacaaaaucuguuuguuaaccagaggaguagcauauaccugugauccuagcccaggaugaggaugagaugggaagacaaagaguuugaggcaguucuuaaaacuuaucauaggugggguggagagauggcucagugguuaagagcacugacugcucuuccagagguccugaguucaauucccagcaaccacaugguggcucauaaccaucuguaaugaaaucugaugcccucuucugguguaucugaagacagcuacaauguacuuauauauaauaaauacaucuuuuaaaaaaaccaaaacuggacuauaaaaucuaaaguaguguuacacauguguauucccagugcggggaucaaggcaggagaaccuugagaucaguaggaguuacacuggcuacuauuauaugggaagacaguauaccaccuguuaauugccauuuuuauuuauuuauuuguuuuuuuauuuaugauggucaugcaaacuaugcaauuuaccacuaaacuaccuuuuuuuuuuuuuuuuuuuuuucuuuuuuugguuuuuuucuccauauagcccuggcuguccuagaacucacucuguagacuuggcuggccucgaacucagggauccaccugcuucugccucccgagaauuugggguuaaaagugaacugcacucuuagucucacuuuauaaacuaugaaaguggcugggcaugguaguguaugccuuuucauagaaaccuugucuugacaaaacaaaugagagaccucuggaagaacagucagugcucuuaaccacugagccauuucuccagcccaguccaguuuuuacuaaaauaugguucacuguuuuucuccucccaggacaccauggugauguuggugcucccauggcugauguuauucucccaggggcugcuuacacagaaaagucugcuacuuaugucaauacugagggcagagcucagcaaaccaaaguagcagugacgccuccuggcuuggcacgagaagacuggaaaaucauaagagcucucucugagguauuauuuuugaggcauuucuuugaagucuuuuuuuguuccuuaauauucauuaagcaacuggagauguggcucaguugggagaggacuugcuuagcaugcacgaagaaguccuaaguucaauaaauuccuguauguagcuuguagugcuggagacagaacccagggccucggcagguacuaggcagggccuccaccgcugaacuacgauuucauucauuaaggcuaaguuaguggcauaaccugguuguguaggaaauaaaguguucagaaaaaugaagaauugaaguugguacuuuccuuguagauuaacaucaagcaagaagcauugauaguuagccuagcaucgucucugugaucuuuuacuucaggaccauauacuugcuaaguauucucucuaccacagagcaacauucugcagauaaauuaagaaaggaaaaaggaaaaaaauuaagaaaggaaaaaggaaaaaaaugccugcuaaaauauacuaaaagacuuuuuucuuucuaguaauaccgaguuauuuuaucauaguuuccauuaugaauuguuuuguuccuuuuuuguugcuggagauugagccccaacccugauuuuuuuuuuuuuuuuuccucaagacaagguuucucuuugaagcccuagaacuuguucuauagaccaagcuggccccaaauucagagaucugccugccucugucuuucaagugcuaagauuaaagauccaggccaucucagccugcuaaacaacaauuauuuauuauauugggccaugggcugugcgugcugcaacaauauuuggagguuuagagggcucugagggaaucuguucucuuccugcacuguguggguccuagugauugacucucuucagacuugaugccugaugucuugagucauccuggcuugccccaauucugacauuuuuuaaguaguaaaguuguuugucauggugaaucugauguguuguagauugcagguaucacucuuccauaugacacucuggaucaaguaaggaaccgucuugaagaggucucuccuaaucugguucgauaugaugauauugaagaaacuaauuacuuucagcaagcaagugagcuugccaagguaaaaacuugccugugugcaguuuuccuaaugugcuguaucuuggcaugguaguacugguuuucaguaugauucuggucucucucucucuuuccagcuaguaaaccaggagguucuugcugacccacucguuccaccucagcuaacuauaaaagacuucuauaugacagguaaguuugacugcuaccuacucacagagaaucagagaauccuuuagcuucauagcuuuuuuugguuuggcaauauuugcuauuaaucuaaagaacuugauuuuuuuauauuuauuuacuugugcuugggcaggcauacgcucaccaugaagaguguggaggucaggacaauuugugggaaucaaacucaagucauuaagcuugguaacaagcacccuuguccacugaggacaucucaggagccucuggucugacauuguuagacaucaaagcuaauguaauuuaggcgguagaucugggugucaaggcucauuuuguacauguuaagcacgggcacuauaccccuagcuuucuagcauucuguguguuucugacaugaaagcaaaguuugaacacccaaaagguuuaacagauuuaaauuguaaaauuuaguaguauauggaaaaaucaaugaauagaaauuuaaaguacuaaaaaaacucucaagguuuucugaaaauuauugauagaauauucagaauacuuaaagauuuuuuaauauauuaaacagggcuucugguguaaauuguuagaacgcuuuuaagaaaugcagaucaccauucauuuucuauaacuuugacaacaguugauaaagguaugagacaguugauauguaaauaauuucuuaccuaaaagcacauaggagcauaaauuuguuugguuuucuauuuuuuaaucuuuuaaagauuuuguuuauuuuauguaugagaauacacugucacuaucuucagccacaccagaagagggcaucagaucccauuacagauagaugguugugagccaccuugugguugcugggaauugaacucaggaccucuagaagagcagucauugcucuucaccucugagccaucucucugcgggcccccccccccccccuguuuaaaaacuggguuucauguagccaaggugaccuuaaaaccaucuugucaaagcagaggaugaccuugaauuuguacucuucuuucucacagugccaagugcugagacuacaggccugcaccaccacaauuuuuaugguacuggagacccagccuagggcuuccugugugcuagugcagcauuuuuccaacugaacuacaucuuaugagccuuaaaaugauguuuaauuuuaccuuuuaaaaaauguguauagguuuuguuuacaugcaugccucuguacuauuuguguaucuaauuccugaggagaugagaagaggguuuuggauccccugggacuagaguugcagacaguuguaagccucuauggagguguuaggaacauaaucccagcccucugcaagauuugcaaaugaucuuaacauuucagacucuguguuuauacaucuuuaaguuagcauguacuaguaagguuauuucagugaggugauagaaguguuaggaucagauccagcagaauggcuuauuguguaaaagcuugugauguaaaccggaccccacaguagcagaaccaacucccaaaaguuguccucugaccuccacacaaacacuggacaugcucauacccccucacauucacacaccaaugauacauuuccaaacaguuuuaaaaauaaaugcaaguuggagucauuguacacuauacaaccaagcacaaacuacagugaaacaguacugugacuugugagugcuggaagcaggaagauuuacaugcauucaaagauuggcggguuuucugcucaugguggguuacaccuggagucucaguacuuggugacaggagauuaaggaguucaacauuaaauucugccacauagcaagacaugaaugacaaacaaauugagcuuuuuaauuuuuuucccuuuuugaggcagaguuuuucugugacacccuggcuauccuggaacucacuuuguagaccagucuaaacuuaaacucagagaucucaaaggcaugugguaccacugucuggcucucuuuuuaagagaagguuugguuuuuguuuuguuuuuuguuucaauaaauauuuauuuauuuauuuuauguauaugaguacacuguagcuaugcugaugguugugagccaucgugugguugcugggaauuugaguucaggaccucuacuugcugaacucagcaccagaggagggcaugcaucagaucucauuacugaugguugugagcgaacaugugguugcugggauuugaacucaggaccuucagaagagcacucaagucagugcucuuaaccacugagccauuucuccaguccccaagggaagguguucuuauguagcccacaauggccuccaauuuaccaccuucuaccucagcuucuuugagugcuguggauacagaaaaacccuaccacucuaggauguuuuauauuccaggcuagcuaacccaagcuacagggugauucucuuaguuccuggugcucauccuauagagggcugugauuacuaauaugugccuguacauuaagcuucuauauugggauauagaucaaacucagcuuguccagccauaccaucaugccagccucuggugggguuuuuggguuuuuuuggaaaugauucuaucucuugaagcccagguugaccucagacacacagcaauccugccucaucuugugaagugcuggagcgcgaugagugugagcuacaacaucuaucugauaagcagagcauauuguguccauuuuuuuccuuagauuuuuaaagaauuuccuaucauuuaauuuuucauacugucauguaaucuaguuuuuaugugauuauuuaauuacugcuagagacuaaaaacauauaaccagaaaguugugguaaaugggagguggaggcagacagaucaaaguucaaggucauccuuggcuucauagacagccagagauagcuaagacccuaacuaaaaaccgugggcaguaaagagcuuauguucagggcuuauugcuuaccuacaguugcguuccagcuucacaggcuuuuguucuugcauguguacauuaaaauucuccguguguucuaaagucacaguaacaaaaaaaaaaaaauggcauuaguggcucuucccugggaauuugagguaggaggaucaccccagauuugaggcuaacuugguauacuauugaauucugggcuggccugaaaucugagacauuguuuuaaaaacaacaaaggaaguuguauuaacaaaaugcaugcucuuaaugucuuucagacuccauuagcagagccucacagacaauggccaagugugucaaagcugucaccgagggcgcucaggcaguagaggagccguccauaugcugagacaucuaacagggacccuuuuugcuacagacaguaaauggacauugcuguaaucccuuauaaguuaauguuuuccaacaugagucugaaugauguaauauuuaaaguuauacuaugcuuauccgaaaaugguauuguacuuaucaaaaauccuggcaguuuaaaauguauguaauugugugcaagcauuaacuaguuuaauaaaacuaucauuuucucuuucauguuaaaaacacugauau

SEQ ID NO: 188 - RNA, 7722 nt, Mus musculus
ggucuucucuuggaauaagaaggugccauguaccuuauuauuuauggguuaugcucugccacaccuuuuucuuggcacacaagacccauauauggucuugugugcugcauaccacgagacacucagcagugugugcaaaggccaugcucagugucauuugaaggaugagcagugggagggcccagcugacccaccucaggcaaugcuaacuccacagcccagccaguauuaaaccuugaaaugguagguuaacacaucaguuugcucccaaccacccuacucccuacguuaaaauucuugugcccccagacucauuugaauuaguacggaaggauuaaaaauagauguggcuaccugaagaaggcucguggcgacucaguuuccuggaaccaggaggcuuuucucaaggugaaacagggagugauagggaaaccagcacugaaucuucucagaccuaaaggaacgaaacaagguagaauccaagcauaccaaaauuaggauuauccuccauauuuuuuuuuuguccccacucuucuacaaagacuuuuuuaaauugugguuaagacuacauuaaagucaaugaauaucaggcaggaccuguauuugaucccugaaacauaguggaaaguugucugaccaccacaagaagcaucauggggcacaucucacaaacucacaaacacacuuucaauccuccuguccuucauaaggguugagucagacuguaucuggccugcugugaggguucuucauuuagacagucuucuauacacaauuucaagauggguaauggguuacuuagugugucugggucuaaaccugaagcccuugguaucaugugcuaguuuuuuuuguaccuguuuucuacuaagauuuuaccaaaugugauaaaagcuauauacauacauuucaauuuacacauaauucuuuuuaaaaauugauuauaauuauuuuauaauuaugacuacagaagucaaagaguagcuuucagaagacugcucuccaaucccacaggguuucagguucuucauuuagacagucuucuauacacaauuucaagauggguaauggguuacuuagugugucugugucagggaucaaauucaggcccucagguuccaguggcaaauacuuccuugaccacuccauaauucuuuuugcuguuguuaauuuuuuuuuuggagagaaggucuccauauguagcccaggcuguccuggaacucccuauguugaccaagcuggccucaaagaccuuucucugggccgggcgugguggcacacgcuuuuaaucccagcacucaggaggcagaggcaggcgaauuucugaguucgaggccagccuggucuacagagugaguucuaggacagcaagggcuauacauagaaacccugucucgaaagaaagaaaggaaggaaggaaggaaggaaggaaggaaggaaggaaggaaggaaggaaggaaggaaggaaggaaggaaggaagaaaaaagaccuuacucugccuccacagaguugggacuaaagguguguaccaccacaccuggccaaacuccacaauucuuuguuucuagauuuuugagacaagagauucucuguguagugauggcuguccuggaacuugcucuguggaccagacuggccucaaauucagagaucuaccuguuaccgugacccaaauucuuaauauacugcauaguuaaauuuuauuuauuuaauuacuuuuuaaaaauuaauuuauuaguuuauuuugaggcaggaucucacuguguagcccuggcaggccuggaacucacagagauccaccugccucuaccuccugugagccauucaguuuaugcacuaaaaaauguaaaccaaguagcugugguucuuuuuaaaaucacaguaacuuuccaauguaaaaguugaagguuuuuuuuuuuaagaagauaucaaguauuagugccuucaaaugucaguaagcuguuaauuuacaauuuaaugccaucuucacgacaugguagauuuucguuuguucacaguacauuaccauaagccuauuaggaaaauuggacgcccacaauccaagaugugacagagcacagggaauugugacagcaggauccaagagcaagaaaacaauucucaaggaaaaaaaaaaaaaaaaccaguauggaaguacaauuuaaaauguucaaaacauuuuaauuacagggcugugauuccaaagugccauuuaagagugccauucuuuuguaaauacaaauucuuuccaauuugauuuugaagucaucugaccuccacucccacccucuccccaucccacacacacuuuaauaagcuuuguuuugauuuaaacuuuuuaauccaccugaagccacaguucuugaauuuggucucuagccuguagcaggaaauggggccacagagcuaauacccaaagcccacagcuccaacacacacacacacacacacacacacacacacacacacaccaccuuguuuuggucuguugggggucaaacccagaacugugugcauacaaggaacuaaaaagaacugugucuuuuguugugagcaaaauccuuagaaugacuugucuuucuaaaugguuaaaguuucuugcccuugcuuugauugguugccuccuauacuuaaggugauauauauauauauauauauuccuguugucaaccgcagcguccauuuugagcuccuauugucccugcucucagccagaugccucccucuguaaggugccuuuauuggcauaagggaugcaaagagcuacagaagcuaaggaaagcugccucagcugcguugcuucuguggugaaugcuugcuuuccuguugcaagguucuucucaugcugguuaagggauaguccuaggcucaguggcagguaggaggacucguguguguguguguguguguguguguguguguguguguguguguguguaugaagcccugguucaauccccacuacugaaaagguuggggaaauaacuauucauuagauaagcauagacguucaaaccuguacaccagacacccaggaggcagaggaaaggggcacagccaggaucugagacuaaccugggcuacauagcaagaucccgucuagucccaauaugccucccugcucaguggucacaaaggacaaagucacccuguguccuugcuaugagaaucauuuucugcauauccuuaacccuuagcuucacugugagugggauuaaaaccuagaaaccuaauguaguucacuggcuuuccccgaauaagcuguaaggcuggucuuucuuuccuuuguaagucuagggccucuuugagguccaguggaggggguugccuagcuuccuuuaggaggauuuacuuugauaauggcaacagcgacacuuggggguggacagggcgggcaacaagcagcugaggcucuggguagccucuaaaggcagagacagaaucucagccgaagagccaccucccccauuguggggcacagaggaggucaagggugggggagggugagcacucauggucacauccugccugcuguguaucuuccucugauuugguuguuucagggagagaggccccagcucugcucugguaggccuccuagggaaguggucuuggguguuucagugagccuuucucuggaccuugcuguagcuuggccugaugauaaaauguccaaccugugacuguguguccuucacaggaggaacuuguuuaugcagauaauccuugauuuaugaugggauuacaccucaauaaacacauuguaaacugaaaauaucuuaauugaaaacaaauugaauacaccucacuuacugaacacgguugcuuagcaacacugugugcgcagaguaccgcuuuuuuuuucccucaugauugcauggcugacuaagagcugcggcuugugcugcccaggaucugaaguguuugugucauauugcuagcuuagaaaaagaccagaauuuaaaauaugagguauaguuucuaccaaaugcauauggcuuccuccccuaaccccccaaacuaaagccaaaauuuuaaagcugaucaccugcaucugguuauauuugucuuuuguccaguuuauuuccagagagagugaggucuaagugugcaggucaggugagaagggaggaggcaggagaacaaagcacaggggccaacagaucacugggauaauuacaaaucccagagaagauggggucuccaaagccagugggaaggggaaaaugcccagaccagaggcacacacaaugggaggggacugggaggaagggcaggguagagguugguaggggaccuacaggcacaggguguuagcccagcaggguuucagggggagaccuacuuaggggcuuaggguaggcaacaccaguuccauugagguucugugacagagguggccagaaugauuuaguggccugaacucucuauaagggaccugggggucaguugguaagucagguagguuuuacccagcugucuccuagggaggcggcaccucagcauccacuuucagucucagcugagccuuuugugcaguugucggaugucccagccucucaaggugacagauaugcagccucauccuggugcccaugcuguaaaugccuuuucucaaaccccagccaacaaucuuuugaugguucaggaggacuugaggagcuuucccagguuaggcacugugcuaggcucaggguguauuaagggaagcauaaauauaaucaugaugggguuggggggggggaauucaucaaacaggcauucaaggugugagcaccaaucucccaguggagaguacaaagcagagacucugguguagccugagaccugggaggucaggaaggguuucuguagaaggaucacgcaaagacaucacuuuagaagaguuagugguuuucuccucaauuucagcaccaccagaagguuacagaaagaaaagcuuagggaagcagauugugucacuaacuuauggaugacacucuguuuauagaaauuauuuauucuuuuacccaacuguauuucaguauuucuguuugcuugucaguguaccccauaagaauauaacgaauguauuucaaaccuucauuaugccuguuuccaggucuggggauuaaauuugugagaauuagggaauuucacuugugaaaugaauuugcugccucuaugauauaauacaaccuuuuuauuguuuauuuugucuaaacuagccgugaacucagauugaagcccaggcuggcuuugaauuugugauccuucugacucagccaacaagaaacuauaguuacaggcccucuuaaccagucuggcuccauaauggcuuucuuuauuuuuuuuuaaaguauuuuuuuuaagauuuauuuauaugaguauacuacagcugucagacacaccagaagaagaccucagaucccauuacagaugguugugagccuccgugugguugcugggauuugaacucaggaccuucagaagagcagucagugcucuuaaccacugagccaucucccuggccuggcuuucauuuuauuagcugaaaagaaacagaauuccucccugauauaguuccuuauugccaccacucaagcacauacaaaugccauacauacaguucuuuauagucacuaaccaagaauuugaggcaauuuuagaucaugaaaagaccuucuauagauuuugggacuagugaaauggcacuucccaugcaggccuggcaacuugagugugaucccugcaaccuguccuaaguugcccaguugucuuaucacuucuauacuuguucagaggcacacaugcacacacacacacuuuaaauguuuaaaagaggaauuuaagaccauagaucuaagcucuuuguucuuugaugggaaggacaccaugcccuggcccagugguuuucauccugugagucaugaccaacuuagccaucagaaaacacauauuuuccauggucuuaagaacugagaccagcuccucuauccaucuccaugguuaggggucacuguguuaaagggucacagcacuaggaaggaugagagccacaacccuagcaguaucuuucauuuacaaauaugccuuucuuccuccucugccuuuguuuugcagagcuaaugacgcaagagugaguuucaagaaacauuuucaauugcuuggcuuuugcuacauaaaggugguguucagccaagaaaggaagugcagagcuauaaaacuaguaccugggagguggagacuagacaaucagggccagcuuuacuuaaagaauggguuccagcccugucuggacaacaaaacaaaacauaacaaaaauagcauuuuuaaaauuuuuucucauaaacuaauacaucccaaaacagggaggaagaaaauagccauguagguaggauguucuuuuguuagaauauauacaagaauauucauuugcuucauacuuugauagaagcuugcaauuuaaaaaaaaguguuuucuaacuauuaucaguaaaauuugcucaaauggauaguaauuuccuacagaauggccaguuuuuuuuccccaucacauuuuuuucucauacaaucaguauauaauauauucaccaaauuuaagagaguuccuggacagcauuucuuucucugagacagauaauucuuuaguucccaagccaggugguuuauagcucaucagcaggauauacaaagaaacucaggucugcuguacugauauucaucacaagaaaugaacacaucuauugaaugguccgacacaaaauaaacacagaacauuaucuaucagaauguccuaguuuuauaaaaaaaaaauaaagagcgggcacgauggaagucugcugaaauagcagggacgccauuaucuugcuccuuacaaugguuucuuucagcagauauucucuuuuaggagaaacccaaagccaaaauaauauccucaaauaagcucucugaucuaagcccuugaucauuaaauuagcuacaaauuaaaaaauuugcuccccuucuguggucauaucuaaguuguaggaauuauuauaagcccuaauaaauagauuaauuaguagggucguuuaucccacgaaauuuuuuaguaaauuagacgagaguaaaauacaaaacuaucguaauuaauuacuuuguggcaccaggccuaauagucauauauauucugacuuugcguaccuggcucaguucugguaaaauggccguaagcgaaugguuaccuugugugccuccagguuacugggcagaaauaaccaguguuuccaauaagucccgugguuagacagugaucagaaaagguuuacuuacagguuuaucgugaaggccgaaagcaaugcacacacugguaagccaaguucaaagaugacgccacaacuugacuguggccuuugucugugacccggaaguacuaaauuuuuccugaccggauggacgacugaagcacuagucaccaaguaguucgguccuuagguucagcgcucugcaugcugugcaaggcaugggauguucaccguagcaugagccgcacugcgcacgcggaauaccggggauuccaggcuggccuggucuagucgucuccuuucucaaaacgagacuggcuugaaaagaugcgaugaagaggagauggguuuggauguuggguuagacccuggauuccauuucucgcauugaaaauagaaguuuguauugaguuugaagggcuuggggacagagacgugccgaucgaugccgcggug

SEQ ID NO: 189 - RNA, 9654 nt, Mus musculus
uccaagauuauagguuuauuacagaggauggaaguuagaaacaggagguuggaggagcucgcucgcugagacguaguugaaggagagccuuuccaccuguuuccuagccuccgaguucuggggucugucugucuguauacaggagcaguaaacucuuggcccucaguaaggaagccacccuccagccccucaaccuccccuacgguuggggaucgguguuuagagauuguggacaggauucguccuuagugcaggaguguuuucuucuaucggaagagcgaagacgagguugugccucaaggcacgagagcggcucgguucggggagagucggugggguuggcggcgggaaacccggguucugggugugagugaccgagguggccgcggccgcaccgggcgccgugggauccguggggugauccgggaggaagcgaguccgcuggagacccgaucgggcuuggagccggugucccgagccgagcgggccacgcgcgggguucaaaccagcugguuuucguuagcccgccgagcccgacgcccgagccgggagucguggacucacccaccgcgugcccagcaaccucguguccgucggacuucuucaaagcagggcccucaggucuccccacacagcaacgcgcauuuucaaagcgauuaauacugggaauggguucguaaaggcagaacccucauucuccagguacuaauggaaggacagaauaagccauuagcuaauacgauaugucuguuuaaugcugguucgccaaauucaucguagggagauaauucagggccuguaauuguugucuaagcgcauuaucagcaaggaaacccggugggagagaauguauaucgucgugaauuucagugcugguguucugauguaagagaaaacgggaaauucugaacacugucgucugucccauuucugagguuaguaugcuagaguagauuaugcuuucccuccaguucuggggcauucagcccagagcauagaucacuuuuccaccacugagcuacauucccaaccgccauggaauucgauuuucugaggaauaauugaauaacuuuucuggucuucucuucaaaacauuauugcuguuguaauguggugcugggaaugggaaacaaggcuuuucccuuguuugggggaaacuuccauuuagcuacacugccccaugggacaauguuuuguuuuguuuugguuugcuuugguuuuuaauuuuaaaggcaagcaaaaagcaaacucuucagaucaacauacccgugacagcugccaguauggcugucuuuuugugguuuugaggaugaacuuagaauugccaucuccucugcuuugcacgagaaaucuuagugacuaaauucagcacgguaaauucaacaagguuucugagaagcgggcuuugggguguacaauggcuugucuaucuugcaugacucuagaggaaaaucugugagaaacaaacaaacaugggagaaaaaaguccuuaaaaagaaguugugugucaaguaauuuguuauuaaauuucugccaagucccuugccagucaaugugacaauaaagaaagacaagguaugucaucuuacaaguguaggaauuuucugguagcuuuuugaacuuuggaugagcacuuguguuugcuuuuggcuuuugagagguuuaccugaccgguagggacugugcugaaaugugccugcuccugcccuuccuguaaaucaccauguuuaaugaccucccaaagaggauuuuaauuuuucucaaaucuagaucuuugcagcacaagauaguuaauauaucgauaugagagaaagagcauauggagcugagaagauggcucaguggauaccaugcugcacgcggaccugggucagaugguggagaggcaggacauggggaaagcauaauugcuacccaguguugagaagcaggcggggacaagaggagucccaagccuuucuggccgcccagucucucucucucucucucucucucucucucacacacacacacacacacacacagaggggggaggagagauagagaggagagagacagacagacacacugggggaaaagcuauuaaauaaaagcaaucauuuucauaucuguuugucuuacuguaccugguuagaccaagucuggaggacaugauuagaaguguguugauugggaccagacccagaugaugguccuuugucugcucuggauuuaguaauugcuccuaggcagcagcugcugugagagagcaucaugagaguaucgaugguuuaagcauguguguguccauaaggcgacgguggguuugguguuuuacucuucuggauauugcugcugcuguguuuucuucuucuucuucuucuucuucuucuucuucuucuucuucuucuucuucuucuucuucuucuucuucuucuucuucuuucuucuucucuuucuuuuuuucuacacuucaacuagggagcggggaaauccuuuagaaaggcuuguaugcuugaaguguucguuuuagagaagcuaguucugauguuucagauccagaccggaggugcucugaaauggaaaauaaauaaauaaauaaagacaggcagauucagcaguuccuugcagaaaaugcaguuugcuggggacuuagaaacaaaagcaagcacuuuucuuuguaaacuuuagacauuuuuaaacaaccuuuaauuacagugggcauauauauaucuuucaaguuuagcuuuuaugaaccuuuuuacaacauacuuuagccuuuaguuuuaucuuuauaugucuaacuuauaaucuuaaguggggggaaggcuuuuauuuagaaguguuuggugugguuagcaguaagacagcuuagcucacagcaggaggaaggaguuaacccacacaaagguucacugagacuaaccugaauguacaguccuuuucaaaaaguaauaucauguccagcgucaguuaaaguuaaacacuuugaaaguuaggugucauaguacaguccuguaauacaaaaaacuaggaagucugaaacaggaggauugguaaucugagaccaauguagaccacacaagacuuuaccugucuuaaaaagcaaaacagggcaacaacaaaaaccacaagacaaaagcguaaaaaggccagcaagaugguuucaccaucuguuugccuccagaagccauuuguggaaagaagguuaccauuuccacaagcuugcuacagugugcagaagugcacuugugagaucugcaggcacacgugugcacacgcacgcgcacucaacaccacacacacacacacacacacacacacacacacacacacacacacagagagaggaacucagagaauaaacaugagugacuaucugaaaaugcauaaauacacaaaaauacauacauacaugaagauaaaaaaauaaguaaguguuaaacacaacgaagcagaaaccccugaacuucuaaacaguccaggcaucguguugcaccaugaugagcugucuucacaacucugaccuauagaacuagggaugugugccagggcuugcauaaaacaagagacgaagaccaagaugccugaagucacauuaagcucgaucccuacagcgaggucccuggugcaguguaugcauugcagcucacaaacuaauuguaccagaguauucuugccagcaacauaguggguguuaagcuggcgcugccagauguggugcuuccaagaguucugaggggagagaacugggacacacaauuacugcuguaagccucugugcagaguuacaucgucaagagaucucagaggugauuuugccuucguuucauucaccagauuguuguauccauucagaaaauuggagaaaccgauuuacuuauugaauuaguaguuuaguaugguagauagagauaaaggaugaaauuugggaauagacaacugcaggugagacacaggaugagccauguggaaggggaccacagcuccuaugccccguccccagaugagguuaggauuuggugugauuagagaucuaggguuagcagucaaucuuuuacccuaguaacuguguuuuuuuuuuugggggggggugguguucuugggcuagguacacugcuguguugauugccagucucaaugaagccuggacucuuggugagaguauaugugauagaccucuccccucaaacacuuugggcucccauagaccuccagcuuuuaguuggaacucuuuggggaaugauauguguuugggggacucuaaacaucccagucaacuugucuuggaacucuccaaauguccuaucccuuaggguucucaucuuggacucuuuugggguaccgugcacuacaguuuuguuguaccagugacaguuuuuauaucuuugucacgacucuuacucagcucaagaagaacucagcuccccgguuucccaaguuugauguacgccgcaauuccgacaaaaaagagagaggauacucacauagcggccaucagcaggaagcgugcucccacuagcggugucuucuugguuagagcugauguccacggcacagcaccagagcagcaggcagaucgaucaucacuuagugggguccaaaccacuccauuaccgagccaaucuaaucaugucccccagacucagcugagcuaugguaaaauaugaaagugacugagaaggagaaagaucgucuucaagauuugauuguaagaaugcagguggcucaagucccacaagaucacacagagcgacccaggguuugagaagagcaggugcuugcaggaacacucuagaaucuucauuguacguccuguggauuaaaagggcaaaacgagguaauaagcagggcugccgucuggccuuauuuucugccaagauuuuaaagcacgguagugcacaccaguaaugucgaaguuaacaggcuugcuucuuucaaggauaguucauagcguggggcacagucacacugugugguagaugcugagaacuaucuuuucuuguaaaucugaaccuccgugaccuggagcucccuucccaucccccaguccuuggaaaccuuucucaucuaugaguggcccuccgcuccuuuagugcuuccccgggcgggcgucuuguccugccagcagcugugucuguccuuuugugagguucuuuguuugcaggaccugccacacagaugucuguaguggcugccuugcuuacugucgguguguuucggucucaucucuccacuauccugcacgacuugcugcuccuauuuuuugcgcagucuaauuuccuuugguuguguuaaggauuuguacacauuuuaauuuguacacacaacacacccuguguguagggcuuggagcguaguuuuuuguuuuguuuuuauuuugcugcagcuuggucuucaguucacgguuuucuugaaaaccuuccauccucuugucuuggaugcucuggcuacagccguuugaaaccuugcuggagccucagucugcccacaguucuuuacauacuucagugaaggcuuauuuaaaucccccccccucucucucugugugugugggggggcacuuuuuuccaccuuuccgugaguucuggggagcaaacuuagguuguuaggcuucuaccaagugcucuuaccuacacuaccaucuuuccagcccuucacagaaaauuaaacagcuauauagucguuauuccuuuuuaaauuuuuauuuuauuuuacaaauuauugugugaaugcuuuuccuguauguguguguguguguguguauaaugugcaccauguccaugccugaggcucacagauauuagaaaauggugucagaucccuggaauuagaguuuggaagucuagcuggccgaagugggcacauacuuuuaaucccagcacuccagaggcagaagcaggcagaccuuagagucugaggcuagcguggucuacagagcaaguuccagggcaaccugggcuacauugagaaacucuguguugucuuagaaaaauaaaaacaaaaacaaacaaacaaaaacacaaaauaccccaaaacaaaacaaaaaggaugguugugaacaaucauuugggugcugggaacuauggguccucuccaaaagcaguuagugcuuuuaacaccaucuguccagucagucguaauauuuuuuauuuuuuuauuuuuuauuuuuuuuuuaaagauuuuuauuuauuauuauauguaaguacacuguagcugucuucagacacaccagaagacggagucagaucuuguuacggaugguugugagccaccaugugguugcugggauuugaacucuggaccuucggaagagcagucgggugcucuuacccacugagccaucucaccagccccguaauauuuuuuaaaaagaauuguuuguuauguauauaaguaggcugucacugucuuuagacacacuagaagagggcaucagaucccuuuacagaugguugugaaccaccaugugguugcugggauuugaacucaggaccucuggaagagcagucagugcucuuaacugcugcaccaucuuucuaguuccccauauuguuuuaugaacagauuccagugucuuucuaggcuaaaaguuggaggcacaauuaagaucuucaaauaucaguaagccuugaguucacaacucaguguuaccaucacauaagccacaugcucagguuuucaguacauagaugcuaacacaaacuuguuaggaaagcuggacacucaggaccaaagcugugagggagccccaggagcacgagcuguuuuccucaggaaauaguucaucaaaucacacaggaaggauacaauguaaaacguucagcacacuucacuugcagaauuaugauuuguacgcuuuuguucuauaaauauguauucuugcacauuugguuuugccugaccaacauuuuguuuuguuuuguuuuguuuuagacuuuuauccaccagaaaccucaaucuuccuuauuuuucuuuagucaggcaggaacaaaggauggauacagaccuggugucccaaccagaggcuuuuuuucuugaaagcccccaacuacaagauaaucucuccuccuccccuuuguagguguagcacuggggaucaauaauagugggcuuugugaauaauaagcuaggcuuaccaccccaucuuagcacgccugucugucguuguuguguuuguuuuuuccagacaagguuucucuguauagcccuggcuauccaggagccacuauuuuuuucccucaaaagucuuuggaauggcuuauuucuaggcagcuacaguauauuuccccucacacuggacauuugccaagcuccugauaguaucaacuauucccugcugugagccacagccuccauuuccaauucugacugucccuguuccuaaccagcugcuuccugcucuaaggucuccucauuagggucagagggacaaagagaaagaaggcgccaaauagacaccacaaucuucauaccuauugucccacggugaugccauucauugcuggcugugagcuuauuccccacagagaauauaggcuagggaugguccugcaguaacuccucacucaauggguucagggacuugcucccuguucccucgcuaugggaauuaauuuccuguauaccucagcccuugacccgacaauuagaucccaccuggucagcucucuguugggaagggggagggggagcccuugccaucaguccuuccucucuauggucggucuguccguuccugucagaacagagaugucauuuuccucccaaugggaagauucaugaugacacuggcaacagaauacuugaggguggacagagauguggcugggacacuaugcuaugcagcaugaaagagcuacagccccucagugacagagcccugagugucccagugcaguuucugggcuuuccuucguuuaugugaguguagaagagcuaacauccagggcaagugcagaccgccacaaugcuuugacucuccuguuugcaacucucuuuuuacacuguuauccugucuuccucuaauuuccuuguggcaggaagcaggacucagcuuugggcugacaagauuuggagcuagucguggagcaaaucuaugagccuuucucuagacaccucuauggccuggcuucauaaugguuaagugucagaccagugaccaggcguucuacacagggggaacuuacuuuugcagaugagccuuuauuuauaaugaggugacaccuugauaaacacauuguaagaugaacacaucuuaaauugaaaacagauugaauacgccuaagcuacugcacauuguugcuuagcaacacugcgcagcagaguaccauuuuuuuuucuccuggugauuacguggcuggcugagagcuguggcuugcugcucugccugguaucugaaguguuuguuauauugcuaauccaggaaaagaugaaaauuuaaaguaugaagcccagucucugcugaaugaacauugcucucucuuccaaccuaaaaccccauuccaaggcuuaucaucaccucugugggugucuuacuaggacacacccgugguuacugucugguuuuuauccaguuuauuucuagagagacagcuaaugucuaggagagcccuacugguaagagagggggugcaggucagguaagaagggaggaggcaggagaacaaagcgcaggggacaacaaaucacugagauaauuacaaaucccagagaagauggggucuccaaagccaguggguaggggaaauugcccagaccagaggcacacacaaugggaggggaccgggaggaagggcaggguguuagcccagcaggguuccauggggagagcuacuugggggcuugggucaggcagcaugaguuccauugagguucugugacagagguggccagaaugauucaguggucugaacucucuauaagggaccugggggucaauugguaagucagguagguuuuacccagcugucuccuagggaggugguaccaggaugaggcugcauaaggcaguggacuguaucugucaccuugagagacugggacaucuggcaauugcacaaaaggcucagcugagacugaaaggugaaaguaaccgucgaucgcagcuuuguagcaggggauauaaaauccacuugcagcucuccucgaacagcucagagaaugcuaagcacacaagacacuguuaccguacucuuacuuucuguuuguucaaaacagcaaaugauuucguuuuaaaggaaaaaaccagcaagcaagcaagcaaacaaacaaaaaaccaucaugaacuugaaaauggagugaaguaagacuucuuucaccuacaaaguguuuucagagcauauaugaaacaguuuuuaaaauauucauuuagaagcuagggaccuacagcucugucagugguggaagacuugccuggcaugugcagaagaccccggguucaguucucagcaccaggggcugggggcagggaggccgucagaauucuacagauggcgagugagcucaggcagagauagggugcacaguaggaauuggccuuggccucuucucuucagccuccccgauaugggugguucacuuuuaaaaacuuauuaucuuuagacaggaucucacuguaucacccuggcugccuccgcaucguccugagcucuggaaccaaaagccugcuccauc

SEQ ID NO: 190 - RNA, 9654 nt, Mus musculus
gauggagcaggcuuuugguuccagagcucaggacgaugcggaggcagccagggugauacagugagauccugucuaaagauaauaaguuuuuaaaagugaaccacccauaucggggaggcugaagagaagaggccaaggccaauuccuacugugcacccuaucucugccugagcucacucgccaucuguagaauucugacggccucccugcccccagccccuggugcugagaacugaacccggggucuucugcacaugccaggcaagucuuccaccacugacagagcuguaggucccuagcuucuaaaugaauauuuuaaaaacuguuucauauaugcucugaaaacacuuuguaggugaaagaagucuuacuucacuccauuuucaaguucaugaugguuuuuuguuuguuugcuugcuugcuugcugguuuuuuccuuuaaaacgaaaucauuugcuguuuugaacaaacagaaaguaagaguacgguaacagugucuugugugcuuagcauucucugagcuguucgaggagagcugcaaguggauuuuauauccccugcuacaaagcugcgaucgacgguuacuuucaccuuucagucucagcugagccuuuugugcaauugccagaugucccagucucucaaggugacagauacaguccacugccuuaugcagccucauccugguaccaccucccuaggagacagcuggguaaaaccuaccugacuuaccaauugacccccaggucccuuauagagaguucagaccacugaaucauucuggccaccucugucacagaaccucaauggaacucaugcugccugacccaagcccccaaguagcucuccccauggaacccugcugggcuaacacccugcccuuccucccgguccccucccauugugugugccucuggucugggcaauuuccccuacccacuggcuuuggagaccccaucuucucugggauuuguaauuaucucagugauuuguuguccccugcgcuuuguucuccugccuccucccuucuuaccugaccugcacccccucucuuaccaguagggcucuccuagacauuagcugucucucuagaaauaaacuggauaaaaaccagacaguaaccacggguguguccuaguaagacacccacagaggugaugauaagccuuggaaugggguuuuagguuggaagagagagcaauguucauucagcagagacugggcuucauacuuuaaauuuucaucuuuuccuggauuagcaauauaacaaacacuucagauaccaggcagagcagcaagccacagcucucagccagccacguaaucaccaggagaaaaaaaaaugguacucugcugcgcaguguugcuaagcaacaaugugcaguagcuuaggcguauucaaucuguuuucaauuuaagauguguucaucuuacaauguguuuaucaaggugucaccucauuauaaauaaaggcucaucugcaaaaguaaguucccccuguguagaacgccuggucacuggucugacacuuaaccauuaugaagccaggccauagaggugucuagagaaaggcucauagauuugcuccacgacuagcuccaaaucuugucagcccaaagcugaguccugcuuccugccacaaggaaauuagaggaagacaggauaacaguguaaaaagagaguugcaaacaggagagucaaagcauuguggcggucugcacuugcccuggauguuagcucuucuacacucacauaaacgaaggaaagcccagaaacugcacugggacacucagggcucugucacugaggggcuguagcucuuucaugcugcauagcauagugucccagccacaucucuguccacccucaaguauucuguugccagugucaucaugaaucuucccauugggaggaaaaugacaucucuguucugacaggaacggacagaccgaccauagagaggaaggacugauggcaagggcucccccucccccuucccaacagagagcugaccaggugggaucuaauugucgggucaagggcugagguauacaggaaauuaauucccauagcgagggaacagggagcaagucccugaacccauugagugaggaguuacugcaggaccaucccuagccuauauucucuguggggaauaagcucacagccagcaaugaauggcaucaccgugggacaauagguaugaagauuguggugucuauuuggcgccuucuuucucuuugucccucugacccuaaugaggagaccuuagagcaggaagcagcugguuaggaacagggacagucagaauuggaaauggaggcuguggcucacagcagggaauaguugauacuaucaggagcuuggcaaauguccagugugaggggaaauauacuguagcugccuagaaauaagccauuccaaagacuuuugagggaaaaaaauaguggcuccuggauagccagggcuauacagagaaaccuugucuggaaaaaacaaacacaacaacgacagacaggcgugcuaagauggggugguaagccuagcuuauuauucacaaagcccacuauuauugauccccagugcuacaccuacaaaggggaggaggagagauuaucuuguaguugggggcuuucaagaaaaaaagccucugguugggacaccaggucuguauccauccuuuguuccugccugacuaaagaaaaauaaggaagauugagguuucugguggauaaaagucuaaaacaaaacaaaacaaaacaaaauguuggucaggcaaaaccaaaugugcaagaauacauauuuauagaacaaaagcguacaaaucauaauucugcaagugaagugugcugaacguuuuacauuguauccuuccugugugauuugaugaacuauuuccugaggaaaacagcucgugcuccuggggcucccucacagcuuugguccugaguguccagcuuuccuaacaaguuuguguuagcaucuauguacugaaaaccugagcauguggcuuaugugaugguaacacugaguugugaacucaaggcuuacugauauuugaagaucuuaauugugccuccaacuuuuagccuagaaagacacuggaaucuguucauaaaacaauauggggaacuagaaagauggugcagcaguuaagagcacugacugcucuuccagagguccugaguucaaaucccagcaaccacauggugguucacaaccaucuguaaagggaucugaugcccucuucuagugugucuaaagacagugacagccuacuuauauacauaacaaacaauucuuuuuaaaaaauauuacggggcuggugagauggcucaguggguaagagcacccgacugcucuuccgaagguccagaguucaaaucccagcaaccacaugguggcucacaaccauccguaacaagaucugacuccgucuucuggugugucugaagacagcuacaguguacuuacauauaauaauaaauaaaaaucuuuaaaaaaaaaauaaaaaauaaaaaaauaaaaaauauuacgacugacuggacagaugguguuaaaagcacuaacugcuuuuggagaggacccauaguucccagcacccaaaugauuguucacaaccauccuuuuuguuuuguuuugggguauuuuguguuuuuguuuguuuguuuuuguuuuuauuuuucuaagacaacacagaguuucucaauguagcccagguugcccuggaacuugcucuguagaccacgcuagccucagacucuaaggucugccugcuucugccucuggagugcugggauuaaaaguaugugcccacuucggccagcuagacuuccaaacucuaauuccagggaucugacaccauuuucuaauaucugugagccucaggcauggacauggugcacauuauacacacacacacacacacauacaggaaaagcauucacacaauaauuuguaaaauaaaauaaaaauuuaaaaaggaauaacgacuauauagcuguuuaauuuucugugaagggcuggaaagaugguaguguagguaagagcacuugguagaagccuaacaaccuaaguuugcuccccagaacucacggaaagguggaaaaaagugcccccccacacacacagagagagagggggggggauuuaaauaagccuucacugaaguauguaaagaacugugggcagacugaggcuccagcaagguuucaaacggcuguagccagagcauccaagacaagaggauggaagguuuucaagaaaaccgugaacugaagaccaagcugcagcaaaauaaaaacaaaacaaaaaacuacgcuccaagcccuacacacaggguguguuguguguacaaauuaaaauguguacaaauccuuaacacaaccaaaggaaauuagacugcgcaaaaaauaggagcagcaagucgugcaggauaguggagagaugagaccgaaacacaccgacaguaagcaaggcagccacuacagacaucuguguggcagguccugcaaacaaagaaccucacaaaaggacagacacagcugcuggcaggacaagacgcccgcccggggaagcacuaaaggagcggagggccacucauagaugagaaagguuuccaaggacugggggaugggaagggagcuccaggucacggagguucagauuuacaagaaaagauaguucucagcaucuaccacacagugugacugugccccacgcuaugaacuauccuugaaagaagcaagccuguuaacuucgacauuacuggugugcacuaccgugcuuuaaaaucuuggcagaaaauaaggccagacggcagcccugcuuauuaccucguuuugcccuuuuaauccacaggacguacaaugaagauucuagaguguuccugcaagcaccugcucuucucaaacccugggucgcucugugugaucuugugggacuugagccaccugcauucuuacaaucaaaucuugaagacgaucuuucuccuucucagucacuuucauauuuuaccauagcucagcugagucugggggacaugauuagauuggcucgguaauggagugguuuggaccccacuaagugaugaucgaucugccugcugcucuggugcugugccguggacaucagcucuaaccaagaagacaccgcuagugggagcacgcuuccugcugauggccgcuaugugaguauccucucucuuuuuugucggaauugcggcguacaucaaacuugggaaaccggggagcugaguucuucuugagcugaguaagagucgugacaaagauauaaaaacugucacugguacaacaaaacuguagugcacgguaccccaaaagaguccaagaugagaacccuaagggauaggacauuuggagaguuccaagacaaguugacugggauguuuagagucccccaaacacauaucauuccccaaagaguuccaacuaaaagcuggaggucuaugggagcccaaaguguuugaggggagaggucuaucacauauacucucaccaagaguccaggcuucauugagacuggcaaucaacacagcaguguaccuagcccaagaacaccacccccccccaaaaaaaaaaacacaguuacuaggguaaaagauugacugcuaacccuagaucucuaaucacaccaaauccuaaccucaucuggggacggggcauaggagcugugguccccuuccacauggcucauccugugucucaccugcaguugucuauucccaaauuucauccuuuaucucuaucuaccauacuaaacuacuaauucaauaaguaaaucgguuucuccaauuuucugaauggauacaacaaucuggugaaugaaacgaaggcaaaaucaccucugagaucucuugacgauguaacucugcacagaggcuuacagcaguaauugugugucccaguucucuccccucagaacucuuggaagcaccacaucuggcagcgccagcuuaacacccacuauguugcuggcaagaauacucugguacaauuaguuugugagcugcaaugcauacacugcaccagggaccucgcuguagggaucgagcuuaaugugacuucaggcaucuuggucuucgucucuuguuuuaugcaagcccuggcacacaucccuaguucuauaggucagaguugugaagacagcucaucauggugcaacacgaugccuggacuguuuagaaguucagggguuucugcuucguuguguuuaacacuuacuuauuuuuuuaucuucauguauguauguauuuuuguguauuuaugcauuuucagauagucacucauguuuauucucugaguuccucucucugugugugugugugugugugugugugugugugugugugugugugugguguugagugcgcgugcgugugcacacgugugccugcagaucucacaagugcacuucugcacacuguagcaagcuuguggaaaugguaaccuucuuuccacaaauggcuucuggaggcaaacagauggugaaaccaucuugcuggccuuuuuacgcuuuugucuugugguuuuuguuguugcccuguuuugcuuuuuaagacagguaaagucuuguguggucuacauuggucucagauuaccaauccuccuguuucagacuuccuaguuuuuuguauuacaggacuguacuaugacaccuaacuuucaaaguguuuaacuuuaacugacgcuggacaugauauuacuuuuugaaaaggacuguacauucagguuagucucagugaaccuuuguguggguuaacuccuuccuccugcugugagcuaagcugucuuacugcuaaccacaccaaacacuucuaaauaaaagccuuccccccacuuaagauuauaaguuagacauauaaagauaaaacuaaaggcuaaaguauguuguaaaaagguucauaaaagcuaaacuugaaagauauauauaugcccacuguaauuaaagguuguuuaaaaaugucuaaaguuuacaaagaaaagugcuugcuuuuguuucuaaguccccagcaaacugcauuuucugcaaggaacugcugaaucugccugucuuuauuuauuuauuuauuuuccauuucagagcaccuccggucuggaucugaaacaucagaacuagcuucucuaaaacgaacacuucaagcauacaagccuuucuaaaggauuuccccgcucccuaguugaaguguagaaaaaaagaaagagaagaagaaagaagaagaagaagaagaagaagaagaagaagaagaagaagaagaagaagaagaagaagaagaagaagaagaagaagaaaacacagcagcagcaauauccagaagaguaaaacaccaaacccaccgucgccuuauggacacacacaugcuuaaaccaucgauacucucaugaugcucucucacagcagcugcugccuaggagcaauuacuaaauccagagcagacaaaggaccaucaucugggucuggucccaaucaacacacuucuaaucauguccuccagacuuggucuaaccagguacaguaagacaaacagauaugaaaaugauugcuuuuauuuaauagcuuuucccccagugugucugucugucucucuccucucuaucucuccuccccccucugugugugugugugugugugugugagagagagagagagagagagagagagagacugggcggccagaaaggcuugggacuccucuuguccccgccugcuucucaacacuggguagcaauuaugcuuuccccauguccugccucuccaccaucugacccagguccgcgugcagcaugguauccacugagccaucuucucagcuccauaugcucuuucucucauaucgauauauuaacuaucuugugcugcaaagaucuagauuugagaaaaauuaaaauccucuuugggaggucauuaaacauggugauuuacaggaagggcaggagcaggcacauuucagcacagucccuaccggucagguaaaccucucaaaagccaaaagcaaacacaagugcucauccaaaguucaaaaagcuaccagaaaauuccuacacuuguaagaugacauaccuugucuuucuuuauugucacauugacuggcaagggacuuggcagaaauuuaauaacaaauuacuugacacacaacuucuuuuuaaggacuuuuuucucccauguuuguuuguuucucacagauuuuccucuagagucaugcaagauagacaagccauuguacaccccaaagcccgcuucucagaaaccuuguugaauuuaccgugcugaauuuagucacuaagauuucucgugcaaagcagaggagauggcaauucuaaguucauccucaaaaccacaaaaagacagccauacuggcagcugucacggguauguugaucugaagaguuugcuuuuugcuugccuuuaaaauuaaaaaccaaagcaaaccaaaacaaaacaaaacauugucccauggggcaguguagcuaaauggaaguuucccccaaacaagggaaaagccuuguuucccauucccagcaccacauuacaacagcaauaauguuuugaagagaagaccagaaaaguuauucaauuauuccucagaaaaucgaauuccauggcgguugggaauguagcucagugguggaaaagugaucuaugcucugggcugaaugccccagaacuggagggaaagcauaaucuacucuagcauacuaaccucagaaaugggacagacgacaguguucagaauuucccguuuucucuuacaucagaacaccagcacugaaauucacgacgauauacauucucucccaccggguuuccuugcugauaaugcgcuuagacaacaauuacaggcccugaauuaucucccuacgaugaauuuggcgaaccagcauuaaacagacauaucguauuagcuaauggcuuauucuguccuuccauuaguaccuggagaaugaggguucugccuuuacgaacccauucccaguauuaaucgcuuugaaaaugcgcguugcuguguggggagaccugagggcccugcuuugaagaaguccgacggacacgagguugcugggcacgcggugggugaguccacgacucccggcucgggcgucgggcucggcgggcuaacgaaaaccagcugguuugaaccccgcgcguggcccgcucggcucgggacaccggcuccaagcccgaucgggucuccagcggacucgcuuccucccggaucaccccacggaucccacggcgcccggugcggccgcggccaccucggucacucacacccagaacccggguuucccgccgccaaccccaccgacucuccccgaaccgagccgcucucgugccuugaggcacaaccucgucuucgcucuuccgauagaagaaaacacuccugcacuaaggacgaauccuguccacaaucucuaaacaccgauccccaaccguaggggagguugaggggcuggaggguggcuuccuuacugagggccaagaguuuacugcuccuguauacagacagacagaccccagaacucggaggcuaggaaacagguggaaaggcucuccuucaacuacgucucagcgagcgagcuccuccaaccuccuguuucuaacuuccauccucuguaauaaaccuauaaucuugga
